United States Patent 9,487,797 (GENOMIC PLANT SEQUENCES AND USES THEREOF) - sequence listing, part 60

SEQ ID NO: 70392 - DNA, 136901 bp, Oryza sativa
  unsure (1)..(136901): unsure at all n locations
aagccatggattatcggcatcattcatttagaaatgaaagataaaatgtcaaagatcaagaagatgagatcttcccgataatcaattgacattgaggttggtaaccctccaagtgaagaaacaatatggtgtgaaggtactcctattggtttaactttgctttttaaatttgagtttaggatgccgtactattaagagggataccacatgcatataattggttgaacactagtgctcaaaatgcttcatctttgtgtgagttgaaaaactaagccaaaatttcaattccgagttgtttcacttatcacaacacttacaccgggtttctttgcaagtttttcataatctcttaaaggttttggaccatgttttatgttgggtttgatagcccatgaaactagctttccatagagtccaagatcttcgaaatcggagttcggagtaaaaagttattgcatttttacttgagcaacatcagactatccgatttttcacagaacttcactctctgtctttgtttgaaaaatcctttcgagtgagtttttctaagtgtcggagtatccgatgttggatcagatagtccgatgatacagagactccgaaatttcatagaacttgagtctctgtttgaggacgaagtttttgcttctaaaatatcacatactccgatttaacatcagatagtccgatgtctcggaaagtccgaaatttcatggaacttcattctctatttctcgttgccttggaggtttaaaatatcggactatccgatctcgtatcggactatccgacgtgggctgaaagattccccttcaacggtcacattttggggatctatataaaccccccaccaacccttttctagggctgcccaaactgattacattcctatcttgctttgggttgagctttgtgctaagtgctttggatttttgagctctctccctctctatctcaaatcccccttgttctttatgacttggatctttgtgtgtgaatttggagtttgggagcctagtgtgtgtttctcttaatcttgagcactaggatttgtccaagagttgtgtggtgtttattactcttggaggttgaggactcctagacggctaggtgtcgttcttgggccaccgatctacgtgtggttggccaagagaagtttgtgaaggccggatcttgcctccgcaaggaaagagatacccttagtggaaggaggagtgcatttgtgcaacctcacgaggatagggttgaaaaagacccggctctttgcgagcccctcaacggagactagaatcccctcaaggatttgaactccgggaaatacatcggagcataaacctcggtgatatcctcactttctttaccttcttgttccattgctttgtgctatgctaatattgttgttggtcgagctctcctctttgcttgtggattgaatctagatctcttaggttgttctcttgtttgtattgttgttgtgcaggtcagatagtctgatctcagtttagactatctgatcacataggactatccgacctgatatcagacaatccgaccctgttttgttttagcttccgcatttatttttaaaaccgcctacttgcaatcttgtttttgctaaaagtgagattttacctcaaatctaaatctattgagtttttgaaaaagttgcctatttaaaacttttagggttggtcatttcaaacatatctttagttcaaagcttttgtaaaagaccaaccattctaatgttgcagccttacaaagttcatcaaaaatcttgatttgaccatatttggccaaaacttgcatatggtgggttgaacaatttgagccaaaattctttgtgaataatggcatgaattagtatctctaacccatctaaggctttccaaatgtcaaacttcataaaaatcttatttggatgtgatttgacactttggttgagatttattgacttgaatggcctacaaaactctctttgacatttctcttgaaagaaaaatcttttttgagaaattctttttggaaaattttctattaagtgaaaagatcatttctgcaaggtttcgatttaaattggaaagaatttgactttttctcaccttgctcaagttgctgaaattttcagaaaattcatggtttttgactgatttgtgatttttacatctcaaaataggttgcaaactggaatgagtttatataatgacttttgttcctctatggttggacttcacatctaaatttacttggatttttctatagtcatttgaatatttttatgatgccctttccaagctctttttgagttccaaattctgaaaatcctgaaactttcagttttctaaatttttgtgtttttttgtggcttctaattgtttgagaattgggtaaaactcccaaaatgaaaaatatgcaatgttctatgacctatctacaagatttattgcagattttatagtggaaccaaaggcttcggtaagaccgctcggtttgcaatcaagctcatctatcaccatgcattcgagcccggaggctctgggtacataccccggagactccgggaagatgtgcctttctccaaaatataggctacactccccatttgtttttcattaaacacatgcatttctacaagtaattcaaatactttgaagcacacatttagggggagtatatcctatgttttgtgtttttgagactaacttgttatcaagtgtatttttgtgattagtctcataggagatcaaaaacatcttcgaagatagtttggaaggtgagaccacaataagtccatgatgaccaaggtggactacttgatcaacctcaatcaactcaagtcaacctaccgcaattgtctatgaagaacatgaagacatgtttccggcacaaatggatgggattgataccaagggcaactcaagagcaaagttacaccatacaagctcaagtcccatcggtgtaccatccaagaattcaccacatcattcaacgagatcatctccacaatatcctcgatgatatacaaaaagggagtagctattcattctcaatctgcaaatttgtgaatgttactctctcttgttgtatttggactattagaaggaagatggtgcaaatgctaaaccggatcgggtcatggccttacaagaagagcacaagcactatcaggacgtagactgtgatcaaggagttaaacatgttcatgatggaaaagcttaagttctttctcgggattggaatcaagcaaatcaaggaagagatttcatcaagcccatcaaggtgccaaattcaaattgggttcaagatatcaattttattgaatgggcatctcaaaaatcgacaaggaaggtaacttgatgatccatagcttgttatttaaattggtatgattggatcacttgccttgtctgggcatctaggccaagtttcatttcttgctaattagcctaatttgcaaaatgttgtgacgacatgcttgtttagtcattaagcgagtattaatcacaaagttgttctaagtgaatcaatgtttatgtgaatttttggtcttagcacaaactatgagattcatacatgcgaaactcatttgtgaaatgttttgtgaaaatcttaggtgagattctttttcatctatgctttaaaccctttgcatgtgagctttctatgcgcaaaatttgtatctcaatgcttattgattttcttgtgatctttatgtgaaattgcttcatttcctaatcacaagtgatgaaatataaaattgagaggtaagtactcgatgatccctcatcaaggatccctttgcttttctttccctacttatgccctttttggtgttagatgtcaaagggggagaagtatactaaaggggataaagaaaatattgatcaaagggtgagatatttgtgagaaattatcaaaatgaatgctttaaagatgccaaagagtaaatgagaaagggggagagaatatttgaaagtgtttatcaattggtgtgaatgcttattatttgatcaccatgccacatgcaattaagattatcttttgatacttgaaattgtctacaaaacttgattactcatgctttctcaatcggtaccggaatcaattggcatagaatcaagtttttgcaattggcatcaataatttcatttgatacattttgaattggtgccaagaatttgagttgtgtgtgttgttttaattttggtatctccttcacacacaatacaccccacggatgcaaagagttagggggagctctcacattttcaaaaatatgtgcatgtgtgttcacttcataaacttgtatgcacacatttaggggagctcaaactaacctttggattcaaaatcatttattatcaatcttttgtaagctttaatcgtgttgtcattaatcaccaaaaagggggagattgaaagagcatctatgcccttagtgggttttggttaattgatgacaagcgattaagggactaatgcgcttattgagtgtataagcaaatgattagtccgatgaagaagctaggaaatggacttatagatggatgagaattaaagagaaaatattgaagatgcgggtatgaagtgactacctatggcaagacggtgaagcgcaagtgacgctcagctgcgatggaccatgcggtggtgaagggcaagcaaggggcttggggccgacgaaccgaaaccggtggtgaagggtgagtgaagactgtgtcgtgatgaaccgtgcgaggccatttgaagccatggattatccgcatcaatcatttgagaaatgaaagatgaaatgtcaaagatcaagaagatgagatcttcccgataatcaattgaccttgacgttggtaaccctccaagtgaagaaacaatatggtgtgaaggtactcctattggtttaactttgctttttaaatttgagtttaggatgccgtactattaagagggataccacatgcatataattggttgaacactagtgctcaaaatgcttcatctttgtgtgagttgaaaaactaagccaaaatttcaattccgagttgtttcacttatcacaacacttacaccgggtttctttgcaagtttttcataatctcttaaaggttttggaccatgttttatgttgggtttgatagcccatgaaactagctttccatagagtccaagatcttcgaaatcggagttcggagtaaaaagttattgcatttttacttgagcaacatcagactatccgatttttcacagaacttcactctctgtctttgtttgaaaaatcctttcgagtgagtttttctaagtgtcggagtatccgatgttggatcagatagtccgatgatacagagactccgaaatttcatagaacttgagtctctgtttgaggacgaagtttttgcttctaaaatatcacatactccgatttaacatcagatagtccgatgtctcggaaagtccgaaatttcatggaacttcattctctatttctcgttgccttggaggtttaaaatatcggactatccgatctcgtatcggactatccgacgtgggctgaaagattcccctccaacggtcacattttggggatctatataaaccccccaccaacccttttctagggctgcccaaactgattacattcctatcttgctttgggttgagctttgtgctaagtgctttggatttttgagctctctccctctctatctcaaatcccccttgttctttatgacttggatctttgtgtgtgaatttggagtttgggagcctagtgtgtgtttctcttaatcttgagcactaggatttgtccaagagttgtgtggtgtttattactcttggaggttgaggactcctagacggctaggtgtcgttcttgggccaccgatctacgtgtggttggccaagagaagtttgtgaaggccggatcttgcctccgcaaggaaagagatacccttagtggaaggaggagtgcatttgtgcaacctcacgaggatagggttgaaaaagatccggctctttgcgagcccctcaacggagactagaatcccctcaaggatttgaactccgggaaatacatcggcggataaacctcggtgatatcctcactctctttaccttcttgttccattgctttgtgctatgctaatattgttgttggtcgagctctcctctttgcttgtggattgaatctagatctcttaggttgttctcttgtttgtattgttgttgtgcaggtcagatagtctgatctcagttcagactatctgatcacataggactatccgacctgatatcagacaatccgaccctattttgttttagcttccgcatttatttttaaaaccgactattcacccccccctctaggcgacatcaaggtcctttcaggcgtgcacgttgatccgtcagcttcgcctcgtcctttcctgtctgtcccgtcccatgcttttccgactcgatctcgtcgtctcctctttctcaattcgaactgatctctagcgtctcactgcctccacgtaacaacgcccaaatcagggttgtttcattaatcgcacggtctcttttcatgtttggccaaggaggacgaggccggggaactgttttaaacactcgggtggacgtccacccgagatattagaatctatcctcggatgaggccaggtagctgcaccggccttggtaggagtccatgacctccggtgagcatgctgctccatccttgtacgcaatggctgtgagcttgtttacttgaaggcaaggttgtcaggatcgggatactaggtagtatcgttttgctcaaagtaatatcgtatcgtaggatcgtatcgtagtatcgggatactatgagattttattttttttaagtttaattaatatttatattaattatatatagccattctatatagaaaaatatagtgatgatatatatcatgcaaatagagacatttatcaagagaaaccacgttggttttgatatatttaactgatttttatataaatttgagcatatttagttacattattttcaaaccatgttattttaaataatattttgtagtatcgtagggattgtagaatcgggataccacctaaaattttgttggatcgtgtagtaatgaatagtaggatcgagatactacgaaaatttggatactaggtgggatcggtatcgtttcggcttgataggatcgtagtatcgtaagatactaggatacgaatcgggacaaccttgcttgaaggaactgattgcgattttgttgtacggtgggttaattgttgagcaaattttagtcttttttggttgcaaaactgtttttatggtacagttcatgtgaaatatcaacttttcccctgaagttcattactggatgccatcttgtttcagaaaaaaaaaaatctttctctccgattttttgataaatcggatcggatcaatagcaaccttctgcaatggggaggtgactggctgttgctcatcccacggccacggagtcacgatgcagaggtccgattgtgctgcgaccttctgtgagccgttggattcactagcacgggataggtctcaatcagtgtcaggaagggctaccatcgctaagcaaaagtcactgatgtgagaagttatcttaatcgggtatttgaccgtcacgaatgataattatctcaatcggactaagcataaggcccatcatagataggtttggcccagcatatgagtcaaacgagattagttatggcacccgccacggatgacgggcattttacccgttgcaacgcacgggcatttttttagtccctataaaatttgggagtataaacttttaggtatacaaacttattagaaatagaaatcatgtggtgccaaatattaaaagcgtgtgtgttcgtgtggggcctagtcaagcaaatgtttgtgctatagcccttttgtgctatagcccttttcgcattgcggttacccttgcctctatactatagtttggcccattttaacgatcttacaattttgtttttccgattttcacataaatgatggcatgtttggttaatgggttcttcgaataaataaccacccactatagcaagttttaatatgaactatccatatttctcagctaatttcgtcctaacccttcattcatctctatttctcaatcccacccttcacaacccatcaaaacacccctaaattgttaaagccttgtttagcatatgtggggaactttctcatttcacgttgagttaaaatgttttcttgtgaaactcccattttccaaaacaatacttatattggaaccttcccgtaaagattttaaaattcacatgttaaaacttcaaaccgccgttgatgtagaaggagcaagtattaagatctcataagatacgcacatggagagcaataacatcattttaggtgaaggacggatgcaagtccttagtcgatatgagatcgcaatatccccaaagaccaccttcatttggagtttgtgtagaaggtgcctttgataaggagtggttcatcttcatctctccattctattctctactttatcatttaatcatgtgatgccttaggaccagtgcttaaaaccttattaaacttactttaacatacatttcgacttgtactcatatccatatcatatacaaatgttaatgaatatgttctgatttgtatttgatcccatatattatgactctcgactaggggtgaaaatggggcgggtatttcccgattgcccgcccgacccaaggctcgtaggagtaatatgggagaaaaaaatgggatacccgatactatccgagttcgaatccgaattcgttagaaatatgggttaggatacgggaagacatgtatccgcccgcatgtcccatattataaaatatgtatgaaaaatctattataaatccacctacaaacatgataaaagattggttaatcactattttacgagctcacatgtaatattgtataatttttttcttgatatatctcttttaatactttaattatcttattatatttaatatatatgaattagagatacaatatatatccatttccgaatctgattcgaatgaaataatatgggataggacacaggatgagcgatatcttattcggcactagccatacctgcctccgaatttaaagaaaaatataggttaggatataggaatgccaatccgaccgtatccgcccgttttcacccgactacctatcagtgactcgcacccgatcaaaaaaagcatatgaaataaaaaaaacaccagtaacaaaaagaaaaagtgttgacgacacgagacaacatgcgtataactgaagtagctaaaactatacaattcaactaggaattgaacacatgagacaatttataatttgacgaggctatgcaatataattttctcttgtgcaatttgcactgttaatcgcaccaatactttccaagcaaggaaaaaacaaagagaaaaggaaccaacaccaacttgaccactttgaaacgagactcgcatggccatgagcacagaagcatgttttcgtggcatgtcagatagctttgaagataaattgtatagatgtagtgacgtttatctaaagtatggaaccacataaccccatactcaaactggagggattaaaacagcgacatgtgtatgtaattgattatgataaatcagccaaaattttagcaaaaattagagaaacatgcgtttgccgggagtcgaacccgggtctattgcttggaaggcaattatcctaaccgttggactacaaacgcaattttgattatttatattctccaaaaatctaaagtttggaaacgtacaaaatgttgatatgaatatcatagatatactggtcaagaagttttccttttcacatgacatgtaatacaattgaaattttccagtgggacatgaatgtattttgtaggacttctgtgtgtttgtagatcttctagtgtcaaatatttgcattccgatggtgcccttaaagtttttcattctgccaagagtgtaaagtacatatagggtgtgtttggcaaatagaatataggagatgggattgggaaagggaaatggatgagtggctaggattaaatgatgtgtgaagaatgaatggctaggatgcaatattgccctttggagtgtgggtcccaatcccatttgctaaacaaaaccatataaatgtaacagcaaagaaagagaccaagccatcttgcgaaactcctaaattggtgcctttttccatcccatttcaccttcgaaaccatttaattttgcaattatattttcatgtatacattatagagaatgtgaagtaaaaaggaattgaagccttcagaggaatcaaaccgtggctatttagttaggagaactcttgtctcccttttttatttccctacatagagctgctgctgttgttgttatgagtaaaatctatcaccggtccctaaacttgtagcgttgggtcatcccggtccctaaactcgcaaatcgaccgttcaggtcctcaaacttgtttgactgtgtcatcccaatccctaaacttgcagatcactcgtttaggtcctccaacttgttcagttgtgtcaccccggtccctaaacaggatggtctaaaaactttatatcaaaaaataattcataacttttttatgtgaactctaatgaagacaaacttgatatcaaaattgtagccctcgatgcgacctacaactttgtagttgaaaagtttttgaattaaaactgtttagggtcccaaaatattgttgcatgtttatagattttgaaattttaattttaaaattacattttgggacaaaaaattacttaaaataaaaaaaaattcaacaacaaagttgtagatcgcgtcgagggctacaagtttgatataaagtttgtctttattagagttcacatgaaaaagttatgaattatttttaaatataaagtatttagatcgtcctatttgacccagatgatattcaaattcaagtttagggaccggggtgacacaactgaacaagttggaggacctaaacgagtaatctgcaagtttagggatcgagatgatacaatcgaacaagtttgagaatctaaacgatcgatttgcgagtttaggtaccgagatgacacagcagtataagtttagggacaggtgacggactttactctattattattattattattattattattattattattattattattatttcttacaagttacaatcgaaccgtaattgtaaagaaaaatatcattttaaaaatcttaaaaattcaatagaaaaaaataaataaaaaaacctagatatatattattgccttaatgtctatttagcaacagtttaactcttgattcttgttccttagagttagaattgaagatagagctaaactaaactttactatctttttcaatcttatatgagtgaaatagatggatttgctaaaaaaatattaaaaaatcgagctaactttttataagggcatccacattgttgctttttagccggtaataagcaatacatgctctcttcctacccggtaggaagcattgtgagagtggcaaagagttaaaacctggtcatacagctactaccgatgaacaagagataaacaatattatttgtacagtgtttctgacagaactcgtgggaaggagtcatgcagcagtcacgggaattttactatcggtgatttttttttagctgggcccatcttattcctctccaacgcgcataaacaatgtgaagggtgcgatggtttaataccgtctgacctcttagcccacagtattgccgaagtcggcagctaacattgtgcttgccttaaccccaactatatacgagtttataccggactccacgtaaagagccaggtagaaatgtagaatatgactacaacacgtatactgagtaaaaggaaatacgccttctgaaccggttaacggaaaagaagcccgttcgcggttcgccccttccaaaccgacttccaatcgcgcaattcccaaatataaatctggcgaccccaacagagccgagctagggtttcgcctcccccgccccgcctcctcctcctccgcaccgcgcgaaccgacccgacccccacttcgccgccgccgccgcagccgcagccgcgatggggacggagcggaagcgcaaggtgagcctcttcgacgtggtcgacgagacctccgtctccgccaagctcggccgcgccgccaccaccaacggctcggccgccgccgccgcggccaacccgtccatcaatcggtggacggggaggccctactcggcgaggtacctcgagatcctcgagaagcgccgcacgctacccgtgtggcagcagaaggacgatttcctcgccgtcctccgcgacaaccagaccctcatcctcgtcggagaaaccggaagcggcaagaccactcaggtattgaatctgtccctgtgcctgtacatctcaacattgaactgtaaaagtattttaggtttgtcgttattggttgtttattaggggatcgttattggttaggttttgtttgtgtattgagatgtgatgatattgtgttatatgattaggggatatttttcccctagatactagtggcatggagctatggtaaattggttagattttgtttatgtattgatgtgtgacgctgtgtcaaggtttttggttgctatatgggtgccttattgatgatttgttcttggggattaattcgttttctgttgatcagattccccaattcgtgctcgaggctgaaggcttgagcaaccgctcaatggttgcttgcacccagccgcggagggtggcagctatgtcagtttcccggcgtgttgcggaggagatggatgttactatcggggaggaagttggttacagcatccgttttgaggattgcagcagtcacaaaacagttctcaagtaagccttagtttgtttatgtttaatggaagaacatgattagttgcacatcctttggcagattgatatggtgcggatgtttctttcttttttaggtattctgatctaatcatgttgtgttgaacactattgcttcctatcagatatttgacagatggtatgcttctgagagaagctatggcagacccacttttagagaggtacaaggtgattgttcttgatgaggcccatgagcggacattagcaacagatgttctgtttgggcttctgaaggaggttctaaagaacagacctgatttgaagcttgttgttatgagtgctacccttgaggctgagaaatttcagacctatttcagtggtgcaccgttgatgaaggtgcctgggagacttcatccggttgagatcttctatacacaagaaccagaaagggactacctggaagctgctatcaggacagttgttcagatacatatgtgtgaacctgctggagatatccttgttttccttactggagaggaggagattgaggatgcctgtcggaagataaataaggaaattaataacatgggggatcaggttggcccagttaaagttgtgcctttgtattctacgctgcctccagcaatgcagcagaagatttttgaacctgctccagccccatcaagagagggaggcccagctggaaggaaaattgttgtgtccacaaatattgctgagacatccctaaccatagatggtatagtgtatgtgatagacccagggttttccaaacagaaggtttacaatccaaggataagggtggagtcccttctggtgtcgccaatttcaaaggcaagtgcacatcagagagctggtcgtgctggaagaacgcaacctgggaagtgtttcaggttatatacagagaagagttttaacgatgatttacagccacagacatacccagaaattcttaggtcaaatctggcgaatacggttcttaccttgaagaagcttggaattgatgatttagtgcattttgactttatggatcctcctgcaccagaaactttgatgagggccttggaagttttgaactacttaggggcacttgatgatgatggaaacctcacgcctttaggtgaaacaatgagtgaatttcctctagatccccagatgtcaaagatgcttgtcatcagtccaaaatacaactgttcaaatgagatcctttcaatatctgccatgctgtcaggtatgtcaaacaaaacttcatgtcgccatatggtttgtcagctaaattatatagtgcgtaataataacacccgcacaattttgcttgcatcaattgcacattgtagaaagcttacaagcttcttatcatgagagtttgcatccactttagtgcatttgctcttccaatatgctttattaattctttcagagctgtaatcagcaactgtcgtgcacctagcttcttgagctattgatcaaaatgatcatacagtttaggctgatgcagatagttgctgtttgttgagttattctgacaaagcaaatggtatcgtctcgcctctttgcatctgctgaccaccatggacttcgtctgttattgccgtattctttctctagtacccaattgctttctccggcctagggaggcacagaaggctgctgatgaagcgaaggctcgatttggccacattgacggggaccacctgacacttctgaatgtataccatgcatacaagcagaacagtaagttcatgaccattttcgttcaatctacactgatatccatttcattgcctaacagttgtcttttcgacaatgcagatgaagatccccagtggtgttatgagaacttcatcaatgccagagctctaaagtcagctgataatgtcagacaacagcttgttcgcatcatgaccagatttaacctcaagatgtgcagcacagacttcaatagtcgggagtactacgtcaatatcaggaaagccatgcttgcagggtacttcatgcaggttgctcacctggagcgaacaggacattacctgaccgtcaaagataaccaggttggtattaattttctgatgcccagtctctttgtgtacaggatgatgaaattgcagatttcttactctttgttgtgctcaggttgtccatcttcacccctcgaactgtctagaccataagccggagtgggtcatctacaatgagtatgttttgaccaccagaaatttcatccgcacggtcatggatatccgtggtgattggttagtcattatctggcagacagctagtccttttatgagtattgaagatttgaaagaatttctgacatgtttgtccttcatgtgcaggctgattgatgtggctccacactattatgatcttagtaatttcccctcgtgcgaggcaaagcgcgtccttgagaggctgtacaacaagcgggagagggaaagagctgctaataggaactgaagttgatggcgttttccccttgcgctagccttccactcgagaagattcgggtatatcagcttgtcgtgccggcgccaacaatggatgcttcctcatcctatcgtatgatttggcttgatggatgctcgtcactacgtatgacatgccaaatgctgctctctagccgtacaatctaccagcaatggcctaggatcatatttttgtttcttttagaagttgtagcctgtgacgcaggatattatgtaccggtctcccatattttgatggttctggcacccttttatttcggcatatttgtttcgtgtttggttagtcttaaaagtgaaatgtgcatcattgctaccttagcccgactttctttcgatagtgtcaaatcaaaggaaattttactttaggtcgcattttattaccgatgtttcattttgaatcacctttaaactaatatttttacttgattgggttttcactttggaccaggtaattttatctttgttacactttgcagccaactacaacccggaacacagatttcaaaacgctgagtgtatgatagatacatatttcaaaacgctgagtgtatgatagatgagatcatgtattaatgatgtaggagatatattagttatagatgatttggagttgatagttgactgtaccattcaatttgctctaaagagaatcaagatatgctgcttgttgctttattaccacattagagaagcggaacagcgcaagatgaaaatgtgttttcagaagtaaaatcatgttaataaaaaaacaaaaatgttaatagtagaaatcgtagaaataatagcttgtcagcatgcgaatattcatgagctttattaccacattagagaagcggaaccgcgcaagatgaaaatgttttttcagaagtaaaatcatgttaataaaaaaaatgttaatagtagaaatcgtagaaataatagcttgtcagcatgcgaatattcatgaggaaggaggaaggattgaatagttttcaggctcccctctgtcttaaatttcccaatagaagtatagtttggacgtttggtacgagacgaaatatttggttatcatgtgtacatgattcaatacaaaataacaactcaaaacgcaggcgaacaaaatatttacccagcttgcaccaagctaacaacgttatttcgagaagggtcaaaagaataatattcttacatgtttccactatcctatttcaaatctcaatctcaacgggccaagaggccaagagagagaagtttctatagccaacgagctcgcttacatatgcatttcaattttcaacggctatacaggcatatatctacttcattatattcccatttggggtttaatgctacatgttacactctccctgatcattttttgttctgcatcccgactccttttcaccatgtaacactcataaaaaacgaagctcagggtgaaacaatggaagtctccaagccgtgaaggtaatcaaatcagctttgcagatgccacataaggccaactataggacttgctagtatcctgcaacgccaactataagaaatgataaagaatatagcgccactgaaattgcaattcccgccacaaaattgtacgagaggcgcttgttgtcacgactaggcacaaatgcgatcttcaaggtgttagtcaactcaaatagcctatgggagacctgtaggaataagttataacataagcaggttgcctgtaaggtctaaactcttcaaagtcacagggaagatctacttactgcaacatatatagcagttgtgagcatgaaattcagcattgggtaatttgggattattgtcaatagccatttaggttgcccattgggcacttttgatctgcaggagtaaagacaattttcagtcattgacaagaacaagaggaacttctagtggcacgaaccacggaggtaatattgtagagacagcagctggttacctgagccaaatatggaactgtgatatgtacgtttctaaggtaatctttccgagccagctagcacagatgaagagtacattaattgcatattcacaatatcgcattacagtaagataaagtccaacataaaagtggaacatgcttcacaaacacaaaacttacgcaaatagtgtgagagagcagcaccggaattcttgagtgaagttgcgtaagcagatgtacacacttttgagtacaataagcattgagcaatcagttattgcagtacaccaaggatttttttttataaaaaaaatcgatatggaaaaaatacatacgttatggggatccaggatgtatagggatggtatttgttgtaggtaatcttgtctagcttataaatgtactcgtaccacaaacaaccagcctgtgatcacagtaaagcaaggtggtcttaccaaaagatggatatgcaacaataagtggcttattcagttatttgataattaccgttaaagcaattgaaactatcaaggccttaatatagagtttagttttcgtttcagcttcttcaagcttctccatccacttctcaacctgcaacacaaacaaatgatttattgatgtaaaatactattctctcgtatgcccacaattttacaaatgactcaacaccctcaaaactgaaagaaccagaaaatttatatcagcacatttctctcacacatgcatatgcgcaggcgcgcagagacatgcactcatacaaacaacttttatgcgatttatgaaatttgataaaactaaagaaatagaacatctataactgaacactatgtaaaagtatagcacagttggcaggaaacatacagttggatggtaataagcataaatcatccccacaatccatatgtagcgatccagtccagatcggaaatgccactcatgcaatcgagggagatcaggtttagatggatcagtatagcctgcacacaaggtaaattacattgatcatccttactaaaaatatatatataaactatcaaactcactaaaagtttacagagaaaacttaccgagaagaaacgtgaatgggctccagacaatctcgaagactcctgggatttcccatatcaggataaccaccaaaaagcaggcaacaaactttatagccatcactgatccaatctcgttatacttatttagtattccaagagcaccataaaccataagggtaaaaagtgtgtgcatagggcaaatataatagagggtgtagtcattatttagcacaatacaacagaatgccacgaaaaaattgaggcgccacatcatctgtcaaggtgaaaacatgtcaggaaggtcctacttatggaagaaagaatgaaggggaatgaagggtctaagaatgaacctgagcaaatcgtgcaaggctgaaatccttccgcacataataataggagaagttaccaaatccagtcatccagacatatgcagcaatgaacacacgaattgcattgtatatctctttagcattgaagtagtggtacatcaaaaacagcacctgaatgagggaaatcaatgctgaaaacaagtgatatgcatgcacttgaacatagatgaaaaacttactaaccacacatgtatgctattgaggcattgagcattgactaattaacttactaaaactaagagaggttcattaatgaagactaggtaagcatacatgtagaacaatatgacaaaagatgtttaataatgaacacatttatatcctctttgcatagttctgagttctgagttctgataaattagtattatgcacaaacggaaaccaacaatatgacaaaagatgtttaatactgaatgcatttataccctctttgcatagttctgacttatgataaattagtgttatgcacaaacagaagccaactagtataagataccccataaatatatgaaaaggaagacggagttttttttccccaaaaaagatacctgcatccaacccttccattcctcagtttggtgcctattcagatacagtatagatttccccgtgaatgacgacttgtcttggtggaccttgaaagaagtcatagctgctacgataataagaagaaagtaaaggaaaaggaacatatctcggctgtaattctgcagatacaggataacagaaaaggtcagaacaaaaaatgtcccattgaaagaacagcacattatataggcactttccatgaaatattagtaaggcttagaatgtattcgtaaaagatatctcaactagatacaatatttttgcaactacttttcaaacgtgaaatcaggcttgtaataaacatcaatgtaatagcaccttcgcagactctcccagtagatttgtgcgatcacatatgtaaaagtaaagcagatgacctccaaactcagatctgaaaaaataataactgctcagccaaataatgcaacatagaagaacacgtgaatgcaagatgcagctgtagcttacattgctctcaacgtcaatcgattctctagaataagtgcctggtccaacaagaaaagtctgtgcaacagattatctttgtcagtgccttagtaatgttgatatctcaacgtttatatacaacatgaaggagaaatcatacatcacaaacaacctgaacatttgtgatgtgagagaagcataaactggcttttgcactggtgcttggacaccctcctccaataacatcacttgatcctctcctttgtttgagctagaatccattactgctaaatttacatccgagtgtctactaacaaagataaagaaacagaaattccaataagtggtacatttcaagcaaaataatggtgcagcacacattcagtccagacgaagtacgactcttgagttatgcttcttgtaacataagtagatatttcaatctcagtggcaacatgagagtatatcacttagcatatacgaaaattaaaatgcatggataccagaactgtaaatatagctgtcacaattacttacgctttaatagaagcagcattcttcctataatagagaacctccgcatatgcccaggcggtgaaaacccaaagaaatcccagaagagcagagacctgtcagaaagttgccagctatctcagatccagtgattgaggacccccaaaacaaaatcctactattagaagaatatcactcagtcatctgtatagtagacaatagttctacggctttcaagttgcaatcaaacactgtaattgtgttatttgaacttgtggggtaaaagtagctcatcatagtccggattcttgcaatccacaccaatatgtatttctgcaactaaattactatctagttttagtatttttaccaacctgaacttcctaacaactaccaaagtaaggaacaaccgtgcgctagaaaatcaagcagattgacaccaattctaacaggttggtcagcacatcgatactgctaccatctcttagaaaatataacagaatagcccatgctgccagatcttaatgacggtcttactctaacatccaatacctccagatctgaaaccgcagccacttacgaatttccaaccttaaaccctacatataagctattatatcgccaattttccaacagctcggatgaatgaaacctccaccatatatttggtgctactagcctaccatacaaaagcacagctatgacctgatgatttacaccctttgatccacatccctgaaaccagccacaaattcaaatcccgcatcagccaaaatagttagcctcctatccgaataccaccgaatcctaaaacctagcactaatacttgtcgtatcaacaaaaaagcaaaccagacaaccaaccgatatccacaaccatctcaccgatcatcacccaatcccgccaatttagccaacagcagcgttaaagcaacacaagctcccgccagagattccacgcgcatgccatcatctccagcgcgcttcctcccagtcccagccacctaaacccaaaacccaagccgcacttccgcggccgcggccgcgcccggcgcccggcacacgggcgatgccttcccattccccccgacgaaatccttgagccacctcgccaaccgcggattcccccgacgaaatcgcctagggggcagcaaatgccgcgcggtccccgcacccgcaccaacaacagagcagcagcccccccctccccggatcgacggtgcgatttagggctcacctggcccggcgtgagggaggtcgaggcggccatggcgatcccacccgcggacgcgatcgcctccgccattctctctacagcatccgccccgcctccttcctgcgccgctcggatccagccgcgtacaggagccgagcagagaagagaagagaagaagagagggagaggacgaagaaaattaggtgcgaagaaaaaaaaaaagagaagcgcggtttaaagcggcgggtggatgtgcgcgtcgtacgagggagcgcgagcttgccgacgctgccatgtgggaccgagcaagagattccacggtcactgacagtgggggcagtgaggcatttcagagcttgtgggccccacacgccatcggatttgcgagtgacggtgtaactaaacggatgcttagtttggtcgatttaggtgagaagaagaagaaagaaatatttccgtttttattatttctctctttacacgaaaattgcagctttgtagattacaggattgcccctgtcggtcggcgagatcttgttgcacttgcacccctcactcactctgctagtcttcttaattccttcgcgtttagtacttgtgtttgcgtttttcgatgattatcactaacttaatctccccgcaaagaaaggcactaactttaatcggtagtactgctccgtttcttggatttcgatgcacatcaattcgtcagagcatcctgtctgtagtgaatagctcgccttaattaagaatcaaattcggaatttgagatggttagcagcgcagatgcccaactggaagtcaactacggcaacagatggtgattttctcgatcaaaagcccatagttgtaattgacgtgtgttgagcggtttatgcgatctgaatcaaagcgataagctgataacaatggcctctttttttctcatagttggcttgtaatatgcgtctacgtggagtatacaaaacgccattaatcggctttttttcacctgggaagtgggaacatgtttgcccaggggaacaggaaataggatttttatgttcagtgcgagagtcactagtctcgtcggtagttggtatgcgccctaacccaccaactaggatgcatgtcatacagatgcaatggagctagcttagtacaggacttcggctgcgttcgatcgtcgcttttagatgttagttttgctgtcacgtgaaattagatgtgtgattagcatataattaatcgagtattaattgttactccctccgtcccataatataagggaatttgagtttttacttgcaacgtttgaccactcgtcttatttaattttttttaaaattattatttattttatttgtgacttactttattatgcataactttttgttttttatatttgcaaaaaaaagtttgaataagacgaatggtcaaacgttacaagtaaaaactcaaaatcccttatattgtgggacggagggagtcaaacttagaagtatttttttaaaaataacttctatataaaaaaactttcacaaaaatacgcaatttgataaacatgctaacagaaaaaacgagtaagttgtagtttagatttggagctttagaacgggaccttcgtctatttgtggtgatgcagtgccaaacaagtattttccctccatgtcaaaataagtagctgtataattcaaatttaaactacacaactagatttatttttggatagaggtagcatgatggtaacctgatggtgatagtaaaaaagagagaaaatgacttgtgtgaatattcctttgaacttgtattcgtggatacaatttatataattgatcaattgttgataatgaaacttaattagtgcttcttagcaataatatacttggcatgagcatgtgtatgccactcttctccaaaagaaaaaaaaaagaaaaacctcaaaagtcatacccacacaaaacaaaccttttaaagtacagaaatttaaaatgattttcatgaaaattagttagaaaagtgtgaatccacgtaaaagagaataaagggcctatagccaagtggttaaaagagtctcagtagtaccttaggtcctgggttcgactctccatgagagtgattttttcaggatttaacggcttttgtgctttcagtggtaggcgacgcccagtcttcgaagatgctcataggggtagggatcaccagtgacaagttcttcctatgagacggaggtgattagggagttgatgtgcggtaggcgcaacatgccgccaataaccaacccaaagctacctcgccacgagctcgtccccaaccatcccctccgcaatgccatccacaagttacatctccgtcacgccatgcgaaacaagtagcccgttggcggccacccttttccccacctctcattaccctctcgttattgctcggaggcttagtgacagataggaaagataggaagatgaggaataataccacttacgaccctttcagtttgcaatggtcgttgccctttctaatctaccgtggcctcatcccatcgatcgccacccctctccaagtcggtgactggtcttcttcccaccacttgtcgcctcctcacagggccagctctaggtctagacaagttgtgcaaccgactaggacccagagtgaatggggcctatcctaatgtaatgtaggtcaagagtaaatagctgagcagtgtgccttcaatcaactgatgtatggacttcttgatgacctatcccattccagtcgtctcatcccgaggccaaaggcgtcgagcgggagcaactcgccgtcatcgccgacgactccttttcgacagacaacagtaaatgtgtctcttcctttgatcaacaattcatctcagttctctcttctactcttgcctggaccgtacgctcgtagcaggcagcagtgtggcacccagccggccaggccaaagagcgcaggaagcaaagtagcggcagccttgattgaagactatgtgcataggtacatttacatactagcagtagattttatttctcaatttataaataatcatagaagatgatatatcctactccctctggtttcattttaattgacgttttggagaatgacacagtctatagtttatatgtttgaccttatttttctattataatatatatataataaataaatatatgcttacttttattatagtcctttgaaagagaaatctatatacgttattctagtttctttaaactaaatatttttaaacttatttatggttaaagttataaaagtttgacctcaatcttgtccaaaacgtcaattattatagaaccagagggagtatctggttaagatgatacatcctatcgggcttttaggtcaagatttttagtgttcttgccttctattttcctttctaattgcagttgtaagattttaatccgttagatgatgatgataattgtgatgtgttgtagtgaaaagaatattttggacaatattgagcacaatattgttcttaatgattttgaataaagaaatgagtaaatttcacaatggtctgccttttcttaccaatgttttacattgggctagggttaggtcaaaattttcactaacaccatatatatttgccaagagttgcactttgggctaggctccaggatttgagcccatctggatgagcagacatcttctccctcccacaagggcatgcgcaacctcgccgccgccacttctgtcgctggtcgggagttgagtgcaaggggacacgatgggggttagccaaggagaagggcgatgcagcaggcactgctctgttgttgttttcccttgctgtccagtagttcaaggggctgacgagattggctagaggatagagattaagcgcgccggcgaagtgagtggcggagtggttattggaaggaaaagcgttagagttggggacaacggccatggccatgaagctgacagtggcagaatcaaggtcaatgaaacaacattaggggacaagtgcttgttcttcttctccagctctagcatgggattgacatgaagctcgtttcgcgtgtgattgacatatccagttgaattaggggcagggcatagcaaacggtggagaagctgtgctccagagttggaaggagagaggaggctcccagcttgcccatttatctcctaatctcgctgacaagtgagccaccggtccaaactgaaattttttgctgtaagacctagcctaaagtgaaaacattgtctataggatggtccaaactagaactttggtaaatataactagaccaatgtgcaatttactctaaagaaattccagaagttcttttttaatcacatattggatatttgccgttttctctttttgaagcatcgtcaataaagttgttggagtttagtggttatttgccgttttctctttttttcaatttttttcaatgaagcatcaacgctatttatcgatattaagaccatattgcaatgtcacgttaggggattaatggattataatgtgtcttataactaaaaggaaatatctagtctaagggactattgtttcgagtttgcatagggtcctagaaaacgtagtagctttgccccctagtttgctacatctctatctatcagacggcttggtgttttccgtcggctgccggtcgaaggcttggtgagaatgtgagagatgggaagagagggaagagggaggatagaggaggaagaagaggtggttgttgacatgtggggcctattggacacgtcagtcaaaatcgggtattataaacctcggatacactgttttgcaagttaagagacgtgctacaattggtatcgcggtacaagaatgtaacttgaactcggcgtcaagataagggacctaatatgaacttattccaccataaaaaaaagaacttattccacgatggaaagctcttcttgcgttcagcagccagtagcccaacaaggcccattgttcgggttaaacgaacccaaaaccgtacgaaagcccgagaaaattgccttcgtctgcgccccgcgggctctcgtcccaaccgctcaccggcttcccgcggcggcggcggcggggctccatgctcacggtgaccctcctggacgcgcacctcgcgcggtgcagctcggcgcgccacctcctccagatccacgcccagttcgtcgcgtccggtctcctcgccgacgccttcgccgccagccgcctcatcctcttcaccacctccacccgcctcctcccgctcccgttccaccactcgctccgcctcctccacgtcgtccaccgccccaacgccttctcctgcaacatggtcctcaaggcggcccgcgagcatgggctgccgcacctgtgcctcccgctctacgcgtccatgtccgcggcccccgactgctacacccataccatcctcgccgccgcctgcgccaccaggagggccatcgaagaaggccgccaggtgcactgccacgccgtcaggcacgggttcgggcgcaacctgtacctcgcgaacgcgctgatgagtatgtactccgcgtgtgggtgcctcggcgacgcgcgcaaggtgttcgacgcgggtcctgtttgggacgccgtttcttggaacacgatcctggccgcgtacgtgcaggctgaggatgtggaccaggcggttggggtgtttgcacggatgcctgaacggggtgctgcggcggtgagttcgatggtgtcgctgtttgggaggagaggaatggtggacgaggcgaggaaggtgtttgatgtggtggagcgcaaggatgttttcacgtggactgcgatgatttcttgctttcagcggaatggcaagtttgcagaggcgttggctttgttctcagatatgcgtggggaggggtggcctgtggatgaggcagtcatggtctgtgttgtcgctgcctgtgcacggttggaggtaactcggaatggggagatgtgtcatgggctggctttcagagctggccttggctcgaggttgaacgtccagaacgcattgatccacatgtactcaagttttctgaatgttgttgcggcacgaagattgtttgacagtggccagtgtttggaccagttctcttggaactcgatgatagctggctatcttaagaatggctctgtcaaggatgcaaaggaattgttcactgtaatgcctgacaaagataatgtttcttggactacaatgatatctggttgtgtgcaaaatgaccagtcctcagaggcactcactattttcaacaacatgcaagcccaaggaatcaagccagatgaggttacgcttgtaagcgtcatctctgcatgtactaatatgtcttctctcgagcaaggcaagtcaatgcatgagtacataagggaacaccaatataccatcacagtcatacttgggactagcctcattgacatgtacatgaagtgtgggtgcttagaatctgcattagaagtcttcgatacaatggaagaaagaggaacaccttgctggaatgctgtcattgtggggctggccatgaatggtctggtgatgaagtcccttgacatgttttcggagatggaatcatctagcactgccactccaaatgagataactttcactggagttttgagtgcttgcagacatgctggcctagttgaggagggccaacatttcttcaagttgatgcagcacaagtatcacattatcccaaacatcagacattatggatgcatggtggatcttcttggacgtgctggatatgtcaaagaggcagagaatctgattgagagcatgcccatgtcaccagatgttccagcatggggtgctttgcttggttcctgctggaaacatggtgataatgaggttggagaaagggtggggaggaagcttgtcaatctagatcctcaccatgacgggttccacactatgctatctaacatatatgcttcagaaggaatgtggcaacatgtaaaggacctaaggggctccatgaaacaatggcatgtcccaaaaattcctggttctagtgtggttgaatcatcactacctttgtgagaatatatcatatgatggtacttgaaatcagaatacagtgcttagagtggtttgactcaagtttcataaggtactgagccgatccttaattccttatcagcagaactagtgttctagctatcttatgagttgctttggtagcttgtcattcaaataatctttcttctgtctattttttcacatgtttttagataatgtatatttttcacataagctaaaagtttttgtctgccattaattttcacaacattcatcttttgatcattcacctgaagtcagatataacctcagtcgctccctcctcatttctgcaaaggtaacatccatccatctggcaccatgaataagtagccacccactacatggtcatgactccttttttgcatttagccatgcataatggtgcttatgtattatttatttattaatttgtaatctatggtgaattcaatctatgatggggactaatacttctgcattattgaaggcatggagcacatgagagtgagggtggtctacttcaccaaattaaggagagtaactgtctgtttatatgaatatatcagggagcttggtgaagggaggagggaagaataaggaagcaaggatggcctgttatttatagttagcagatgacagattaacgcaggcagactacccaagctcctaaatggtacgatttttgcaaaaaactttcttcatcaacatttcttagataacttgtttaaatcaacttccaatatttaattatgccctcgaataattgtcatgaactctgtgtcatccatcacccatcatctatttagggtgggatcttaaggggtgcaataagcttgcaacctttattggtatgtttagctttgtcgttggaagttttgaagttgggacaacatgttatcacacttattgcactggaaaacaataaagagaagatctgtagatgtttttttttccatagagaaaagaggaatgtaggtcaattccgttgttttgtttctaaggcatttgtttgttacaaaatatgtccatgttaattattatgaatttatgatgtacaagttgcagccgtacaggcagctagctnnnnnnnnnnnnnnnnnnnnnacatttctggttcagcgatcttattcagtattaaattcaagtctaaagaggcttatatttaaggtgaacaacactcaaaatttactgttgtgcatattgacgaaactaagtaattccaaacaaattttgcaagaagataatcattttgtattgactttctaacaaagaagaatttacggtgtgaaatgtgagatgagatccaccttgacaaagtgatagatgacctgctaaattaattattggactgaggggatttcattatatgacaaagtgaaagtgactggcctatcttaaaactgcacgggcaaatactactggaagagtttttctgtcagttccttgcatatgactagaaaaatatggaacactcctccctattttatattttaaaatgaagtagagatcaaatgcagaacaactttggcaccaccataccattatctcccttgaggggaaaaaagaattcaaagtcttattgacttttgactaacataacaaatgcatggagaaataatacaggtttaattgacagaacgataatcatagctaaagggaaaaaaagaatacaagtctaattgactaacatagctgacggagcgtggggctcctcaccgggagaccgcgcaggcccccctttgccggttcggccgggggccctgggtgagattctaagctcctggtctgagtgtggaaggttcgcgagagtggaaacacacaagacacgggcgatgtatacaggttcgggccgctgagaagcgtaataccctactcctgtgtttttgtggatctatgtatgaagaagctacaaaagagctggagaaccagagagctcttactctctccctctctagtccttctggatccgaaaaaatcccctttctaagtgggcaaggtcctccttttatacctcaaggggataccacatgcaccatctctctctttttgtggggacttatcctatcttttcataaacagacggagacttgtatggttgccgtccgaatgaccttctgatgggacggcccatacctacctccacttccgccggaagcaggcgcgacgtgggaacatggctgtctgctgacgacgtgaccagtgtcagaccggtcacaaatcggtcattcttgtccaccacgcgtcagtttatcaatctgcatgttcgcccctcttcatacaatgtcttgcttgtaatggttaggatgaagcctggtatatatctgaccgggaccaacgtgccatctccaggagctaacacgccggctccggctagggacgagtgcttggaggctctcatcctgacgggatggggcgaggcgtgcgtcagaccgcctgtcgccacctaacccacgatctgaccggtctgtgactggtcacagaccggataaacgagcgcgctgcactgcgttacatgcggcgtgacgcgctcgtccaaaccgcaataaatgtggttaggtgagccccgctatgctcacctaccccatatacgtggcgcaaaacccacaaggggtcggggcgcctcggccctcggggccgagacgggagcggtccgacccctcggggagacaaagagaagggcggccgtatcaccctcgggcccgaccccccccccccccccccgagggggttaggccacgtgggtgatcgtgtctgcctcaagtctctaagtcatgatacttccggtcccatgtcaccgacaatagcaaatgcatggaaatgataatcatttgtgcaagagaaacaacatttcaaagatgaatccatcccccaaaagactaataatggttttgttgctgttgtgaatttgtgataatgcaatgaaagctcgattgcatcaaaatgttgcatgatcaaccggatcatctttgctgatccacaagttgtctgcaactcattgcacatcaaaataaatgaaaggtgaaactcttcatgcaaaactacaaagccatgtcatcaagcgaatatggagcagatgatttttgcttcgggtgttatacgctgtcggattctctgattggcaaaatatcttctcaatcctccaggatacttcttttgaatgtacgtcacatctatacacagttcgagtttgtttattttgtaaagagtaaatttcacaaaactacagatattatgaccaaattatcacaaaactacagatataactcggtgtatcacaaaactacacatttaacaccaaatttatcacaaaactaaacatttaagatgaagtgtcacgaaactacgtgtttagtaactaaattatcacaaaactacaggtttagaaacaatttagtcacaaagcaataatgtttatagcttcaccataacaatgttgctagggatttaaactccaaaagttgtagttttgtgataacttcaatattaaatacacatttttgtgatatttaaccttaaatctgcagttttatgataaatttggtgttaaatctgtggttttgtgatgcaacaccttaaatctgtagttttgtgataatttggtcaaaatacatgtagttttgtgaaatttactcttctgaaaacctcattgcatattagtctatttccgttggagcagttggggatttatcaactcaaatgccaaaataatttcaaaaaggaaaaaaaatcattgttgagaaggctttgatgaaagctgaaaggttagcctgccaaattatacagttctggaaatgggacaattaaattgaccaatctgttattgcttcctagaatgggttgccaattttctatagttccaactttctcaaatgagaaagtctagtgggtttaggtcagtaaatgactcatacccagaaacaaaaatgagcagacatcccctatgtaacgcattgtcctgcaaaaactgcagcatgtttacagatattctaagagcaatgctacgctgtatggagcattttcactatgtcaaatgcgggtaaatatgcgggtgcaaacccaatttaggtgaaaactagtgtaaaccctgagtttggaaaagatcttttacatggttgtgtaaaataatctcatctacatgtatgatttttttggggtgaatttagacaactgtttggtcagggttcacatgagttttcacctaagttgcggtttccaccatatatttacctgtcaaatgcagctcaagtatttcaactattctattatagataaaagctaccttttggtccctcttttggtcttatcttttccatctgttatcttaagaaggatagtgaaatctgcagattattaaaattaaattatttagaaatccatatcctattgaatgtgaaactataatcattttatctttgcaactgtgggttcgtgggccttatagaccttgaggtttatgatagtcttatagtcccccctcactgtcctttcaccaatcagctttctttcaccttttgatatgcagcccatatttgcagggattgttccccatatcaagcgcaagcttatatgcatatgttttcatttccattattccattgttttcttttactcctgaatacatgacaacttggccccttttttaatcatatattagatagctaagtccttacacctacccaaaaaaaaaacatttcttgtgcgtgatatctgaacccaaaattgtatgcgcctgccacgtgcttggttttcatagatgtagttatggacctctgtattgaatattttcattcatctgtaaggacattgtagtttccatcattttgcaaatcaaaatggataaacatgtcgcatgatgcatttcgcttatttcctattggcagaaatcctcagaagtaatctactggcagagtgtagagctaagggcatgcaagtgcattagtgaaatccaagcatcgttcacatggtcaatcctgccctagaatggtccaatccaagaaatccattaaaaccagtaaaagtgatgtcaatagatgggctaaaaagagctttgaggtatgaagtactatcccagctgccagctttgcaactttgcataatgttctgtttgttcacatttttcctgttctttcctgacaatagttaacttcagcggtgaatgaaacgatgttgaaaaatggaaatgattgtattacgattctcctcctaaataaagtacgcatacttcatttgtagctagctaaaacttttgaaggtcatgtgtggcatgaaatggaatataaatagaactgttctaggaaataattcttgtcttgaactatgatatctagaagaatccccaaattaatggtttagaatgatggtagattatcagctacagttacacactaaatagtttatttattaattctagttttattttgcagcaatgtagataaagtagactaccgatcttatcgttgcctgattaatggtattaaactaagattaaatatcaagtacaagtaaggaataactaaaatttggattaaaaacaaaaataagactagaatttggtttccatgcaaattctaaaaaatatattggttaaccatatttaaaataattttaaaaatgagcgaaaatgcaccccaaagacaatgactaaatttagaataaaaaagataaattctatttgtatatgaattccaaagttatccattttcttaaatgtacatgattttagaaggcgagccttcagatctcggaattataactaaccaatatgcgtggataatattaaatattacattagtatttttgtcattaaaaaatacttttgttttgttaaaacaaggatctgaaatcatgtcaatctgctaatgacctaaattagaaattcctaaatagctttttagaataaaaatagacttaaaatatcaattaacttcatataatatacaaataaaacagagctacccattttgtatattcccaaactaaatacataactaactacaacataaaccaataactaaaggaagcacgctaacacaagcaaagtatgaaggcctccgtgccatcccccaaaaaaaaataaaaagataatttgcctgaactcgaggaagatgagctacacatacattggaacattagaggaagcacaataaaagatgataagggggctgaaaaaattgccgttttagatcacggagtttgtaagcaccacttgcaaatactcctaattcatgatgtactaccaaccaatagatagtcctcgtggagagtcaaataccctacttagagcaagttttatagtagaggtgattgccatggttacggataaggcatatctccaatcctatgacttacggaatatacgaatacggtataccttcatgtatacaatgtgtttccgtatacgataaggaaatctacaagatactatggaaaacgtcctcacgataggcggatgtcaaagtcctatttggagaggattgggcttttactatatcatgcggggtccgtagtcttcgagttctacttggagactaaggagattcacggtataaaaggcgtacccctgaggggtttagatcatcgaatcttactaccaacacacccaccatagtctacaagctggaggacgcgaagcctactcaccgagagatctcgtcgaatcatctcgacaaggatctcaccgataacgccggattcatctattctcattgtactatgtggttttccatatcaatatcatataaattggattagggctatcacatgatatctttgccttcttgttcgccgatgtcgtatcgtgtagatcctcgtaccaacgtaccccaataccttattcatccggtctgcgggtatcacccatcgatatggtcctttaattttattcatattatctactcgttgattagagcaagtataataatgagctataagttagctataaacatatgtggatgagagataagaggagagagaataaaagtgggctacaaatttatagccaattacggtacatgctctaagagattgtgtgtatattagagatgggccagatattaatgttgttctatatgtttatatgaaactattgtatgagtaggctattagatttgttacacatgatgtgttaatttttagatctagcagttggctatactattgggacaatacaacacatcgccaatgcacttatcccaatacaccactttatttattttcacttaatccattagcttatttctctcatctaggagtttgtgtagatattggctcctcctctctttcatctcattatatgatcttagagcaagtttaatagtatagcccactactagctccaattcacttatagccaaactaatagccaattcataaaatagttgcttactatactattaatatatggtcccacatgtcatacacacattgcgtcttggagtccgcgctgcagctggctacagatctgtagcccgctgctattctctctcatcttttatctcattaaaatatgtttatagccggctaatagtctgctattgtacctgctcttatgtactctctccgtcctattttaagtgtagttgtgggtttctgtatctaaagtttgattgtccgcttatttgaaaatttcataaaaagattaaaaaaataagtcatgtacaaagtaccatttatgttttatcatctaataacaataaaaatactaatcataagatatttgaagacagactcacagatagtcaaacacgttggacacagaaaccataactactcttaaaataagatagaggaaatagcatcttccaataagatcttagagcaagtttaatagtacagccaactaccggctctaaattatctatagtcaattttatagctaattcatataatagttacctataaacatatactacacaattaatatatgatcacacctatcatacatgcatgtatattggtgtccgtgctgtagctggctataaatatgtagcccgctactcttctatcttttttttatctcctcgaaatatgtttatagttgtcttatagcctgctattgtatctgctcttaaggtttgtactcgctctttgtacatgacagagtcgtgagaactcaagcgcacccaccaatggatgacgtacccatggatgacgtaacaatgaatgacatatgtcaatggaagattctttgtccaacggccttgatctttcatatacgaaccaggattaatcgtccgtactcgtaagagcaggtacaataataggctataagccagctacaaacacattacaaacacattttaagaagagacatgactacacagctagtggtagctggtctgtctccactccatatatgatagacactatccaactatacttcaaatacaattttctctaaaactgctcatccgatatacgatccgattacaccgttgtgttcgtaacaattaaatctttataacaagatatcacatgattatattttgatgaaaaaatataaattacttttataatatatctaaattacttttagatttcactaagttacttcttagacatataaaagtaattcaacaaagcctaaaagtaatttacatatactatagaattaacttataaaaaaagaaagttacttctataatatatgttaattactttaaaactttattgaatttacttttatatatttaagaagtaacttagtgaaatctaaaagtaatttagatatattataaaagtaatttgtgattttttttatcaaaatataattatatgagatcttgttgtaaagatttaattgttatgaacacaacggtgtaatcggatcgtagatcggatgagtagcttaagagaaaattgtatttgaagcatagatggtaggaatattttttctacttgcttgatcaagtactatagtaaagtaagattcttcaagacacatatctggacaatggttgatcgtatctggacaatggctagcgtcgctcgttatgactaaatcgagagcgctctcgatttagattttgcgtttaagaagataaataaggagaaagaagaacagcgggctaaagatttatagccagctgtagcacagactcctagacgcaatgtgtgtatgattggtggggccagatattaataatgtagtatgtaactattgtataaatgagctattagattagttatagatgaattggagatagtagttggctatactattaaacttgctctaagcagattaattctcatactgcgttcgacatgtgcaatcaagatctcccgtcctctgagttcgacatgtgcaatcaaggattaccttccgtcttctgaaaatttattcttgtacagcgttcgacaattagggtgagtttgaggagaaagggattgagaatattgggaagatatgtaaaacgaggtgagctattagcgtatgattaattacgtattaactatttaaaattttaaaaatggattaatataattttttaaagcaactttcctatagaaatttttaacaaaaaaacacaccgtttagtagtttgggaagcgtgcgtgcggaatacgatgtcctttctcaccctataccaccagaacgaacactccatctcctcctttgcatgtagccatacatgatggtccttatggaatttctttttctttcttttaatctatggtgatgaattcaatctatgatggggactaatacttctgcattattgggggcatggagcacatgagagtgagggtgatctgcttcaccgaattaaggagagtacctgaatatatcaaggagcataggtaaggagggaagagtaaggagccaagaatggcatgttctttgtagctaatggatgacggattagcgcgtgcccactttctaagcttctaaacaatactgtgatttttgctaatactttcttcatcattatttcttggaaaacacaagttgcacaagttgattaaccctgtccctgcctgtgttaattatgatgcacaaatctcaccgtacaagtagctggctagccggttaatgattgacacatttctggtttagtgatctgattcagtaccaaattcagtctgaagaggcttatatttaaggtgaaaaacgttccaaatttactgtacgtgttgcacattggtgaaactaagtaatggcagcagtaattttctagagcaatttactctgcatgattccaaataaattttgcatgaagataatccacttgtattgactttgtaacaatctcacatgcttgctgcaagtgctaatattaaaccgtgtgaaatgtgagatgagatccaccttgacaaagtgatagagggcctgctaaattaattattggacttaggggatttcattatatgaccaagttatgcagatactgccggaagagtttttctgtcagttccttgcatattagtactaaaaaaaatggaaaaatcattttccttttttttatatttttaaatgaagcaaagagcaaatgcagaacaactttggcactaccgtaccattatctcccttgagggaaaaaataatacaagtctaactgactaacataacaaatgcaaggagaaaacaatacaagtctaattgacagaacaacaatcattgctaaagggaaaaagagaatacaagtgtagttgagtaacatcaacaaatgcatggaaatgacaaatcatttatgcaagagaaacagcatttcgaagataagatccaaccccaaaaaactaacaatgattttgccgccatgaatttgtgataatgcaatgaaagcccaattgcatcagactgttgcgtggtcaacccaaccatcattgccgatccacaagttgtgggcaactcactccatatattttgttaaagaattatccacgtgcaaggtctagctggacaaccatctctgcaactgcaactggctaactggtcagtggtcacttgctccaccctaaaatacgtactccctccgtccaaaaaaagacaaaccctggtttccgtgtctaatgtttaatcgtccgtcttatttgaaaaaattatgaaaaaaaattaaaaagataagtcacgcataaagcataaagtattaatcatgttttatcatctaacaacaatgaaaatactaattataaaaaaatttcatataaaacggacagtcaaacattgacacggaaactcagggtttacctttttttggaacggagggagtagaatagtgctccctccgtcctataaaaatgaatctaggatcggatgtgacatgtgctagtacaatgaatctggacatatgtatgtctagattcatagtactaggatatgtcacatctgatactaggttgggtttttataggacggagtgcgtatatatcaatctatatcggattagacacattcactccaatcaaaatcgatttgaatcacttttttttttcattacactatttcgattagacatatttagcactataagaccctgtttggatccactgacaaatttttacaccatgtcacatcaaatgtttggacacatgtatagagtattaaatatagatgaaaaaataactaattacacatattgcgtataaatcgcgagacgaatcttttaatcctaattgcgccatgatttgacaatgtggtgctacattaaatatttgctaatgatagattaattaggcttaataaatttgtctagcggtttatagcagtttataggcagattccgtaatttgttttgttattagattacgtttaatacttcaaatgtgtgtccgtatatccgatgtgacacgctaaaactttacacccttagatctaaacacagcgtaaatcccggtcaaattcatagctttagaatgtatataatctgaaagcatattattatattttgggacgaaaaaagtattagacaagagtgatgctctggtactctttactggttactaccagtatcgtcagaggtaaattagtaatttacaattataatgattagaatttattttatcatttatatttttttggctaaatcaatatatgatcatccattgtgttggcgttgctcatgcttcatcgaaaaagccaaaaaatgagaaaaaaagtagtcattgctaaatgatgattataccctcgatcaccacctacttttttttgatagtaatgtcccttcacgtttctactaccgctaaccgtggtggttgtataaatagatttgaacccttcgattaataaaaataacggttcaggttgatttctactaccagtagagagcaccgtagtgaggctcatttagacaatatgcacagctccatcccaaaatataagtatttttagctatgaatctggataactgtgtgttcaaatttataaccaaaagttattacattttgggacggaggtagtaatttatagtcacatacagtatccactgccttgccctgaaccctataaaacaccctgctgttctgccattccaaagcgccatttcctctcgcttgcaatctcaccattaacaggctgtaccaggaagcatccatttcgatcgcaagaagaataatgggtgagagcagaggcagcattgccttcttcgcgagctacaggccaccggtggctctggacatattctgctgcccagctccaccgtctagcccgaaggacgagctgcacctgacggacggcgactcctacaactacaactgccagcccatcccaccggcggcgctcaagacggtcgtggagcgcctcggcgtgtcccgcggcgacgccgtcgagggcgacatcgattccggccgcatcaccggcctcgtcttcgtctccgagagggagcacaacctcgagacgctccacatcgccctgcgcttcaacgacgacggcgaggtccaggtcttctccctggccgacgcctatggcggcgacggcctgttcagcggcgcccgcatggaggacagcggctgcattgccggcggctacgaggtggatggccgcacggttgaccattacctcgtgtatgtgtccaccaaggagccagtgcgagaacgtcgcagcccgtggaacgtcgcttacaagaccaatcttagaaccggcgagactgaacgcctcacaccaccaggttataatttgatcagttactgaattatatcttgccaaagcttagccttttgccacttgatagccaacagatattactcgcgcttggaaattcttgattttagtgagattaggatgtaccgctggtttcgatatcttaaaatatactttctctattgatatattatagtatttatagtagtaaaatatgtaaacatccggaactaggttgatttttttataagacggatgaagtatgttaggagggcacattcgtaggatatgaatgtagtattgcgtatgtagttgtatgtgtgcgtgtgcgtgtgcatatgtagtgtaatcactgaataaagaaaatttttgatttggtccgtgcaattgaatttggacaggaacatttgatataagcccatctgtgtcaccatccgggaagaaagtagcggtggcttcgtaccaagggaagaaatgggacggtgagatcaagaacctcaacaccaacatctacgtgatgagcttggagaacccgtctcaggatcgcgagcgggtgatcgagaacggcggctggccgtcgtggggcagcgaggacgtgatcttcttccacaggaaggacggcgacggggagaacagctgctggggcgtgttccggcacaccctgagcaccggcgagaccgtccgggtgacgccggcggcgttcgactcggtgactccggcggccatcgacgagaccagggtggcggtggcggccatccgccagaagtccgagttcagtgatgtccgcgtcgaggcacagtacaggcacatcgaggtgttcgacatgagatcgccggagcagccgatgcagatcacccggaacaccaggccaaaggccgaccatttcaaccccttcgtgatggacggtggcaagttcattggttaccaccgttgcaaaagcgagctcctccaggtacatagccatggctatgtccattgatcacgttttcttgtccagtgaaatggcggtccagccgtatgcccgtatatagtatatcattgcactgatggataactaattttatttagataatgactgagtagttggttgatttatattcaaagccgcagatgatattatattgtttctcgtgcagcacggcgatgatctcccgagaaaatttcacaagctgcaatccccacacgaagatgtcggtgtgttcagggtgtccggtgtgttcccaacattttccaaagatggttctcagcttgccttcgttgacaacgagttcaaatccgtgtggctggccgatagccaagggatgcgtgtcgtcttcaaggtatacctcctgcctcctgctagtagttgctatatactaatatgttaatcctccagaaatgctgtacgagtagtcaatattttttttcaattatgaagtgctaaactgctactgatcattacttaacctgtttgcttagactgatggcccagacagcgtcttctcaccgctgtggaattccaagaaggatatactctatgtgtgcatgggaccttctttcaaagccagtgaaacgttggagatccattccatacacaatgtatccactggtgaccggaagtcgcggcagctcacgttcggaggattcaacaacgccttcccttccaccaatccagacggtaacaaaaaccatcaccaatattcaatcatcccgtaaaatgaacttttcatagttaattttgactgtgttttggacttcttaattaggaacgaaatttgttttccggtcgacaagagatggaggggcaaagtacagcaagaacctgtacataatggaggacgccgacgccggagaaggcgaggatggcagccagtcgacggtgacgcggatgaccgccggcgagtggacggacacgcactgccagtggtctccgaacgggaagtggatcgtgttctcgtcgaaccgggacaggccggcggacgcgccggagcgcgaccacggcctcgacccgggctacttcgccgtctacctgatggacgtggcgtcccggtcggtggtgagggtgatcaggagcgggtacgacgtcgccgggcacgtgaaccacccggtgttcagcccggacgggcggagcatcgcggtgacgtccgacctcgccgcggtgaccgccgacccgatgtcgctgccgctcttcctgcactccgtcaggccctacggcgacatcttcaccgtggacatcgacccggacgacatggcgaggaacgaggacgtggaggggttcgtccgcgtcacgcacagccggtacgagaactccacgccggcgtggaccgtgttctccacgcacgacccgcacgcgcagtggaacctcctcgtcgtggaggacgagcacgtcccgtcgtgcccgtacgcgcatccggacggaggcgagagttggcacatgaccggccagatttgcatccccaaaaggcactgttaattctctcgccattgcattactacgtttcttgtttagaagcgttgttgtttgtttaacgtacgatatttattatctgaagacgttttcagcatttgcttggatgtacaacgtgtgtatgaactgtttgcgatgtaatatttgtttatttgcttgagatgtacttttttcttgtcagtaagacttttgcataaatcgaaaaaataatcacacgagtgtaatactacgaattttgttgttagaacaaacctgactgtgtgtaaaacattaattcccagacagcttgatcgtttggccaatagctgataaactgtaaaacaatttatttagcaattagaaaaataatatgtaggtaaaacttgtatatattcatgtccctagtataaataaaaggcaatactgaaaaaataagtataatataataaccctcaaaatttaaatttcaagaaataagccaaaaggtaaacgatggttatgcatatataaaaccttaaaaacaagaacttatacaaatttcctaaataataaccactgcttgaaagaaagaaaaactcacaagaaaccacaatggaaaggattaagtttgatttacccctctcaactagggtcaaattgagaattacccctttaactatgataccggatattggtatttgatatccctgaattattgaatccggacgaattatcccccacatgacatcctctctgtcttcttcttccgccctccctcacatctggcaaaaaacacacgagaaggaaggacagtacaagaagcatagaatgatcaagtcactgcgtgaactgttcacgatggagtctttgctggcggcgttcttgcagagctcaccgtcaccagactatgtcgtcctgcccatcgcaattcatgttggatacagagttgtggctactcctgtcgtgccgccatgtgttctatgccgcctgcgttgacaggtggctccgcaccaccctcatcatgctcgctatgtcaggccattgtcttgcttccacatctgtcgatctccgtcatcctcaccactagagccaaggagcactctaggagcttccgagtcaagatgggcaatgtcagcgaccgcagctcgtccacagccagctgcggcaacaacctccccatctactcactcgattcgttcgaataccacattgatgaggaggttgaggctatcgtctcctgcgccatgcctatgtcaaccaagaccgcagtcctataaacataattattgaaagccgtatgagtagtttctatatatatatatatatatatatatatatatatatatatatatatataaataaatccttctacatagcagaaggaatatattgtaaaaatttgcaggaaaaaaatatttctgtaatttaaaaatagatatcaaataaaaaaactgagcttccatttggtaataataaattttggtgctaccatattttttttatttgattaaatggttggatccgtaattttttttcatttaagatatttcaagcctatcatgtacagaccagttttaaattaatttgttcaaataaaatttttctatttaaaccgctatgttttgagtgtgtatgtgggttggagggaggaggggattgaagggttgttaattcatttggattcaataggttaggggtgtcaaatatccttgtttagagagtaaattacagttttgcaattattgaggagataaatcggacttaaccccaataaaatcggttgaaaataccaaattactttgaagaagaatcataggacttattcttttggtgttgacacaaggtacatgctacatgtatttttttaaagaaaaaaataatcagctgaggaatcaaaagaaaacactgctatctgcagatctgcttattgttgcacagcataactgttttcgcaattcataggaacgtttttcttttttcagggaaaaattaccgacctgagccagaaatttaattgatatttcttccttcgtcaaccgtaacttcgtggacggcacgaagccatcggcgtccacccaccacatcgacgcgaccacactccacacaagccatggaggcgtcactcaccgtcgccggcgccggcgcggccgccttgtctctgcggccgcaaatccgccttcgaatcacccaagcgacccctctgatgccccctcggcggctccaatccggaccctccaagatccagacctccggcgcccgggcccaccttgcggcggcccccgcgtccacgccaccggcggcgggaggcggcctgtactcggcggagacctacgagctgacggcggagaacgtcgaccgcgtcctggacgacgtgcgcccctacctcatcgccgacggcggcgacgtcaccgtcgcgtccgtcgaggacggcgtcatctccctcaagctcgaaggtgaacccctagatttttcttaatccccttgcgcgcgtcaccaattcttggccagaatcatggctgcgagaccaaatcttgctatgcttaccacttactaatttgtggttttgctacggcatctatccaggagcgtgcggcagctgccccagctcgacgacgacgatgaagatgggcatcgagcgcgtgctcaaggagaagttcggcgacgccgtaaaagatatccgccaggtgttcgacgacgatcagcagccggcggagccaacgccccaggtcataattttgccaaggatccccaagactctgtaaatttggagctaccaatgctcattggctggatgttgcaggcggtgaacggccacctggacatactgcggccggcgatcgccaactacggcgggagcgtggaggtggtcgccgtcgacggcgaggactgcctggtgaggtacgaaggccccgagtccatcgggagcgggatcaaggcggccatcaaggagaagttcccggacatcaccaatgtggtgttcttgcagtgagctatccagaaaatttttacctcattggcatgcatgagttaaaatgcaccagttttcgatggctgttcatgtgctagtgaacttgttccgatgtatgttcaggtgcaatctttacagtgttcgcagatacaatacacaaacagggaaacggaatgatacttgcctattgtcacctcacttgaaatagtatttggatttaggggaataatccatatggatcgtcaagttagatgttcaaattataagttttcgaaggtagcaagtagccaagtaggaaaagcccctaattggccaagtattagcgattactactacctagcaagtctgaaaaatctggctattggggatgatcgaactgttaaaaagtttgtctgaatatttgtctgagactgaaatcttagcgagaagagtccttgaatatctgtctaaaaatcttgatgacattgatcccctttaccaccgaaggagcaccagtctgtctataatctggctactagataggatcaacttgcctgaacgtccgtggatatctgtctaaaaatcttgatgacattgatcccattccatttaattatcgccaaaggatgcatcagagtgtctgaaaatctttcgatgtgtgcagtccaaatacatgtatatgtaagatcgaactgtctgatgcatccttggtgatttcagactcgtgcatcaaagaccacattattaaaccctcgtaatgctacaaaaatcgtcagctctggcccgaacagaaaaccaggatatgttgtattcctactgtagatcaatagagttgtacgggcacattaggacctgttttgaggagttttaaattttgaaaagtagctggagaagctagaaaaaccagtttcttgcttttaagtttattttctggattccataactacaactttttataatttaaactaaaaactacactgtttgaagaagttttttattttgagagaggctgcggttgtcagaatcacaaactgcagaccatcagtgtttccaacatttcaggccggtgtcctctatctcgtttagtacaaagtacaaacaaaggagacaggccaccactagaagcgtgatcagttccccaacccaaagaagcccatgttctccggcccagttttgaccgaactttcggaggccgtgcgatgcgaatgcgacctctacggtacaccgtacacgtacagtcttaccacccagtactactcggcccgcagtgtcactgtgacagaacaggctacagagagcacatcgaccgtggaatgcgttccgggtcgcaaggtcgcatgatcaatccattgtcgtcgctaccaccacatcacgtgacatgtacacatatgttatggccgtgtactagccatgtaggacatgcatgctgctcgttcattccaaggcccatatgcctcgcacagtctcagagatcgagtcccactcgagccccgattgatcactctgcccaattgttcgttcttggccgcaaccagacagcatcaaaccgctaaaccagaaaacaatctttttcttaattagtagacggtgactaaccactaaaattaatggcactagtactactagtgtactgtactgctactggcactggcaggcagctccatcggttaacgcatggcgattgccttggttggagcgtgcgaccgtgcgtgcgtgtgcgtgtgcatctgcaggtcaaaccaagcgaaggcaggcggccgcgcgcccggccgcccggccggctcgcgctcggtgtcctcggtgattaggccccgcgcgagcgatgcgttgcacgatggtggtggcgcgggcggagtagtcgtcgctagggaggatgagttttttttataatcgggtggtgcacgagcaagtggtggtgttggtggtgcacgtgaagccctatgcggttcggcgttgggattccaacaaaatattttcgcgggaatggcgctcggatccgcccatttacgccgcgcggagcggacgggggccggggcccctttatttccgttgccgaacggcggcacgggacggacggatggatggatggatggaacggccggggcggcgccggcgcggctttggtttcactgcgtcacacagcgagaagggacgtttctacagcgggggagggtagtttaggctgtgtttagttcagcgtaaagtttggattttgattgaaattagagatgatgtgattgaaaagttgtgtgtgtatgacaggttgatgtgattgaaaaggactgaagtttggatccaaactttgaatctaaacgcagccttactgcctaccaccggtcaagccgtatgcgatggtttttcgtcggtgactgtattgttttaattaccccggttttagttgcggtgctggtttgggccagatgtgaccacgtcggtgtgttaaggtttctgtatttttttaaacatgacctaggtggagcaatcttaatagtactcccttcattctaaaatattaacgtaactgtgtatccagatttatagttaaacgttgttatattttatgattgagagcgtgagccgtgaggcggcaaatttaacctaaccgtgcccaatccaacgccaaccatatgaccggatcaccccggatcttcaaccgaagcagctgccttgctcggcccttttttactgcacttgcgttgctctcggactattcataccaagtgctcgggaagctcacacgctagagaccactaggccagcgcgagcgcccagctatagcccatcgatctcttggaaaagcctgagatcaaatcccagcttaactccccaaagatttcctgactccaaatctccatccgctccgcagctaccttctccccatatatacacgcgcactccctcccccctctccagcctccatgacccctcctcgctcacctttctctcttgcctgagccaagagctacactttctatatccaccacttcaccgtgcaaaccccatgcacacgccttgacagaagctgagctagcttctcctgcgtcgctgcaagctgctactttggtgcgtgtggtttggttaagttcgtgtactggtgcaacataggttctttcttctaagaagagactacttggttgtagtcaatttgtgtctgcgttttgctaagcttgcttgatgccgttttcctgcaggttcgtgactgaaagccaaatggaagatacggatcaggagctatgcaccgttgcggtaagaacagcgagttatctgctatatctctttatgtttgagcttgcgcactcaagctagcgctagctattattgtgatctcttgtgttgatcttctttttatctgtctatcaggtggagatgatgagttcaggaaaactcaagccatgtagacacttgttgttctatcaagactcccttcaccgagaagcatccataaaaatggttcatgtttagcaatagcacggtgttatcctaactgagcttttcttctagccaccgtccacatccttcttcaaaacctcaacatcactttgtgtgggaattaaaaggaattggtcttcttgaccttgcaagaccttttcttgaccttgtaagacccaacatcgttgtgttgtttttcttgtttcttatttttcaatttcatccacctcttctttctacctcccatctttctcctagttcttgccttctctctcggtctatccctcctgagctgtattgatcactttctatgttattttctcgatgtttaaaagaaaattaattttgtttagcaatatacgaagagattgtgaaattctagtatacctgtaaattgtaatattattgcttgcgtgatataatttgtaatattattattgcttgcgtgatataatgtatttctgcagtcagagtgcagctgatagacctaaggatgtttcctgttaccacatgtgaagctggaaatctacctgtaaggtagcttgacatgtatcacatcatgaacggaataagttcgctgtgtgccactcgataacgatttggatctttgccgccttgctcactgttgggaacaagtactcgtactcgttataacactgcatatgcaatacacggtttatgtgctgtcatttcgtttttgttatgcgccgctacagaaggttcagttctgtctcaaacttttgtcacagcactcgactgtgtactactcgatattgtcctttctcgcccatatacttcgagtttttttttattttgcaattacatggatcatcgctttagttcgcggcttaattagccatttactaaacatctaggcctactgagacgaagtttatatgaatatatagatcgacctagggaacaagtgtactcgcgataaaataaagaattgatcaaatactgatactaccgtaccttcgagatagcagcacaatcctgacctagcagaattatattgggccgtgtttagttacaaaatttttcttcaaaccttcaattttttcatcacatcaaaactttcttacacataaacttttagtgtgaactaaacacagccgattcagctaagagtctaaggaaaaaagaatatatagccattcatgttatacgtacctctagcatgcaaatcattacagggggtcaattgatatagcagtaagatgtatcggaaatttagagtagtcacggtatatcgagcagtccaatctataacctcccgttattatagcaggattacagttgatgaatcaaaacattgccatctagtcatgtatttatccttacaaatcttaaatgccaccacttaattatttggcatttgatctaccgtgtctgctacacaaattctactcccaattattccaattccaaattggttccaaaggatctatgttttagagccgtgcataaacataaaaaaaatttggttaaagttactaacttatcctcagttattacaccatggaaatgataccccataagatgggagttttaattaaatcgtgcagaagagattaagatagttaaaaagtattgtgtcactataatattagaaatgaataccctatttactcataggaacggtataatgcgttcaattgcatgatagggaaaatggtggatatctattttttaagttaaaaatgggggatgagctactccaagttttagtcttttagagaagcgttgattactctaaaattttgaatcaatagggattttgaaggtttaattaattgttgcagcaaaacagggaggtctgaaataataccatgcatgcaagtaatagtgatacagaaagtgtcaagtagctgttctgacttaaacagaagagagacaagatacggacaacttaaacaagaaaccaagcaatatgtacacactcacgtcactttaggaaagaagtggggaaggttgctccacaacacttttcagtcaattcattaatcattgacaccacgaattcttcagaaaacgggaacgcgtagagcaaaatgccaaaaagcagctcttacatctgtactgttggcaatactcaaattagcccattattaattaagtcattatcagtgacaccaatgagtataaatactttcatgcacttagtaaaatttgcaacagtatctgcattcagttctcagaactactagtctgctactctactctactactacaaaaaatgtatcagtaatttggagtctgcccctagtgtactactccattgaagcctggtatcatagtggcagatcagacaggtacgtctaatttggcagggcactctcactcaagtctgtacagtaaatgagccattgaaaggcatgaatgaagcaacctaccgttctttcacagcacaagatgcatgcataccttccattcttgctaccatgaataatgggtgttacataaaatgggaggatgcagaatgctacaacactaacacatgctttattgatgcatgccgttactgcatggactgattgaattggttgaattgtggtgctcttcacatgggtaagattgtagtgtaagagactaaaatagcacagagctcaaaggctatgaaagtatcattgccttagacttcactttcctgtgtggaaaccaccaagagttgtccaggtattcaatcaaaaaataataaaagaagaatgaagggaacaggtattcctaaatacctaaaagaaataggggaaataagaaaggaaaaactttagggttcctttggactgaaataatttcaaagaaaacctggaggatttcaataatccttggaaaatttttcctacgagctcctttggaacaacggaatataaagttctacgaatttgcttcctatgtctcaattccatagaaatctaagcatgagctcgtatacctctttttattttcctttgagaagtcccatgctctctccctacctccctacctccctctctctctctggccgtgtttagttcacccctaactactccaaacttccaactttccatcacatcacatcacatctaaaacttttctacacacatgaacctctaactttttttccaaacttccaactttcctcaaacttccagcttttttcaggaactaaacacagcccctctctcactctctctctctctctctctctatctatctatctatctatctatctatctatctatctatctatctagtatctctcttccacaaaacaatttcctccaaagtttctatattttatttgttatgaaccatccaagcgtataaactgcttgtgttttgaaaccctataggaattcctagtctgtgacatcctattcctacggtttacttgttcatgcgatttagaaatactgcattctaaaaaggagcccttaatctacacattagaattcaaaatacggcaggatatatgtagtctccaggaagcatgcaaatcaaacacccattttcacaaaattcatgtgttttcaatcctctattttgtgcatgtatccctatcctattctattgtttttttccctattcctacgttttttcaattctacatttcaaaaggggcctgaaagttaatgcaaatactcaggctgttatcaaggctgtgtttagatggtggaaaagttgggagaaaattggtagtttggagaaaaaattggtagtttatgtgtgtaggaaagttttcgatgtgatgtgatggaaagttgggaatttgggagaactaaacacgacccaagttatatgaggtctatgatctcaattccatatgtggcacttcaattttcatgtcatatatgtgccactttcagcgacaaacatgagattaggcaaaattttaatggtagacagggattttatccgaataaaaaaaatactccaggaacaatgctcctcagtccaccacttttcaagtttaagcgtcatcaatatcacaaaaggtaaaaacactacattcttttgtacaaatttttaagatgcaagaaaccacaagcaatggcattcctgactgagctttttatccaccggatgcacattgttatagtttgaaagaacaagtttcaaaagtcccaactataggaaaataacagagaacacggagcaaggtaaaacatttagtaaattgaatcaactaatcaaggtcccctgttagatgcctctacagttctttttaatttcatatttttttttactttagagatgaaagattggttgagaacaagtttaatagtaaagccaactatgatcttatagcttatattagagttaatatgtatagtaaatgagctataaggttatctgtattttttttctcctcactctagctctcacatatgcatttaatatattcatcttaaagtatgtgaatagttagttaactcttgcatgagccaaaccttttcattttcaaattctttcttctctacatataagcttgacttatagtctactattaaacttgctctatgaagatagaggctatacagaaacaatagagagaggataacagtgagctataagcctactataagcttatgtggaggagagatgtaacccaaaaaaaatcaagggtattggctttcatgcaagagcttaacacaagctccaagacatacattaaatgtataagtaaggccgtgtttagtttcccccctattcccaactttccatcacatcatatcacatccaaaactttcttactcacataaattcctaactttttttttcaaactaccaactttcctcaaacttctctctaatttcaggaactaaatacagcctaacttttccatcacatcaaaactttcctacacacaaaaacttacaatttttccatcacatcgttctaatttagatcaaacttccaattttgacgtgaactaaacacacctttaacatgacagccatgaagctctatggacatttatgaggtacccaccaccaccatctgtcccctctaaagagaaataacaatcccccctatataccctggcacaattggacagctactacacacagggggtatagttttgtccttaaatgcctttttgctctctccctctgctggaggattgtagacgcagcgacatttacgcaccaaaacgtttgaaggttgtcatgcatgcatgcatgcttgctaagggcgcaaagcctgagttttttcagctcagaagttagtagtaagtagacaaaatggattgaattcaaacagtgaagcgagcagccactgtgcgcaagcaacagataggcaagaatccacgccatgtccagaaacagttgcaagaacaggagcagtgacgagtttagtagcgaagaaaaagaaatgctactgcattttaaactttgcccaacagggagactcagaacaggcattgaaagcatgcaagactctggagggtattactgccgcagcaacccgactagtcaaaatctaatgcatgcatgcaaacggctcgagatttaatggtccatatcttttgcatcttctttgaaaagtgaactcttgcaacatgttctcaaaagatagcctcacactctcttggcagcagacatcaataaggtaggttcagttcatgatcgatttagactaatttacaaacttcaccagcccccaaaacaaaccctcctcaaatgacatcgatttagactaatttatgacactccatgatctatggtttaaagtaggctgtgtttagatctaggggttaagatccaggggtgaaaagttttaccgtgccacattggatatacggacacacatttgaaatattaaacgtagacaataacaaaacaaattacatattccgcttgtaaaccgcgagacaaatttattaagcctaattaatccatcattagcagatgtttgctgtagcaccacattgtcaaattatgaagcaattacgcttaaaagattcgtctcgcaattttacacgcaatctatgtaattagttatttttttcatttatatttaatactccatgcatgtgtctaaacattcgatgtgacagggtgaaaatttttgcaaggggatctaaacatgccattaaatacagtataagtcttgcatcaatgtcttatctttatttttcatggcactagctttcaaagacttaccatactttagtttcttcttcttaacgtcctccagattttgttgaatgctcttctgctcccccaccactgtattcagctgatcctgcagagcagcccagtgatgcatcatgaaatgaccataaaatgggtaacgtatgatcataaaattgcaccataaatattgcagttcctagagtcgctaccattcattcaaaacaaaccaattgcaaagctaaagatcttgcttggatcttatttgtttctgcaagggagacctcgcagttccaggaaccgcctggctcctacgggtgatgtgaacaagacataaatgacagagtagatcagcagggtagcaactgtgccctcccagtgcattttgaaagggtttaccccctatagctagtagtatgcaaagccatgattgtgttatgaacttctgatcaacaaacagtaacaaaacacctacatattaagtgaaagccgtgcaatgtaagtgcatttaaaagtggccaggcagaccagtggtcaccatttgtcaagtcagtttgtgcagaagttaaatgctctatacgcactgcagagaaaaattaagaccgagtatgtccaaagcatttaacttaatgcgattttttcccggaaagccattagattgcagcagcaattacagtaagtactccagatatgaatttttacctgttcttttaagtggcagaggatgcatggagcaatcagggatgttaaagagggagcatcagtgaaaaaaaaaggagcaatttcagatcttgactgcagtcgagtctttactactaaatgtttgaacaggacaggacacacacattagctggctgggaagaagaccttaattggtatgaatatacggacctgacagtttaacccatgactgcttgctcctaaacaatgctggatgcaacagctggacggcatgtctggccctcatcacttctggggactcagtcagctgaaataagaatcaccagctattcttatcagaggcaagagcaagaacactgtcagaaacattctcccatatattgattacaaagtggcaatatttacatcctgtcagtttacaaccggccaatcaacttttgatcggcttttagtgtagtatgcaatcatgatttggtagaatgtacacacaagcgttatcgatggattaaccacaagattgccaaaataaccggcataggtggccaccctggtgaagtaactatgctaactagagcaacgtaaaaaatacaacgaagtagaatgtgcagtgcccatcttggtagtcaagcaccaattgtggtactacacaagaacctgcgaccttgccgcacgacgggagcatttggttcgggcactcttgttcacactgcatgcacacccttccagcagctcgagatcttcctcacaaatcaatatggatgccaattctggacagtctaaaagcattttagagctaaggtatcctgcaatcgtccaagtttgatatagccttgactgcttcccaataaaccttcctgtccttgtgtcataatattctggccacttgtcctctgagagtctcttttctgcgacttcaatggctcgctgtgctaagtcacgcctacccatcttgatacaggctagagtgaactaaattaacaaatacaaatgattaaacatacaatcggtggaaaaaataatggaagcgttaacaaggttagtgatatatcaattttagatttttacctgccatagcaatgtaggccaagatccaccattatgatacgaccagggcctgtatgcaataacaaaggtataaaaaaatagactcaaatactgaagcaatgcaaatctggttaatgctaataatacttcctgacaaatttaggtttcaatatctgcatctgcacataacaaatgatgtagtcatcataaaaaagagtttttcagttgcttacgtgtttttagggtcactgccagtgatgatacgccattcctcatactctagagcagggtagcatatcttgagtggcatatttgcaattatatcctcccatttggcttcaatgaggttcaggataccctctgcttgcctttgagtagctagagaagagataattgcccagagatttccaagagaaaaaaacctgaaatccatgtgagccggttgtagatttcctataaggtaaccacccttttcaggaatccaatctgcaagccaagaaggtatttgttctggatagatattgaacttattaatagcatcatgggagtactcttcagttttgtagcgataaatttcatttatcttcttcatatcaacccaatagtactctcttatgtgaaacgacaaagcactgagcctgtagttgatggcacggatcaaactgttagatccgtcatttacactgaccatttcacgggcacaacgcaaagcagaatagaatagcgactgcaaaatagataccactaggtcaaaaaccactacatttgagttgtgagtaggacttgcagtgaagaaaaacaccagtctggtactgaaagtctgagtttgtcaaaatcattatcaagcattagcttacctggatctcaagaggatgcccatggattcccatccgtcgatcgatcatacatgatccatcagtgactaacaatgttgggaacatgtcaaatccatcagacaagcataaattcaggattagtctgatgcctgtctgcacatcaaccctttcttgtagtgcatagtctccagtaattttaccatatgcccgcaacaggattatccaccaaagaccttataaaaagaggatggtataaaatatccacgtaataagtagtaagagtatattcaaaagtataatatgaacctatctagcttactcacccgaatcaactggtgctacacgtccaatggctgactctccaaagtcagggtcaagaacctcctcaaatgcttcactgtttccatctagaggtatggatctaactttgaaactagcaggcatcaatccctgaccaggactgtagcaatcaactgtcttctcccagctctgataggttaaaccaaacaaaaaaaaagtgacttttctttcaaaaaacaccaatgatcatcataatttatatattttaagaatgatacaaaatttaaaaataaaataaaagaaaagaaagaactcaactcttatgctaccaagcctaccatagatgagctagcagcgtaatgtgatgaatcatgacaaatgaagcatcttaccctatcctgtacatagaaacatagaccatggaaatttggtcgatactggtctcagaggtttggatacgctagtggatctatttttgaagttatggaacatgtttccagaataaggataagtatgtcttttattttcaaaagaacatattcatgttgtgatttattagttagagcttagaacatacttgtcctagagtgttaaaccagtgttaaccaccttacaaaaaccaaccaaagtagtagtgatttttaacagtcccaaagtcagttggtaatatttcagatttagaacaccacacaaattttggtgttcgagtattccagatttgcaacatggtatctctttgtggagccctcactacagaataccatgctctagctgtctcgaagtagtgcagcactcttctttcttttttgatttgaatgggttatggctagcacttgtgatgctaaatggtaacatcatttcttgcccctgtcccttatactgtagtatagacaagtagacaaccatgtagcactacctgtagacagccataccaactgacactaatgattcttgacttcttgagtattggtagcaaacttggtcatgcagaaatgttgtcttgctgtcttgcatgaatcatcaatcctatcgtgttctaattttagatgaagcttagtatgtactactaaatgttatgcattgcatatgaataaaaaacaattaaaagtgtattttaagacaaggctgagaccattatggtcatatcactaggaatgggcctaggaaaagaactagtaaatgataacctcaagtcatgcacccttgccaaaaatgaaaagaaaccatatctgctccaatagttacatttaaataaaccacatgaacttttagatcaacaaacaagaatatgtcatactcaaggtgccggcgctacaagattatagtattagtattataagtataacagaggcatacatcatgacaaatgtacattagtggaaatttagaaaatatacaaaacacatagattcagatccttcaaaatcctcatacgcttaaacaagttgttgtttgaagtcccaccaaaattatgccaggttgtaattgcactaattttgtgttatttaatactcaagttttttaagcaagtttctggtgcaagaataattggcattgttgcaagagatgcaaggatcataatctacttgagggtttattagaacaattgctggtgttatctagcaaaggctaatgagaaacgcctagggttttccggctagctccacaaggtggtgggctagacgacttgagttcgaagcctcaccccttctaattatttgatattaggtccttccctaatattcgcgtctagaaagacataatatgtgctactttgtgcagaagattttctttccacactgaaattgcatcagaatttgtgttatttgatccataataacgttttaatagcgcactgaacattattaccacggctacatttaaaccgaagatgcatagaatgtactactgccacggcccacgggtaacatagcatttattccgatgtttgtttgggcgactgacctggagttgcaaagtgtggagcaggaagttcttcacgatgtccccctcgcccttgaggaggaacgcgatggccgacgggacaaagtctctaatgaacacctgatcgtaattgagcatctggttcgcggtggatgggtcgttcgccgccaccgtccccacggcggtgccgcagtagctcacgaccgagcggccgagcagactccacgcctccttctcctccgtcgactccttcctgctcctcaccgtctccacccaggccttcagaccctccaactcgtgctggcacgccgtcgccaccggatccttctcgggcgcgggtagcccaggctcttcctccgggggaggagtcgcgtcatcggggagctcctcgatggggggcgactccagcggcggggccgacgaggcgaggctggcggcgcggaaggggtcgaagagcggcggcttgtagctctcccccgtcgaggacgcgccggagtccaccgacgtggagagaaggcggcgggctgaggcggcgaccgcggcgaggggagccacccccgcggcggaggaggaggagaagcggcgggtcgagaggtagaggagcgcgcgggcgtggcgcggcgcgccgcggcggaggtgggagatggcggcggccgccatcggtggcgatttggattgcggaagaagaaatctcgctgcttcgatcggattcggtgggggatttgattcgccgacggaggagagagtctctagaacgggtaatggcgactgcgatcaactcgttaacaatggggtagtttcagtttaggagaagtgttaaccttagggcaaccgcgagatcggacggcgtaggagtgaccacgtatatggaggttattctgtccgtaattaacacgggccgcgggacggcgggagccgaacatgtggcgagcaagccgtggcctcgtgggtggcggcgtgtccgcataggaggagaagcaaaattcgcattggaattggcgagcaagcgacactgctttcatcgctggcaaaacaaatagtatcaggttttcttaattaaaacacggaaaatcatccgaaatcaaggcggtatgggtaatgggtttatctaaaatccagaaatacattgccttcaatttaaacaactaacatgtccgtgctaacgctacgacgttatttataatgcaaagcaaacaaccaaaaggtaacaacatatgtttcaaaaagtttctaactccatattcaaacaagatcacaagtatcattcccaaaaacattgaagaaaatctaaataaattaccttctggagtcttagcatcgacatcatttttaaataactaaattagctacaatagtattgcatcgcgctggtggaacattaatgtcttccatcttagaaaaaacctacccatcaacactatcatcactaccagcgcaaccatctgcctatcttagtaaaaagcaagcaacctgtccatcgtaatgatgtcttctttgcaatatgccacgtacttcatcaggatcctttgggttctcccaattctctcaagcatcgatcttcttgaatataccgccatcataattctttgggtctagactggagagatgagccttacatgaattcaaaagaaaactaacttacagaggctacacatgaattgtttatatatatatatatatatatatatatatatatttgtaaatttacaaatagttcttcttcatttccttttcacaatctttgccatgtacttccggcacaaattcaatggttaattaatccgggtccaattacataaaagcatgaaaacaaacaatttgcttgaaaagttcagaagtgaaaactggaagctattagtgcagattaaatcggagcacaatgaaaaatccaaatacactccactaaaccaatttaattgcaaggttacctatatggcagccaaaccccttaaatgcttagacagatccctagagagtagtagaaatccctaagaaaacatgcagttgttggttgctaaattatgcttagcatcctaattacatacttacggcaacatgatgatggtgttttaccacctcctgctatttttcattttgcaccctttcactcgtttgcatgcctccccagaaattggtgcagcaaacacgatcccatctacacctccataaagtaagatttggttcttttgacttcttctagagcatggcaacattggtttctaaatttgttaaattcagaaatggtctctctgtatcatgtacttttgttttggtccgataaggccttaaaattttgagttatcagtgtacagaatgcattacccagtgatgatgtagaactggtttaggtgctgcagctatcaagactgaaaattttccattgagcattctagcaatctagcacagctaacaactcattaaatgaacatcactgatcaaaatgcaacagatcaaaggcactggttgatatcgcatcgtactaactcaacgtagccacgcgtagcagaagcctaaaccgcgctgccaccggagcccgtcgcggggggccgccggagcccacaagcgtacgagcaacagtgccttccgtaccaactacatcagccaatggaaccagctcccagaaacaccacaacaggtaaaatctcattgttttttcagggttagcctgatcataattttcagtataatgttctcagcccgaagaaccttaggttgagtattgcatataagtatttatcatgggaatagagtagtatcaaatcttaattcagatgataagagtgctcaggtgtcgatctgtgcaacattattctcacacaatgatatcttcataagcttctgaaacttgaaaatggtttgcagagttcctgccaaggaaaaaataaaataaaattgtgccatcagtaacattggaaacaagagctctatttgatcaaagtcacatacatctagcgccaacagtctatgaaggccaatatctgtagcacgatttaataatgctcaaaatgttagatctgctcaaaattgtggtagcatgttctttccaataaaaattactgaaagtgcatctaggaccccacatttgtttttggtgttaatgacaacacaattagagggtaactaatgctttttgttgagatgtctgcaaggatgaaaaaggagtggaacttaagcatagaaagctttgtggcaatttttgtggtaaccacctctctaaaccttgtgtatcatgtgttcttgagtattagaatgccgtactattaagagggataccacatgcatataattggtagaacactagtgctcaaaatcctttatttgaagtgttcctgttttattcctgtcggactatccgatctagatcagactatccgatatccgatctagatcagactatccgaaatttcacagaactttgccctctgtcattggtctgagtgttggcaaaaaaaaatatcggactatccgatataaggtcggactatccgatacatcggactatctgaaattttcttagaacttcactctctgttttgaattgctttttattcctcttgagtgaatttcaaatcagactatctgatgtgatcggagtatccgatgacccagagactccgaaattcaatggaactttagtctctgtgagaggatgaaattcatgattcaaaaataacggaatatccgatatgacatcggactatccgatcgatcggattgtccgaaattctccagaattttgttctctgtctttggcttgcttgggggtcaaaaacatcggactatccgatgtcacctcggacttttcgaggtgggatgaaaagattcccttctgctaatgaccaaatttggtaaattctatcattattggcatcggagatgaagatcagatcgaagtggaatccaagatgaagatcattgcggaaacagagtaagaatcggctgcagtccaaatcagctaaggtcaggtcggcagagttcgagtcggatggggctagccgatatagctgattctgataatatgactaggtgtacgtcatcgggttcaagttgatgtgcttcaagatgattgccacgcatggatagagtcctgggaaggcaattgtatctattaattaggatattctatgtgatttccttagagatatgtttgggcaaaagtctgccgtaaatacttatggtatcttagagtttgttagagataatagtcgtgtccgttatggacgtatcttgtaattctcgggtataaatagacccgagccctatgtaaaaagtgagaacacatccaatacaatctcggcgcatcgccaccttttttgctttacttttatttcgacgagttcgtgctctcggattgagctgcatcggtttcgatcttcaacaagaggtaaaacttgtcatgacgacttatgttctcaggattagtgcttccatctttatgacactataatcttgtctatataattcgtcgagttatcatatatctcacataatcttcgataatatctttatctaacctataatcggctaacatctgctaatggaaggcagccgattaggttagacaataacgttaacttagattatgtgatatatctaccactctatgaaacctccagcggcttgattgtctagatattgttcttcttttcatacttaatgctgcatcagttgagtttgatctattaagtcatgcttagaattgcaatctctagcctgttttctggttgccgattagggtagtatcggagtttcagctaatcttatttgatttaactacttttatcccatatgcttaatctatatgttaaatctgccctttatgttaagatcttgtcgcatctaagtatattaggcttatgtttggtatattctacttgctttaacatcttaatatagagtagtatcggagtattagccgatacatgctagatctacctgatcggctatgctataaatgtatataatcccactattaatatatatttcgatctaagtgatttatactgtctcggcaaggcgaccgatctatcccaatcacttgatttaagtatacatcgatataaggattatatatcattaatatctacagccgatcgagtagatttagttctgatttgcttattgatatttgccaatcgatgtacgcatgacatcggcttgaaataaatgatatgtcatcggcacctagccgatcggctatcatttataggattaattgcggtttatttgttctatctcttgttgattgcaggatcaaatcaactggcacgctcatacatccgaaagcgagctttggacctgcactggagttaagcagatctcccaggcctcgtgttttctgtcaacaccttcccaacggccacattttgggggatctataaatacccccacctaactcttttctagggttacccaactcattcattcacattcactttgggttgagcttggtgctaaggtgctttgaatctttgagctctttctccctctctcaaatccctcttcgttctttgtgtggtggatcttagtggttgtggatttggtgtttgagggcctagtgtgtgtttcactcgatcttgagcactagggtttgaccaagagttgtgtggtgtttgttactcttggaggttgaggactcctagacggctaggtgtcactcccgagccaccgatctacgtgtggttggccgggagaagtttgtgaaggccggatctcgcctccgcaaggaaagagataccccttagtggaaggaggagtgcttagtgcaacctcttgaggaaagggttagtaaagacccggctcttagtgagctcctcaacagagagtagaatcctctcaaggatttgaactccgggaacaactccgtgaacttcatcgttggtgatatctcttcatcttctctttagctttgcttaattgtgccgctatagatctagtcgctgtttgcgctatactcttgtttgtgtgttagatctgcttgttgtgactctttagtggatcagacagtctgatccaacatcagactatctgattttttcggatagtctgactgtggatcagacttttcgaccctaactcagttttagcttccacataaagttttaaattagcctattcacccccctctaggcctaattgaccctttcaaatacaacacagagatcagttgaagtacaatcgcattaattaaagtacaatcagtagtgccagttagttctagctaaataaaaaattcactaaagtttccatttgaggttgtttaacagaggaaaaaaaatctaatgtgacaaacttcatttagagtaactttaattcactgccttcatttaaatacatttgtaatccattttcaatttcatttagaccgttcatacgcagtttaaagcgggatgatgcaccaacccaacgtaacctaaagtaacttggtttagacggtttgggccaacgtctttcacgagttaaaccgtcttcatcttcctaacctgtacacaataacgaaccaaagaaaatgagaagggacacgatcatgaccgacctcaataagaagattatatcaactggagcaatgtaggcacttagaaaatcatgttacgattctagtagagggctctccgggcggctaatggagtgggaggggccttgcagccgcacaccgcccatggtgctagcttgcctagccacgtgccgtcgctgccaccgatcttagtacaaagtgaggcagatgcgatgtcgatgggtggtgactcgtggctatttgcctacttcccgcatcaagtttattcattaccacgcgcaatcacaacaacaagatcaccttcgtgtacgactgaagcggcgatggtgcgctggcatgggcactgagtgacgacatcatcccaggcttcatccatccttttggcaacatgatcgtcactaaaggctccaatccaagaactctcatgccataaccacggggatggattccaaggtcagctcccagatcatatggttttagtccaagcaaatggttgtacgcgacattatccttcctggttagcgactcacctcattggtcgagagcgtaatgacgagactaacaatgagatgactagctacaatgatgaagggaatgtagagactaagcacacggtttggacgagttttagagtagcccaccacaacccatgtataactttgatctggattggtttaccggtgttggcgatatggcatgaggcccttcgaccaaacctgccgaaaccagtaagaattcaagcccgaaatgtcaaggttagtcagggcgaagcccccctccctccaatggtgaagactaggaagcaaggacggcgagaggcagggaatcacgcgggtacctcgccaagccagaggcctcctaggcgaaggatgtagggcgaagagtatacgccgaagggggtcgacttcgccatagcaagattcggcctcgggaggaccgaagaagccatcctggcccatcaagtctaagggctaattgggtcgacaatcacttgacggcccgttaagggcccatgaaacacaattacactgtgtacccatgtaaatgtccctttcataagggcaaccatgtaaattctcctgtataaccaaaaccctagtagtaagaacctataatggggatataaatagccccatagggccatgtaatagggggatcccaagaaaaattatcaatttaatacactttacttctttcccaactactgttgagtgaccacgtctttcgacgtatgcggtagtcgtttcgacaacagctggcgccgaccatggggatttccgagcgaaaccactgagagcaaatgccaccgaaaagggtcgtgaaggagaaggttacaaggcgaaaggaaagcgaagccgaggtggagatggtcgccgaagagggagcagagccttcggcgccagttgccgaagatggaggagcattgtctgcctccgcacctgcaccatcactactgccttcggctcctgccacctctgcgcaggtgctgaatgcggctgacatggcgaaggcagccgcggcggcaagggcactccagaccaggcggagatcctttcgacaagccaactgctggtgctccaagccgctccgtcgcagctggcagcagcctcgattgcgctcgccgctgtacaagcccaagtcaacccagaccccgaaacacaaatcgaagccgacatggaagccatgcgacagaacatgacacgactccaagacatgcttcgccaaatgcaagaacagcatcaggcgtatcaggcggcgaggcggtccaaggtcgcttcggccccagtcctccaatatttggcaagctacgtcccaccccaagtctatccacaagcaccgatccagccccttccgccacaagttacgcaagcgccagtatacttcaccgggcagccctcgaccgcagcagtgcatccagctcctcacgtgcaactgcaggctcagccggtcgctgcccaagtacaccctcaaccgcctggccaagtgtcacaagcaatggcagaatgggcttcggctctgcaggcgcagctccaagctttccttcagcatctcagctaaccccacagcatttcaggtacagccccttcggtccacccggaggggaatacaagtcaaggtgcacctagttggttgccgtcgaatcagccaggtctgggggcttcgccttggagtcaaagaccgcaattcgacttcatcaatgcccctcaggcaccaaccgttcggccgcaagcaccaacgccaggcttcggagcaaaccaagcaccaaatcaggtcgccatagcatggtcccagcaaacgttcgacccatccatggcggctcaacaagcatcaccaatcagagccgggtagccgaatgccatggcccatcctcaggcgcaagccgtgatttcacccttcgccacgccatacccgcagcaaggtgccgtgaacagggcaagagccgaaaagaggctatcgctgagtgggggaatcaagacccatccaatcccaccccagttcaagttcccacccgtccaacgctactcaggcaaaactgacccaaaggaattcctctccatttacgagtccgcgatcgaagcggctgatggtgacgaaaataccaaggcaaaggtaatacatctcgctctagacggcatcgcccgttcttggtattttaatttgccagccaatagcatttactcacgggagaaattgcgcgatgtctttgtccttaactttcgaggcacctatgaggagccgaagacacagcagcatctactcggcattcgccagaggccgggggagtcgataaggtagtacatgcgtcgcttctcacaagcccggtgccaagtgcaagacataaccgaggcgtctgtcataaacgccgcttcggccgggctactcgagggcgaactcacaagaaaaatcgccaacaaggagccacagacgcttgagcacctacttcgcatcattgacgggtacgcaaggggcgaagaagattccaagcgacgtcaagcaatacaagctgagtatgataaggcttccgtcgctgccgcccaagcccaagcacaagctcaggttgccgaaccacctcctctcgctattcgccagcctcagccgacgatctagggacaaccaccaaggcaaggccaagcccccatgacctggaggaagttcagaaccgaccgtgcgggcaaggctgtgatggctgtcgaagaagtgcaagccctctgcaaggagttcgacacccagcaagcaagcaaccatcagcagcctatccgtaagaaggtccgaaaagacctctactgcgccttccacggacgctcttcgcataccacggaacaatgccgaaacattcggcaacgtggcaacgtgcaagatctaaggccgcagcagggagcagctgtcgaagcacctcgtgaagcagctgaagaacaagcacccccggccgaatagcgccaagatgcgcagcgcagagtaatccaagtgattacaagggccgacccgccgatctagctatcgaagtgataaaagaagatgcagctccgaatggtccacaatatgatttcggcgggcgaaggggccccgaagtatctgaaccagcaaatctcttttgggccgggagatgccgaaggagtaatgttcccgcatcaagatcctctggtgatctcagctgagatagctggcttcgaggtccggcgaatcctggtcgacggagggagttcggccgatgtcatcttcgccgaagcatatgccaagatggggttgcccaccctagcccttaccccagcaccagcctcgctccgtggtttcggcggagaagcagttcaagttcttggccaagcacagttgctggtagctttcggcacaggggaaaacagacgtgaagagcaagtattattcgacgttgtcgacatgccgtacaactacaacgccatcttcggccgtgcgaccttgaacaagttcgaagctatctcccaccacaattatctcaagctcaagatgcccggcccggcgggagtgatcgtggtcaaggggcttcagccttcggccgcttcaaaaggcgatctggccataatcaacagagcagtgcataatgttgaggccgaaccacatgaccgggcgaagcacgcgctaaagtccgcccctcacggcaagataatcaagatgcagattgatgacgccgaccccacaaagctcgtatcgctggggggcgacatgggcgaagaagaggctgcgaacattctagaggtactcaagaaaaatagtgatatcttcgcctagggccctaatcaagtgggaggtgtttcgatagatctcatcatgttcacctggcagtcaagccggacgccaagccaaggaaacagaagctgcgcaagatgtccgctgatcaccaagaagcagcaaaagccgaagtccaaaaattgctcaaggctggggtcatccaagagatcgaccatcctgaatggctggcgaatccagtgctggtgcggaaatcaaacggcaaatggtgcatgtgtgtcgatttcacagacctaaacaaggcatgtccgaaggacgatttccctttgccacagatcgaccaactcgtgaattcaacagctggctgcgaacttatgagttttttggatgcatattccggctatcaccagatacacatgaatccggccgacatccccaagacagccttcatcacaccgttcggcacctttcgtcatctcaggatgccattcggcctgaggaatgccggggcaaccttcgccaggctggtatacaaggtcctttacaagcagttagggcgaaatgtggaagcttatgtcgacgatatcgtcgtaaaaagctgcaaggctttcgaccacgtgtccaacctgcaggagaccttcgacaacttgcccgcagcaggtatgaaactaaatcctgagaagtgtgtttttggcgttcacgcaggcaagttgttgggtttccttgtttctgaaagaggcatcgaggcgaatcccgagaaaatcgatgccattcagcaaatgaagcccccgtcgagcgtacgtgaagtacaaaagctcgcaggccgaattgcagcactcagtcgattcatctcaaaggcagccgaaagaggtttgtccttcttcaagaccctacggggcgcgggaaaattcaattggacacccgaatgccaagcagcgttcgacgagctgaagcaatatctgcaaagcccgccagctctgatcagcccagcaccaggaatcgaaccgctactatacctggcagcttcgctagtggcagtcagtgctgccctcgtccaagaaatagagtcaggccagaaaccggtctatttcgtctccgaagaattgcaaggagcgaagacaagatacattgaaatggaaaaactcacttatgccctggtgatggcttcacgcaagcttaaacactacttccaaccccatagagtcatagtgccatcgcagtaccctttgggcgaaatactccgaggcaaggaagttactggccggcttaggaagtgggcagcagagctatcccctttcgacttgcattttgttgcccgcactgctgtcaagtctcaagtgctagccgacttcgtggccgaatggacaccggcattcgtccccgagcccgaacccgtcgaacaaccctggatgatgtattccgacggttcgtggtcgcataagggggcgggcattgcggcagtactcacttcaccaagtggtgtgccgattcggtatgccgcaaggctgcagttcaacacaaccaacaacgcggcagaatacgaagccattcttctgggcctaagaaaggaaaaagcattggggattcggcgcttgctaatccgaaccgactctaagctggtggcaggccatgtcgacaaattctttgaggcaaaagaagaaggaatgaagaggtatttggaggccgttcggtctctggaaaagtacttcaccggcataacggtcgaacatttgcctagaggccagaacgaggaagcagaggccttggcgaaatctactgcttatggtggcccacattcgcctggcatcttttttgaagtactatatgcaccaaggtgcccatggatagcctggaggtcatggcaattgaccaggtgaaactgggcgaagatccatgcgactagcgaactccgtttgtgaaacaccttgaaactggctggcttccgaaagatgaagaagaagcaaagcgtctgcaactcagagccacgaagtataagatggtctcaggccagctatatcgctccggggcaattcaacccttgcttcgctgcatctcttttaccgaaggtgaggaaatggcgagggagatacaccaggggctctgtggtgcgcaccaggccgcaagaacagttgcctccaaagtgtttcgacaaggagtgtactggcccaccgtgttgaaagtctgtgttgagcaagtcaagaagtgtgaaagctgccaacgccatggccgaagtcaaaacgcgccccagtatgagttgcagcccatcgcaccaatctggcccttcgccagatggggattggacatcattgggccgttcccggtggcgcgaaacgggtacaagttcgcaatcgtatccgtcgaatacttttcccgatggattgaggccaaaccccttggagcgatcacttcggcagcagtacagaagtttgtatggaaaaacattgtttgccgtttcagagtgccaaaagagttcatcactgacaatggcaagcagtttgactctgacaagttcagagaaatgtgcgaagggcttaacctggaaatcaggtttgcgtcggtcgcgcacccacagtcaaatggggcggccgaacgcacaaacggtaagatcctagaagcactcgaactcttggaagaagtaagagtcgaagcactcgaacacatgcgcaactatgccataggcacttcggcaacttacaataaaaaagttcgaccgacggagctgttgcctggtcatcttgtcctacggaagaaggcgaacctgactgccgttggcaagcttgaatcaaagtgggaaggaccatacctcatcaagaacaagtctaggatgggatcctttcgactggcgacactggaaggagaagagttcgaccattcctggaacgctgcctctcttaaacgtttctatgtctagaacaggtggcacccaaatcgccaatttgtaaaaacgtatatatcgttatgtaagcccttcggcactatgtaagcctttcggcaaagaaaaaaaagaaaaaaaaagaggaaaatgaaaaaagacaaaaaaaatggatgtagggctattatccatcacggaggcccgaaccagtataaaacctctgtgtcctccgccttctttttatttacttgtgtgattgataatttgtggaaaaactccaaggcaaacgcctgatcagcgaaaaaggccagggggcgaaacgaatcggccgaagcatcgctcgccgaatgttgaaaccgcaacagcttgtttcgggaaacaactaaccgaacaccgttacactcgatcaaaaggaaagcaccaacgcttcctacaacatagaacaaaacggatcgaaatcggaagccgaaagctgaaaagtcaaaacctatttcgctaatatacgcaaaggggccgacacgttccgacccaacgaaagcacgcgaagtgacaatgcaaaaatagcgaaaaggagataaaacacatctttattgattttaaagaaaaatatatcaaagagtacaaacccatcaacatggtgcaagtaaaaggagcaatggcttcacagcccaacttacagataaattacatctccgtccccacaatcactctctctctaaggaatgatcaggcgaactaggttcgtcatcactactaatatcatacacgaccctaagaggagaagggggcgaaacacagactagactataacgacgctggaagattaactcccgccgatcagttctttgatgatttcgccaaaagcgaaccatatcctccagacgtcttgtacgaacaagatcgtagtcttctagggttcgcctggggtgcgctcttagccagccggcaaccttaaaaaccttatagctgcggccgtttatcaccatttcgcgataaacaggccgaaatgggcattgcaccctcggcaaacccttcaacgccacgaacttctcgttgttgtttcgccatttttcagcgggaggtcgaacacatacctttcggccgcaagcctgctagcaaagcacaaaaaaaaggagaagtgcaaaaaaggagggaaatatagacgaagatcagttccgctttcaaacagaacaattaaataagcgaaagggttatactttgccagtagaacaaagactatattgaatacaaggcgaaggcggcttaaagctgaacaaacaaaaagcttatatacaaaaacttaggctacaagaaagcccgaaagggccgaaggaaaaaataaaataaaaagacacgagggcgaagggtctcacacctcagggtggtcttggcctccgtcaccttcgtcctcgtgcccgagggaccgttccgacggcccgggatcctttttggagttgacagcggcggcctcctcgttcctcgctatcctttcaaggttctcgcggagtcgaatcttcgcacagtcccggccgccatcctcccaaaaccgtcccggccgccatcctcccaaaaccccttccgaaaggcccttagcgcagccccggagcactgcgtattgctaggccattcctccttcacgaaatcaggaaaattcccgatgtggtcgcagccgtgtgtgtgcaagaggctgagaacgaatcccgccgaaacacgagcgcaacagtccccataggcgcctgccacttcgacaaccgagccggccgcctcctgcgtccattcggaaaaatcgagcacagtcccgccttcgcccggagcaccttttgcccgagccccaaggtcgttaagggccagctggagagtgtaacaggcctccttggcagactccgtggctggtaccagggtcgcggcggcatctttggcggacacaagacgggcttcgaggcatttaatattctccttagccgaagcaagttgtcggtcctgttcggcgtcctgcttgcgtgctgcttcaaggtcagagcggagagacctattttcagcattcgccttcttcaaagtctccgccacaacgcgtctttcgtcttccttgtggcgaagatcttcttcggatttgcgaaggcgaaggcggtacccatccagtcgctctaaggcggacttcttggcacttaggtgcgcggcaaggccctggtaaaaaaaattacgtcagggaactggcgaaagagcaaaattcgacgcttaacaataaaaatcatacccgcacaaataggctttccacagccgcgcagctttcgctgaactcgttcagtttggtgaagagcccaaggccttcggttggggctatgacctggcacacaccgtccacgaacggagtgatctctggccgcgtggcgaagtcagcggggacaaaatgtggggcggtaagcgtcacgtccgaaacgctcgcttcaaccgccggggcctttccctctcgttgacgaacaggtgaaggaactgcatcaacccgttcgtccttagcaacatttgccccagcggccggggctgagacactcccacccgtcgccgcttcggcatcgctagcaggtggcggagacatgcgcctaccacgggaagctgcgcgccgtaaaaccggcgaagtaggagtcccgtcggacccctcgttgtccgaaaagccattgccgacctgcacaaccttccctttcttcttccttctagcggtcatcaccggtttcgcggctgtgctggagatcgccaagagggtgttcgccacgacaatatcttgcggccgtgtaggcgcaacatgagagcccgccctagatttcgcaggagtaggactggggtataaccatgagagccgtcatccttagaaccagcctccacatcttcctcttcctcctcatccccatcactttcgacggcaaccttcacgctgcggcgagttcgaacttggtcgcctttcacgaccgcacgcttgtgcttcttcgaagtgccaacttcatcatcaccggcccgagagggtttcgattggcttggaaattcgccggtataaacatggttcacccggccgtcggcttggcgctgtagcaagcgggcgaactcggccgtggttagagctctgatcatcttcgatgcctctatttcggcgtcttccaaagcccgcactgcgaaaagataggaacacaaccgtttagtctaaaaagcgcctccataaaggaaatatgcggcctagagcaaaaacaaaaatcttactttcaaccccggcagggagaacaaggcggggaagcccaagaacttcttcgccctcgatcacggaaacgtcccacacacgagcgagaggggaaatccgaagcagacaaaactcctcacaaaggtcccgggtgcttagccgccgggcaaccttacgaaggagtatgagccgggactcgagagtcccattgatttccatgtttggcttcgcgttgatggaaacggcagaacgctaaaaaaggagccagttcgcctgggcatcttctgcgaagtagggactgctgacgtagaaccatttctgcatccagttcctgtcccacttcgccatcgatgcaggtactagccaagcatctgaacgctccggccgcagcatgaaattcacacagccgaaaacggttttcctcggacccgccggcgtctgcacgtctttggtcgaggcgcatgcagtaaacagagcggcaaatagctcagcggtagggacgaacccacaggttcggcacatccaagcgaaaaccgccagcttcaggaacaccgacgggctaagctggggaagcctaacctcatacgtcgagagcatcgaaggcaagaagttgtcgcatgtgaggcgaagcccagcggcgaagaatgcgcgcgaagacaaccgttcgcccatccccaagcgagggaacaacggcttcgcccccgcatgatccttggccctccgtgagagaaccggatgataccagttcgcccaagtcggcctctttgacaagtgatttgccaaggaagcacgaccatccttcgccaaggttgccaggatcttcgccagttgacccggccttggtaggcttgcgaggagccatcgggctcgtagctcaggaaagaaagggaaagagccgataggctaggggcacgatgatggcgaaaagctaaaaagcaagagaatgaagagagcacgaagcgtgtcaaacggtaaaaaagggagaacgtggggggagtgaaaaaatagcaggccagcttgggggtatatataaccccgtcgcgagaccgttcgcctgccaaccaatcgagccctgacacgtgtccaaggacagacgaaacggtaaattcccattgggacggagccaaacagtaaaaagcccgattacggagaaggaaaagtccatggggcccattactattcatagtaataaaagagactaaatagcccccttcgacgctttgcaacggatgcgaagaggagattttctcaagaaatttttctaagcataaaaacaaaacaaactttactagcaggaacaatataggtttcggcaggagcaccgatcgaaagggggcgccacataccataccacatagtttgcacggtctcggccgaagctcctatcttactcttgctcgtgaggggcttgttggcgatatggcatgaggcccttcgaccaaacttgccgaatccagtaagaatttatgcccgaaacgtcaaggttagtcagggcgaagatccctccctccctagcgaagactaggaagcaaggatggcgagaggcagggaatcgtgcgggtacctcgccaagccagaggcctcctgggcgaaggatgtagggcgaagagtatatgccgaagggggacgacttcgccatagcaagattcggccccgggaggaccgtagaagccatcctggcccatcaagtctaagggctaattgggtcgacaatcgcctgacggcccgttaagggcccatgaaccacaattacactgtgtacccatgtaaatgtccctttcataagggcaaccatgtaaattcccttgtataaccaaaaccctagtagtaaaaacctgtaatggggctataaatagccccatagggccatgtaatagggggatcccaagaaaaattctcaatttaatacactttacttctttcccaactactgttgagtgaccacgtctttcgacgtatgcggttgtcgttttgacaacaaccggtttaaccgggttggatccaacctgtgaacaacctgagttcaagtaccaaactcgtttgtactcatatatgatttccacccctttttttctacttggctaagaactagcgcaatcgctaaaaagcgatcagtcgcgcgcctcccctcccgcacggcgcggccacgtggcacgcgcggagaggggggccgcagtggaatggcgcgggagcgccacgtgcacacgtttctccttttttctttcccttttttcctttcggtttttcttttcggtttttctggttttttttccctgatttggcgtttctctttttttttttctttcagtttttttctttttttctggttttttccctggtttctttcggttttaaacttatatgtatataaattttgttttcgtacgtatataaagtttgtatacatacgaatacaaagtttgtatatgtggtgtttttttgttttttttcttggttttcggttttttaaatatgtatgtatttacgtatacaaagtttgtatgcacgtatataaagtttgtatatgtggtgtttttttttcttggtttttggttttttcaatatgtatgtatttacgtatataaagtttttatacgcatatacaaacacaaagttcgtatacaacagtgtagtagtagtactagtagtatagtactagggcctgtttggtacagctccaactcctaaatttagctccaggagttgagtctggagtggagttgtggagctgactaaacccaactccacaactctagttcattttgtgagatagctccacccaactccactcccagttttggtggagctgaaactgtttggctgagcttcagcttcaggagggctggaggtgtgccaaacaggctcatagtaacagtgtagtcgtactactagtagtagtatatgagcagcagtagtagtagtaggtggtatatgagtagtagtagtaggtggtactagtagtatatatagtactgaccgtgcggacggcgggtgcccaatcgtccattagcagtccccaagatctagccctcaagacagaacccactagcaaaacgttttatacttaacctcaatttaccaatatttttgtaccgtgtaaggtattcccgtttggactcggatcgtcacagaacggaaagtctattttcgccttaaaagaaaagaaattgatgtctatttgggcctcaggatactgggcctacatggcccatatactaaaaacatccagcacgcggaaaaagtacactgaaggtccctcaacttgtcatcgagttacaaaatcgtcctccaaccacagaaccagatatccggcgtcccttaactaaccaaaaccagtcacaatagatccttcggtggttttaaccctggttttatcctacgtgacgactgagtcagcatgggacccacatgtcagaccgccacgtcatttctctccccacctcttctctccctttctcggttcctcctctctctcagtctaaatgcctgtaggccggtcggcgggagagaaggagggcggcaccacgacggcggctgctccgcccgcggagacgacgcggtggtcgtccctggcagccacgaccgcgagcctcgtggcgatcggcctcggcggcgccgcgctgctggtgtggtgggtgctcgcgttccacccggcgaacgcacgcctctggatggtgcctgcggggctcgtcctcctcggcacgcccatcctcgcatggctctccctttgcctgtacgccggcccgtgcactgccgtccgcgacgcgccggtgcacgtgtaggatcccccgcgcgagtctcgcgcgcgcgcattttttgctgcttccagctgctccatttcgggatcagatgtacatacatgttcagtgttcactgctaactagtcatactatacttctttctttgatttcttgctgattcatttcgggatcagatgcacctgcacatacatgttcactactattttgatttctttgtgaattcagctgcgagctgcagcgtgttgatgctagagggagagggacatgttgcattgatatggacatatggtatatatgacctggtgtacacagttgctttccaagattacttcctccgtgtgtgtgatatggtgaatgcgaacttggccacctcctgcgcgaagtgctccgcctcgtgcgccgctagcgccggcgggctccatgagccgcactcgaacctctccagcgacgccagccgtgacacgctgctccgccgcggccaccggtgtgtgacacgctgctccaccgctgcatcgccctcgtcgtcgtgcggcaccatggacctcccctcggcgcaggatgcgctacgtgccagcgcgggggcggcagcgcccggcgcggcgacgtagtgggcaagcgcgaccgagtgttgccgcgcgagggcgcgcatcgcctccatggctttggcggtgggctcttccctttcctcgtcaaggatgggaggctagcgctgacgaagttgggctgccggagtggcggcagcatcggcgacgaccgcaccaccacctccctgcgtgcaaataccggcgaggcggacgacgaggcgaacccccggcggcggcgaattgagagagagagagaggaggaagggagagaagaggggaaagagagaggatgtcgtatcgtcgccgccatgtcgcctgcctcctcctcctctcccgccttgcccagcggcctcctccccagccgcacgctgctcctcgccgcctgcgcgccgtccctcgccgtcgcccgccctgcagctccttcccccaccgccgccacgttgcccgccatcaccgccgccatgtcgcccgtcgccggccgccgacgccttcctcctcccgccggctaagtcagagaagggaaagtgagacgaggaagggagagaagagggggagagagagagagaggaggctgacgtgacagcacaacgctgactcagccgccacgtaagataaaaccgacgtaaaaactaccaaaggatttattgtgaccggttttagttagttaagggacgtcggatatctggttttacggttgggggacgattttgtaactcgatgacaagttgagggaccttcggtgtactttttcctccagcacgctgatgaaaattcataactgaacatccataattggacctcctgaccgtcctgggcttcagtctcgccttctgtccaccaccaatcaacaggcataaaggcctactcgtgtgagctgcagttaattttgaattctaaaacttaatttgaaggtttcattttgacgttctcttttttaaccttagattttgaattactgtacaaaaaagaataactctaaaattgccttttgttactttggtcaagtatcctccgtttacagcatataaaaaatgcatcccaagccggctgataaagtggcgccccacctggcgagcgaactaatcgaacatcacacccttcgctcgtagtagtagaaactacggaatacgtatcgatgcctgtcgtgttgaacgagctaattaattaaccaatggcacttaccgttattggaccgcgttgacatacgtacgtactcctacaggagtaatattgtagtgtgcgcccctgctaacttgtccttttcgttgttttgttactacggtcgggcttgccacgatcacgtgccggtgggataatgaccatgtgatagttaaaagttaatccatcaagtggtgaacgataattaataactgtatcgaatcatctccggtctaactaaacaataaattcccttaatttacttccgatagaaattaacatggtatttttgcctatggtctgaaaaagaatgatatgtactcccttaatatgttacatcgttgatattttagatacgtttgatcatttattttattcaaaatattttatacaattatctattgtgacttgatttgtagttagctattctttaaacatgacttaattttttctgtttataaaaataattaaataaaataaatgctgtcatatattagaaacggagatggtatttgttaaccgttaatctggacgaatacgtacactgtagttaagtgcaaaattacttgaacgggaatgagtaaactacgtgtgacaaggtattttaatttgcacagaggatgcaacggattccatgtaatttgcttaattacaatagaaacaacgcatttttgcaattgatctatatatatatatatatatatatatatatatatatatatatatgtgtgtgtgtgtgtgtgtgtgtgtgtgtgtgttaataagtatagccgtggatatccatgcccaacgtttgaccgtccgtcttatttgaaaaagttgtgaaaaaattaaaaatatttagtcacatataaagtactatccatgttttattatctaatagtaatagaaatactaatcataaaaaaagttcaaataagacgaacggtcaaacgttgaatgtgaatagtgcaaaactgcactaaaatctccccactaattttaggacggagggagtagactaaatgtgacgacgcagtacataggagacatcggacattctgatgctcatgatgtatacaatctgataagactaagtacaatgacacactacatactccatccgttccaaaaaaaaggcaaactgtgagttcccgtaccaacgtttgactgcccgtcttatataaatttttttataattagtattttcattgttgttatatgataaaacatgattaatactttatgcgtgacttatcattttaatttttttatcattttttcaaataagacgcacggccaaacgttggacacggtaaccaggatttgtcttttttagggacggagggagtaagaggcaacggcaatcccatgagacaacgtgcaatgacgcaatgcaatccgacgttaatctggttagttttaacaaggtactaccatattttaatgtatgacgccgttgactttttacccaacgtttgaccattcgtcttattcaaaaaattatgtaactattatttattttattgtgacttgattcattatcaaatattctttaagcatgacataaatatttttatatttgtacaaaattttttgaataaaacgaatggtcaaacgttggtcgaaaagttaacggtgtcatacattaaaatacggagggagtacaatctaatgagactgggtacaatggcacaatataatccattgaacgtgacaacagtaacccaatgagttctaataacaactcgcccatgcttgacaaggtaaaaggctactttcactctcaggggcggatccagcgtaggtgctgggaggactaggtctcctctaccctactggatcaccattcatagaaggagagagtataaaactcaggtgtatgcaggaaagcgtcacggtggacgcagggtttcgtgttgattcacaatacgcaaaaacgtgctgagtttacagatatatatgcatgcagatgtgttggttcggtgatcctaattacaagggattagagtcctatcctctatctatccgaaccaacatgtatccgtgcatatccatacagagaatgataagatatgataagatctaacactcctcctcagtcctaactctttctaggttaaaattgttcttgaacatctccatttgtcttactggtatagcttttgtaaaaccatctgcaacctgatctttagtagatatatatgcaatttcaagcaactttctagctaccctttctctcacaaaatgaaagtcaacttctatatgctttgtacgagcatgaaagattggattagcagaaagatacttagctccaagattatcacaccatagcttggctgctcgaggcgattctactcccagttcttgcaacaaaatctgtacccacataatttctgctgttgcattagccagagctttatactcagcttcagtactagaccttgatactgtagcttgttttctagcactccatgatacaagatttgggcctaaaaacactgcaaaacctcctgttgatcttctgtcatctggagatcctgcctaatctgcatctgaaaaaccactaacaagcagagagggattcctacagaacttaagacctgtatcaactgtatatttaacatatcttaagatcctttttacagctgcccaatgagttgtagttggagcatgtaagaactgacacaccttatttatcgaaaaagaaatatctggtcttgtcaaagttaaatactgtaaagcaccaactacactcttatactgagtagaatcctgaggtccaagcaatgttccctcatttactgataatttttctgaggttgacagaggagtactgaccggtttacactcatacataccaacccgtcgtagaagatccgatgcatacttctcttgactaagcatgagaccatccttcactttatggacctcgattcccaacaagtagtgcagatcaccaaggtccttaagagcaaagtccttgcttagttcctgcagaagtgttgaagttgcatctggtacagaactggccacaataatatcatcaacatatatcagaagaaatatagaaacctgtcctttcttatagaagaacagtgatgtgtctgcctttgaaggtacaaagcctaactcacttaacttagtacttaacctggagtaccaagctcgaggcgcctgtttaagtccataaagagctttatctaatttacagacatagttaggcatagacttcttttcataccctggtggttgcttcatatagacctcttcttctaggactccatgtaggaaggcatttttaacatccaattgtctaagactccaacctctagagacagcaagagacaaaactattctgatagtagcagctttaacaaccggactaaaagtatcctcataatcaatgccatacctttgcttgaatccttttgcaaccaaccgtgctttatacctgtctagactgccatctgctttccttttgaccttatacacccatttacaatctatgacatttcttcctttctgaggaggaaccaaatgccatgtcttgttttctatcagtgccatgtattcagcatccatggcctccttccagtgtttattattcactgcttcttccagactctgtggttcaccagaagaagtaaaatttagccatttaacagttccatcagtatataccttttctttcctgatcccgctttggagacgtgtttttggtctgatcggtgcaacagctgcttctggcatggcctgatcagtttgatcagactgatcagtagtcacatcatcatgcacgccagccgatgatgcaacagatggcgatgtggacgacgctgtttgtggggacgcttgcaccaggtgctcctcctggattggattgccatgctgctcagctgccgacgccgtcgcatcatctgtcacaggcgaagagtgctccggcgacgcatcatatgccacaccatgcacgtcgtcctgtgcaccaccatttgctgctgctgctgcattttcatctgctgctgctgctgcatttttttcaccgtttgctacaatttcttcaccgatttctgcattttcttcaccaaactgatcagtaacattaggcggataattaagcacatggttatctgtttctccccctaatgaaagaaagatgcggaaccaaggatggtgaaaggaaagatatttccgctctaaggcgtgcgccggcatttgagtggagttcggagaaaggaaaaatgctttcatcaaaggttacatccctggagacatagactctgcctgtggcaatttctagacacttgaaccctttatgtaggttactatagcctagaaaaacacatctcttggaacggaaagctaatttgtgtttattgtaaggccgaaggttgggccaaacagcacacccgaatattctcaatgctgtatagtttggtttttccttgaacaattgttctaaaggacatgcaaagttgataaccttgctaggagtgcggttaataaggtatgccgcagcaagaacagcttcgtcccaaaatttaattggcatagatgcatgtgctagtaatgtgagtgcaacctcaatgagatgtctatgttttcgttcagctgaaccattctgttggtgagcataaggacaggaaacatgatgagagatacctatcttagcaaagaaggtgttgagtttttgatactctccccccccccccaatctgtttgaacagcaagaattttgtgaccaaaaaatctctcaacaagagtttgaaactcctgaaacttttggaatacttccgacttatgcttaagaaggtaaacccaagtaaatttactataatcatcaataaaactgacataaaacttctttccaccaacagaaataggagcagggccccagacatcagaaaaaataagttctagaggttgacttgacacacttgaagacttaggatagggaagctgatgactcttgcccttttgacaggcatcacaaattgagtctttatttgctacggtagaacaaggtaaattattcttgctaagaactctagtgactatgggcacggctgggtgtcccaaacgactatgccatcgggagaaggaaggagttgtggcggcatggacttgcttggcaggtgatgtaggaagggagtagaggcgacggcggcatctccccttaagaatcgtgttcctcgtgactcgatcctttatcaaaaaataattggaatgaacctcaaggaaagcaaaattatccatagctaaacgatgagcagagataaggttctttttcgcttgaggaacatgtaaaatatttttgagatgtaattcacgagtaggggtatgaatgacagaatcaccaatgtgcttaatttccatacctgcaccgcttgcggtgtgaatcttgtctcctcccttgtacttctcccgaacatctaacttgtcgagttcgttggtgatgtggtcggttgcccctgtgtcgaggtaccaattggtgtcgatgccatatgcagctgctgcagccgcactcctttcatcagggacataggtctcatcgtacctatgccaacactctgcagcgacgtgccccctcttcaggcacacttggcagatggggcggtcattaccaccccgagtctgatttcctccagtgccgcgcccacgtcctggagcagcaggattgctgcgcccacgtgtgccacggccgccgccgcgaccacgctgaaaaacaccacggcagcgtgcggccgcgttcaccgaagcatgagcttgccgaagagcttgcctgttctcaaagttaagaagctgagagtacacttccgccattgtggtcgactcattgcgtgccacaatagcagatacaacaggttcaaaatcatcatctagcccattcagaacataagcgactaaatcttcctcatcaaggggtttccctgaactagcgatttcatttgctagtgctttcatcttgccacaatactcagatatactcatgttacctttctgggtattggtgagagtaagccggacgttgagcgaccgggctttggtttgtgcagtgaacatggcgcacacctgctgccatgcctgcgccgccgtggatgccgtcgccacttgggtgagaatgtctcttgacagcgtggagagaaggaagcctaggacctgttggtccgaggcaaaccactcctggtaggcggggttgacgatcttctccgtcgtcttgtcgctcgccgtcttctcgatctccatggatggagcggcggtggcgccggtgatgtggccatcaagacgggcgccgcgtatcgcggccagaacttgcgccgaccagagcgcatagtttcctttggtcagtttctttgaaacttgaacgccaaagagaggattggtggaggcagtgcttgacgaggaacctgccatcacgccggacttgcagatcacgccggactttgaggctctgataccatataaaactcaggtgtatgcaggaaagcgtcacggtggacgcagggtttcgtgttgattcacaatacgcaaaaacgtgctgagtttacagatatatatatgcatgcagatgtgttggttcggtgatcctaattacaagggattagagtcctatcctctatctatccgaaccaacatgcatccgtgcatatccatacagagaatgataagatatgataagatctaacagagagaagggaaaaaaaaggaggggaggggaggggaggggagggggggagtgaaggaggaagaaggagattagttcccatataatgttttttctggaactgtccctattcacatcaattgctcaactggctaggtgagcacttatctttttaaagtagctcactcttttagaactagcaaaggtgttattaaaagtttgcatgcatgtatctcatgggttgggattttaatattctcatagaaattattctctacataggtcttggatcacataataattaattccaccagttaagcctctaatcgttttagactgcacggacccccggccggactcgacgcgcgtgccaaagtgcgtactacggcgacacgttcgagctgttgagcaccgcgaggagatcgatcgattgatgctcctctccgaagtgaagtactgacgttgatatatcgatcactctcgatacatacgtatatgatcaccgcacacaaaactaaacgtgcgcgcgctagctcgatcgtttcagtgagtgtggtacgcgtactgtcaatcaattatgcatgcatggcgcgccgatcccacatccccgaaggccgtacgcaagtcggtacgtggtcaagttgcccacctgagatcaaatcgcatctcatcccatcgcatcccatcgcatggtgccctgctgccgaaggcaaagccatgcaacttcatcccaagcccccaccccccgcgcgcgcgcgcgtgcccgcgcacatttacctcgccaccgcgtctgatcgatctcgcgcgcgcggttgccggagaaatccggcgtgtgtgcgcgcacatgcatgcggtcgacgggcaggtaggattttccttggcgtgtgggaacaccgcgcactgtatcgtggcgcctgaacctactgagatgtggagaggcacatacgagagtattctgcagctcgattgctactccctcctactagtactagataggtataggcgctattagccaaagctagtggctgagaccgcgaggaggccggctgggctcgtgacttccgcgcgcgccaagctaaggccgtaagctaagctaggcgtcgtcgttggcatgtggaacccagccgaaccggagcctcaaattcccatggaagcatccacgaaccttctcatcgcacacctcgctcgatctcatatccccgaaagacagtatgtgtgatgcgtgctttggggcactttgggcttacgcgagggatcacgagctagtacagtggtccatcaccatcgatcacatgcgtggtggtcgtcacgctaaggtagtttgtagtgtaagactgccggtgccagttgacaagtatactcctatgtcaaccacaattgcatatcgtgccgtctttaggcaaatatcgaagttggatttatgctgatatgggagagaaaatgggcaaaaagatagctttataagtattgaccatcgtgcattatcgaagaaataagatgggagggacgacgatctttctctgcagatgttcgataaaattgaaatggtacatactgatatatgtctaaaactgaagggatgacgtgcacaggtcgaaaaatagtcttttttttacccggcgaaaaattcttgcctagatcgagaagatacaacaagctcatcattataaagcatatagtacatatcgatctcttcatgaattaattagtaatatttcaactaatagtctctgctattattttcatcaaaagaaatattatcctctgttatatgcatgtgtttattgtatttgtaattatatttgcacaatattaattggtgttatttgacaagcaagctgctgctacgcaacccgctgattaccatattgtttgtgctggctgcggcgcagccacaacccatgcagtcgaacaactccatcgctagcaagccttaaaaagatagcacatgctatgctatcctttattgtatgacatggcacatatatatgataaaacaaaaccaattaattaagcatggttaagcagctaactgtgacaacccgcaatgcatggtagctagactttttttttctttttaagtgacaccttactatttacagacgataattaagagaccgctactccctccatcttagaaaacccaactttcccagaagttgtttttttcctaggacggggtgaatacaaatctacaactgcacaatctatgttgaatgcaaaaccgacgatttgatatgtggatgcgtatagctatgaatctatatatttatatacatctggataattgcgtacaatcagttttgctcacctgcccgaggagacaaaaactataaaagtacgtatcaccattcaagggaggcaaaataattccaaaataaacagaaaaacggtggggttttggttgttatcagctgatgatttatccatagtctgactagctatctatagctatagtaactggaatacttaaaaaagctttcacgttgatcagaaaaatctgatgttggttagatatgttgtgttaccaaaaatccatagatcacataaaaatcagtgttaaataaaatatactgttgaaaatagcaaagactcattagtttcgttcctataatttagtaatttataaatttgaaatttataaatatgaagtttctttgtattcattttaaagtctcggcttagtttttcgttgtttagtctcaaattaaaaaatactaattattaagttgtagtaattgatatggactcatttttaatgaccacaaaatagttcctaaaacaactaatgtattcaaatacattaaaattttaattaataattaaattttcttatgttcacaatctggcacaccaacaatattgtccttgcaaaaataagatccaactctcacgagtttacgagtagtactgttaaacacatacatagtatacctataactacttttctttctttttttttttgggggggggggtacctagctagctacttttctcatgttcaacctggcacacacgaaagaaaagggcatatagtacatatatatctggccaatggataaatggataataccatacatccataaggcaattttaaggtaagcgatatgcgcgagtacaacgtgccactttgactagttgcagcagcttctgggctctagctgtggcaacgaaagagaaattcgtgatcaggagatccacaacgacgcaataaggtgcaacttgccccatgaattgtcgatttcacaacctcacagcgactttgcactgattcgttgcggacaagcattggactttccgtttcctgcgcctttctgaagtcttttagtttgagggggtacggggtggagaccccctttctcttgataggcataatgcacttttttgttggtggaaattgatgatgcccatagttgctcaggcacagagagatagagaagaaagaactcagctataggtaggatgacccagcccaattcagagaaaatctaatctagatgattgtgaaatgtatggtgcgaaaacactagccctattgacatgtaagttcatacatatcgggtgctagcttaggtctcagttagttcatttatattaattagcagcacaaataacaccgagtgacagcgattagatggataagatcatgcatgctctttatttagtgctttacatgattggaatggctgaaaaattgagagatctccgcgttcttttaacccacaataatatcaggtagtacactttctgctctcctgatgtcattaattagcaatttactaggtaacacgcgctagtgacagtgagtagtggctaatgtaatgtgtgcaccactaaagtgaacaagctaggcaaacagcgatttcctaattaattaatcagcacattcttcttggctcattttaatcacctgtcagcgcactagcaacggggtgaaatgcataagctaggccagaaagattgatgccctggcatggcctgttttgacttttaacttccctagatgaacaaaaagtctaaacaaagagatttgtctccaaatcttgcctacaacaatctccccctctttttctataaaggggcaggagacctacgcataatctacagcaatctcctgtggtatttgattagggctaatgcgatagctttcgtttcctttctttattactgttagagttgtatggcaaagatctgattcttatgctatggtataggattgtttgaaattgagtaatttgtgctgatcacctattcctaccaaagttttaatttaggcccatcttaaaagtattattttcactttgggctaagtaattctgacaaaagttgaagtttataccaagtaacctacatgtcatgcattgtgattaaccatatatgttactgtccatgtatcaattacatgtggaccacttggttcaaagcgcaacatttactaacaatacctaatcaaagtgaaaaaaaaacacgtcaaagataatccaaagtaaaactttgaaaaatatatagtaaaaaacgtaatttattcaaacatcatctctatgattatttgagatcagtcaaccagtcgaatatttgtgaaactctcaatacaattattttgtgtactattacagttgtctactctctccatccctaaatataagagattttggtttgatatgacacatcctagtacaacgtatctagacatctaaatctagatgagacaaatagtatttcttgatcgtcgaaaatatgtacaagcaccggtgattatagcaacagagcctacacaaccacctgactagctttggagttacctccttcattgtttatggtaccaatcgaccttcccttatgtagactctagacaccttaagttatattcgtaagtacgtttttcaaactattaaatgatacatttaattaagaaacttcaaataaatatatttaattatgaagttataattgttaatacataataattatgtactaatcacccacgtcgtgttattcgtggcatagttaagctaaacctagcatggtgctgagttattatctctactttcccaactaacttcactcgttttttgcacgtacgttttttaaactgctaaacgatgcattttttataaaaattttctatacaaaagttactttgaaaaatcatattaatctatttttcaaatttattttagctaatacttaattaatcatacactaaacactgtttcattttgcgtgctgggacacccgagacactgcattgctcaaaacgtttcgaaatggacgatgtcgtacatatatgcgtctccaaagtccaaacccaatcccatctctattcaagaaacagtaccacagtacagtacaatggtacgggtgctagtgctagtgctagactgcccctagccagccgctgcgcgtgcagaagcagaacagaacggacatgtgcagcttgcgacttccgtcgtcgacgaaacggacagacagagtgctagacgggcagtgtcccagtaggaactagaaaagcaaagccaaacccagggaaaaaggtagaggaaaaccctcggctcggtcggccgctctactgctactgggtgtgaagcctcgcaagcggaaaagcgcgcgcggcgagggagatcggcagcacgagcacgaggaggattgaaccgaactacgtctcgctctcgcgcgccgagtcgagtccgcccgcgttgacccgtccgaacccgcccttgacctgctgacgtgtgtggcgcgggcgctggcaccgccgccgcgtctcgttgctcgccagactgtctttaatttgccgggggccacaccgccccccgcggcggcggcggtgcatcgcgttgcgtcgcgtcgcgcggatcttctgctccgcccacgacgatctccgcatgctccgactgcgtctgcgtgtgctccctaaaccgcacgcaccgtgtgaattgtgatagtctgattagtgatttagatagctcgatcagtgagcatccaacttggcacttggtaatcttacaataataattctccttccagaatgaaaagaaaaaaaaatgaaggggtcattttatacgatttgcgaaaattgacttgctggtactgacacgtcaggctcaggccccacatgcctgaaattccacgtcgctggggccagtgacaatgtccacattggtactacgtggtacgtgattatgcgggaagaaatttccatgcaacgcttccatatttgtctgtcaacaattggctcgccgctcgctgtcttgtgcttgggagttcacagtgagcgtgagagcatgcaaaatgcaacacctactcatgccggcccggcgcctgcgttgagtgcaatcacgcatagcgcggttagtaccgtctagttacagcaacaatctactactcgctatacgtacctgcatgatcactggtcttttgtgaaaaaagaactccatgatcactgatcactagttaagcagtcaggaaagttctaatatgtactctccgttccaaaataattaacttttatacgcaaatttagacacagactatatctagattcatgtgtaaaagttgactttgtttttgatagagggagtacttacataaatattttcaaagaaattatatatacacatgttgatattttaataagggcatctttggagaaaactttaacaagtgtagctagacattttctcgctcccctgaatagtctagatatttcgacttctgagtagatagctacataatccattaaatgattggtgatctaaagttggccaacttatctaggttctcatcaattgtgtattcgctgagtgcttctcgcggaatccagctctccaaatttgagtaaatgaatgtctagatgacatgatttctcaatttaagtactactccttatatctctcaaaatataaggacttttgtcaattttatgaccaattaagcagtgagataaaagttcattatgtcccttattaaacaattaggaattggtggctgaatgttgggactaatccatcctggagtataaattaggggtttaaatctgattgcacatgttatataaattatatccaaatactactatatatatcactaagattgtaggacccaaggtataagttaattatttaagggcggggcttgttgaatttccaaagttcttttataagtaacataaatgatcagtccctaaacttgtgggggtggtgtcatttaggtccgtgaaattgaaaattatacatttagatccgtgaactttgtttaatttaccactcccggtccaatcgctctttgacacagctaactgcttaggtgacgtgccacgcaggcaatacttttgcgcttagacccctccgcatcacagtgcgccacatataccctctttagctacaatgacacccgaatccccctaaaaatatccccaaatccttcctccctctcattcctctccttgcacatacagaaaatgatgccctaattaataatcgtcattgttgtgcactccacaatggtcctcttcttgcacaacgagcactttatcaacggtaccttcttctggcgactataagacgaggacgagtttggagaagccatggggatggcaagtgtgcaagcggcactaccccgcctccccccactaattgatccacactgcgctacctcccgttgctaacctcgtcgtcaaaaccctagccgattcagagatatttgggaggttctgtttggaatgcactgataagggcaaattatgtaagaaaatatatacaaagggggataaagtgcaaaaatgttgtctacgtagcgcgtcatgctggcggtcagccgcggtcaaaaggcgattgaaccgagggtgatacactaaaccaatttcatggatctacacgcgtaatttttaagctcatggatctaagtgacaccactccacacgtttagggaccagtcatgtattttgacatgaagagagtaaaaaaacgatgcaaacaactttgaatttttcaaggttttgttagaaattaattcaattcccgccaaactcctctgaaaattctccattccaaagaactgcttagtcggcagatgaggcacacacttcgccatcaaaattgggttacagccatcattccgttgctggcccaatgataatcatttcccgttccgttttaccagttcaacaatcagcgactagtgtgcttcctttttcttttttggaccaattggcgtgctaattcagagatagatagagaaagagaggagaaaaatatcagcgaatcaacaccgagaaaaccttctcatggaagctgacagttcgcgagtggtgcttaggtcggcccagccacgacaatcgcgcgggggctcttttctcaggttttccacttttccttttccgcttcttaattaatacaagtgtgaaactacgaagaggaaaatgtggctagcttccatgatttattttaaaatattttggttcttttttaaacattttttaggtatacccttagaaaaaattattgtagtaatggatcacttctgacgctagtcaggttagtgccatggaagtggatcagtgatgaatctagaatgaaatttaagtatgtgctcatatttatgtaaattattttagcggcaaagtaaatatatatatgcctatcattttttaaactcaattaattaatacataaacaaaacaaagaaaataatgaattgtataataaaatcatgattcgaaactgttggtgtggtccatggccatgtcaatagtttaactgtatggccaaattactttattggtttttgaaacattaaaaataattcaaccaaaattgacaaattggtattctcaacgtttactaattggcacatcaggtacaatctcagaatctgctcatcaattatgtgataaggattaacaagctaacaagaaatttggttgattaatctcacaacttttaagttttcaccattctcattggctcttagtaatcagtattgcattcttgcttgcagtggctgataggttggagggcagatctggcccttaagccccaactatgaatccgcccgttgagagggccagggggggaggggggttgggttcgatataatgccgttggcggagccattggatctcggtgctaatgaggttggtacctaaaaatgattcatttgttaatacgttttttccctacaatctattcataaaaaggtttttaaaaagatcaagatgtaaacaattcacgctagctccccttttattcttttagagaacacacactctcgctctccattttcactcccttttaattcccttttccttatctgtgttttgaggtgatgcatgcaacgccgcttggctggctgggcccacagctcagtcgcatgcaagagtgtcgtagtgagcgtagtagcagcaagcagtagcagtagagctcactcgctcgccatgcgcgtgccgtgcggatggtttttagnnnnnnnnnnnnnnnnnnnnnnnngctcgacatccacttgggtttcagggctttcagagctgatcactcctgctctgctaatgctaacgttaatcgtcactctcacccctcccctcgtctcgtctaaattatctgaacctgacgaggtgatgagttgcgaaaacaacgtgtgtagtgtcacgcagaaggccacgcggatcatcacatctggggagagcgagccgtgtcgatcgatcgatccgatgtaacagcgcacgcgatcgatctgcaccgaattctcgcggtagaaaacatccgtgtcggcataaacaaatcgaagcgatctctcgcaaaacgctcgctcgcggtcgcgatcagcgtaatgataaccaagccagccactgcaacaaaaaacacagaaaaaaagggagaaggatcgagtgcgcgaggatcacaattagcggcgagaaatgggccggggatattgtgtactagtgtaccactcggctcgacactggagcatgcaaagtgtagtaattaatcaagacttgacgtcggagctttgcttttattaccggtttctagaagtgtacagtaatcctgtcaatcctacagagttcagctcgtacatacagtagtggcagtactgtatttactcaaaaagaatgagtaaaatttaacggacaaactttagtaacagcagcatcaacactagtataacggctacactttaacttctttttttttaccctaggaagtaaaaaaggagaaagaaacggaaaagaactggagttagaatagtctgggagctaggagtccaaaaatggcatcgtgaggcgattaatcttgttctaatcccccagatagcttctctccttcttctaatccgcttctccgctccgctacgcgtccccggcggttgtgcacccgcgggtgtcgcgcgcgcgcgcgctcgctcgccgcggcggattcccatggcggccgtgctgacttttcacacggcggcctgggtggggcaccacagctggtcgtcctccatgctcgtccagaagctatcgacgtcgaagccgccgatctcgaagtccgcgacggcgaggtcggggaaggtgaggccaggcagcgacgactcggacgtcgtccacgtctgcccgccctggcacggcggctgggccagctccagctccgtgtcgcgcatggccacgccgccggtggcgctggaggcgtcgcaggcggtggtgaaccactcggcgccgtcggcctgcgtgggccagctgggctgcgccccggcgccggagtccgtggacagcgacgacgacccggccgtggtgctcgacagctccggtgcaggcgtgccgcccgactgcgcgccgccggccgccgcgcagtactcggctggccagcagctggcatcgggcgccgggagctccggcgactcgtagagcccgtcggagccgccgtgctgccacgacaggggcggcgtgtcggtgccgccttcctgctgctgctgctgcccggcggcggcggcctggatgcgctcgacgaggcggggcatccagaggtagcgcatgacgtccttgaactgctggctgttgacgtcgcacttgagctgcttggcgtgcttctgcacccgcgtgcgccagtagttcttgatctcgttgtcggtgcgtcccgggaggtgctgcgcgatcttggaccagcggtttccccaccgcgagtgcagctccaggatgagcagctgctcctgcggcgtgatgttgcctcgccggaggtcggggcggaggtagttcagccaccggagccggcagctcttgcctgtgcgtttcagccctgcatgacaacaaccaaaaaccaagattaatttttctcttcacgtcacatcaaaatattcacatgtagtacaccattgctaaaacatagtatgcagcaactaatcaattatatactaatgcagttatacgcatacgacgacggcaggatggatgatgtaacgggggagggatgagcaactaaaaatatccctatgaacaatgctagctacgctgctaaccactaaaaattctctcccctttccctctcactcactatagcttctagcttagctggttggctgctagagaactcagggtagactcgtagctatctgtgtttccagaaatcagcatgtagatgcaagagcgactggtactttgcgtcctataattgctcatcaggctaagcatgtacggacactcagctcatggaattgatcgatgtgtgcgtgcatgtaatttatggtggaattgggagctcgatcgatcgagatcgcgatcctacctgctgatcgggcgagcgagttccagcggccctcgccgtgcgcggcgatgtagttgacgagcaggaggtcctcctccaccgtccacggcccgcgacgcaggtcgccgcccatcacctcctcctcgctgctcgcgtccctctcgtgcgccatgtccatcgtcgaccgatccggatcaaaatccctccctttcgagtctcgatcgatcctcgcgggccagtcgattgatcggatagatcaagctagtagctagatcgagctcaggagattctggttgttgtgctttggtagaggggtactatatatgcgccgttgctgtgctctctggatagatggatggatggatggatgtgtgctgcgatgaaactggcgggagacggggagggaggtgtcggggtttatatagacgggaggagcgcgaggaggaagaagaagaaagaagaaagaggcgggtaggctgggctggacgacttggaaagaaaggaccatgtgggggagaacgccgcaaccggggagattagtttacgccttttttgaagtttttttttcccttcttcttctttaaaagccaaaagtttaggcgattaacccccatcgtggttaattagggataatcatgcgattaggattaattaaccacgccgctaatttaatcgcccgcgtacgtacgtacacgggttggagagactcgggggacttttgcggtgggtttgacccgttgactcgtccagctgtacaggcgtacagctcactcgcgcgcgctacacgcgctcgcgccgtctgcctacgcgggcctctgccgctggggcccacctgggtccatttctgtcagccagttgggagctacctcagcttctagttccggtgggaaaagagatacggagtaactacgtataccttatagccatggaatacacaactgatgatggtacagatatactgccactagcgtatactactacttactactactagcagtattggagcatctgtggcaaatgggcacaataattgctgctgcacaaatcacaaatactagtacgtatactatcggtagtgtagtacaccggtacggacaagtagtggtattatcgcaaacatgcgtgtacacctctagtacagtgcgtctgtgcatcaccatggttctacactccagtcgtaggtggtagctggagtatattataaaatatcagggcatccacaatagttatctatagactctctataagatatccatatcagtatattttcctacttgaaagagattaaatgaagagagagagagtaaaactatctaataacttggagatagtctatagagaaaaacgaggtaatggatgagagagctatagatatccatgtagacatactattgggatgatttactattagtctagtctattgttgagatgtatatattttatagagagcaccttactttaccattgcgggtgctctcaggttatatatagggttcacataaccgcttgtgaaacttggaggtttcaaagatggatagagttgatgatccgcttagtaagccaacagaagttaataaaattaaaccaaaatttaaactatctgacaattttttgaatttatgtggttttgaaaggactccgtgtgcgaaagggcttgtagcctaatggttacaagagcctcagtagcacctgaggtcctgggttcgactctccatgagagcgaattttccaggattcaacagcgttgtgctttcagtggtaggcgatgtttgtaaacctggttataagtcctatcctatccgaggtgtttggagctagcacataaacttcagctgacaccataagaggtgtatgagattatgtactattttcagtcaagaatatttgatgttaacgttgttatattagtggcactactgtcaaattttatcgactaaataaattactatcttattaaaaatatcgtattaattggataaagaatttgttggattatagtgagtcatgattaaattaattgtgttacatacgtacatctctctaagagttatataccaaatcggattctacacttaaatttagcatagctcaatattgcacacaaaaacaagctacttacttcctccgtaaaaaaaaaagacaaaccatgaattcccgtgtcaacgtttgactgtccgtcttatatgaaatttttttataattagtattttcattgttgttagatgataaaacatgattaatactttatgtgtgacttatctttttaatttttttcatattttttccaaataagacggacggtcaaacgttagacatggaaaccagagtttgtctttttttttttttatgggacggagggattatgtgtgatgtctgaaagaagccagaaacttcagctgccaacccagtagatgagattgcttgtacatattgagcagcaaaattgacttgatcagtctcagaatttcgactattccaaccaggagatcattgttggtggccgaaacgttcggcaaatgttcatctcagagccaccgcctcttcgccgagctttccccgtatgagctccccaggtcccctctgcgccgcgccgccgccttatctatccatcaggaagaagaatatcccgaaagatcttcgcatgatttgcgacgatcgagacgaacaagatcgcctcacctctccagacgcgtgcagctgcagcaaaagcctagctggctggctatagccgctgcatgctacggctaaactgatcgatcgatatcgacagcgatctgtaattcccctgcacacacacacaacaccccctcacgcgtcaattaatacacatcgtccagacgacgttacgtacgtacatatacgcgtttgtcacactagggcggcagcaatgcatttccgctcgatcgatcgatcgatcgattcaactttcgcggtgcaacagtgtgaaaattgctgtacaacagcaggcagcagctaaagttgatatacacagcgccccccgctgcactgtttccaccgtacatcgcgcgcgcgaggaggaggatttttgacccattttgctcggattttagctccgacaaaccgatcgatcgattgacaccgcgagcgatgcgagaaccagcggttttttttgtcaagacgtggaagacaaactccacacatgcggtttgttttttcaaaacaagataattgaaaggtactagtaaatcggtacaagtgttctagtattaattgggcggagtcgtccttgactatttaggctgcgttcgttgtgatgagttatgggggattgggtgagaaaaggacatcgtattccgcgtgcacgcttcccaaactactaaacggtgtattttttgcaaaaattttctataggaaagttgctttaaaaaatcatattaatccatttttaaaatttaaaatagttaatactcaattaatcatgtgctaatggctcacctcgttttgcgtatcttcccaatcttctcaatccccctctcctcaaactcacccttagtactactagtatagagatgatgggagagtcaaccccaactggcaagagtcatattctctcattgatctgccggggtctgtgtgaaacaaatttaaaagtcccaagttgcagctttgtatacgcaggaaaaaaacggatgctgagaagaagagatcggtgtggtcggattccacaccggggttgaaaactttggcagcttgaattggattcttatgtgccgttttttcaacacatggaggtgctgtttttttaaatttattttccaactctctgtttctattttatcccctgttttttcaacacaaatcagtttcaggatggtacacttgctcacttgcttgagaatccggtttgttttttaagctttgacaggctgctgcagcggtagagtagtatagtattgtttttatttcgaacggtcagcagtatagtattgttggtttggattttgtccatgcacttggcgacttgtaaatttgtaattttaaacgagaaaccggaccaaatctgccaatcagatggcgtccacggtttgattcccctgccagcttggcctagtctgttttgtatttgcagagctatgctgattgctgtagttctagtagttgtagtagctcgcaaataaaggtcaaagtgtttgctgagttggactggcgtgctcgttgacccccaactacggccaaggcaaagccacttgtggttaatatattcataatatttctgttcttatgcgagaggtcgatcgatctaatctatgtcgatcactgtcttcatgtgacctgcagcaacgcatatgcgtacaacagttcgtgtccgtgatggtcagtacatcgaacattgctctcgttttggctcttcacgcacattctcatgtgcgtttttttttaaatgttggagtgtacaagtaaatactcgtcctatcttaaaataaaggaaaaaaagttcggataatcttctagaataatcgtggaagtatgaattatccttctcaatttttcatacaggacgaattacccctcctctcactctacagtggttttgattctacatggcacacacacacatagtagtccagtcaacataaaaataaaaaatggtgaggcccacttatcggttatgtcttttctctcgatcaccacatgtgggtcctaccttttttatattttcatattgactggactgctacgtgtcactattacaaaaacagtcaaataaggtgttggttgggaaccggctataggtgtcggttttccaaccgttacctattggccggcatctatgcgaatcatatagttgccggtttaaaggtgccggttctttattttttaaactgtgggaggtcggaaaaggttaataggcgtcggttttaaataaatcgacacctataaaccagtccctatgagggtttttgtagtagtgtgtgtcacgtagaatcaaaactgctctggagtttgttgaggattaatacatctggtataaaaaaaaattcgagagtaaagaatgatttttttaattgaggggggtaattcgtattgccacaatagttgaggggtaattcagaattttttaaaaatataagaatcaagatgtatagattcgtatataaaagttgatttttttccataacaaaggaagtagggcagtttagtagatacggtcaagttgtgtaatgcaacgagatttcaaactttttgttgcacggaattggactctaccttgaaattttctagtattccaaatatagacaaaatatccacactaccgaaccctatggatttattttactgtagcttatattggataatatacaacttttgggattgatattgtgatcatagtgagaaggcttgttgcttagggtaaaaaaaatatttaaaaaggatattacccaggtgtacagcataaccacttctgaccatgatttttccttccaagaacttctagatctgtagtacctccggttcctaaccaaaaaacaaacaaacaaatttgtagccacttgatcagagtttataaacaaatttgtaaccgcaaaattaattaatatcgatcacatcgtacttgccttgaactctcaatctaataattttctaaagttaaaatagtaataaccagcaaattataaactcaaagtggactcactattaataaacataaaatttaatatggtgtgaggtcttaattttattttatttcttaataaaatgatttctatattaaaaatattaaatataaaattgcacttggcttgagtcttgattttagtttaaatttggtaatttcaaaagtcagaatctattatatgaaattgtacatttcttggactataattttagtatgatagtaccaatttaattccaaaattcagtattaatgggcaaactgtaattgagatgattaaattattcttcttttattctaactgtatattttcgaaggtacaaaagccagcgacgaatccttaaccttactgaatccctgctaaatacgcaccctcatcaagtcatctgtgcattgtttgtaccaaccaggatttaatccatcttatataaatgaggtttgtcatgcatatgcatcctttataaatgatccaattaaaatggatgttcaaatttattttctgtttctccgatcaatatgtgattgtgctcgagatttccagttgatatacttcctccatccaactgtccatcttttattatgtatttttataatattttaaaagatgatatattaattaccaaagtgctttgcatgccacatataaccatccttacttttactggataaaaaaacaaatttatttcaactaaaaagatacgcggcgagatttttttagttgatcttatcaagtcgtttcctttcaactttcttttttgcagatgggaaaatgacgagtcgcctgagttgaggaggataagctgctgtggcagcctggcaggaggccggcatcacgtatacaggcacgaccacatgcagaggacaacagtggaacgttgattccgaccacccattttgatgacacgtggaaaatctgcatgcatggggactaataaaaaataaaataatgcatagatatgcactgggggcgatctcagccacaataatcttttcggtgcctaaattatgtaaaaccccccgtttttctcatcaatatcgtttcgcttttcggcgcccagtgcttctttatggactatggtacttgtgatcattgatcgaccactcgccgttagaagaatgttgatgaagtggaaatccggtccatttccccctttttatatatatcgtaatgttttatccactaatgcggcgcattccaacggaaattaaagaaaaaaaattcatagttaccattcttaatattaatctaagaattcatatccatgttggaattttatatcttctcctcatgctactgtagttgaaataaatattcaccgtttgatggttatatgtaggagatagtggtggtagctagctatggtaggagatgataattcatcattcaccattaccacttatctctcccttcgaaaatataatcatttttagatttcgacacggtcttcgagatactactttgaccaataatatgtatagaagtaaaatattttaaataaaaagagttgcatattatgataatttgtttaataataaatctagtaatatcaattttacatgatagatcttttctatttttttacttttaatagtcaaagttaaaaatatttgacttggcactatactaaaatacttatattttgggacggagagagtaagtcttttcaaggagtacaaatttttctagtttatgctttatcgtccatcaaatatttacagaagtggttaaaaaataatgtatatgtagcaatgataatcgaaattcctatctctcaacgctgataaagtgaaggatgatgtaatgtagggtgaaatttatttattttttcttttgtagaggtggggaggacaacgacgacatgggtgagctcgtgatctacctcttctcgaacgtggtatggtcgtgggaaggagaagataagacgataacgttactatttatgcacaaatcttgatgcagtttacaaaatcaagtgaaaatttgcggtatttttgggtgaaactagacagtaaaaaaaaaaaaacttatactgctacgcgctactacctacaggatgattccaagtttgtcgccccattttaatgatcaataacacacagtgagtccgctagtttcttagccttaaactaaggaaagtatcatgtatggcctgtcttttgtgcaacctatagctagctcgtgtgttccattggcaaggcgacagctccggtctcaaaagagccctccaaggacaaggagagccggccgcaatggcgatcgaatagtaccgtccattattgtagagtatacatgtactatctcctaaactactattgctacttccatagctgaagttaaagtgaagccacaattagtttttttttttcatggcaatcgtaacccacgttttcgaatcccagaactaaaaaaaaagtacaatataatctcgctgaaaaactaatcgtcgtggcctcatataaatcaggcacgattgcgtcggcgacgagtaaattaaaataaagagtgcagagacagagagagagagatgcatggctagctcgtgcttagctttttcgtcagtgttatgttgcagctagctataatatatatatatatatatatatatatatatatatatatatatatatatatatatatatatatatatatatagacatacacaagtatgtaacggctaatggcttagtgggagacacataagattagcagcgtgttgttagtggaaaagcgatcgagagctcatgcataattaattagtgacaaacgtgttaatgttcgatccaggaagcactagtttgtgggtcagtatttgtaggcttcaaagggctcaggggtacaaaagctgcaagtataataacctgtttcaggtagtttcggccgagcactttacgtgttccaatccaggaggcggctgcacatcatcgacaaagtcgtagtagaattaacctgggaagtgttctgttgatcagcttataatatagatcacatgcatatctctactggttttaattttgtcttaatatacgcatgacaagttattgccagttctggtgctagcaaaacagcatatatatatatatatatatatatatatatatatatatatatatatatatggtgaaatgttcgtttagaatctcaattcatgggcgttaactaggagatatggaacgaaaggaaccggagaactttccaacacaaggagttgccggcgctaactctgctagccaagataaaggaggaagcaaaaacatgggggttggcgggcgcaaaaaatctcgccgcctggttgacaatgtaactgcctatagttagggccacggccctaggttttttgttttctgtactttatccttgtttgtacagttttcgtctcctctattcaatgaaattgacggcctcgtcgattcgttcaaaaaaaaattcatgggtagatgctacaaattaaacaaaataaaatgcaacagatagtgtcccaaaaggggcactacatgtataggagccattttatatatagatgctgaaaataaggtgttaaaaaatgaaaagaaatccgggatgaaaggaacatccctaagcttaagaacaggctcaagaatatgtcccttaaagcaagcaccacttgtttgatatgcttagcatcaagtaggacaacaattttttttataaaaagtttctatgtaggcacatcatcttggctagctattccttccattttttttctcctactgatgtactgaaacaccaacaaattaaagttgctcatatccttttccaacccttttcctttttcttgtttttgttttcttgcttactccttgattcgagcattttatatcattgcattgaaactaaccaaccgcgtcctacgcgtctgcttgctagtatatgcaaaaaaaaaaaactttgatgaaatctagaagttgcgtttcaaattaagccacagagaacatattccaaactttacacacttctgctttaatgatgtggaaactaaataacaacttgagctctgttttggaccctgcctgagcatatataatcatctgtgtagaacttgacttcttaatgcaatgtgtcagtatcagcacagcatcagctaaaaaaattactaatcagaatgaagaataaaaacatggtgcactgacttttatgcttgcttgcctactcaatgctccatgaagccaacttttttaactattggtgtacaaagctgaagggaactttgcatttgcattgtacatactggtcctccttttcagcaccagtactcctaccactgttggttccaatggtaaagcaagcatataaactggtgcctcccatgatgactaagtttagataaaacatgaaaagctttttacaacatgtgattggatttgtctaaatactctggatgaagcatctgatctgaggatgttctgagggccgggactcctatttcggagttaaaaagcttccaggagagtacaataattggggattctgttttaaccttatcaacattaacatcaaaaagaaaagttttggaggtatacaaaatattatcattattttagctggtactaataatgtggatgatcttttaataaaaatttgtatgtaaaggtctacgaattgcggcagatttagaaagtatatgggacattcttatgctgcaagttagcaagtatgcgcaaaaaaaaaaggtagtatgattaaagaagcccaattgggacaaaactttgtgtcattaggctccatcaagaccgtacattacaatacttgtatatttgcatgaactacgatcgatatggcaacatatgcgtacatgcgaaaatatatttatagacgcaatgacaagtgtctgcacacaatagaatacttggattagaggagtggccactagcatagtgacaaaaagctttagaaagttcttccaaattaaataaatgttgtgtgaactattaattagtttacattatcatgtagatgagagcatacatattcaaaaactggcggaatgccatctacttatcattctgaaaataaaatgcaccaaaacgattttacatcattacggtgcaacggaattcttgcaagcatcattgctgaaagatcagcgagcaaatgcacggtaaatttctttattatgctatagctatatatgtgggattcccctaacctggtgaattaaaatggatcagagagccctcgtagccatatgccataggaaaaggatatcaccaagataaaggacacttatccacacgacatgaagctttcattcataatgatgattctggctgcaaatatatatgacaaattgcagccgttcgtgtatgacagtaaccaacgatatttgcatccttctccctccaattgcacatggatatgtatatttttaggagtcgacgtcgacgtaattagctcagcaaagactcctacatggtagtttttaccaacctactcgagatctcctatcatgagtcgccattaatctagctgatgatcatgactagctccctttgcattttaaaggatgctctctctcaaatctctctctgccaatgctaatggctgccacggcattaaccagcagttcagctgctacttagcacaccttttttcctccttatattactggctctatatatctgatcacacattcacaccaagtgttcgctaatggctagtgttatatggacatatggtccccctcctgccttaattatccattcttttcgagtgattaagcagcaactggaagtaagttaattaagctatataattgcgcaacgagaagagaagaggtctatgtgcgttctagaaccgcactattctcatggtgcgcgcgcgtgcgcgaggcggacagcgacgatcacgcgcgcgcgtcgaacgcgtgagcgcgcactgctcgctctcgccggtgtccggacccgccgggccgtctggccgccgcctccgcctccgccggcggcccgtatgaacgctccggcctttacatttatcgtgttgaacctgtcaaacttgcattcacgcctcccgcaaggcggcgaggcagtcgtagcaacctactgtcccgtcttaaaatagaagtatttttagcatagtgtcaaattaaatatttttaactattaatataaaaaactcaatcatgtaaaattggtgttactagatttgtcattgaacaaactatcataatatgtaactttttttaaaacatattacttttaataaatattattggttaaaatagcatctcgaagactgtgtcggagttaaaaatatttatattttgaggccccacatgtcagcctcctttaggtcgtctctttttatatcctatacgtgttggaaccggccggctacggatgcgatgcacgactgttccactagtataatctagcgtttgtattagtgcatagttaacggtggctagtgactaatgtactgtacagtacgtgtggtctgctaattgctcatcgctaagctagctcgaccctgacacgattatattgagccgaattagcgtctttgactcgaactgctttcttctacagttctgctgctacacgtatacgtactggtgctggctgccagtctgccacgatcggacgtacactacatttgttttatctgcaaaccattaaaaaatgcgtacaaagtcagtacaagtcgccagcttaattagtttagcttaaccgtagtttaatacttactccggccgtcacgtgccgacctgacgttagtagcttttggactggagatgggtcccacacgtttgactgacggacccgacccgggtcgagtcgatgcgtggcgtcagatttctttactccaagcgacctctggtcaaaatgctgagtagtattatccaaacgtgcaggataattaattagggtgtcaaaactaattgttccatgtttggaagcttttgcccatggcgacaaatggttagggctgcaaagagtgtgcaagtggggatcaagtgacgatcatgcattttggtacaggacaatgcctttgaccttctggggcgttaggtgccaactgatgatgatgcatcctgcaaaaaaaaaaagggagggggactttagtttgttcgatcgatcgtagtgtgccgaattatatttatttagggtttttaagttgtgttgatgtcaatgcaaggtggttacaaaaatgaggacttgttgggagcactcatttggcttctagaagagattttggtagggttagttggtgattttctgatcaaatttgtgcagaaaaggaattaaactgatcgatcgtccgatttaattagttttttttgtgaggattcaactagttagtttgaagcttgaaaatgttcacatctttcgaataaaagaaactagtctgagaattaattatttatgtttacacactgctatatattgatatatatcgacggcactgattaaatatgcagccacaaattttcctcaaaacaagtatgctgccacaagttaagtatatatacttccttttgaaacctcacaagttaatactaaatccactcagaacatgtagtgcttacccattactgatgttcctgtgaatgtatatgttgatctacagactggtcactgtaactgctgaagaaattagatgtactgggattgcatatatgccagccgagaagcgagaatgtattgatcacacgcagcatttcttttgtcaggtagggttacatatataaggctcattggttcgagttgctcaagagtaatgaagaatttttgtgtgtgccactataggacatatagtacatatgtaatatccggagataacaccatttctcttgtttaaactttgaataaaccaagcgtgcaatgaatatactactacagaagtcaaatagtgttgagtatgcaaagaaggatgccactagattgaactggtttgactcaaaacaaattttgttattttatttttacttaaggacaaaattgagtaggtgcatcagggagggagtactaaagttgtgtgatgtggacgaagtaaagtgtgtgcatgattctcccacttagattaaaatcttgtttgtcacagttacacacataaatgtagtatctttagaattttagtgagacctacggaaattatttttcggctccaatcttaagtgtgtgttaaaagtaacatattcatgcatatgctccgtgtgcattttttaatgtgatcgaaaaaaaaaaggtatagcagtttaaaaatatatagtccctccatttagactcatcactattatgatttgattttcttttctttcattgagggggacggagagagtaggggaaaaggtataaacattcttttttttagaactggtataaacattctagaatgttccttatcagcaagcaggtcctagaaaattatagtaccatattttctttggagaatatagttctgtgtttagttgtttaggaaaaaaaatttgacgtatacggacacatgtttaaagtattaagcgtagactaataacaaaataaattatagattgcacctgtaaactgcgagacgaatctattaagtctaactaatccgtcattagcaattatttactgtagcagcacattgtcaaattatggcataattaggctcaaaagatttgtgtcgcaatttacatgcaaactgtgtaattggtttttttattcacatttaatgcttcatatatgtatacgaatatttgatgtgacggaaaagttgaaactttaaagggaactaaacgctccagtactattggttgcaaactttgataaatttagtggtttagagagaaggctagaggagatcctttgactggagcatcgtcatcgtggtcaaactcgacaatgcatacaacaagctatagtaactgattagctagctactactatatatagtacgtactgataggcaatatcagaagttaacaagattatcatggagataagaactaagggattttctttgaccgcatataagtaaacagactgttgggatgcatttggaatgttggatcgatttccatacggttaccatgagaatttcaccccaaaaaaaatcggtttttgctatatatgtgtcgacaaattattttgccaaaatctattgaattttcagccaataatttggcgtggagattagtgtgtgtgactgattagcttggtagtattagtactggattttttttcttgctaactgctgcatgcagtttctcattgtcttagactgtgtttagttccacgctaaaattaaaagtttgaagaaattaaaacgataagacggaaaagttgaaagtctgtgtgtgtaggaaaattcgatgtgacggagaagtttgaaattcgaagaaaaaaagttgaaatctaagcatggccttagcgtaaatttattagactttgtatgtggatttgatcccgtacactcacatcacgtgcacacgcctctccccctaaattttaggtgtttttatgtatttacatgatacttgcatactaattacatatgcaattttgaaacttatatcgtaaatacactaaaattcaataagtaaattagtaacttacagtgtaaatatatcctgactattttcatgaaaaatatgccgtcataaatattggtagtcccaacaaaatctccaattcaaacagaaggttagttcaaagagtgtttttcggtccttgaggagattataccacattttatactaaaagtttttatctctctcaaagaccataaagttcctcatataggattgaatagggatttgagcattttctgtttcgatgatacatggagaaagattagcaaagtcgattaggaccacaaatttaacagtagaagatatgattcgttctttctaatacatgtaaaatacattaattattattttgtgatgagacgtttgtatattggttttgatatttggttagatttaatcgcgaagtgatgctctctggatgcggttggtcagatcggtttgtacactatagtcagatcggacaaatgacgtgaatagtgttttttgttttttcagtgaactagagtttggttgtgcgatcagaccgagctgagtgcgccggtcagaccggccacctgacggtctgactggctagcttctgattggaatcggttttgagttgtttctttgattctcaggattactttatgtttattacctctagataatttatgtatatatgttatactgttggtgtgctaatgttgagttaattaagttgaaaaagaacttgtgctcgagtatggtttctcatctatttatgtatagatgtattttaatgcctcgggagagtgttgcctgtgatggattaggagtcgacttagaaaaagttgatgtccgaatgataagaagattatacgagatgcttaggctaaagagaaaacgcatgattttgaaggttccatatggcatacaagagggattttgtgcatatgggatgagaagtcaaatttggaaggagtccaaattttgggaaattatagtttgtattgtaaaggaacaagttgtatactatttattcaagatggattatggcttttgtgtagccaccttagggtacaaatagaagagtggttaaaacctctcggtattgattttgagagagaatagttttgagaaaagtataaacttaacctacagttcgagtttagtcaaaaattgagaggggagtgtcgttggtgtactttgtaaacataattagaaacaataaagttgttatacttccaaagagttattcgatttgtatttttctttgtttcggcgatcaaactagcaaaggtacggtcgtcagaccggtgactacacgatggtcagaccgatgacacctgggcagttagatcagtgacatctggcaattacggctagaaggacaattgaccagagctacaccttcggtcaaacatcgacatcgacactattaggcccgacgtatacacatcggtcaaaccgatttccatctggtttaaatgtatcatttattttgtgaaaacatttgttttttttggtgttatgccattcaacctcatattccaaccctcttaatatttggggaatgctaggggacgtgataccgttccccaacaggatgctcctcctccgcaaacgcgattctcacccatgcgacgtggccgaagccatcaatgcgcgcccgtcccccaccgtcaccacgcccgtcccccaccgccgccgtcaacgtccctcgccgccgcgcccgtcccccgccgccgccatccccatcccctgccgccgccaccacacccgcacccaccgccgccgtcgccgtccctcgccaccgccgccgcgcccgtcccctgccgccgccgttgccgtcgccgtcctcatctacaggggacggctgcaggtggccggccgcgcgtcgggatgctcctcccccaacgggatgcacagttatatctactaggaatcacctgatacctcgtaagtatcatctgatacctcgtaagtatcacgcgatacatagtagaaattgtctgatacctaacatgatacctcgcgagtatcacgcgatacgtggtagaaatcgtctgataccttacaggtatcacatgatactttgcaagtatcacctgaaacgtgtgtagaatcgtctgatacctgataggtatcacacctgatacctactcgggatcatcccgttcgaaaacgggattccgttatataacaaccccctaatatatagtcatacttatactaattggacactctgagagagctgctacgttaattagaaatatttagccgttgatttgatcgaccatgtacgttgagagttgacggtaaataaatcacgcagttgaaaacataatggactttgatttaataattctgaaattcctatttaataaatgtgatattgcatccatcttacattctcaatttattgttatttatttatgctcaaattcaaaatcagtaattaacatattgtaattggtgtggactcttcatttaataagcatctatataatttcaaaaggtaaccaacatgtttatcataacattagaatttcaatatttataccaccattaataatatatagctcgtgtaacacttagagattggctactagtagtaatagtaaaaatggctaaaaatttgaagctgtacattatttttcctatatacgcggacctagcctgcgattatggaagagatcgaactgtcagtttaactgatgcaaattgcataaaggatgttaattgttatccctatttcagtattattaggaggccaatcatctcttatgctagtgcccaaggttaggctgaacaaatatttttcagaatccattaagagactgacttaaggaagcatcccatcagacacgccactagcgtcgtggatcgtatacgttccatgatgagtttactccgatattatccggccccgtacagagctagatcctccgaattaatcaaaagcacgtcatttgagatgtctaattgatcactgcattggaagacgacgaacgatcattgacaggcccttcaatgatcagccacacgagccactagctagcaaccgctagtgtcacccgatcgaacaagctaatgcgatatcttattatgggtattatacagttacggtcactaatcgagatattttggcttgcgctttacgaacagttgctcctgccggatacgcttggatcccttcaaatctatccttgctcgatcgactgaaacgcatcatattgcagaaatatctgaatccttacgaagtggcggcacagtaggacgacgggcaactgaacactaagctagctgctactactatatatgatcatcatcatcgatccgatcggtttgccggcactcatgcatgacaccatagtaaattcatttctcacaaacaagcagctattaagatgaatgaataccaatggcatcggtccatgcagatgagagacaagggacctatatctatcgatctatcagtgtactatctacctatctacctactaaaatggcgatcgagctgaagccactgatggatcgatcgatcgatacatatgatcaatccacattaagaagcagtgtgcgagaagaagtagaaaggggggaaggaacgaacaataatgcgtgcatgcagggagagaggaaagggaggcaatggtgcgtagcaccattgggcgcggctgcgtgtgcccggccgacgcaggcatcgccatggacagcgctgatccgagacggatccggccgcgcgcggacttagccatccgtcccactcggacaggacgcgcgcgcgcgtgtcgtgctcgccgctgtcgcgccacgcgctaggcgagtagcagctagctaggcgtgtgtggctataggccttttgtgccagagcgaggcgtgacggcttggggctccggcaccggctagctgggctgggcgctgggcatggccgcgtcgtggagcagtgcacttaggcgtcactcgcagcgctttccgggggcagaaaagtggcaggggcacctcgccctgtccatcgttcctgcccatatcttgctgcaccaccactaagccgtctccgtccatgatcacgcactgtgtcgtctcggagtcggatcatcatgcaagccgtgcctggagctgtcaaagactagctactgctatgttggatatagctaggcgagtagctagctagctagctgctagtatacgaactattggtctatggctataagccgtttaatttggacgcatgctcgtacgcacgcacgcaacgagaatggtggcgagcgatcatgcatcagtgcgcgggtgcacgcacccacgtacgcaagcaagcaagcacggcacggacgacgggcagggcaccgtgtcctcctccgttttgctcgtgtcactctcgtgcgccatgcactatagtgcgaggcgcgcgagcactaactagcagctggggtagtaacgcgcgcttggctagcgctaattaagctgccgggttcgctcgccgatcgatcgaatctttttggcgcggatcgcccacgacgaggcgagccaatccatctcgtcgatcgacgacgacgacccaacgtacactgaactttcgtcgcgcgcccgtgttgcgccgcgcggcgcggcgcggcgcccatcgatcgatcgtacgtacgcccgcagctctcacgatcaacgtacgatccggccgtgtggtggcccgtgcgcgcgcgcggtgcatggtggcgcgtggcgcgatcgagatcgtgcgtgctgatcgggaaagccacggattggttgctgcgcgcgcgcgcctcgcgctcgcgctggggacgactcaactcgatctcggacggaggtcaacgcgatcgggttagatagaaaggagcaacatggcggcattgttggtgctctcgacgtacgtgcttgctgtttcaatttgatcgtcatcgatctcatcacactagctcaccggaaatggtttgcagaatacggataccccggcccgtttttgcttcagattatgatagctaagtctagcaactaagtttaaaagaagcggttaaactcttttttgaggacgttcagaatttctatttctgtaccgagttcgcctgcatatatactcttgttaatgttttaaaatcctgatcagatcttatcataaacattaaatatctataaccgaaaagatgacatggcgtctacttgtttcctccgtcttgaaatataaagaattatacccttcaaatttatcgtataatataaaagattttataattttgagacaatactttataccttatcaaccattttttactagtttattccccactcactatcttttatactggtttattttttcatctatcattttttactactttattcttctaaccatcatatttattattttactattttctgaaattttataaaaaaatataaacccttatatctgtggacaggactggaggagaacggcactatatcaccgcatattgatacggccagaaataccgagagacgaattgaccggctgtccggcctcgatcgtggtgctcatctcggggcgaaatgtgttaccgtatattcgcgcatatatgtacgcctctgcacctgtactgatctgtacctgttagtgggggcagaaagccatggacgccttcgacggcgacccgtccatccgtcgggcccgggcctcgctgtctgtagcgtgcgctcgctgtttgacattcgagttcaaaagtgtgacacaaaattttcccccggaaagaaattcttgcaggtcgatcgacgactcgtacgtcggcgcctccctctcgacacgaacacgtactggtactggattagtactcctaattgtctaggtgcacgctgtgctgtacaattcggcagctggactgactcctgcgtccccaaatcctgcagcctttgcctttttgaactcctgatcgacgatctacttacgcagcaggcaagctagctagctagcattagcgtgcatgctgaaatggagagaggaaaaacaatactctctccgtttcaaaatgtttgataccgttgactttttagcacatgtcgttcgtcttattaaaaaaatttgtgaaatatgtaaaactatatgtgtacatgaaaacatatttaacaatgaaacaaatgatatgaaaaaaataaataattacttaaaatttttaataagacgaatggttaaacacatacttaaaaaatcaaaaaattaacggtgttaaacattttgaaacggagggagtataagattggtgagaagaaagtgatcaaatagcaactgaaaagtgtgtgcctttcttttttattgttttctgaggagtaaaaaagtctgcggctgattacttgcatagactgtatgacccgtatcgttctctgtatgcgtatgttgtgcaatgggacctaatccctcttcggttcctggatgatcaacgtactcaccgtttgtctaatgctaattatcgagcaggctatcatgcaggcaagcagagcagtggcctagctaagctaagctaaactatagctacactgtgcgtggtcaaactaaacaccagccaaagccaagccaattagccatcgctagtgagtagtgacccctggggatgcacagggccgagccaatagcttagctttgtgactgatcgacacggccaggcaagtacacacttgcacggcggctttgagctgacagctactacgatccacacgacgacattgccacgcacggagaaagccccgggccggcctcgtctctccgttgctgcctgcatgatctcgtcgccgtcgccgtcgatcggcctcatcttgcgcggcaagttgcaggcgagagaaggtggtacgtggcttatcctgaattccaacccccactcacgcacgggccggcggatgcgcgccggggggggggggggggggcggcggagacgtacgactgatcggtcgatcgacgacgcgtcggcgggcgacggacggaccgacgacgtgagagcgagcgtgcgtgaacagtaggtccacctgaagatgccattaccggggggaaagcacttgatcagaatcagagagctcaaaactggattgattaatctgcagtggagacaagggcttagaaaaaacgcgccttgggaaagtgactgacaccaccagcagcggctagctcatccatgcttgctgctactggattttttttttatgttttggttttttgaaaatttatttccctacgacaaaacttattttaaaaatggatcctgttttctcaacatcaaggtccaatatcttagcaccgataccctagctctctggatatctaagtcgctaatgtgatgggtgttggaaccgaggacttatttgtaaaaaaagttttcaaaaaggttcaaatgtaaatatttttatagtctctctgtactagcttttttacgtcgagaacctaattataataaaagtatttatgttttgaccattttaaaagatcattgtacaaataggttcacaacactaaagagattagtgttatcccctatatcttggctatagggggcgagggtgttgacaccagcgtcattggtgtcgaggcattggaccactggcgtcaaaaaaggattaatttctaaaataagtttctcatagggccgtatgtaaaataagttttaaaaaagagccaaaacataaaaagttcagcttgctgctatctgtttcagagtttggtagctctcctggtttggtttggttcaggacgcgtgattgagcgtaattgacacaatgacggtatgacacacaccgtacccaagttgatcaaaccggatagatcagtactactgagcatggaggcgaagacgtacgtcaaatcccttttttgagaaagcggatggttaagcagagttgacatgcattttctgtgtggctggccggcttgatagatagctatgctgctgctgtgaggagaagaaaaaacaatttgatgtttggtacgtgagagtgaaaatagtggatggcgctttcagtgaaacttgtcaggtttggcagcttgatatgtttgaacaaattaaagggcgagggtttgcacacacaagcaaacggtttttaagcggttttaaatagtttctgttcctgtgccatgaaaaggaagggtttatccaatgtcaacctgcgaagttacaaaagcgatcgagtttggttctctctttgctttaatttatggtcctctctttggtgaaacagcattgcccttttgtggacacctgggatgacaacgtgctgctgggattgtagccaactaaaacaagtctcctatccctttttcacctgtagggattaacaccagaccgtcttctacaaccaggcgtagcaggcaaacttggcttgtgttgatggcttccgtgaactacttgctgtttgaactttacacaggttacctacccgaaaactggtctacgttgcaaatctctccactgtttgctctccattttgagcagaaatagacgcctaatccagaaaaggctatagtgcaggaaatagagatgctgaactgaaagtccaactacaattgggcctttgggaggcctttctgcaagtgttggacaactttacaacagggaagcaacatccatttctttcagtaactttactttcatacacattgattgatacaagcacagatcgaagatgggaaatggttggaatacaataggtcttcttcatgccttttagatcgtgggaaaatgagttgatgagctaccatcacagctttctactcagacgtaatcttcctattgaagctattcatctgtggtttgcccttctcccgagccctcagaaggtgtgtctgatgataatggccctaagatgccctctgaactgagagttaatccactctgtgaagagatacagggagaaacaatttaattcagccaaatgttactgcagtggcttatgaataatgtcagataaatttcattttgcagcctcaataaaatgatgatggcagtacctcaggctggaatcttaacatatcagcacgagccattgcctctgcttgagctatcctctgcctgaatatctgagccatctcatcagcctgttttgagacagagaaaacagtatgtcagtttgtatacattccagatggaccagatcaaggaatattgctttcaaacttaccttctcaaaaacaagctttggattgcgaatcatgtcaccaggtgtcggctcaagctttttagtagaaagactaacacggcctctttcacggtcatggcttagaatcataacctaatagcatttaaaaaaaatactctggccttagctctataaactttagatagtatacttttctcaagtacgaatgcaaaaaataccttgagcgtatctcctggttgcagaactgtcgagatgtccgcaacacggtcatgactaatctggctgacatggagaaggccattgattccaccaatgtcgataaatgcaccataaggtttcaggctctcgacagttcccaagacaactgaaccaataccaagctgagcttgactatctgccattgccttgcggttactgaggacaagcctgccttgttcctcatcgacctccacaaacttcagaggtagttctttgtcaagcagttcttcagcagttgatttctgatcaaggtcaagaagtggtttgtaaaatagtgggcagctagtgtttacaatgtgattgagaactaagcattggaaactaggatcaaatgttcagttatctgcataacaactttgacctgcagatgaaaggcagctcatgccatgcacatgcacatacacctaaaaccataggatgcaagaaagttttgtagtaactaataagattgagaaccaaccgatgacacttgtgaaaatggaacaaatcccttaaggccctccacaagagctaccacacctcctttgtttccaccaattacctgcggggcaacattgccaaatgaacaagtcaggtaaccgcagactaatacattacagcaaattcatcccaataaaactaagcatacaatcatataagctcttgcaaaaggattttttgatatgttgttacaaagtgactggtctagacttcaggagttcattgctagttgcacaggaacaaaccaacaaaatcacaatagtccaataaaaacaaaaaatttctggtcattgtcgcatctatagacgatctcagtacctgatcagtaagctctaccaagtaaacagcagcacaaatatagaaattatgaaatcatgggttggatgtcataaagtatgtacaccataaattaccacttgaataatttcttttcattaaaggacaatggctgctgctgtgagggatagattcaaggacaaagcctgattgttagaaccgaaacggtgggcaagaagaagtagtgcttaacaaacatttggttacaagtttaacaacagcaagctattaaaggagtagtgaagaacaatagtaatagcacagaaatatttccttctgcaagtatttttactcactttacccgtgacaacaacatcttctgcttgaagctgtctgcacctttcccaggcaaggtcttgctgaattgcttgtaagctcaaaatcaaagtttcatcaccaggattctcgtcaataatcatgaactcttctaccaaacctgcacggatccctgcctcttctatatggttgacatcgagaaggcatgcctcatccaaaggcaagaaagcagtagacttcgattggatatcaacatatgcaccatttgaagtggtcatgaacactgttcctttaatctgtagagattgcaagaacatgatagtttttagatgttaaggatagagtaatacatcgtttcaaaaaaaaaggatagaataatacaatatatgagaaactatacaaaatttgcaatatgaacagtatcttataataccaacatagcacaaaatattgcagcaaagataacagtactgcatgcccaaaaggagatactaacagcagaatcattgctaacagagcaaaattctaaggatcaatgcaaatctggcagctggacaaaatgagtttttgtgtccatgtgcatttgtaacgtataagagatgtatagctgattattgagtataatattggttgataaatagtaagcaattcttatttaaatagacataaataattacagtcaagacaagcagcaatcggtcagtaactgaaatctcatcgagtttggggttaccatggtcagctagttactacagggaatggatcaatggatcaactccagcttactttaactatcatttaatgtgaatttggctttgttttttttttaaaaaaaaggagaaaataactatataaagaagaaaaacagaccccacctgtatgacatttcaaggacatttctatcttttgaaggggaaacccctttttgatggaaattacatgtacatgaacatcctacatgtgctttggaccttatgcatattcatgcttcaaagaaatatctatgccctgatggattggtgaccggtgtgaggccatgagggtgaggtaggcatatgtatgatgttcgtataacttggtacacgtgcggaagcaatcaaagagaggatgtagcaaacacaaataaaaaccacacgcttttggtagatcaaactcttgctccaagcctccaataaggtatcatccccaaggaggtaaaaaagggaattcgccgttcaagtctaattcaccagaattgaatcaaaagtcaagcttaatttaaagtacatcaaattaatatgaactactctagcttacactgaatacatagctatcgtataaatctccagcctatagaggaatatgatatggccatgtattgctcttatttgaagtatcagacctacatatatatttttttagtaaacattattgaaaaaacaactaaattatttagatgaagccacacaattgcgtgagttctagcgttcaactagtttcacaaaaggcaaaacataacaggtaagggctaatgaaactactattcctgattatcactatacctgctaccactatgagcaggtcagaaaatggaagaggtacttgtagtaaactgaacattctttcgcttgtaccttaggggagtaacacattatagacgaatcatgatgcgcagagcacattccaagcaagcaaacaatagaattctagttgggtaactttcagtaaccaatcaccttgttgttgatagcctaaaacaactagcaaaccgaaatgtaacaactagtgacatatacagggcaagtgactccaatctcccgcaagccgtatccaattgagcacaaggtaagactcaagtgacttgcaggaaaacgaggcatcacctactgaaagttaagcctgtttttaagcaccaattgctactatctgtttcacatcatacgagcgagcaaggacgattgagaagaacaggaggaaggttgcggggggtggattacgagtgagccgatatcggtgtcgatgtcggtggactcgacggcggagtcgaggtcctcgggcgagaaggagacgccctccatgggcgcggtgcggcagcgctcggaggcctcgtcgaacagctggcacatccgctcccgctcccgctcctccttggtgagcgcgtacgtcccgcacaccagcgccgacggccgcgtgggcgccgcggggcggcgccgcggcgcgccggagagcggcgggctcgccagccccgcgacgtgctgcgccagggacgccattcgcgctctcggcctacccgctgtggtgtgttgtggttgtggtgtggtgcttcggggcgacgagacgaggcgacggcagcttttcgggttgagggagggtggctgtgttatccggtggccgtgggggtttagccgtttaggataggcgatgggtggttttgggccagcccaggtaagaattccctcgcaaactgtgtgtgttagtattccgtctcggttaattcagctattaatgaggaaaggaccggtctagggtgtgttaggataatagaaaatagaagtaggattgagattagaaaataaacgaagggttaggattaaatagaaaagagggaatgaatggttagaacttaacgatgtcttttagtaggtgaaaaattatttcctattcctattagccaaacactgcctagggagtgacggattcggattaatagaatttgcgcatggccacttaataataacgagaggaaactactgatcaagtggtttcatcgaggatagttataactctaatatattgtaatcatatgaattaagaaaaagcgattatcagtgtttcaaggatgtaggcttcgactagacgccgttcataaatatcatgcttagtgtcttttatgctatatcataaagtagtcgatgaacagtacgaagtatatattcaactgttgtgacggtgtatggacggatgttttatcagtaacaacagaaaaaaaattgcattggtagtatataaactttttcaatgggtgttatctagtgcataaacttgcgaaacgcttgttttggtacacaatatttcttatgcgtgcaaacaaaggttaaaaggacacaaatggcggaatgggtgatcttactgatttaagtgttaattaggatgctatgtaataaacatataggtgagaaggatttgtttttttaataatggattttcattaatccggcctatgtatccacaaaggatacacagccaaaaagatacaagaggacttagactcacgccttaaaaagaggagagcacaaaaccaaaagaaaaacaaacgacctcggcacatcattgcttcctggcattctatcctgaaacatcgagattcggcaagtggaattcgtctagtcaccgccgcccttagtgcttcatcgtggcgagcctccaatgatgccatctccaagcgcttcaaatgagttgatgccacacgtcgccggtttagcccaccttcatccgtcgatgttcagcaagaactagccgaccaaacatgagctaacaagatccacttccactcgcttcgtggattcctagacctttgccgcccctagagccgctgtcatcttcaggatcttcttgcccctcctggactcctagctcaccaccgcccctagggccgtcagctccgccagagtcctctgcagtcacagtcgaggaaatcctctttcacccgaattcccaggcatctgccgctcctaggtccgccgccgccgaggggatccgccttctcctcaccttgaaccttgcaccagcactcaagccaccgccgtctcgggccgcctctgcccctagggttgccactgccgccactagagaagtcttccgccggacttataagccattgctgctagtcaccgctgcgaacaagaccaccttcaccaaatcctgccatgtccttgccaaggatacgccgacgatgcttaggccgccgccatcctctgcccgaagggatgccgccgacgacacctagtcgctacccgccgccctcccaaccacctccactgctgacactaggtcgcgcagctagacgtgggcttggtcgccaccgcaacgcctctgcctctcccagctttcggccgcctcctacgccgccaaaacaagggcgagaaccctagccccaacgcccccccccccccccccctccattcaatagggagccaggcccccgccgaggaagccccgccgcctccttcctcgcggcctgctcgggcaacgacaaggcactggagaagacgaaaggtcgggagtggagggcttcggatggagaagacgaagggtcgggagccatataggtgagaaggatgtcacgtaaacatatatatactagataataccccacgcgttgcagcgggatatttgaataactttcagtgattagtacatttgcatggaagttgtaagttatatatagtcttccagaaacactacatactgaaaagagaacgcaagtaatgattattgaagaactgatttagctaaggaacactcttgttaaccgctcatggtaatgaaaatgcgatgtgaaatactatgatagaagtacttgatcacatatgggtataacatgcaaagagccatagcatatacatttcgttacttatagggatagtagcttcagttgtgctatgtaaaagtccaaccgtttctacgttgactactgaagctagctaagagcaggtatagactattagctagctataaacatattttaataagataaacgataagagagaagagcatacgggctacagatctgtagccagctgcagcacggactcccaaacacgatgtgtgtatgacatgtgggaccatatattaatagtatagtaagcggctattatatgaattggctattagattgattataaatgaattggagccggtagtgacctatactattaaacttgctctaattagttttctccaccaatcaatgcatcatgattgaggatagaaaaaattgaacatcgattaacttgtttgtagctactggccaagtgagtgtgttccattttccatttaatagtctactctgttcacagcaacaatgagcatgcatgcgaacaaaacgaaatctgcattttcagtacaacacaaatgtcaatgcaggtaatactcgaaagaatgaattaattgtgttatgcacagaaaaaacaggaagctgaaccttgaaattctagattttatatattcctaggatgagtggaagaccccagtgcttttacgaacttagaaatcagctttctgtgattccggcaacaaatgcactgggggcttagaaaccaaacaaaagtaatgtatatgaggtacgaagtacctgcgaggttaaaagatgaactacctggaacaaccattttaattcttcgttttcagttgctccgttctataacagcttagcaacgaatcttcagatgaagtctgggtttctatttgcaacaacctttgattggaactaattaaaatgataatacgcccagaaattaagatatgctaccatgatttattaggcaccatccaaagaaaaacaatagggaggattaaaaatgggcaagtgaaatatttttcaatacacgaaatagatcaaaaccctatagagcataaacagaacataaatacagatacatcacatgatagagttcccacatagtgaggcacatagtaaatcttgcccatggagtcagaatagcacggagaaaaggcatgagctgaaacaataaaacttaaggccaatttaagcactaatatcgagcaagataaatcggtggaaccttgttttgtttccaatgacttccaaatcggacttgctggaataatgggcaaggagttcacttgcaaggtgaaagaactggtcaatgtagttgccatgagacagcgagaatgcccgatattgctttgttcagactttagagggtcttgtatagaattaaggtgagaaatgaacagactcaataagatggaaagccagtagaagataagtcggtcattacaaaggagaaagaacgtcaaggaagtgaaggaactgctgaggaggaggtcgaacgacaatggcagcaggaatctcaggggacaacatgcagatggaaggaaaactgatctgacggctctccttttgaaagtgacgtggtgcaccaggaagcaggaaaataacttagtggggatgaattgtataggtatatataggatatgtttaatacaaggtataataagacatgtgaatatgtgattgcacaaagaaagaaagaaaaataattgagtacgatgcaagggtggaaaaaagatgggtaaagcaaaagcaagtttacaaatatagcatatctcatacccacttcaggtgtgcaattcacgtcaaatacgtccagattaataaaattggtcttgccatgtcattttggttttagttcacacacgtcaaataaatctgtgtataaaaatgtatgttttataagtttattcactaagtcacacctattagataaatttatacaccaccaatacctattagaactataatataatgtcattattgtttttcctagcaaccaaagtctgcgattcagagaacaataatagaatactattatgtacatacttctatcgtcttttggttggttgaaggatgaataataccaaatatctttttttggttgaaggatgaattatatcaaatattgccgtaatgttagtacgggtatattactagttttgttaaggtgctcacgatctgttgtccaagtaaagatcgttgttgtatttgatctgcttcggaatataacgctgcagtccaacaaggcaacacattcctggcacggccggcccaaattggtgcagcccaataagccctcgcgtccggccctactcgaggcagcgtgttcttggacttaatccgaagtattgccagcccaactcagatttgtggacttgatccaaagttttgccctctcaagcagtggtgccctcggcctcggcgagccccgaaatcgatttctccttgcacgcgcggcaatactgcgaaagtgcgaatagttcagatcgttattaacttaccacgaaatcacaatcatggtctggaaccacgaaaagaatgtccgagtttacctcgcgacccgcgttgcgataaagatcaaggaaaaacttccgtgagcccatccaaatttccgatctgccgcggacgtcgatggatcgctccgtcattgttgccgcttgtaaggtgacacgtcccgatccccagacagacggacgcgcctacgtagtagtagtacgaggcgaccgaccacaaactccggggccttacatcggtcgccacgaagcacacggccacgtcgccgtgagagcaaaaaatcgcgccggccatacggggtcacagctagcatctccccgtggagtcgtacgtggcggcacgtacgtaccggcgggactcccccgcccccgcgcggccgacacgggctcgccattcgccgagtgctgccagccaagcaggcggtgctgcgcgtacgcgtacagtaccggtacacgtcgcctcggcccggtcgcgagctcacgattcggcgcgactcgagacgaggccatgacgccatgtacgtacgccccgtcgcctcgtagtcgtagcacggtagcagcgagcggccccggcacgagagagatcgtcaggttcagtggatcaccgaccaaccgccaacgggatatttcgcgcggatgaaccgttgcccgccgcgaatttcggtcacggatttgttggggttcggttgcaatttgcaagcacggtaatgcactcgtggtgaccgcctatgaccttttggtccccgttactgaaaatctgaaggtaagtattatcgtatgataatctaattaagtattattatgcttatttattatgttatataggagtacttgcctatgtcaaatacacaaataaaattgtctaaaaatgtgaactttatttcttaaaaagtataaattagcagagtgaatgcagctcaattggttaatttccttatagtgaaaccaaccaatccaagtaaatcgtagaattgatatggtgctcttatttatggtaaattattcttttaatgttagattataaagttacatcaacaacaaggcacctatgcgtcagcctaatattttggaggtcttagcaagaatatgatattggggaaatatcatgtgaaaatgaattaagtgtttaaaactcgtgaaaattatacctaaaatttttgtaaattcatgaaaaaaaattactagagatatgtgtagatatgaaatatattctcaccaaataacaagtcatcaacttcatttgagaggaaaagaaaaaaaagaaaaaattcaggtgaatagtaacatttagccaattttcaccacatatgtcctctatggtattataagcccacctcggtattagaagcccacctcttggttgtcatcgttcgatcacttccttttccactaagtgattgcttagggaccttagcgtacgatctgtgctgtttccctcatgatcaaattagactagtttcatttcgtggattcaaacatgagggagtatattgtatccactttggtccaatgagttctaggcttccaactgaggcctcacattggctcatttcaaagtaagttgagaccacctgattcttacctagataatatttagagcatgtttggtcaatcctcgtgagggagatattagaaggaatttatttcacacctattggggtgtaaaattattctctcgatcccctctaatcctcttcaatctcctccaaaccgaacaagatcttatctaacttaaaacattctcaattggacttttacaaattcaactagataaaataatatgtttttctttccaattggaaaaatgagggaggtggtacactattagtattatgttacatttgaatcttaaggtcacacttgacttagatggtggtcaattggttatggttgaaaatgagcttgtaataattatttgaaagtacaaatgaatgaccgttaggagattgggaaataaacatattataattcctcagacaactaagtaaacctctcaaaacttggtttatttgaacaagagagatgtatttgtgcgctttgtttctttctgttaatttgagtagaaactttgaaagtttgaagtcacaagtcaaaagtttttttagttttatttgagagttttagactttgaattgaaaggtttactgtataagtttcttaagttctagttggatgttttagatttttaattg

SEQ ID NO: 70393 - DNA, 3988 bp, Oryza sativa
atattttaataatataatgagaaaaatatgtgctattatatgagagaaaatataatgatgctagccgcgcaatctgcgcgggccaccatgctagtttattatatatgttagctttaagatgagctaatagtaagaaatgatctatactattatccttgctctcatcactgaagtcaaaagctacatgcacgcactgatctgcgagcaatgtccaggaatcatgccactgatccatcgggttaatcgtacttaagtcttatctaaaattccaggtcgtactgtactactactactactttgctgttctgtggacagtaatacctggagcagtcagcagatcaccatgggaaaaaaaacagttcatccaactaatttaaccaattggcaagttgggagacttgataatcataaatttatcttgaaaaagaaatgatgttttctagcttagatcagcagcctaagctgatgtagtagaaggctgcggcgtgttcttaccggcgagcacagcctcgccgttgaaatcaacggccgggcaattctcaggtagagccacaccgatctattatactccttccgtcccaaaaaaatcaacctgaacgaaaatatgatctctttacaatgaatctacacagaagtcacatgttagttttttttttacgaaggaagtaagtttttaattgtcacgcaaggttagttccacctcgcgcgaccgcaagcgagtcgtcccgtgagccgccgtcgccatcgtcctggtaagtcgtcggcgacggcaagtctctgccgctgatggtgcttgtcgcgcagtgcgacgcgacacgaagttagcatcagctgcagcgaaattgagaaacgggaacatgttttacataaccaaaccgatcagttcaacccatattgcgttatgggctggtccaagtgaagctcgtagtgatttcctttttttgggccaagaactcgacggctcgacaaatggatagttgggcccatctggtgaacgggctggtgctagagtactagtggaaatcttttttcgaaacttgtgagctaagaatcaaattcgtgtagtaaaggtctaacctcacaattgtccatggcagcataatgcataaccttacaagttattatccatagcacatcagttacattacatacagattttaggcctgttcactttgatgcaaaaaaaaaccttactaaattttagcaattgctaaaattttggcaacttgctaaaattttgataggattttttatatagttaccaaaatttgctagcaaaataaatgtagccacttttttttttgacaactttaccaaaatttagtaaggttgaaaatggcaccaaagtaaacaggccctttaaaccatatgttttaaggagtttaacgagatgaatcttatttctaactcgtgatgttaataggttgaaccaagctagctcgttaacttaacgactcttacgagttggctcgttagctatcgcgaccctggcagataacaacgccagcctggctggtcgtctacttgacgagtgatgatgagttgatggctgatgagggtaccacactaccacagtccaaatcagggccgtggaatgcactctccattttggccgctctagccagaagaaaatcggaaatcggccgggacagacaaactccatcaccaagtgccgctcgtggcggccgtgggttccgcacttccgctgcatgcctgtatgtcacgggtagcatgattcggctcacatcttctgtcattatgatattatcattatagctactgacacgtaaaacaatagaatattgagatccgcatatcagtgactataacgataataatattatggtaaatagtcatcaacctagctagtgtgtctctgtagcatttgaaacataattcatcacattattaatacaaatcatctacttagttatatataaaagtaattattttgaaaaaaaaataaaagttaacttaatagcttaaattaagcttagcttaatcgtctaaacaatggcaaacaatgtcacagagggaagctctctgataccgtatttctataaatacggagattctgcagtaacaatgtaatgagtaagttgaaaaaaagaacatgacacaaaacatggctaattagtatcctttcgttctagaatacaataactgatgaatatagataaatgcatatttaaattcgtaaataaaagcaagtaaaatagcaggttgtaattaagctaatgtcacgcccagaaattcacgaaccagaatttctaagctgaatgtgtattaaacccctgtccagaaccagccagggtacacaaacgacaattgttgacatacagatccacgtcttacaaaaatataaaagattacaaagcagcggaaaagataaaagcgagctaaaccgggaagcttgacttgagcagcggggcgactccattccacaggcaatccttgacggcagcgacggaaccaacctctctgagacggctccaactgagaagaacttcaactctgttgtgggggaaaagagagcaagactgagtactacccactgtactcagcaagtcataccggaagaggaggtatgatgcaggatataaccaaaggaggctacgaggttcatttgcataaagcaggcatttaaaaccagtagttgaaaacagtaaaaacagttgtagtaattaagtaatattaaccagtcactgtccaacgctacatcacgttgtaacaggcccaaccaaccacctgaactacaccagctcattaagctaaactagggggtgagactaatcacggtgaatctggtcgaccgcccataaccgcgggcacggctattcgaatagttttactctgatcagaggtgtacaactgtacccacaagacacagccccacgacacgttcccgtgcgccgacatgctaccacgacataccggaaagaggccgtgacaggacccttcgcataaccccctctaaccgatcgcaccacaccttagggttcgcccccgcccccagcaggcaacgggcagcccccctttcgtgccgcagtgaattcggaagccgatcaaccggacaccccggccgacccaactctatcacgcccaccctcgcctgggtacgtcggctagagaaaagctacactacaagtccagccgttgcccacgctggcttgtggtaagtacgataaattcttccagggtttcccgtgaaccggtccttaatcgccatgggcacaactagcaaaccatgcacccacagcccaccgtgcagtgtattttaataagccaacaccattacggtgccactaatccaaagctattgccaataatcaaagtctatgctttaatgagattccctttttgtgtactagtagaactaagcatggctaagcatttcctaaaccaacatctaatcattttgatacccaagttatcaatggcataaggtaaacaatgtatggctgagtaataggacccatcccacatgacattgtaaaagagtgcaacatttgatagaaatgcagggtgtttgtaaattgggtacaatatgatcaaatgtaaagcatgacttaccttgctctcgcactgatgagaccacaacaacttcttcgagaaaccgcggatcgacgaaacgaccgaaatctacgcgacaaacaaagcacacaagcaaagcaggctataagactactgaaacaggaaacaaaaccatttttaatggattctatgcatttttatgaatttaatgagacttgaatggacttaatcggagctcggatgaattagatataatttttagaagattatctgtgtttattactataacaaaaagtccttaaataatttatcgcgcaataaatcccagggctggcgtcatctaaggggggggcggctgcgccgacaggtgggccccgcttgtcagcggctcaagagagagagggggcgccggcacgtgggccccactggctgtggcacaatgcgggagggggtg

SEQ ID NO: 70394 - DNA, 20233 bp, Oryza sativa
  unsure (1)..(20233): unsure at all n locations
aaaaagcccaaacgtctaatgaaccttaaatctagaaattctcctaacaacatataatttgtggataatacttctatacctgtgttattcatgattaaaaagacattgctaacaaataaactaggatgaaaaaattctaaaagtaatttaaaaattaagctttaaaattaaaatttttacagcggcttgtgagctgaaagacagacgataggaagcattccatatgtcgcttttttgctgttaaatgttatcttaagatgaccttagcgttctctgaagtatccagattcctgaattcctcttcttgtttaaattgaccaaaaaagcatgagagtttgaatgcctttttcttgtcctttttgttggatggatgcgcacctttgagatacctacttcactagtttgtttgtttttaatggtgttagccaaatggtcatatttgagacacgaattttcccctgattagttcttgagaaaaagctcaaacgtctaatgaaccttaaatctagaaattctcctaacaacatataatttgtggataatacttctatacctgtgttattcatgattaaaaagacattgctaacaaataaactaggatgaaaaaattctaaaagtaatttaaaaattaagctttaaaattaaaatttttacagcggcttgtgagctgaaagacagacgataggaagcattccatatgtcgcttttttgctgttaagtcattttggatatattttttttggacaatcttttggatttatgaatctaacaaaacaaacaagagggaagatgtgcacaccaatgaaaatgatagatgcccatcaagtctacacgcgtcgtaagactgacatggagattctgagcaagacagcgatcggcatatgagcatggctgcaagttnaactaccccccccccccccccccaacgatgaaaacgactttgtcacatgaataaatccaaaccgcagatatgttcactatatgcatccatatattaatttaagaaagaaattgtttaaaactttggcacgatgcatttatatatgtgatcatttttcagatcttgactagagggatattacaagtctcggtacgcgttttcatgacaggagcaccttggctcttagatcttctgttcgttaagaaaatatggtttgctcaacaatgccattaacacagacaaaatccaaagtttcagttttgtcacattggtatagcatactaattgctcccttcatcactccacaaaatttcaaatctaaactcgatttacaaatttagaaacctaaatgatttccaacctaaacatagctcacattcgttggctatggttaataacgtagaaaataaacgagacaactaacaaaattttatggtaggatttttatatttttcactattgaaaagccaaatctgtaaaaaagataacgacgaaaaaacaactagaatcatttaaaatttataattttagctgtggatcataaaccagcaagcaaacaaatgatggtttcatcatcaaattgatcaagtgcagggcagcacaactgatgaactgatggccaaccacaccgcgggctacaaagtggggatctctaatttcacagcgttagtacgtgactacgtgctaactatcttgagatttggagcatttggcccaagtcaaggtcttttcctacgtgtaacgcgtactcccatgccaatcagccgccgatgcgccatggcaagtaaccgcgtggcccaccatgcaggttactacttgtactgatttcatttttattctggtctttctcgaggacttgtattttatactaccagcaaactactaaaatcattgttgtttagttaaatccatcttgagagagagagagagagagagaggtccatctctgcgattgtcatggctacaggtctagtcatgcttccaagttccaactgtagcgtagactggagtgttattttttttaattagatgatgaagtgttgtttggggttgtacttgcaatgggctagttgcattaacaaaagacatttcaaagatcaaagagtgatcgagatactaaaatggcggttaaaacgcgtctttcatgcgccacttgcatcaccagaatatgaggaagatgcctaccacgacatgcttgttctagatttcagaaatttaaaccaaatctcagtatttgatcactatccctctttagcacaagttgacacaaccacacagcaatgatgatggattatggaatattcagattgtagagttagtactccaaatgagtactaacatgcttcactagatcatgttattgcttaaaacatgctttatttttaatggtcatttgtgattcaacggttcaggcatatcataccaccggtagtagttgcatgtagatggagcagacttttgtgaggctgtcagttactccatctttgtctgttgacaagaccatcagttagtttagttaaatcggtagcagatccagaatatgccataatgaaccttaattgaaaacacttgttaatttaccaggaaatgggtcctgcttcaggagcagcattttttgtcaactgctctagccgaaattccacctccaaattcaaaagttttcttgcttggacaccttcttgacaatttaccagttttggtgtttgtgtgcttggactcatgtttgttattgtccattttaaatgtcgactacatcagcccctgtaatcgccaaattttcaactctgtttagagagacagacagtttgcttctctgtatcacagaaataaggttcatgtatatgcagatgtacaaatgtaggagtacaatgcaagtagcgaacagtttacacaaagagaaacatttgtttaccaatcattacgatggtttcttatcatattcaacacccaaatcccatcgttcttgtattctccactagtcttgggtcatccattcttcagacagttttgtcagaaaagcaacaaagctaagaacaaatactaatgcaatccagagacaaatttaattttcctagaatcatcaataaaagtacattaggaatcctgttctttctgtactgtctacatgacggcggacggccgcctgtcacataatctttcggcgccggagaggagcgagacgacgacgcgacgacgggagagcgacgttgacctctgcgagcccatgacatggcaccattacatcactctctctctctcgctcgctcgctactccagactgaagcaacctccttcgtctcgccttcccggaatcttcctcccaacttccatcctctcactgttcgaaccgccattgcggctgcagtataaatcgagccgtccgcacactgcaactcctcctacgcaaaccaccccaacctgcacaacctctcctcaccgaaccaaaatctcacagcttcgcttctctctcgcctcccgaagaaaatagctagagaaaaaattcgcggatcaagaaggaaaaagaaaaggaacacttgagcttgtttggactgacaacaatggcggcgaagcggcttcacgacggctacggacaggaggaccagcccgacgacaagcgtgtgcgccgcatgccgtccttctcgacgtgagctagctttcttctccttcgctattgctctgcttgtgatcgttcaaggggagattggttctaattaacatgtgtttgcttttcgattccagggtgatccgtgaggccttgatggtgaagcagatgcagactctgttcgtcgcactggagccacttctccgtagagtggtaagcaggcaggagatgatcgatttgcagttgcacagagcttgttccaactgttcttggattgcagtgtgctaattgctctgtttctttgttacttgcaggtgcaggaggagctccaggcaggtctcgtgcgcagcccgcgttacatcgagaggtgagaattcacaacgaaatccgcaagaacagcgtcgaacagcagcaagaaatccgaatgatgtataacattgtttgatctgtattgtcaggatgtcgcctgagacgccgccggctcagccgccgatgtggaagctggcgttccggttcaagccgcagctcccgatcttcaccgggagcaagatcgaggacgtgaacggcaacccactggagatcatcctcgtcgacgtcgacaccggcgcgccggcgacgatctcgcagcctctgcgcgtcgaggtcgtcccggtcctgggcgacttcccgccggacgaccgcgagcactggacggcggaggagttccagcagaggggcatcgtgaaggagcgctccggcaagcgcccgctcctcaccggcgacgtcagcctcaccatgcgcgacggctgcgtcgtcgtgaacgagctccagttcacggacaactcctcctgggttcgctgccgcaggttccgcatcggcgtccgcgtcgtgccgggcagctacgacggcccaagaataggcgaggccatgaccgagcccttcgtcgtcagagaccaccgcggcgaacgtacgtttcgtcagagaccatcacgagttcaccacactacatctctctcctcttctctgaattgtttccctgacgatttggcgtgtgatttgcagtgtacaggaagcactaccctcccgttcttggcgacgatgtctggaggcttgagaagattggcaaggagggtgccttccacaggaagctgacgcagcacaacgtcaggaacgtgcaggagttcttgcggctgctcacggttaagccggacgagctgcgcgctgtaagcttccaccgcatttgatctcgcaaatcacaatgcttctccaacgcatgggtggattctgaacattgctctgttctttgtgttcagatcatgggcgacggcatgaccgatcgcatgtgggaggtgacgacgagccacgccaagaagtgcgtccccggcgacaaggtgtacatgtacagcacgcagcacggcaccgtctacgtcaactccatcttcgagctcgtgaaggtcgagctcgccggcgtggagtaccagctgcaccagctgaacaggggtcagaaggcgttcgtgcatcagctgctgctggcggcgtacgagcagcgaaacaacctccaagaggccgacgccatggcgctccactgcaacgacgttcctctgctgcagagtaagtatcggttactacagatttgctcaacatcgagcgttagtttcgcagtgttctcatctgttcttgtgcttgaacaatctgcagatgcagcggagataactatcccggcgcttggagacacgcagctgtggattcagaacagtctcaacagccaagaaatcgacttccaggtcgacgagatcccccaagctaactttgcgcttcagtggactggccaaatgtacaacatttcaggctaagaacagtcactgatgaacagtaactaaggctggggactttaaaaggtttcagaaatagggtgtacattgtcttttcaagttcgcgtctgtataactgtgttcaagtgacacgaaggttaagggtaggtgaacaacagcttgagcggccctcactgtctcgcagagaatgtggccaatttggccagcatcggcgagagcaagaagaggcgagcaagttaattctttggtttaattggtatcctttgttgcagtttttcttcttcgtgtttagtcaagtagtagtgttcttctcccaaaggttgcattgttaatgttggggtgtcgcaacatggagaaggagaacatgtatgatgataatgcagaacctgtaagagcaaaccggtcgttctgcgatgttaacattttgctgaagtttttgtgtctgtaacatcaagtcccagtaaataaataactcattttttttttgtacacagagtccactttgtcttcagatttctttagcagtggtgcctgaagcctgaaactgaaacacaagcttgacttgcattgcatatctgaatctctttatttccccgtttctgaacttagcttggcatgcacatgcatagtttcagtgggtgatatacggggaaaaatgaacgaaacgtctaaaaccaaaattaatgtatgaataaaaaaatataccagtattattaacggttcaaaatctaatactgtaaaatagacttacgatgaaagaaaccacaactccaactagtttcaaaatttaaactgtaactctaaaattaagtttcaaaattaaaatattgattacaattgacaggtctttgtttttttttaaaaaaaagtttacaattggcaggtgaaaggtaactgtggggccatcctctattcctgacccgcccaaagccccacaaacaacaaacaatttggagcaagaaagactgggtgccaggcgagtaggcgacgtggcctgagaagtcaagtcaagagatagagagagagagagatagtttgcgcgttaaacatcagacgtgggcgcaaaactgtactgcgacaagcaaccctaggaaatgaaagcagagggcagagcaaactccgggatctcttcccaactccgggattcaacaaaagcaaaccgcgttgcactctttttttcttcttcttttgtttttttggcgattgactatacactagaggacgaggaggagcataagtaagtcaattgttgttatctaaaacacatattgttccaattatcttcacaatgtatcgtagccgatttttgaccgtcggatatttggatctatatccggctcctccttatcctacaattaattaggtattagcaaaaagttttttaaaaatgattaatatgctttttataacaacttttctatagatttttttttaaaaaaatgtagaagtacacgtatgaaaccgttcaaaaaaaagtacacgtatggaaaacaatagagtagacgctgggaaactgtaccatagaatacacccgaatcctcgatcttcagttcatcagatcacccacggccaataatccggcaatttcctacttttctgggctttatctaaacctgattgtcatccctcgaaaacgtaattgtgcaaaaaaaaaatattatctttgatgtcgatcaaatggtgaaaaatatcgattgggattacgctaaaagcgataagtatgcattatttatctttagcaattttgttatgcttaataggccggctctatcaggtcagttcagattgaagggacgtgcaggcccagagaaaagtatccaacctcaaggcccgaacttccgatatctccactgcactgggccgctcaaagcccagttcaatttagcacatgaaaacccacaaaagtaacaacagaacgggccgaaatcggtatgctcatgcatgatcatatacacacgagacatggtactttaaattggtcgtttatttactgcaaatctgtaggtagcaaatacaaatccaataccctcttttacggtttaaattaccacacacggacacgccaaggccctataatcacaacataaaacaacatcacatctcttctgatcgatctaaaaaataatcccaatcccaatataatccgtatatatgcaatgcacttaaccgttctatgtactacacgtatgaacgtatgaatcccccccgatgatggagttggctggctagagatccatgtcgagcacgagtgggccatctcccttgccgacgtcgaactgctggtacttcatctcgccggcgccggtggtgagctgcacgacgtacttgccgtggaaccccctgaacttgaagtggccgctgccgtcgacctgcccccgcgcgtgcgacgtccactcctgccggagacccacgtagcggtggccggcctcgttgagcttcccgtcggcgtcgacgaggtgcgcgtgggagcgccacatgttgccctgcatgaacccccacagcatgatcccctccaccgccgggtgcgcgaacgcctcccggagcacgatctccaggtcgtcggcgcgcaccgcctcgtccgccgccgacacgtccagctccgtgatccacacggggagacccgtgacggcgagcctgtccagcgcgtcgcagatcacgtcgcccaccgggtgcgtcacgtggccctgcacgccgatgccgcccaccgccgcgccgcgcttctgcaggtcggtgaccagctccacgtaccgctccggcgtcgcgttcgggtcgttggcgctctccacgttgtagtcgttgacgaacagcgccggcgacgggtccatctgcgccgtctcccggaacatgcgcgcgttgatgtcgtcgcccagcctctgctggaagaaggcgccgtggagcatctcgttgttcacctcgtagtgcgggaacctgccgccgtaccgcgtcacgaggctgcggaggcggccctccacggcggcgcggagctgatcgccgttgagcgcgcggacccacggctgcacgacgttctcgacggcccagaagatgcagtggccgcgcacgggcttgccgtggcggtcgcagaaggcgatgagctcgtcggcgtcggagtagctgacctgcccctgcaccgcctcggtgtagtaccacttgagctcgttctcgagcaccgcccagtcgaagtgcttggtgaagaagtccacgaacgccgggttctggatcgccgtcttgttgatgcacgcgccgatggggaagctgttctccacctgcaccacgcggatcgccgtgccgcccgttcgccgccccagcttgagcaccacatcacgcttgcgcacctatgtagtagtttttgcagaaatttcgagtgttatgatattttgttactatattgggagaaagaaattcgtgtatgattgggtggatctttgattagatggggtgaaaatttttgtgcttgagtgagtgtgaagcaaatgaagcaaagtgtaatgttttcctttcattttacaatgttcctatgcaaattttatggtcatttgctcaacgcaatgatcatgtacgtgaattgtcatgtgggccattgcttttgcatgcgcttgagtgcaacgtactactcactttttgttgaggcagttcatagctcgtcatgttgcttatgtcattcatgtgatcacgttgcgtagtgctagatttttttttatgtaaaaagtgctatagattatagttatgtttttcataccttgtcagttttcttcctgaggtgcctgagcctcgcgatcttgttcacggcgaatacctgcaggtccatcaccttgagatccaccccggccggcggtccatggacgaacaccttggcgcagcgcggcggctcgtcgtcgtccacccggaaagagcccatgatctcgccccatttccccgcttccgccacgaccacgccgccgccgaccgggcgaccgtcgtccgtgcaaacctcgacgcgcacggcgtggcagcacccgtccgccgcccccgcgccctgcaggccgacccacccggccacgcggtacgtgactttggccgccggcgcgcgcgagagctcccggcagaggccgtccctctcgccggcacggtgcgccgccagcacgtaccgcccgctgggcctcggcctgggctcgtcggcgtcgtcttccgtagcggacagaggatgcggcggtggcgtctccggcgccgggtcgtcgtgcacggacagtgtgcaggagccagacggggtccagccggccactgccaggccgccgccatcctcgcagtgctcgacatggttcatgaccaagtgcgttgtctcctgcgggcgccaacaacacatggtgtacactagtgtcagagaaagacacatgtcgcggaacaccattcagagattgctggcgcgaaatgggtgtggttgaagaagaaatcctatagcagttcgatatgggtgacgcactggctagcttattgtcacttgtcaggatcagacagctaatttatgtgagacatctgtaacgagctactccagctcgtgtagttttgcttggctttaaagcagagaattggaatgcacctacaagggcataactactctgaattctcaagagaattggaatgcacctacaatgcacctacttttgtgccatgaattcacaagaccattgaagttgcaataaagttttaattttcaggttgccagagtcccagagaagaactaaacaacaagcaggtttgccagtgagctctcagctctggcagtaatattgcaaactttgccaccaaccactgtaagaattggtgtgttacaatctagtagagagcagtcagacatggtaattaagctctaattaagctgagtagctgacagttgagaacttgcaaagctgagagcatcacatacctcggtgaacgccatatggaccgaaggagtgcgaggggaaaactctgaatctgcagcaagtctcagctagcgtttgtgcttttggctgctgggttccggtggcaagtgagaccgactgtgtgagagatgagacgcacgcaggcgggcaatttataaggctgcgtagctgccggtttggtcggcaatcacacatccatcgcgacacagcggaaaggcagagtcactagccaaaaaccggtgtttcatacagcagagactactaaaaccaagcttagctacctaactcatatctttctcctatcttttgtacaaaactgaagattgggcaatgcagattagtcgtcacactggaccgtacaagtcgctgacgagtggggcccgattgtctcggatgattagtcgagaagataccgtaggtaattcggtcactctgataaattagcttcttattaatctgtcatggtaatgatcactagcaacatccaagcgtctccggatcctgacacttttcttggctttgggaggagtaaaagtggatcaatccttcggtcgttggtgggacaattgcattttattatattttgcatggatcgttaacctaaagctaaaaatgaaagcctgtccatggaagaaaaaaaaaacagagatgtcctcctgatgggcatgtactttcaacagacaatcttctcgtctctgctagtacgactcgtactagacaaacgtcgatgtgaactgcaaaagatttctactagcttttttgtgaaaaaaaatgtgaactgcatgtttcaccattggagtagtgctacttgcagccgtcccaactggatctgtctagcttttcggtgaacgaagttacaagccatagccatggcgtcaagctacgagaatcggccgacgcaagatcgtgacacgtctagaagagcagatcagaatacagcatatgcatatggttgcatctcgtgttccagacttgcacacttgagcttgcatagcctcatgtctgaagtctgaacatcgaacgaatggaacgaattcaacggatgaatcttgacggcacaaacaagccgccgaccggagcaaacattgtgaatcgtgatgcatttttacatgcaaatccttgcttagaaagcatcgaagcacgtccacgaattgatcacaaaaaattatagaagttaatgcgtaatgaacttgcatatgcatggagatcgcacgatctgtatatctagctttaataaatattttccttgcaacatccaacacatatcttcatatctcaaaagacacttaaacagtacctactattgcattggataatctagaagaccaatagatctagagggatgaactaatctagcaaaatacagcgtgtgacgaaaatacggtgatagtaatgaatgctataatacttttttgcaagaacaccagtaggagtatttgtttggcaacaaattttactccatttaatcgtcgcaaaaaaaaaggttttgttaaatttcgttgagggccttaatatatgttgggccaatgcaatttgggccttttaagccttcgatccagaaggcggtggacgctggtcatgttttcatttggaagtgcctctgttcaacggtcaaccgccataacaatttgtggtttgaattattttcgaagagtttttataccttttttaagagatgccatgttttttttactccttttaggaagtactgtcaacctctcatctccaatcattgacagcggtggaaacaacccccggacatgttggggcttccagagacctagataaattgggtggccactcacgctctattgttgtcacttttactattgagtgctatctatttaagtgaaatattggtcgatcatcgtgaaacgctattaatcgtttagacttgccgttgggaattaactgaacaagctctaaatgaaccgtgttttaacttttaagctctataaaacaacaattgagaccatgtttagtacaactccttgtcgcctcctctaacctctaaactttactatacgcctgcgcggactatctttttatcggttcaacacacctaaaaggaatataaatggctggaaattgagggggaaaaacattttctgaacctaaccaaatgtggtagtacaaaacatcgcatattcgttatattatatttaaaaaaagaaaatcatgttctataaaacgaggattagcccgtttttaccttatttcttgattaactttaaccagtacaataccttacttttctcatacaatacccaaatgttgaaaatgtaaaattgtagttgttgtatgtgaggtacaagttgctttgccctctgtccgaagtggccgtgcaatctgttctctgctctcacacagccaagagtggaaggaggactcattcaccagtagacaattaggatgcccaatggtggagaagcatccaccacagcttcctggattaggggcaggcgaccacgatatgatcaattctctcctcatattgctcgtagagaacacagagatccggatgcggtaagcctctggggcacagtctgtcagccgtccaacaacgctttagggcaactagccaggggaagtaatgacatcaagggggtgcaagagacctccagataggctcttgactgaaaggggattcgaccgaagaagaaagcattgtaggccgagctggaagagtagtggccagaactctcccacttccagataaagcgatcaagtcgatcctcgagctggatcgattgcaactatttaaacttttaaggtctattaaacaacgattgagaccctgtttagcacagctccttgtcaccttagaaatataaatagctggaaactgaaaggaaaaaaaacattttctgaacctaatgaaatgtggtagtacaaaacatcgtatatattgcacagataatcccgttatattatatatatatatatttttaaaaagataatcatgtactataaaacgaggaatagcccgtttttactttatttcttaattaactttaaccagtacaataccttacttttctcatacaatagttgaaaatgtaaaattgtagttgttgtatgtgatcgaggtaaaagttgctttgccctctgttcgatcaaataatcatcagtataaactgtatggagtataaaataatggaagtaatcgtcagacgtccatatccagcacaagaggggtgtcccccttctccacggtgaacgtcttgtgcatcttccccgtcgccgtcgcgagctgcacgacgtacgtgccgtggaagcccctgaacttgaagtggccgtcgccgtcgatgtggccgcgcgcgtgcgacgtccactcccgccggagatctatgaacctctcgccggcgtcgttgacggtgccgtcggagttgacgaggcaggcgtcctggcgccacatgtggccctgcatgaaaccccagaacatgacgccctcgacggccgggtgcgcgtacgcctcccggagcaccacctcgaggtcgtcggcgcggaggtcgacgtcagactcgcagacgtcgagctcggtgagccagacggggaggtcggtggtggcgagcttgtcgagcgcgtcgcagatgacctccccgacggggttggtgacgtggccctggaggccgatgccgccgacggccgcgcccttctgctgcagcgcggtgatctgctcgatgtacttctccggcgtggcgttggggtcgttgccgccctcgacgttgtagtcgttgacgaagagcgtggcgcccgggtcgaggcgcgccgtctcccggaacatgaaggcgttgatgtcgtcgccgaggcggtcctggtagaagctgccgtggagcatctcgttgttgacgtcgtagtgcgggaacctgccggcgtagcgggtgaggaggccggtgaggcggccctgcacggcggccgtcagctggtcgtggtcgagccccttgatccactgctgcaccacgttgtcgacggcccagaagatgcagtgcccgcgcaccggcttgccgtagcggtcgcagaagtcgagcagcgcgtcggcgtcggcgtagttgagctgcccctgctgcgcctccgtccagtaccacttgagctcgttctcgaacaccgcccagtcgaagtgcttcgtgaagaagtccacgaacgccgggttctggatcaccccgccattgatgcacgccccgaacgggaagctgctgtccatctgcatcacgcgtacggacgcccccgatatgctccccgccccaccgaacttgagaacgacgtcccgcttccgcacctgcaattaactcaccatcatctcaattaattcacgtacgacgcattgcatggactaattaatcttgcgttaatttggcatacgtggccgcgagagtgacttctcgttacgtgtcaatgatgctcatcgatgtcactatctaaacaacgaattatccattgtagccgtttatctactcacttgaaaattcgatcatttcgtactgtacgtggcacatcatgtgtcatgtgccacgtcgaaagtatgttggtcccgcctaatcatatatggtatagtaggtgctgatgcaatggtgaatggtgattgctcttgaaacgtaaaaatggagatgaaaccaatcgcctagctactgatcgttctcaccaataataaactgttttaaatttggtgcccatcgggtgatgtgagtgctcaccttgtcagtcttcttcctgagtttcctgaaccgtgccctgcgatccgtggcgaagatttggagatccatcaccttcacgtcgacgccgtcgggcgcgccctggacgaacaccgtcgcgccgcacgggctcgccttgagccggaacgcgcccttgatctccgtccacctgccggcctgggcgcacaccgcgccgccctcgacgacgcactcgtcgtcgtcgtcgaggcggaggttgacgcgcaccgggtggctcccctcggcgccgtcgccgaggctgatccacccggccacgcggtacgtgacgcggggcttgagcgcgccggccaccgcccggcgcagcccgtcctcctcgccggcgcggcccgccgcgaggatgtaccggccgctgggcttgtagtcgtcggccaccgtgttgatggtctcggtcggcaccttctccggctcctcattgtgcacggacagcgccgtgcactcgccgaccgccgcccagccggcgagcccgtcctccagcgtgctgttctcgagcaggttcacgtcgaaaaccaccccctgcaaacaaaaagctcaaccataatcgatcaccgtaaataatgctgcttttgaaaaggagtgagtacatagctggcaaagtgatcaatcaaccaattttgttgattgtgccgtaccttggtgcaggccatgatcgtggcagcaggagcaggtgatcgccggagtctggaacgacttgttcgccgtggattggtgatttgcggtggcgagtcacggcgatcggacgagaccgtatataaaggtccgatcggtcggccgtcaaaatcattgcgacatagttctaaagcgtaccgaccgccaaaaatattgtgcaaactcgaagcaaccaccaccacagcgagagacgacgacctctgcttctccttctctctctggctttgctgcgtttgagtaacagtaaagcttgggcaagcaaggctgcaattgcatgcgtggccgtctcgttgggtccagggagctgtgtgactggcaaagtgggacccacatgagacgtgccccacatgtcagaggggggtgctttgagataaggtgttctttttagtaagcatcattaccggcacatccaagcatgtgtcaaggccgggtccgtgcttttcttggctttgggaagagacaactaaaagcgatttgtttagtcgccggtaacgccaaacgtggaatcattagggcacaaaccaatcggagattagattcgacatggactttttctgtccacgataatctctcgtttttttagcactgttcgttaggaggactgaactcgtcatgtactgctaatctcatcatgctactgtgtttgctaattaatttaccggtaattaagcagagggcgcctagagctagccggaattgagaacttgggataagaggagaggagagtgcgacggcggcgtatccaagttgcaggcaggcagccgccccacgacatgactacgacgacgacgacgacgataatggaggatcaattaggcgtagggagtggaagtacgaagcttcaagacacaaacatcggctactaaaacgtgaggtttggtgacggatcgtgtggctgtcaatccaatgaaggaactttgtacttcatagccgcaggtccatatgaacatggatccttctcgaatctttgtttgaatcgatcgcatgatactctctttgctacgaaaatacgcaatggaaatgtacatgtttacaacattgaaaaagtccactttgactcccttaattatcggcagaatctaattcgtaaccctcaaccgcaaaaccggataagatgactccccgaactattgaaaccggtgcaatttgactctctcagcggttttggagggcggttttgctgatgtggcgctgacgtgttgatgttgacctagtctccgtctcacgtggcattcaaattaagaaaatatatgtgggacccatttgtcattcacacaaagaaatatattatgggacccactgacatatggagcccacatgtcatcctctctctctctctttttcaccggtctgcaagagcgagagctggacaagcggcggcgaccgacgggaggcaagcgacactagggatctagggcagcggcagcggcggtcgagggagtggtcggcagcggcggcggcgaggccagatcttcctcctccttctctctccctcatctctttctcccctgtttgtgtggccagcaggagtggtcggtggcggcgggatgacgacgggacggccggcggatgacgcctccgccctgccgtgcagcagccgggcaacctcattgtggcgcaccggcaagaaagccctcgccgcgcacggcgacgacgccgcaggtgcccatcttgaggtacatgatgggcccgtacttgcgcgctagcgacgccaggtcggtgtgcggggccgggccgacgagcgggagcgcgtcgaggacagggacgcccgggggtccggggggaggcggcggccgccgccaggggagggcgggcggtgtcacgccccgaactagtcccgaccggaactagcccatgacgctccaaattaacctgttaatcgataccagtcccaggaaacagtgctggtatcacaggaagacagattatcacagcaacagaggtctctttattatagagtaggagtacaatcaagtcgggctgcggacagatcccgagctcacaactgcattacaaaagggaggcggaagccaagacttggaccaaacaacacaggcgcgacttgggaactaggccgaaaccctaaaactcatcgtagccggcttgctcctggaagaactcctcgtcagcgggatccgcttcatcttcttcagcaactggggggattatttatatagagcaagggtgagtacgggagtactcagcaagccatgggaaataagtgtttaatgcaggcttcaaagaaagggctgttgtttttgcaattgattttatttgaactcttttctgaaaacaactaagtgagtgcttctcaaacgacacggatgagacagtgcgtctcgtccggtcggagtatgtgcaatgtatcagtctttaaaattgatcaagattggcacccggccaacaactttcaaacggccacccgggccaacaactttcaaacggccacccgggcctagctgatcccatcagctgcagattttccaaacaacgatccccttttcacgacagcaatttcacaaggcagtagtcaaacaaaactacgctaggaatcacctcacatccgcccatgaccgtgggcacggctgttcgaacagtttgttgacctctgcagagggggtacactttacccacacgacattactaacccggatcacccagcccgtggggatcagccacgtcgggagacctccaagctttcatgacaaggcatttccaaagccgacacaggtttaccatatgccgatgagaggggtcccagaccaacaacaggttaggtcccagaccatactgtgccaagaagcccagaggtcctccccgacaccaccccggcgaatccacatgtctctcggcatcaaggctcccctgataagctagttactcaaccaggggtgtcccattccacccatgtggtcgtacttgtcttatgttcggatgaaattccaaggaaacggtccttaagtgcaagagcgggaaaccgtacacccgatacgttccccggtccgcggttttggaaattcatttagttcgcaagcactgacccaggtgtcgggttttccaagccttttgtaaaacccaagttttacccaagaagtttttcagattttaagtttgaaggcgaccgtcgatactcgcatagggtgcacgaatatcgaggcgcaactagatggttacaaggggacatgatataacaattaacaaaggaaggatcaaatgcaacaaattaggtaagtccgccaatctgccttgcagacgggacaaacagattaagtgcgatcctatcaatgcataatatttttcaagcaacataattaaattcaaatataggctcaagatgttcaaaggtggcttgccttgctcgagatctggagcttgatcctcgaaatcctcgcactgcgggtcttcggactccaaaactatacgcaaaacgggacaactcaacaaacggcgaaaataaagccctattaatgacctctaagcgtgccattagatagatctcgagatttgaggaattttggaagttgaacggagtcaaacggacttacggttgggaagatattgaatttctaagattattggatttttggtctaaaggaaaaggatttaattaaatcctttttgaaaaagaaaagaaaagaaaagaaaagagggagggaaattagacttccctcgggcggctagggtgcggcccgggagaaaaggggcggctcggccgagcttaatgggccggccggcccaaaaggcggcccagagcgcgcgcgggaggggaggagagagggagccggtggaccgggctcacctcgcgtggtcccgggtgggacccgcttatcagcggctcggctcaccgtgcggagggagtatgcagcgtgcgctagggtttggggaagggacgcggtgcacgcgcgcggttcatggaggacgcggatgcggcgggcccacgcgtagcctcacggctcgcggtggaccgcacccgcgagcggggccggagggagcggctgaccggggtcggctcgacccggtcttggccgagctggcgccgacgtggcgcctacgtggctgccacgcgggccggcgggaggtagacgacgatgccggccagaacggacggcggacgacagcggcgagcggcggagcaaaccacggcgatacaggcgaaagcgagcacaccgggtggttgcacgagacgaggggagacgagccaacggctcggattcgccggagggagcttgatggcggcgaattgcggcggcggcaaccggcggcggaagaagggggaaacagcgacgaggtcacgaggggccgattcccggcggcaaaagcatctacgcggctacgggaatccgatgctagcgttgggttaggaggaaacgcatcgagggaggccggcgacgagaggcgcttccgagctcgggcggcgagcacatggcgagcggcggcaacggtcggggcggcgccggctagctacggggaggctacttgtcacgaccggaaataacccaacgggcgttccttacgtgcgtgcattaatccttgtcccaggaggcaaggtacaccaaaagttaatacaattcagagtttaacaagcg

SEQ ID NO: 70395 - DNA, 564 bp, Oryza sativa
gaccgtttccttggaatttcatccgaacataagacaggtacgaccacatgggtggaatgggacacccctggctgagtaactagcttatcgggggagccatgatgctaagagacatgtggattcgccggggtggtgtcggggaggacccctgggcttcctggcacagtatggtctgggacctaatctggtgttggtctgggacccctctcgttggcatatggtgaacctgtgtcggctttcgaaatgccttgtcatgaaagccttaaggtctctagtcgtggccattctgcacggactggatgatccgggttagtaatgtcgtgtgggtaaagtgtacccccctctgcagaggttattaaaactgtttgaacagccgtgcccacggtcatgggcggatgtgaggtgattcctagcgtagttttgtttgactactgccttgtgaaatttgctgttgtggaatgggtttgatgtttgaaaaatctgcggctgatgggatcagccaggcccgggtggccgattgaaagctgttggccgggtgccaatcttgatcaattcaaaagactg

SEQ ID NO: 70396 - DNA, 12004 bp, Oryza sativa
acgtcgattttaatagttacagtctgcatgtaatctatagacatcctcgtacgtaaaaaatcgtgttttctgcagcagtggtacgtactatgaaccgatcgaaaccaccgccatgtacgtacagcacgcgcgcgccacatgcatgcatgcccgccccggtcgccgtcgcccgtcgctgccggcgaaagaaagaaaccgtccgtgacaaacccaacccacgaggcggctaattctaccgatcgatcgaggggacgaccgaccaggcgaccagcagctagcagcagaggaaaacgatgcgagacgaccgtgcgaggctagctagctactagctccaacgaaagcggggtctctctagctgcgttcgcgcgcggtggccgcgccaccgctttcacgtacgtacgctccaccggtcgacggccagtcgcgtcgtgcacacgcgcgcgcgtgcgcgctttcatacgccatatatggatggaattttcggtggttggccggagcgtatgcacgtaccggcaatccacgcgtacgagcaacagaaagagagataaaatgtccagccgtcggagtcgaccccgactgatgctagcggtactcgtttttcgcgcgcgcgtgtgtggttgttgttggatttacggaaacagattctctacagtaaatataaaaggggaactatgtgaattgtgttttgtgtcttgtgcgctactgtgaaatgcaaaaaatcactatacaatacagtagatatactataccagggtccactataaattaatgtccacagctgatcggatggttgagattctcgacttaataccctatagccctctctgcactagatagtgtctacgtacgggttctctaatctctatcctgactagctataccgttggttggttatccctttcccgtactttgtgatcttctcatcattagacccatttgaatcgtgggaaaaaaacagaacagaaaaaaaatacagaattttgatgggaatacaagtgtaaaacagaaaaaaaaacacaataatagccgtttgattggaccatacgaaaaacacaggaattgggaaagatagactcaaagaaaattttaagaggttgaaactcttactaagttttttaaaaaatctatatgtaatgagccatttcataggaatttcatataatttgaaaagtctcaatcctttgaaaatcatttgattcaaagggactctaaatcctattgttactttgagaacttgaacaaagcaaaacactatttatgttttttaatatatgatgcggttaaattttatatacacatttaaccatttgtaatataaaaaataattatcatttattttattgtgagttgtcttatcactaagtttttaaaagtataatttatatcttttacatatttctatataatatttttaaataagtcgaatggtcaaatgtgtataaaaaaatcaataggaacatctattaaaaagcatagggagtaattagtttaagtaaaagcctaaggcaagaatgaataggatccaatcatacagaccaagtcgatctgttaactctcggccgtaggtcttaaaattttttaaaaagataaaatcctcaaaaacataggaaatttgtaggctaggttaaccacaaagctctgagtaccaagtatacatttttttttcaagacaatgttcagtgttctttgtctcgctttctaaggactaagaatattatggataatctttttggcggactggcatagagaattaggaatatttgagcacatattttccaatagcacaagtctttggaatatatgagcaaatatcatttatattctatttctttctgaaatgaattcttagggtttccacaatttccatgttttggatgtgcttttgtagctcttcaggaaaagaaatgcacatcattaaagatgatgagaggtctaaattaaaagatatctaacagactgatcgaatatcatcaaagaggaaatttctatataggaagaacatttttcaaaaagaaaatcttaatctttaggagttttaaaaatatgcatgccataatctagtagttagtagctaaaaaactgggccttagtttctatccatatattttaggttcaatcattagtacacaaattttaaatattgactttgcagaaaataaaaatgtcttatagctcagaacggagagagtaacgaaatactttatcattttttcttatttactctcttcgttctatattaattattatataaactttttagtcaagatcatgaaaaccttaacttccctatatttcacttaatatgactatgtgatggaaaaaatagaaacaagcatacttcaactttctcgcatgcataagaaacgagcatttgtaactgcatgcatgcatgtagactaaatttacatgcctagatacaataatgccacacttaaatgaaaggatgattatatatgataatcagtttagaaattctggttttgattatataataatcaatgtagaattgagggagtattactctattcgaaattggatgcgatcaaatggttagtggtacgtaggacgcgtggcctattttgttgctcagccatagctcccagcctcccacgtccgcacgactatatatagcgcggcagcacgatcgatcgccggagctcatccacaagctcgccgagccagccgttgcaccggccgcgccggagcgagcacacggcggccgcgtgcgtgctccaatatgcccacgtcgcggcgcgcgctcgccggcggcgctttgtccatgcacgtcgcctacttcctcgccatctcctgcctcggctacggcctcctcggggtgctcaaggtgcgggagcccggcgccgcgccgcgccgcatcgaccgcttcttcaccgccgtgtcggccgccacggtgtcgagcatgtccaccgtcgagatggaggtgttctccaacggccagctcgtggtgctcaccgtcctgatgctcctcggcggcgaggtgttcgtctcgctcgtggggctcgcgtccaagtggtccaagctgcggagcgacgccatggacagatcccggcgcgtcgagagccacggcgacgtcgcgctcgccgacatcgacggcggcgacgtcgagaacccgacgtcgtcgggagaggaggcggcgagccgacgccgcccgatggacgcggacacgctgcggcacaatgcggtgcgcgcgctgttctacatcgtgctcgccatcttcgcggtggtgcacgtcgtcggcgccgtggccgtcgcggcgtacgtgctcgcgtcgccgggcgcgaggcggacgctgggggacaagtcgctgaacacgtggacgttcgcggtgttcacgacggtgtcgacgttctccaactgcgggttcatgccgacgaacgagaacatggtggtgttcaagcgggacgcgccgctgcagctgctgctggtgccgcaggtgctggcggggaacacgctgttcgcgccgctgctggcggcgtgcgtgtgggcggcggcggcggcgacgcggcgggaggagctcgtggagatggcgagggaggggggcagggcggcggcggccgggtacgcgcacctgatgccggcgcggcggtgctggatgctggcggcgacggtggcggcgttcgtcgccgtgctgatggcgctggtgtgcggcatggagtggggcggggcgctgcaggggatgagcccgtgggagaaggtggtgaacgcgctgttcctcgccgtgaacgcccggcacaccggcgagtccaccgtcgacctctccatcctcgcgccggccatcctcgtgctcttcgtcctcatgatgtgagtgctctctgtttctctctctgacctaagctctctcagggtctcagctcttcaacctagctagtactccatctgtctcataagttttcgcttttactatttgaccacttgtcttattcaaaaaattttgtaattatttttttttgacttactttattatctaaagtattttaagcataacttttcgttttttatatttgcacaaatttttttgaataaaacgagtggtcaaacagtgcaagcaaaaactcaaaatcccttatattataggacggaggaagtacttgtttccaagcttcctgcattgtacactataatattctagaaccatagtcttttattactactatcctagcccaaaaatataataacatagaattagactaaatacattttaatactacgaatctggataaagtagtatagatttgtactacttaaatatgtcctgtcctttctatgctgttatattgtggacaaagggagtagctagtaggtacgcaaaccatttacatcatcacattaaaatgggaactagttttaccatgcatgttaactttactctccggacctctagaacatatgttttccttttcattagttctcctaccaattttgacattgttagtagcatgttttgcgattaaatcacaaactataaatacatagaaatgtttcgttgcaacatgcatatatgtggaggtgagccatgcatgcgacccataacaatgacacaatgccaatacctttgtcccaaagtgtattaggttgtgttcgttaccggtggttgaaagcaaatttctcatacatgaaaaatggaacggtctaatagcacttggttaattcggtattagctttaaaaacttaaaaattagattaattaatatgctcttttaaagtatttttttataaaaaccatactatttaacaatttaagaaacgtgcgtgcgaaaaacgtaagagtgttgcaaagaacgcaaccttattgcattgccgagtgtagtggcacttggcatcgatgtccttgagtgtaaaatgtcaggatctctcaggtggaaactgcaaaaccacttgaattattgagtaaaatatcggatggtcatatcataatgacaaattaaattacaagtactaatagtgaacgagtgatgataggagatgtaacggccggtggcaagtgggttctcttctgcaatggaatcttcttcggttcttcccttctccgtacgtaatagtcacggacaaaagcacatcaaaacactataaactcgtcaataattcttcgtatcctaattaatttgctcatcggccacagcaagaggacacatgtttcttttctgtggtaggacagtcccaacccataacactagacatggtttccataaactctacatcatcaagaagtactagacactactcttccaatgcaaacaccactatttcatacttcaatttaatgctacttatctcacatgatgtcttggatgttgtgtagaaaccatgtctctctttcctcatttattcacttgcatattattttttgtcctaagtagcaacttatttaatgctatggacatcatcctaattattgggttgagaatggccttaggtaggtagatgcatgtgatggagagtagtttcaaacgtcaaaacactgtcccatttcccagttcgtgaccataggtaggagttgaccgtgcgttgaccctttctcctagatttttgacagatttttttttatttttgccaaagaagaaaaggatagctctcctcctagcttcacagaaaccacaacgcagcacaccacttcaacttgcaagaacaccacaatcaatttgctgaaaggtaggagtattaatattccaagtctccattcaaaagcctgcatgcatcacatgccacaccttctgtcaacctgagaatatgctctccgcgttctcagcaaatctggtcacctgggaggttgatgactattacttctaattttgttcatgtcaaaatgggaggcgcatagttgctagaatttgttccaatctttggttcttccagatgattatggctcaattttcacatgcaattccataaaattcgccatctttccccagttgatgcatggagtacaaaatagtggagcacagtagtcgtcattcgtcaacttttgcagcctggtttaggaactgggatgtgtgcctctgaaaatgacctgcatggctaaagcagggtgatatctcctgccgattgtcgtagcgcgtgcaaaggaatttcttcaccggccagcagttgttcccatattgttctctcaaggccatatgcttgtgaatccaagcttccagtcagttgagccattgttttcatcttattgtcgcatcatttacagagaatataaccaagcaccagaatgttcttgcacgtcacctgaaagatcaaaccttagacaagcagagctgcaactccttccctgaattatttctcaataatgatctgcttttgaacatccgaagatgataatccacccaagggtgactttctgatcgcatttcgttaagcagctgcatcgacatgcatgcattttcaatgcccaaaataagcaactaatcactgaaactttaattggaaagattgctgcaaattaactgatgtctgtttaaactcgtaccgtttgttgtctcatattctgcttcatcttgcctccaggtatctacctccgtacacgacgtggttcccatttgaagagaattccactactaaggatagtaatgcagagaaccagggaatcagactgctcgagagtacacttttgtcacaactctcctacctgaccatctttgtcattgccatctgcatcaccgagagaagaaagctcaaagaagaccccctcaacttcagtgtgctaagcattgttgtcgaagttgtcaggcaagtcagactaaatggtttcttacctgagaaaaaaaatgcagaccaagtaaattaacaatttatctgatgaaaacagcaaaacacaaagtaacacttgtcaggtatttctgaatcttaataatacacaatgaaaatagtaatgttttctttcgtggaatctgacggatctgcccacatttgcagtgcatatggaaatgtggggttctcaatgggctacagttgcagtagacagatcaatccagaccatctctgcacagataaatggactggtttcgtagggagatggagcgactctggcaaactgatactcatttttgtgatgttctttgggaggctcaagaagttcagcatgaaaggaggcaaagcctggaaacttagttagatcttagatgcagtaccagctgaacattgcaggtccctgagggtaggaaaaaagtataaagatgtactctttctcttccgtttgtttgtatattcattttcacatagacaggaaccttccactgtcatccttgcacaaagctcaccctccactccaagtgttggcagtttcagatcaggtgaatgaaagttcatcacaagaaatcaacataggctaattaacctgattcacttcacatagagatgcttctgtcactggctccctgcaatgaccatttattgcatccatgtaatgctagtaaaaggccggatgtcattgtgatggctgcaatacttaaatacccacatgttaaaagatatgtagatgtctatcaagtggtgatcagttcatacagtacgtccagaagtactttcttctgaagcaagggcatctagaagaacctgagagctgagatcacaaagattgaaaaaacactagattgcttatcctagtcactacacttttctgatagaaattaaaaaggacacacgtgcaaccaagggtgcatcagtgaaaaaaagagagaataaaagggaaaagggaaagaaaatctccactacacattgtgcattctggtacacttgttcccactacagaagatgttgattatatagcaataaagcaaacaatctagtatttgtggaatctgaaagataaacctcagctacatacaaaaataaaacgaggtaacaaattgtaatctgttataataaatatataaatgttcaattaagtgaatgcaaaggaaaaccaaaattagccataactttgataccagaatcttcaacaatggactgaacagcaatatgcagtagtaaattcaaaataatggttactataactaaatttcagtatcatgatacacaggtgaattctattaggaaaacagggacaaatttgtagtccaaaactagttgcacatgcaacattactgatttcagctaaagaagaacacaactaattttttacaataccgtatgataataatagattaaaaaagagtgaattattgaggcagagcaggtttacgtgtgaagacaaacagctaatctaaattgaggatattcttatgactcaaaaaatgtgaatgaaggattctaattgctgacaatcatttcactcaagaacatatagtagttaggcattataatattctaagcacatgcttgtgcatacaccaatcatgcctgggttggggccctgtacacaccatcagcatcatgattctgcaaaatgggcacatctgtcttacaccatcctacatattaagatccagaacttggttgcagtgagcaatggtggcaaagacagaatcattgaaacctaagaaacaccttccagtagccaactccagcatactgaacactatgcccacaaacctccaatgatgcatccattcagttcaatcctagttacatcacagcatctgccattagccatgaaaatcccacagcccaagttccaagtggttagggacattacagagaaagttaagcacctccatgtgtttatctccatgaggcttcgttccctctccaaatgtgcagtgtgtttcttcagacgctgtttctggtttttcatgttccaaagcaatccattaatagttcaacttgtgtacttcatctcaatatcctttgttggtttccttgctctgaagatcctcaagccacgacacaagccaactccaagggacctggatttgatgttcacttctgtgtccacagcagcagtctcaagcatggcaacagtagagatggaagacttttctaaccagcaactctgggtgttaatacttctgatgatattgggaggagaagtatccatttcaatgctggcgctgcacttcaacaatgctgagaccaacacaaacgaagtcctcccaaaaagatcaccttcgacgagaaggaatattgaatcctttgatgctgtaaatgatagcaatcaaaatagttcacaaggcttccaatcagaagcaaccatatcacttaactgggtacagggaagcagaaccatgaaacagaagtgccgcaatatgttggctcatatagtgacaggctacttcatagcagctgttgtttgcagctccttagtcattattatttttgctcagattgactcagatacaagacaactcctgaagagtaaagatatcaaaatatggacgttttccatcttcacagcagtatcctcatttgcaaactgcggcttcaccccggtaaatgataacatggcaatattcagaaagaaatccagtctataacttctggttaccccacaggttctagcaggcaacactatattatcgccactattgaggttaagcatatggatcttgaggaaggttagcagaagagaagaatatgcctacatccttcagcatccagaggatactggctacaggtatttgcaattgcagaagaattcagtcaacatggttctcactgttggggggctagttctgctgcaagtgatgtttctttcctattttgagtggaactcaagtgccttaaatggaatgaactgatttgaaaagttggtttgctcattgttccagagtgtgaaactgtgaatacaaggcatgctggtgaagctgtcattgagtccaatactagttctatttgcacttgtcatgtaagtattccctataaacatttcataatatttattattttgaagcatttatcaggactttcagaattttatcataaatatggcacaatcaccatcagtaactgcaaaggataaattaagcacataatttcagaacgaaacaacataaacaattatgagcttaaaatcttcagatattttttggttgaaattgcttagttatcttaataaaggaacacaaaactagttcacttgttgaaggccagccttatgttctcgcaagagtttcagtttaaatgaagttctagataataacatggaagtatgaacactgtctcggtgagaaacatacttgtttactacagctaagtcagcaatttgtgtactcgaaaaagaaaaaaaagcagataaatgcatagaacaaaatcaaaacaaccataaaatcctgcactatgacagaggtcacaacatggcggagaagaacagattccacaatccagatagtcaattcatcaaaaaaatagaaaagcatgctagtacccacgtaaacttcaatgacaacatgccattaacttatttgcaggtactatccttctgataattcagctctccctatcaatgctgataacaagcctttgacagaacgaggaagaaattcaaatgatcaggccatatggaagaattttatcatttcaaagtctgcttgcttagcaatattcacaattatagcatgcataacagaaaggaagtcaatatctactgatccactaaatttcaacattttcagcatagcattcaaaattatcaggtaagttcacatccttatttctaggaaaaccctcaactatggcctaggaaataggaatgatttccatcccccaactttgaaaccattactaccctcaacaatggccttccaaattaactatgtgcatggaaaagaaatatgaagaaggtcagcataaaagaaaattatgtttgcaccttccaagcaatgatgcaaaattttctttcacagtgcatacgccaatgtgggatactcactaggctatagctgcgagaggttgctgaaacctgatgctacctgcaaagctacttcatatggttcgtcggcaagtggaccgacgaaggtaagctgatgataattttagtgatgttcctggggaggtttaaaaagttcaccctcacaggaggaaaatcttgaacgtccatgtaattaaacatcactacatcagtagggagtaaactgtacgatcacgagcattataagcaaaaaagtttgaaggtgtaaactgtaaatcaatcagttgatatcatcatatcaccctaagcatggggaaacgaaattcgtctcgatatccaattcctcggtaggaattcaatcgatattacatgaatgcgatgcgagagcctcgaatgggctaagcgagaatccattccgtgatcagttcaccgaggggaaaagtacgaggaacgcgtatcgtatcgcattacgcattgggatttgatttcgctagccattagcacgagagcaaaaacacgggcacccagatcagggaaatgcagagcatggaaagaggggaactaccaggagaagcgaggttgcagaggtggccggcggcgaggccgccacggcagggcattgattgggcttgtccccgtcctcggatgcgcggcgaggcgcggcgcggcgaggcgggcagagggagacatcgtcggcggcgggaaaccgagctcccacgcgccgcgacaggatcgcgtccagggcgacgggcaccgcgcgcgccggcggcgggaagaacgccggcgcctcccgccgccgtcgtcggctgttgcggcggactgctcgccatcgtcgggcttccccaacgactgggcctaaaaaatgggcctaaagagctaatgtttggtcctcaagtgggcccaataaactgtgggctatatatcagcccaacacatttagggccctcattttttttcgccgataaatgctaacgatatgttgactgaaaatctacctccaaatcttgcagattttggtccaccggatgaactttgcgatttgtgcttcaggccttctcctccaactccggcgactttcttctccggcgccagcgataccctagactctggcaaaggaccctacgggttaggatcccgggttggggtgggggttggagggggaggggcaagaggggggagctcgccggctttagagggatggctgtggga

SEQ ID NO: 70397 - DNA, 1596 bp, Oryza sativa
tgatgacccatgtacacaaccttcctacagtgcttaagatacgtaatttctggtttattccttacagggagggcaagcctttttccccttgttgaactgtccggataggttgctaagtgcaggccaatcgttgatggttacgaacagcagcgctcgtaggtaaactcctcttgtttgtcattgtcccacacggggacaccttccttcttccacaatagtttaagatcttcgaccagtggtcttaggtacacatcgatgtcgttaccaggttgcttggggccttgaataataatcggcatcattatgtacttcctcttcatgcatagccatggggggaggttgtagatacacatcgtaatgggccaagtgctatggccgctgctcatctctccaaaagggttcatgccatccgtactcaaaccaaaccgtatgtttcgtgcgtcctttgcaaagtctttaaattttctgtcgatgttccgccactgcgaaccatcggcggggtgtctcagcatcccgtcctgttgacgctcttcagcgtgccatcgcatcattctagcattccccttgttcctgaacaaacgccttaaccgtggtattatagggaaataccacatcaccttagcaggaattctcttctttgttagctgcccgtcaacttctcctggatcgtctcgtcaaatcttgtatcgtagtgctttgcaaacagggcatgcttctaggttctcgtactcctcaccgcgatataggatacaatcattcggacatgtgtgaatcttctgaacttccaatcctagagggcagactatcttcttagcctcgtacgttgtctcgggcaatttgtttccctccggaagaatggtcttgacgagtttcaataaatcgccaaatgccttgtcactaacaccattttttgcctccattgcaagaactccagagtggtatccaactttttgtgcccctgctcgcaacctgggtacaaggacgttctgtggtcctctaacatcttgtccaatttatgggcccccttttcactttcgcggtcctccttggcgtcctgcaatatctgaccaagatcatccacaacgtcgttaccatcagcatccctttcctcctcgcccgtttgatttccttcaaatccaacgtactgagcaaagtccggaatattgtcgtcttccacttcatcttcttccatttcaacaccttgctcttcgtgggatgtccaacaattatagcttggcatgaaccccgactcaaacaagtggaattaaatagtcctggatgcagaatactccttctgattcttacacttattacatggataacaaataaaacccttatgcctgttagcttcggccactctcaaaaaataatgcacgccgtcaataaactctttggaccgccggtcagcgtacatccattgccgatccatctacgtgacatgaaaaaaaatcgtacataaataattattctaacaataatgacagtcattcaataattataaaataattacaaactctttcaacagtcatacaaaaatgacatatcattattcatacaaaaattataaaatattacaccaaataattcttatttact

SEQ ID NO: 70398 - DNA, 5745 bp, Oryza sativa
acgagagagaggggaaaagggaggagaggggatcctcaccggcgagcacggcggccggcgcgaaggatgaaggcggcggcgatgacccaacgagcggaggggcagacgggcggcgattgcacctacggaggaaaatggagaggaattaggggttgggaggaagcccacggcagctagcgtggccggccggagatgggaagggcggcgaaattcaccggcgcacggagagagaggcgttccggcggcaggattggatggggatgcggcggccgaggtagctttggcggcggagaagctaacggcggcggcggattggctcggcggcggcgctagaggagatcggcgcgggcgcggtagaaggcatgcgagaacgcggcaaaaaagggaaaagggagagtgggacgcggggaagctttataggggctcgggaggggcggtcacggccgggaagccccccgatttggccggcgacgtgggggagggagagagagagagagaaagaaagagagagagagagagacggattcaaaaccgaatcccgccctctcgggccgcgcacgcggggcgggaaggcgtggggaagggagcggcgacgtgggcacggtgacgtggggcgagtggacgaggtggggcgccggcggtgcgggcggttggagctccggctccaacggtcggaggtaggagacgaccgacaggtgggccccacctgtcggcgcccgaaggagagagggagggagggaggactttggggaggggaggagaagcgggccggcgcgggaaggaatgggccgacggcccaagaaaaggaaaaaggaggaaaaagaaaagagaaaagggaaaaaggattttcccagggggatttaatattgcttgtgctcaattttaattggttaaaattatttccaaggctctgaaaattccactaaaaatcctgttagcatattttgacatgtagaacccaagaaaaattccacatgtccgctccgattattatttgcatttattaattaaggattcaactctaggttaattcaacaatttctttaggcgatttatttaacaaattttaaagctaaaaaggggaacttcagggcgtgacagctaaccacaagcacatgtcactattacaaaacatcaaatagatgccaacactatagatgtcggaagtgataaaactggcacctgtagtgtctttctcacccactcacccttgagcctgccaaaatgctatagtttttaatatattgcatgtgtagagagaagaaaaacatgctacagtttttaatatattgcatgtgtatgatagataggtcaagtattaatggtataatacatatctatacgaaactatgtacatataggctattaaattagctgtagatttttttagagctagtggttgactactcctattcatcccaaaatataaaggatttttattggattttacacattctaacttcttcagactcgtggaatagaatgttatcatattcacttaaaatactttatattttgagacataaaatatagttttaaaacttactctgagttgctgctatctatgtcctaaaatcattgtaattctaagttatttagtataactaaggtttgaggagaaaaactacgatgcacctcgttatgttgtatactcgttccgtcccaaaaaaaagacaaccttgtaatatgatgggatatatctatccagattcgttgtactaagatgtattacatcctaatacgatgttggctttttttttacggaggaaataggtaagagtaggagggtggttaagagtaaaatgtgaaaaaaaattgaatgagaagtgattgatagaacaattagtaatatatggtaacaattattttttagataatttttttggagaaaaggcgcaaagcgcccaactttttactagaaatcatatgagttcatacaacaataaacaaaataaacgcgaaaaggctggggattttccagcttatatgaggcgcaaacatgcaacacgcatagcacttagacagcgcaaagtctacacacaattaacaagtctggcaccgcggacaattctgaaggattaagacaatttttttaggctgtgtttagattggcccaaagtttagaatttggttgaaattagagacgatgtgactgaaaagttgtgtgtgtatgaaatgtttgatgtgatggaaagttggaagtttgaaaaaaaaaactttgcaactaaacacacccttagataaattttaattctaaaaatataattactatgagatcggatgtgctgtattttaggacggaaaaccgaggcggctacactggaaggccgctgaaacctcggctggtttttgcggtcccctcgcgcggtccagccgctgctcggcgttgctccgacctacctgagctccgaacccagtccaagccgggttgtacgggaaccaccgacactttctctgtcaaaactagctggaactattacatggcgctcacaccaacacaatgacaggtagcgacccgtgatttgggtggtggtgatcgcaccaacccaagtgtactccaccgagaaccagctccgtaaatgggacaaaacccaaccccactcactaaggctcatgagtggaatcactccaaaggtggggttaattgcatttggtcttgtggatatgcacgtgatttgtccctactgtttactaccactctttctgatctatgtagataagaccagaaacaactttgtaacagaattatcctatctaggaatacatttatatcgctctcttttatattataggtcatgctttaattttttttatagctaaactttttatagtttgattgaatttataaaaaaaaaatgtaacaacattttcaacacaaaacatacatattatcaaaataattaaaactactaatttgatattgtagatattattaaaatttcctataaatttaattaaacttgaaaaaatcataaaaaaatcaaagagatatgtaatataaagtagttaatacactagtaagagacatgagaaaaaactacgttcaccatatacaatatgcctcaaatcaaaatataaagattacaacttagtgtagtaccggagtcatggatgcatgaccctattcaacaggatacaaatttttaatatccacgaatataagttcggtgttacgtgtgcagtggtgtagtggtgcgcagtatccgcatatgcgtttgctgtgtgcccgcgaaaaaaaacagagtactgtttaccctgacacgtacaaagcctgtaaacaaacgtgccacgtcatatcgtgcggcgcggaggaataaatacaggaggtgcaagcggcacgctggggcagaaggcaggcaaaaggcacactcattcgcgggccgcacgtgcagcggcggcgcggcgcgggtggatcgccgacggcgagaggagcaatggtggcgcccggcggcggaggaggaggggcggcgtcgtggccgtcggagggggaggtaaggtgccccgccccagtggcattggtcgctctcgtagagcggtgcgggtgttccgatcccgcgcggccccgtagatttttcgcgtttctgcttcagtgctttgtttgatttggggggcgaatgcttgcggggctggggatcgcgacttctccggcgaaatattgctgcgccggcggcagcaccggcggggcggtgaccccccgtggccatcgatcgatggcggcgtcacagtgtagtagaattacctgctttcccactgcttggttggtggtcaatctacatctaattaccatgtttgcaaaaacattcaaatatgcacctcttttattattattgttgttgttgttgttgttgttgttatttggaaaggaatcgattttagtttttcagtttggtagagtggtggtgcataataaaagagaggaaagtatggattggcagtacacgtgagatggtaatgttagctcgaattgatgtggcaaccatggtccatggatgctagcacttattgagaattgatgtgaattttgggataagataatgtggtacctttgcttgtgctttctgatgatgtgtcgaagagggaaggggtggatgtgcactatgcttttggactatgtagtgatgtggatggcttcaggatacgatacaatgtgctgtagttttcaaacagctgtatttttttttgacaagtcatctgctcccaactaaatctgaatcttttctggtgttccagcagcatgagaccatgtttagcccaatgagtcttgaagatagttctagccaaggagcaatgagtttttctcctatcagctcgagttttgatataaccaatctgacatgcggaatttaaattgctctagtgaaagttgcatggccttgaatatccttttattttcttttaactacattgttgaacttacacgttactatacatctatgataggagtagcttagagtactcaactaggttcatcctgttatgtatggtcatcttatccttctcaattgtttctgatgatgcagcttgatgttgttcgagcaaaggtagtggagattagtggaaggggtgcaggagaggtcagggtggttgcttgcccctacaggatttgccctctgggggctcacatcgatcatcaggtaactttgtagatattatgtccttgatgttttcatttttcagaagagtgacccactgttaagactgttgtataaactgtatgtttgcaaattattttaatgtgttcttatattaaatttgtatatgtgtatagtcaggcagcaatgtaccataaatggcatgtgctttaatgtcatatcgtcgccgcataaatgtgacataattggactgttctatacatgtgtggaatgagttgatgagaccttgatgattttcagggggagtgttaagtacttgacaataaacctagctataagaattttcctctgcaaatgttggaaatatattagcactagcatagtggtggtgatttttcctacaaatagaataaagctcccacttgggtttgtatttggagagtctttggattaagtctgtaaacctgagtttatttgagttacaaagcagatccatcaatattggtggaattcaatttctctttatttctgagcagcacacgtagtaattctttaaaagggtggaagttgcataaactgctaatttacttagtttcgtgggaataaattttcaggtcataacatattaaatcagtcagcagtaagagaaaagttctgtatattggatcatcaccatctctaactgactagaatcaacacaaacatccttgcagtaactattttttttaccagttcttaacctgttgttggcggtatctaccttaggttatactctacctaaggtaatgaattagttttatcatttcaaaaattgctggataccctctaatgttaaataattcacttcaaggagagctatattagttgggtatttatggaaatgtgttcccatgaacaccttattgttacaaatatcatgggttgacttcaattcaaaagaacctctgcaagggatatggtggttggctaacttctattctgttctgcattacggcagggtggaactgtcacagctatgaccattaattatggtgtacttctcggttttgtggcctctgatgatgccgaggtgagttattgtgcttaaacacttttatctgtatgctcccctgaaattccaagttaagttctttgtgccaaaataacataccat

SEQ ID NO: 70399 - DNA, 4312 bp, Oryza sativa
agggagtacaaaggagttatacaataaagggttagggtttgcagtaaacagcatttaaaggtaattagttgctcaaagctattttgtaaacgcgaatctagaactataccatattgtttatcaaggccgtgaacccacacgaacctgccttaacccaaggcctacgatgattcagaccgaactggcaacccgaccctgggtcccagctcgtcccaagccaacccaggccaaccattccacattttagttgctaagcaggttttaagaattaaaacactaacttgggtacattactcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtgtgaatccaattccacaataatccaacagttccaaaatgtcaaggtgatatgaatattcccaaagtctagagttgtaaaaccacctaatgttacctaattaaattgcgaagcatctacctaaaattaaactagtggtgccatgagtagagtgtccactagttggggttttgtttactctagggtgaacaaggaaataataacaataacaataataataaggtcgtaacaaaggtaaataggcatggctaaacaaaacaatgataacgcgggaatttaaataaagcgataatgcgataatttaaatcaacataattttgcaaactgggattcaatatgttcaaagatgatgtgacttgccttgctcgctttcccaaacgtcggcttcaacttccacgaagagcagatcttccgaagctgcagcgtctacacgaccaacggaaaagaaaaggcttttactctaataaactccatataacaagcagaaacaaagcacaaaaatgggttcttgacttcttaggaaaaaattagagacttgaacggtccaattccgagttcaaatggccaagttatggccatttgaagtttatatgctctttaaatgaatatttgcgaatttcttcatttaaattttaatttaaaatcggatttattgcgtcagccgaggggaggggtgcgcggaccgggtccacgggagtggggcccacgtgtcagcctcacggtccacggtggaccgggtgcacgcggcttgcgccggccggcgccgtgggtcccacgcgtcagccgcacccgagggcgcgggcggctgacggccgggccccacatggcagccgcggggcgcgcccgaagacggcctcgccggcacggccgacgggatgcggcgcgcccgcgcccctatggtcgccggcggcggccataggcacggcggagcggcggccgagagaggggagggaagggggaaacgaaatgggcggtccatggctcaccccgggtcgacggcgacgacgggaacggcaaccgaagcggagagaggcggcggcgcggctcgggtcgacgaggacggcggcgttccggtggtcggcggtcgaaacgaaggggtggacgaggtcggcgaggacgcggcgaagccgaaggaggcgatgccgaagcgggaggaggtccggtgcgacgacggcggcggaccggagctcggcggcgacggcggagagagaggacgacggcgcgagctcgattccgacggggagagagagcggcgagcggcggaaacggtggagataggcacggggagtgtttatatagtgttgggagtgagagagggcgaccggatgaggaggaatcggccgcggaagatccggccgccattgatgcgccggcgaagttcgcgggagggtttccaaacgaatccgagggagagagagagggaaaagtggggggggaaagagagagggaatcacggggagtgatttccccctctttattgcgcgcgggggcggcgggatgcggcgaaatctgcggcggcggcggcgctagggcacgggcgaggcggcgggtgcggcgcgaggtaggggatgacgggtgggccccacccgtcagcgaaaagaaaagaaaagaaaagagggagggaaaatagacttttctcgggcggctagggtgcggcccaggagaattggggcggaccggccgagctaaatgggccggccggcccaaggcggcccaagacggtcgcgcgcgcgggagggaggagagagagccggtggaccgggttcaccgcgcgcggtcccgggtgggacccgcttgtcggtgacacggttcaccgtgcggagcgagcacgcggcgcacgcgcgcgggcgggggagggacgcggtgcatgtgcacggtctgcggaggaacggatgcggcgggcccacgcgcagcctcacggctcgcggtggaacgcgtgcacgggaggggctgaccggggtcggcccgacccgacctcggctgagctggcgccgacgtggcgcctacgtggctgccacgtgggctggcgggaggaagacgaaggcccggccgccaatggacggcgggcggcggcggtttctccggggcgccttgcgacgatgaggggcgacggggcgtacaccgggacgacgaggaagaaggagagggagcgagccaacggcttggattcgccggagggagtctgtcggcggcggatttcggcggcggcaaccggcggagagcaaaggggaaaacggcgacgaggtcacgaggggccaattcccggtggtgagagcatctacgcggccacgggaatccgttgctagcgtcggattgagcggagctacgccgagcgaggccggcgacgagcgggtgctacggagctcgggcggtgacggcggcgagcacactgcgagcggtggcaacggtcggggcggcgccggctagctacggggagactactcgagctactaccgaaaactaagggggggagatggagcgaggaggaagaacggagggaggcatcaccgagatgaggaggggcgctgtgacgagaggccgacggtgcgggagggatctctccggcctcgggccggggaagaggaaggagaggacgcgcccggagtccccttccgcgtcctagtgcgcaccggctcctccggcacacacgcgacggctgcggtcggcgagagggacggcaatggcgcgggcgagaaacagggaagattgggaggggaaaaggggaagggagggcgcctgggtttatagggggcggcaatgtcggtttggaaaccgactttggcggtcaaggcgcgagctggcgctccggctagcggccaaaatggcgacaggagggagggaggatgacgccggcgggaggaaaaggggaaaaaggagggggagaaaggggcttgcccccttgccgatttgggaaaaaggaggaggggagcgggggcgtcgcggcagagggaggagggctctgcttccgtcccttggcggcttgcgcgcggagtggcggggccgaggcgatgacgacggcgatgtcggcggggcggtttggagcggagcggtgacacgggcgacaggcgcgggcaggcgctgacgacggcggcgactaggcggttggccaccacggcacgcgcgcgcggcttgcaacaggaggcgcgacgggtagagtggcgcggctcgggcacgcgcgctggcgcggacggcgcgtcacggacggcaaccacgcgggcgcgcgcgcgcgaacgacgcgcggggagcggcagcgaggcagcggaaaggagggctcggctcggcgcgggcagctcacgcgctcgcgcgcggcagagcgaggggaaagggggggcgctcggcgcgagcggcttacgcgcacgcgcgcggcgcgcgggcggggcggagcggagcggaggggagcggaaggggagagcgagagagagaaagggagagcgagcgcgggagggaagggagagagccgggggagagggggagatgg

SEQ ID NO: 70400 - DNA, 617 bp, Oryza sativa
tcaccatgcctttgcaaaccctttatttcgagctttcactacatgtcaggtcacacattgtggagtaaaacacaaaagttagtgggatggcattgagttagcagtatccctacttgtggtcttcgttgatgaatagacagtgctggatatgcataagctcatcaattagagatgaaaagaatggatcgcatcaaatgcagtatcggagacttagaatgttgcagcagaatacctgtttaaaaaatccatggattaaggcaacagtccacgttgtattcttgagatggttccggatagctcgagacagaaactcgttccaaacaaacattgtctcataaacaacttgcccagtattcttgtcagttatgttcttctgaaggctgcgcatgatattgtaagagtagctgaagaagaagtctttcgagagatcgaccgagcaaaggagccgtttatatctacaaaaagtgaaaggtaaaaatataaatatccgcagacaatagaaatgagaaaaactctagatatagtatatttagaatcatactaagaagaatattagtggatcaaagaaattcgaaacaattctatatacctctgaccttatgaacaccacacacaat

SEQ ID NO: 70401 - DNA, 31030 bp, Oryza sativa
ttgagatcttgagaaggcacggacactagacgacaagcaaagaaacaaatttcgcaattagggtttttttttttggagataatttttccgctaggcgccacgacggaacgggcgctacagggaggagcttgggtttataggggcggcaatgtcggtttgggagaggggaaccgacattggacggtcaagccgacgagctggcgctccggctagcggccaaaacggcgacaggaggtgacgccggcgagagggaaaaagggagaaaagggggagagaaagggggcttgtcccttgcctctttgggaaaaggaggaggggagcgggggcgacgcggcagagggaggaggagctctacctccgtcccttggaggctagcgcgtggagtggcgggggccgggcgatgacgacggcgatgacggcggggcggtgtggagcggagcggcgacacgggcgacaggcgcgggcaggcgcggcagaggctgacggcggcagcgaccaggcggtcggccaccacggcgtgcgcgcgcgggaagcaacgggcggcgcgacgatttgagcggcgcggctcgggcacgcgtgctggctcgcggggctgagcggctgcgcggctgcaggcgcggcagggcagcggggccgggtgacgcagacggcgcaggcgcggcacggacggcgactacgcgggcgcgcgcacgcgaacaacagcgcgcaggggtcgagtcggagggctcggctcggcgccgcgcacgcgcgcgcggcgcgcgggcagagcggagagtgagcccgggagggagagagagagagagagccggggagggaggggaagatgggccgagagagattcggcccatccaacctgggggaggcgaaatagacttttgcggagggactttcgggaaggatttggattcgggattgaactcaacaatagatcggggatttaagatctgagatgacacggacactagacaacaagcaaagaaacagatttcgcaaatagggtttttaagagatagttttcccgctaggcgccacgatggaacgggcgctacaggcggtaggagcagagggagaggtggaggaggaggcagaggaaggggccggagagcacgacagggtcggtgcagagcacggcgagctccatggcatctggagcgacgaggcggggcggcaacggcgccgtgggggagggatgggcgaggacgtcgacgactcgcggggagagagaaagagaggcggcgagggggactccgctccgggctgggtgaactctggccgggatggggttggaggaggcgccggccaccgccgctccggcccccgtccgccgccgccgacgatctggcccctgctccggccttcgcccgcccgccctcctgccgccgctagcccccatcccacgctcgtaaacagaaagagagagaaagagagggggaggttgaagaaggtagataagaggggatgacacgtgggccccacatgtcagtgggtcccacaatatatttttgggtgtgaatgacagatgggtcccacatatttttttaattcgaatgccacgtaagcgccacgtaagatgaagactaggtcaacatcgacacgtcagcgccacgtcagcgaaaccgtcctctaaaaccactgagggagtcaaatttcaccggtttcaatagttcggggagtcgtcttatctggttttgcggttgagggttacgaattagattctgtcgataattaagggagtcaaagtggactttttccttacaacatcacgtatatggaaacgatggaattaaaatgtaagcccaacccagcccatctcacacacaaaatggaagggctttatgggcctgctaattaacttgaggaataagtttactacaggtccctccactgtcaaaaccgttgaggatgtaaaatgaacttgtattgacaattaagggatgttgtatacccggttttgttgttgaaggaagtgaaccaaattcatcaacaagttgagggacgtaatatggattttccttcagttgatcgtctgctctattgggctaggtctacgttttaccttgcgttggaaaaagtacaccaaaggtcactcaacttgtcatcgagttacaaaaccgtcctcctatcgcaaaaccagatatcagtcgtctctcaactaattaaaaccggttacaataggtctgacccgattttattctacatggcggctgagtgagcgtggaaccaacgtggaccccacatgtcaggatgccacatcatctctctcttctcttcatcggttcagagaatgccggggaagcggagcacgagcaccacgccggtggccggagctggaggagctcctgcggctgcctctacatgaacttagtacggggtcattgactgcttcatttaccaatttcccccccccccccccccccaaaacaaaagctgcgatgaacattgctacgcaaggacatgccgggaaaaggactcattgacctctagtgaagatggaaaatggtgatgagaaattggagattgacgctgtctagacatgaacttagtacggggctacggcgacagtgggcagccagtacacccgtgcagaggagtaaactgttgcaactcaacttgggtttttttcgacaacaaacatctcgtggattgagagttcatattggtttcttgcacagattaattgcagagcaacaagaagattgggggagaacatggcactataatcgaattaaaatataccaaaagatcaaattaaagaaaagaacagtcaaacccactagatccctgaaaaaaaactgaatctcacctagctgtcagaatcttcagagcccccttgattcttcagctcggcttctcagacacgagataactgaatcgaaccatggaagaaacaggaggaaatacggagaggaagaaagagtcttgagagaggagtggcgacgcggagagaggaaatacggtgagagaggagtggcggccgctgaggcaagccaccgccgtcctcgcccgcctcgggacgtcgccgaagtccaactgcctccacgctgagtgcgcaagcgctgctcttccagcccccaggacaggagcaagcgagcggcggccccgagtcgtcgtcgtgctccgcgtcgccaaccgccgcccgtcgcgccagccctcctctcagccgcgctcctcccctgccggccgccggcacgcccgccgcgccggcactcctcccctgccgagtgctgctcgagaggagaaagagaaagaaaaggaagggaaaggaggggaaagagagaggatgccgacgtggcatcgtgacatgtgggatatacatgggtttcatgacttggccgtcacgttgaataaaattggtgtcaaaaccaccaaagaatctattgtgaccggttttgatcagtcgaatgacgtgggatatctggttttgtggttggaggatgattttgtaactcgataacaagttgagcgaccttcggtgtactttttccccttgcgtttggtctatttttactaggcccaacttgagagaggcccactcagagtgaaggctagtctgggctgggcaaccgagtagacagtccggaataagtccactttccttccctcaactcatgcgcttggttgaatcacatccctcaactacaaaaccggatataacccatccctaaactccgaaaaccgttgcaaatcgactcctcgaacggttttggaggcggttttgtcctacgtgacagttgacttgctgagtcaacaagcgggtctcacatgtcagcagtctgagtgccccttgcaagtgccaatgataaaaaaataaaaaaaggtaggacccaccagtcaacctcctcctccttctcattctccctaccttatctctctctatctctctctctcgcaggcaacggctggcgagcaggcggagccgccggagtagaaggctacccgcgcgcggctgccgctggcgacctcctccctgttcccgcgcacggccgatgaccccctccacccacgcgcggccgtggccggcgacctcgtccccacgcctgcaccgaggcccgtgacagcggcggcggccggcgacctcgtccccgcgagcgtgccgcggccggctacccattcccccgagcgcgtcgttgctggtgagctcctaaccatgcccgcgcgaggcctccatcggcgacctcttccccgcacctatgccgaggccagcgacccctcacccatgcgcggtcgcggccagcgacctcctccccgcgcacgtgccgcagccggctatccctttccccgagcgcgccgctgccgataagctcctaaccatgctggcgatgatctcgtccccacggcggcgcccatcaagcggaggatgccggcggagcgatggcgacgacaggctgcgggcggagcagaggggcgggcggagcggcggcggtggaggtggccagaggaggaggaggtcgccggcgagcacggtagctgtggcaggtgcgacagcggttgacgacgacggtctactccactccgtcggcatgctccgtccaccgccgcttggcctgccccgctcttccctgccgcggtggggttccagactgtggcgaggagcgcggaagcgtggtcggggaggcccatggaggagagggaaaagctgccgccgcccgcggttcctctcctcccaccagctgccggcgaccgcgcgccgcttctgtcccttctgatgcttcccgcggttcctgttccaccggccgccgctcgtgtctcctctcccacccgtctccgccgctcctctcccgtcccggtgaggtcaacgggtgcggcgacatccttcttatctgcccgccctgctctgcccttctacttcctctctcgccgccgccgaagacgacgacggcgacgggttcgacaacgaccgcccgctgccctctcccggcggcaacccgccactgcccagctccgcccctctgctctggccaccgtcgctccgcccgccccgctcagcccctctgctccgctccgcccgtggcctgctgctccgtccctctgctctgctccgcgcttactcagcaccggtgagttcatactgcatagacacttacatgtgggtcccaccgtgctgagtcacgtcgccaaccgagtcaacgacgccacgtcggacgaaaccaccagccaaaccaccgaggggatttgccaaaccaccgagggaggggatttggtctggttttcaaagctgaaggagccgatataccagggacgtgatttaactagggacgagagttgagggaggtaaagtggacttatccctttcagtccaacgcagaacaaacatttcggcccaacgacaagagctcaagaagcatttcggcgaacggaaaatcatattccaaatttaattggcacatccgcacatgaaagcatctcacaacgaggtggtgcatttccctcgtcagccacagcatctgacagataagcagatcacttacctgcatcactgcatgtacattgacaatctgggcaaactgaataaaatgtactggtagtagctacagattacactgcatcttgagatcaatatctaaccagagaggttaatgacagaagttatgctgacaagattgcatactacttactgcagataattgaccaggtacaaaactatgtggttaaaggagtggacgtgaagaaccaaaattcagtagtgatggccagtcaagtagatgtagcagccttttctggccggtgcctgcatgcatatgcaattgacattgctgcctgagatagactgaaggtttcagagggctaatggattttgaggcataacaaattggactctgctttttatggtagccttcttctagatcatggaagctggttgctttgaaaattgtcggatggcggtgatccaacagagatgcagagtaacagaaatctactctgccgtagactgtataatctcccgtgtttgttgaactaactaccatatctcaaatctgaatgtataatctgccagtgtcaactgcgtgcttccatttcaacccgaggtgtaacatgtgcacacaaaagctcttctctgaattccgcaaataaactctgcttaatttgcagatgagttcgtagttgtcactgttaccgctatgaaccccgtgtggatggtgggggaaattgacaggcgtcgtcactcgtcagtgccgtgaagaagaattaaccaaaactcaatctgcatgcaagtgtccatggttgcctatttgttgctcttctagaagtagtggcacttgttgctcttgcttgccagttgccacctcgatcctctagtacaatgttactagcattggtgctttgcttacttttgaatcttttgtggcttcacaatggccgtcaagatcataaaaatagagggccgttttggattgaagccaaaacggtgccttaccaaaattttagtaatttaaatagtaaatatgttagtttggtttgaagccaaacccatacacaatttggccatattctagaatcttcttcaccatactactaaattttggctccatgttggtatcaaaccaaaagtaggctaattaactttaccctaccaccaaaatttacctagattttgtcacactaccaataaatagttagggtaccaataaatagttagggtagagaaccaaataggccaagaatccacaaaccacacaaaggaaatactcaaacacaaaaactgaagtatgacgagatgagctttgtggaagagaagatgaccagcaattctgtcattaaaagttcggccaaatcttagctggtccagatcaaagtagcatacatcagcagatcggtgtacacataatcacatataataatatacacggcgctgctaattacacatggaagcatcagtcatggtctcatggattcagatcgatattactacccttttattacatcatttctaggtcaaaataatgacaaacagaagcgagcacatctagatgacctgacactgttttactccgtcttggccttgtcagcgccgccggttgcagcggcatcacggcacatcatcttcttgaactcctcgaacccgacgcagccatcgccgtcgacgtcgacggaggcgatcatcctctcgcactcctcggcgctgcagccctcgccgatccggccgaggaccttgccgagctcggccgccgtgatgcggccgtcgccgtcgacgtcgtacacgtcgaacgcggcgcgcagctcggcctcgtgctcggcgtccccgcgcccgcggccgtggaacgccgcgaactcgccgaggtcgacgaagccgtcgcggtcggtgtcgagctcgttcatcatggcggccacctcgcggccgccggcggactcgctgggcggcggcgcgatggcgcgcgtcaccgcggccagctccgagggggagatcctgccgtccccgtccgcgtcgaagcgggtgaagaccctctcgatctccgcgtccgccggcgccaacgccgtcggcctctcaacctgctgctgctgcggcatcttcttctcggtggtgttcgacatggttgcaagacttgccgtaagcaaaagcttgagcttaattagctgagtgagcagtgatcagaagtgtggctgtggtgagctagagctcgcaacaatgcagaggggagctattaataggggtaggtgcacggcgcacgcgccattgacgcgcaccgacttttcatctctttggataaagaaatgcatagtcgtacaggagagagtctttttgtggcctttccctgctgcataggccggcgtggcaagcgcgtctgccacgagtcgccctcgtgaacatgacacgttgtcggctgatggaagtggtgcgaatctcgggagaattgatgcaaatttttcgaccttttgcaggcagtttcttcgaagggggtgcacatgtatggagagtacgaatcaccggccacgtcttccgtgtgaccgtgctgaagtatgtatactacggagtagtatagtcgggcaacagtttgctgtagctttcatggcctatcagtccagaagagctgtgtacttggtggatagactacacgtgtccacggagggaagaaaaatgagagatcatagtagtatatagctaactttgccatttcaactcaaaatgaaaagtaaactcattctctttttgaataagtccattttacctccctcatctcttgtccttcgtcgaataacatccctcaaccaaaaaaaccaggtataacgactcactcatctccgaaaaccagtgcaaatcgactcccaagacagtattgagttcagttttagcttaggtgccatctaagtggcattcaaagtaaaaaattaggtgggacccatgtggggctcacctatcacccttcccctcgctctttcatctcctcctctctcacaatctcatgccttcaatcggctcgagcagcggcggcgggtgtgggggaggagctcgccgggaggccacggccggccgggcgcaggggaggaggtcgccgccgggtggacgcgggggaggaggtcgccgggaggtcacggccggcggagcccgggggaggagctcgccgggaggccgcggccggccggatgcgggggaggaggtcgccgggaggccgcggccggccgggagcaggggaggaggtcgccgggtggtcgcggccggccggacgcgggggaggagctcggcgggtgaccgcgactggtcgggagtgcgggacgaggtcgccgagtggccacggccggccgggagcgggggaggaggtcgccgggtggtcgcggccggccggacgcgggggaggagctcgccgggtggccgcggctggtcgggagtgggggaggagctcgccgggaggccatggccggctgagcgccggggaggagctcgccgggtggtcgcggcgggccgagcgcgtgggaggagctcgtcggaggtcgcggcccgccgggcgcgggggaggagctcgccgggtggtcttggccagccggtcgcgaggggaggacctcgacgggtggttgcggccggttgggagcgagggaggacctctccgggagtaggagtagatgagtcgtgtcttcaagccctccgaggcccgcccccgaccgacgttcgtcgccaccggccggccgaatcagcctcttgcatgtgcggttgcgagaaagagattgaaaggaggaagaagataagaaaaggggctgacaagtaggccccaccatttttttattttagcatttgtcacttccatgtgggacccacttctattttggtgatatggccgccacatcagcatatttggaccaagtcaacctgccacatcagcataaaccgcttacaaaaccacccgaggagtcgatttacaccggttttcggagatgagggagtcgttataccttttgtgtggttgagggatgttattagacgaagggcaaaagatgagtgaggtaaaatggacttattccttctctttttatacgaagaagaaattctaaggtactccttcacaaatagtgccagcccagcaaaagtccaatccagctccgtgaattgaatccattatccatctcgtatagattatcagcccattgtgcaatcctaacaggcccatttaattttgaagcctggtccagtccacgccaccaacggacgcgccgtcgatcagctctagagatctcgcgccacacccagcacccgctgcttgccatatgccggtgacctccagaacaagcaggaaacctcatcactcacccactcctcgacccttcacgacgcatccaacccatcctcacttctcaactgattctcgtataaatccacccccctcgaacaccggatcatcggtcgccaaaaatcacacaaacctgcgtgcaaagccatcttgatccagcgagcaaaacaaaacaaacgttggaattaaaccgcgaaaccgagagcaacaaactaaccaagcagtaaccaacagcacaatgtcgctagtgcggagcggcaacgtgttggacccgatgtcggtggacttctgggcggacgccgacccgttcggcgccgtgcgctccctcgcggagcggtgccccgtgctcaccaacgtccgcgtcgactggaaggagacgccgacggcgcacgtcttcacggccgacctccccggcgtccggaaggatcaggccaaggtggaggtggaggacggcggcgtgctcgtcatcagcggcgagcgcgccagggaggaggacgtcgacgggaagaacgacgagcggtggcaccacgtggagcgcagcagcggcaagttccagaggcggttccgcctgccgcgcggcgcgcgggtggaccaggtgagcgcgtccatggacaatggggtgctcacggtcaccgtgcccaaggaggagaccaagaagccgcagctgaaggctatccccatctcgggctgatcatatcaccgtccgtgttcggctgtttgctgcgtgcatttggcatgatcacaaggatatgccaataataaactgtgtttcaagcaagggaaaataatataattgtcatatgtagcccgtacgtacgtgtcgctcgtgtgtatgcatgtgtgtactagtagtacgcactacgtgtgttacagtattgaactgtcttaatttgtcgttgatgatcagttcttcgtcagatatgcgatcatgtacctgtctaccgcggatatgggaataaatctgtattgctagtcgtacaagctagttgatcgattcatttcactagttaaagaaatggaggacatgcgtgtatgggtcaggggagcgtaatggtattgggactagctatccatcacacgacagatttttgagtctaaatcacacagattttagatagttagattaggctcatttaatcacttgattagaagagtctatgcatgtatcaacatatattaattatatatattgcatatattttatttattagatctttacatcgcaaaaaaaatatcaccaactcatctactaaaagttaaagtgtaattacactaactataatgtaattacagtgtaattatagtgtaattacacttacatgtcatatcaactaaatttacaaatgtaattttagttatataggactgtaattttatattttaaaggaaataacaaatacacatttacttacacattattttttactaaaattatagtacacttatatatcgtatcaactgaaattacgaatgtaattttagttatataggattgtattttttttcactaatcagcgaaatgaaaaaccacgtgtttagctaaatcgaatagggaggaggaagcggaataagtgagaaaacggttccggacacggcgcactaatcaaaaaattcgcacggaaacatgggcccacgcggcctcaactcccccttgcgccctaatcagcacaaatcgtggcgtagatcatacggtcgaaaaaacatcaaatacgaaggaaaaaatcacgcgacaaattaatatatagcaaattcataatttaaatatttcaattttagcatcacagcgttggcccgtaatgcatgcatgttaattttcctcacccatcatctgtgggcccatgtgcgaagggtcagctggcccatgaaaacacacagatctcaaagcatatcgaaccgtcaaaaattctagtgatatctcacgagaaatctgtcgacagacgtttagcaaaatcgaatggtattttgtttttctttctcaatttcgcttcggcccacgggccatggcgagagaaggctgatctcatacgaggtggtctccttgtgggaaggccccagagtggcttgcatgaagccttgggtggtcttcggaaaaagtacattgaagatctatctcaacttgtcatcgaattacaaaatcgtcccccaatcgtaaaactagatatatgacatctctcaacttacaaaatcgttcactttagatcttttggtggttttgactccggttttatccggcgtgacggctaagtcagcataggacccacgtaggccccacatgttaggaaagagagagggtgatggcatgccctcctaacatgtggggcccacgtgggttctacgctgagtcagccaccacgttagataaaaccggggtcaaaaccatcgaaggacataaagtgaacgattttgtaagttgagagatgtcatatatctggttttgcggttagggggacgattttgtaactcgatgacaagttgagagaccttcgttgaacttttttcgtaacggaattgtcagtaacgtgctaggtcgaaacctctcctccggtaatagcccaaatatagagaaaacaccaactaattaggttttaaggttagggtgggtttgggaggtgcttaggggaagacagggtttccccgaacttaattagagggatggttggagtgacggtggcccatcgacaggcaatgaaaaggcaacgacgacagcaccacttgaaccatgggcgaggagagccagttggtaggcgggggtcaagtagttgactagttaaaaggagaaggaagatgtcaacatatccgacgacgtatgttgttggagccgagaaaggcaagacggggctaggaatgtcgcggctagggtagggtggaggaggaagggaggggtgtaaggaagcttcggcaatggtagatcaggtgagggatcgggagaaggaaagagggcttgtggcagtggcggcgggagcgggagtgtaagaaagaagtgaatgatatatcgcacaaaacttaactcgatctttgccattcaacattttattcactttttttaagacaattgagaaaaaggtaatgaacataaacaatggtaaataagatttgagccgagtttgaatcagcctttttgtttggcatttcgaactactgaatgatgttttttttttaaaaaaaagttatatgtagaaatttctttttataaatcaaatatttttttcaagtttattatggttagcacttagtaattattaatgtgctattcccttattgtgtggtgcgaaaaagccccgccagtcagccttgtttaatgaagcctcggttctaaaagatactaaatctatgtactttgaatcatcgtcaaatgaaacgtacgaacgagtacttaaaaaggtggtcgaccaattgctaaaagcaagttcacaaacgaaaattatgaccttaacatcaggtacggccgtatccgcgtatatggccacttttaacgtctggtacggccgttttatttcctcgcactgaaccggtccggtgtttcaagtttcaacaccaccctgtcgatctacagtatactgtaagtgtgaagatattaacgactttcgataaaatttatggttaaacaacttttaataaaacttatagactgtgtttagttcacactaaagtttaaaagtttggttgaaattgaaacgatgtgactaagttgtgtgtatgaaaggtttaatgtgatagaaagttgaaagtttggaaaaaagactttagaactaaacatgaccatagttagaccctgtgtagataggactaaaacttttaagttcctatcacatcgaatgtttggacactaattataaatattaaaagtagactattaaaaaaacccatccataatcttgaactaattcacgagacgaatctatcgaacctaattaatccatgattaacctatgtgatgctacagtaaacattctctaattatggattaattaggcttaaaaaattgtctcgcaaattatctttcatttatgtaattagttttgtaagtagtttatatttaatactctaaattagtgtgtaaatacagagactaaagttaattccctgatccaaccaacaccttaaactgtttgttcataactataatccgagtacaatgctgactgtagacacatggaacgaaccaaatttctgaatcatccgtcactgactgctgcgtgccaccttctcactgggtggagccaccatccaccggtttactttcaccatgctagcctgatgccccctagtgccccgccgctccacaagtcaaaccgaaacgccaacgcgtctgttcgccgtactgcgcgccgacgacgttctcccctcggtatgttgatggatcaaagcaccaatgccacgttcgttagttgcggcccagtgtcgacgaagatcgtctatcagccatgcagatggcatctgttgccgcgcgcaattgtcatcgcaaatggctgtcaatcaaatctatcaactgaccactcgtcgtcttttctttttttttctttttttccgttctgaaactttcacattttcgtgcaatgaggtaataagattgatgctttgtccggaccgtgaggcgtcgaggttcaattttctactgatgatttccacgactagtatgccggcgccgaagctagagtgctagacatcattacaccaacctttttttttctctgatctggtactcacttgtggtgcaaaatctgataattttagcattgaagttgacatctaggagaggatattttgtggatttaaaggtaaagagaggctcttggctacttgagtgctaattatcctgtgtcatgttccgctgttcgctacttccagaaggagcagcactattgtcacgataatatatccacttgcccaagagcctaccaagcagcctcgccagattgatatgcttccaattgtctgaagtctgaatcttggccaaacaatctttttcaatcgttttaccgcaactctttccaaccaaagttacagtcaccgtattcaatagagttgttttctccgggcaaagcttctgaattatgtcatgactacatcattaagcgatggcaagtgatgtgacgaatttcttggataaggctccataaacctacatctcatctcttaagtgctaagaaaccaacataaagcgcaatgaaatggattgacatgtggtggtgataattattccttcgcgtggctgccaagtgacttgtatgaactaatccggtttttgctaagcactgcaaagaagtcgaatatggaagtacgtttcctactatcaaacttaaattcaggatgtcacatttgatctgtctggctaatggccaccaagcattcctgagggcaaaccccaaccagaggactgaaagcaaagtcttcacctgcaaaactctagagtgcattaattaaggaagaaattgaggtctcgacgtgctgtcgatcggtacccgtcagtgaggaatggtctattctgcacatattttcatcggagtttttttcgtggcccaaaacgtttccccggcacggggaatctgtgatctttgtaccgacttttgtgtccattacaaactttggtgaatcagggacgtactaaacgtacgtgccatctgatcaaagaatggacaattcggaccgggcacggtggaaaaacatggctgtctgaaacctaccgttttggctgaattattggctctgtctccctgtttctttcttggactctctagggccttctactacggctttgtttagttcaagctaaagtttaaaatttggttgatattgaagacgatgtgaccgaaaagttatatgtgtatgacaggttgatgtgatgaaaaaaaaagcaaagtttggatctaaacacaaactactactcagctgcttcctgagagggccaggaaggttcatgaatgaaaaacacatgctacttgccttacttgcagcttggaccagcgtcgtcttctttcttctacgaagtattctcttctgaaaattgttgtttgattcgcatcatctgagtgtactgagtccctccgattcaccgaacaagtcgcaatttgcacatatcagtcaaaactttgcagctgaacatatattttgcagcggtttagtacgtaaccgcaagagcaagctactgaaacggggagtttgaaaacgataaagcaagcaagtgacgcagatgattacaagacatttactgcttttctgcctaacacaaaattgatgatgcacctaccggtccggtaacaatacttttctgaaatgaaagctccggtaatactactactcaaacaagataagctcagagaccaatagccctagaaatcttctgcaatagtaacaagggagatgtgattgacgacgcaggattcagacgcgcacgtggtgaccggagcttgcacaagacgccggagagaaagtgtgaacgaattcgacatcacccccatcaaaacccttaactgacggagagcgacgccgcaacaccacatccatcacttgcctgcagatttgcatctcatactgtccggggacacgaggggggcacacctatcaaatgtagggtagtactaccttgcagctgagctacagtacagcggagatcgatatatcgcgacgtgtacggccacgtcacgaccgatcgattcatcgagagggctagatgacgcagaaatgtgaacaaaaaacttaattaaacgtcgtcttcgcgagggtccaaaaggcagtatttaggtgccgtacagtgactgcacgactgtgggggcctcgctgtttcgatcgtttcacacgctggagaagaagaaggaatggcgccgatcgccgccgtcgatcggtgggaggaaggtgaagccgtgcccgagctttcgtcgtctctcgttggaaagctactgttttgacccgttcacaccactacgcttccagctataggcagtatgtacggtgccacgcacggctctcgtcctttatataaaccaactacctcgccattgccaccaccagcagcagctcgccatccaagcatcaaagcttctaaactgaagcttaatctatatataaggagagttcattttgattttggtgaggaagaagtagtagaagtgaattagtgatatcgatcagagtgtgaagaagatgtctctggtgaagctgtttgatacgttggcgttcgacgcctggaacccgttcagcatctttgggacgacggtggcggcggacgcgtggctggcgagcgacacgtcggcgttcgccaacacgtacatcgagagccgggagacggcggaggcgtacgtgttccgggcggacctgccggcgggggtgaagaaggaggaggtgcgggtggaggtggacgaggggaacgtgctggtgatcaccggcgagcgcagcgtccggcgggaggagaagggccagcggtcgcaccacatcgagcgcagctgcgccaccttcttcggcaggttccacctccccgacgacgccgtcgtcgacctcgtcagggcgtccatggacggcggcatgctcaccgtcaccgtgcccaaggtggtcactgacaagcagcccgccatcgccgccgccgcacccgtccccgccgtcgtcgcacccgctgtcgaggcgaaggcaatcgaagccagcccgtagtgatgcgatgaacacacacacacacacacagacagtcagtcaatccaacgatccgtatgtatacgttgtcgtcgatgataagttcaaagtgcttgcgagtaaggtgcttgctgtacttttggtttaattacctttggtgtgaaatgctttctcgatgtaagacaagaaagctagtagcaaaatcatactatttgcttgatgcaatacatgttccatcttagttcccttacgtattttgtgtgttcccatatgaacattatcaatcattcttttttttttttctgaacgcgtaaaaaaattacacgtcaacatattaaaagaaaagagtatacagcacaatcaatcacactggtttatatcagggaaaaagagaaaaagcaaaagaagaagcttcagcttcttcttatcaatcaggctgcgtggtgatcgatcagtagtcccaggtccccattcttttcgtcttacacggtattattttttcagaaagttttttaaatgaactttctatactcgaatatttgggaaattttcatgtgccttcgataatattctaagctcagtttgatccacgtcggctgtaaagactaaaggaacgtgcccgtgggccgtggctgaataacagtccatgttaggctgttactacgaccactaatctactgggggtcagcaattcggaacagatacatcacgattcacgagccccccaaaaaaatctgaagctgcaccagacagactgtttgatgaaaagcactagaggtagttgggtcgggtcccgtgaggacttgaggttgatgaatggcctcgcaacaagtagcacgacaattgacaggctaaggtctggaattaatgggtgaggtagcgacgcacagttgcagacagcagaccatttacaccaccaactaggaagagagaagcacggattgccggggtagccagcgttgctcccacgaaatctatctatcgcacgaaacggattccagtggcggcagagacgttttgccgatcgtggggtcaatcaatcaatccgaacaagttgggaacgagttgaaacacacaagatgggaagaggagagagagccatagaggggatcgtgggttgaccgactggatgccggcgtactctccgtggtggcgcaccaactttttgcacgccttgccggctgtgctctggctgcaggcgcacggggagggggactcgtcatctggcacgtcggggaatcatttgggctgaaactttgatgggctgaattttgggccttattctggcgtagtattgggttgggatcgcttcgcttaaggatggttacgttataaccgggctgaagatttttcgaaattgctaatcggcgcagttgcgctagataaataactagcgcgcgtttccgttttggcccatcattagccaggcctaaggcccaaccacacttttgacttttttgtttttcttcctgaaagcaccgacgcatgcatgtgctagtatagataggaattaccgcgaaggggcagttgggcaagtgagacaaatcaatctacagcttaattaacgctataattcttcattattagttctaatttttattaggtgccgtgattaacatgagcactcatatctgaaaactttcaacccattttttaaaactttcaactcgttctatcaaaaaaaaaactttcaactcaaatttgaaaatttcaactctaaattttgaaaatttcaacctaaattttgaaactttcaactcaaattttcgaaaactttcaattaaaaattcaaaactttcatctaaaattttaaaactttcaactcaaattttaaaaactttcaaatcaattatttgaaactttcaacataaatttgaaaactttcaattcaaattttcaaaaactttcaactaaaaattaaaaactttcatccgaattttcaaaactttcaaatccaaaattgaaaactttcaactccaatttttttttaaaaaaatcaattcctattctagaactttcaagtccaaaattcaaaacttttagtttcaaatttcaaaagtttcaactccgaatctaaaatttaaatcttcatgttagctagtactgtatttattagagttaatcatgcgattaactctaatcacattattagtatcagtaggaggggagcacttacatgggttgaacgtagcaaaagggaaacaactcctagtcagctccacgcgctcgcgacttgatcttctggcgcaagcgcgcgctaggagcccccaagattttttgctgggccgatgatttggaaaacaaacaggatgacgtacggagcacacacacgtctaaaaaatttagcattgtcaaactttgggtttattttggcgataaaccaagcataccccataatgaaacggaagtgagggcatattcactttgatgccatttttaaccttatcaaattttggtaaagttgccaaaaaatatagctatatttagtttgctgccaaattttagtaactatataaaaatcctaccaaaattttgataagttatcaaaactaaggttttttggtatcaaagtgaacaggccttaaataaaacatgcacgtctcagcgaagggaacggaagtgaatgacacttgtgcaaatcggccggacactttatttactcattcattcagacgccatgggacaattccaaggaccgaaccaatgttgtgctccggtctaaccagaatacattacattggcggaggccacgacacaactgccacacagacacgagactcgccacacatggacctgacacgaccggactcgagcacagcacgacgtatatagcttctctccttctcagccagagatctcaatggccttcacctcgggcttcttgacctcagccttgggcacggtgacggtgagcacgccgttctccatgctggccttcacctggtccaccttggcgttctccggcagcctgaaccgccgcatgaactgcccgctgctgcgctccacgcggtgccacttgtcgttcttgtcctccttctccttgctgcgctgcccgctgatcaccagcacgttgccctcctccacctccaccttcacctcctccttcttgacgccggggaggtcggccttgaagacgtgcgactccggcgtctccttccagtcgacgcgggcgttggcgaaagcggcggtgtcgcggtcggaggtcgccgggacgagggagcggaagacgccgtcgaaggggtcccagaagtcagcgaaggggtcgaacacgttgctgcgcctcacgagcgacattgttggtttgtcgtggatcgctagctgcttaggtttctttgtatgaagtggattggaggaagtttggaacgagtgtttgtttggagctcgatcaaatgcttcagtcttggctcgatggatggaggttggggaatgaggcaggatatttataggttcacaactaatctgtcctgaaatctctggacttctctggttcttgctcgtttcgctttacagcacactcgatctgcttcgcttccgtcgctccagtactccatcagcctctacaaagcggggctcaccttaatttgctctagagtattcatttttcccccacatatcttgcttctttgatgtaggttactttgattgcgatcaaatcttatcgtgtactccctcagtctcaaaacaaaagcagccatgaatttcagtgttcaactttaatcgtccatcttatttgaatttttttttatgattagtatttatactgttattagattataaaacatgaatagtactttatgcgtgacttttgttttttagttttttaaaaaatattttaaataagacgaacgattaaatttgtacacggaaactcattgttgcatttattctgtgatggaggggatagcgagtatggaatgattgattgagaacgagaaactacgagaaccaattgcccgctagtgtgggccccaggcagatgggcagtactgatcctgaaccgtttggaaatatgtcgtgaaactatggagtccttttggcataccaaattacaccagttttgaagtattacttcactgtacatcgtagagtgagtactagatcattccagtgggtttcgggaatgcttcaattcactgctttcactgggagcagtgagtctcttgcgaaacatatttttaacggcaacttgtgaaagaaaaacacatttgagtttgaattcacaaccacgttattttacaatgcaggtcatgcccatgactgaaaggtaaaaatcactgccaaagcattgcttcgttggtaagttttttttagtgaattacactttttgggtcacgtctattgcactttggatcaccccgatttttttctctacccatgttcatcctataccgcggcaaagacataggtggatgatttcgccagcgtgtcagagttgacatcctccaggtcgtttacatgttaaagaagaggttttgggtggttcaaagtacaacggacgtaaatttagctagtccaaagtgataagactgaactagtgatgatccaatataaaactacaacagtaacaggtggtccaaagtgtaattcactctaaattttatatgtactacctttcttattagggttgtttttggtttggtgccatgaattatattggtagggccaatgtaattgatgcatttttcttccttttcctaacttctattttttttttgaaacacaatacaatgcagacgtctacaacacgtacacactgacccgtatgaacatacacgcgaacaccctactctatgagcaccttcaaaagactggccctacataaagtcaccgtagacatttacgggtatatcgtctaccactgaaagaataattagccataaatgtgagcacccgtatcaaatctagaatttgaactcgagttccatcacaagaaacctaacctaacctgttatgctacgcttatttcacatctcttataaatttacaaaaattggttgctaaatattcatgcattggtcagaagtgataaaggccatattttttttatccaacaatgtttataccgatactaaaatttgaatttgaggttatatcgctgtagttcttttttctaacatcgatatttaagtcatgaagaacatatatgtatataacgatactaaaatttgaatttgaggttttatcattgtagttctgttctaacatcgatatttaagtcatgaagaacatatacatagtttaaccataaattatttaatcgctaatatatcgtttgatgaattataagtaaatgtaaacgggtaaacatttaccgcgtatctactaaacgtttttttaaaaggagggcaaaagctttgcctcgtatattgatagagatggagaaaatacagggcgatagaattatgtacagggctagtctaaaaaagaactaagcccgcaaaaggtgatggttaagtgatatctcccaagattccgaactcttgaagcttataggctcctgctttgacccatgcccgaccttcctcttttatcttggcgaggatggatgccagtggcgatgcagagtttcgaaaaattcttgcatttcgctcacaccatatttcccaggagaccaagatcaccagagtacgcaggggaatgcgggggttgttgagagaatctaccacaaggttccaccattgttctaccgagtcgcaatcgctccatttgatcatttggaggttggtttgagtccacctttgtatttctgtccagacccgctttgtaactctacagtgtgccagcaggtggactgctgactcgtcaattatgcagcacaacgggcaaatcttctggttttgccatcctcttttctcaagtctgtcaactgtccagagcctattttgggtggcgagccaggagaagaatttgcattttggaggggcccacgctttccagatagtttgattgaaggcagacctcgtggcccccaggaattggagcctgtaggcagactttgctgagtattgaccattggctgtcaaatcccagtggatgctatcttggtcttcagtcagggggttcattcttctgatcatagtccataggcggacggactgctgaacgtgatccgcctcagtgatgcggaggatgtcgatgtctctgacccagttgctttcctgcagggcatcatggacatatctgttctttcgttttgaggccacatagatgtctgggtgattttctaaggagtttggttctctagccacttggagtcccaaaagcgagcagttctaccgttgccgattgttatggttgttgcggccgaaaaaagctccctatcttcctgactgcacggaaccgccgttcccacccaaggcttctctggggccgtccattcataccatagccacctaagccgcaaggcggaggcgaagcgctgaaggtccattattcctagtcctcccaggtctttgggcctgcagactcttttccagttgaccttgtatttccccctagaaatgttttcccctcctgcccagagaaatttccttcttattttatcaatgtcctctaaggttccatccggaagcttcagggaggttaagtggtaaatgggctgcgctgtgagaactgttttggttaaacagatccttgcggccgctgacatcattttcccttgccagggggccaggcacgattgacacttgtctagcagcggttggagatggactttcttcagccttcctaccaccagtggtagtccgagatatttcatggggaaatttgttagccctgccaagaagatgctcgtgatggtgctgagatcgatggtgctgcatcggattgggatctactaaacgtttcaaaatgtactaaacgataaggtgtcaaaactgatctcttaaaagttttatggttgaagttgcattctaggtataatatgatgttgttttttgtaacttaaaccttatataaatcgtgagttttattaaatttacttaaaaatatagtgacctgaaacttatcgactcttatcacattccatttcttcggctgaagtttcaaatcagaccaccgcacacctaggagtataactgttgtcaaaagctagtataacacagtatatataacatcggaattcaaaaacgtttgcatgatgtttgcaacctgaaaagctctttatttattcctcaacgagcaagaactaagaaggcgattacacaagtactcacaaaggaatacatgaaaccggccgactcagccactcggactcccaacgggtacgacacaccagcagcagaccatacttgcacgaccaaacaaacacacactgaaatactgaattactgacaccaaacatgacttcttccctcaccgatcacatcttcaggagcttaaccggagatctcaatggccttcacctcaggcttcttgacctcggccttgggcacggtgacagtgagcacgccgttctccagtccggccttcacctggtccaccttggcgttctccggcagcctgaaccgccgcatgaactgcccgctgctgcgctccacgcggtgccacttgtcgttcttgtcctccttctccttgctgcgctggccgctgatcaccagcacgttgccttcctccacctccaccttcacctcctccttcttgacgccggggaggtcggccttgaagacgtgcgactccggcgtctccttccagtcgatgcgggcgttggcgaaggcggcggtgtcgttgtcggaggtggccgggacgacggagcggaacacgctgtcgaaggggtcccagaggtcgagggagaatgggtcgaacacgttgctgcgcctcaccagcgacatggttgctctatctttcgctttctgatgcgaagttgtgggctactgaaatggaacggaagaagcgattgcaaagagggcgatttgggagtttgggacgtatgcaagtcttgtttgttgtgtgttcctcggtgggtttcagcacaagagcggtgcacatatttataggatttgtccgggagctgcgcaatggacgttcttgaggcgtctcgagtcatctacttttgtttcggtgctcctgatttgatctgctcccttctagaaaaggctttgcttcccagtccagactagtctccacactcccaagtgctggtctggatgaaatcaatgattgcctacttagatttgatgtgtactgtattaaactggagtatttagaaagaccagccggatttaatttttgttccagatttgtccagtgttaatcacatatacttaatcaggtagctgcaagacgagatgcttctgcacaacgacgaatgattaatcagcgacccactgcttgccaacctatttttttttaaacacttgccaacctattcattcagcatgataaatacggacgtttaaaggattttgtatcacaccccgttactacaagcctataacacatttgcaaacagcatatttgccaaaaaagaataatttattaataaaacttgtatatacgtgtttttagtgatcttaaagcaaagactgaaaaatgaattttgatcaaaacccccaaaatcaacttcaaatttaaagttgaaattttaaattttgattgataaatataagtataagtaaaaagataagtaaacagatattcaaccgtgaatcgcgtaataagttactccgtagtataaaatttattcctcaaaagaaaggataaaattatggctctggcataaaacaattagagcaagtttaatagtatagcccactactaacttaaaatcatctatagccaatgtaatagtcaattcatacaatagttgcttactgtactattaatacctggtcccacctatcatacatacattacgtattgaagtccgtgctgcagctgactacagatctgtagcccgctgctcttctctatctttttttatctctttaaaatatgtttatagctgacttaagcttgctattatacctgctcttaagggcaaaaccatcttttcaccccataataacgttaggggtgggcaactgggcatacatttggttcggtcttgggtcatgatcaaaatttgaggatactaaaagaaacgcaatcaacaataaatcttgttttaggacatatttcaaaagtgaacaatcacaacaacaaattatatataacaccaagtaaccaatatagtggttttaattttttttttcaagcatgatacttccttcgtctcatacatatataccatcccgtactatttttttttgggacgaaaaaatatttatctgagttttagctaatgttaattcggttaagagactcatgattaaattgaccgtattaaattcagttagtaagaagggttagaaaacgataggcaaataaacgataaatagcaatagatcaatcacataagacataagatttaatgtggaaaatcctctcaaagcaagagagaaaaagccacgggtgccaggcagcaaatatcttcactataacgggttgaggttacaacgccgaacggcggcttacaagaagtatatatgaaggtgaaacactaaagtgataaggatccgtccgaagctagcctttatacatgtggaaatgaatccttgagacgaattccttttttagcataaatgaatccttcaacctaaacacaataaagaaaaatactttcggtgccaaataacctcttgggctaaatcactataccaactaagtttgagcaaaaagcaatagaaaactagctttgtcatcatttccgcttcgttccggctgaagcctccgacgacgggcctccgcttcgctccgttggaagctagactttatacgtgtgcaaatgaatttagatcacaactcaacaagaaagagaccggaaatttcggtctcatttctgttagttcggttggttttaatttattttgtccacccctaactaacgttaaatcgacgaaaacctactaaaacaacaaataaatgataaaaacagttcgaatgagaggcattacagccttacaggagagtgaattttacaagggtaaatgtctagctcggttaactttagaggataaataaataattttcttaaaaaggaaaaaagagcacatactaattaatgaaaatcataaaacaaggagctccaggctccagtaagcgggagactagtctagaaaagagtgggtcctgctggacagagacaagggaaataagctgatctggaaagaaaagagaacatcagagagtggagatcactcgagatgcttcaagaccaagttctgaagaacctataaatacgcccaccttgcatcgcatctccgcattcaaggcagagctagtagtggtcacatcgccaattcacagtcgaatcaagcaaaccatccaaatcacacccaactcttcttcttcccatcctccagagatccaagcagcttagccatgtcgctggtgaggcgcagcaacgtgttcgaccccttctccctcgacctctgggaccccttcgacagcgtgttccgctccgtcgtcccggccacctccgacaacgacaccgccgccttcgccaacgcccgcatcgactggaaggagacgccggagtcgcacgtcttcaaggccgacctccccggcgtcaagaaggaggaggtgaaggtggaggtggaggaaggcaacgtgctggtgatcagcggccagcgcagcaaggagaaggaggacaagaacgacaagtggcaccgcgtggagcgcagcagcgggcagttcatgcggcggttccggctgccggagaacgccaaggtggaccaggtgaaggccggcatggagaacggcgtgctcaccgtcaccgtgcccaaggccgaggtcaagaagcccgaggtgaaggccattgagatctctggctaaaatggtgaaaacgggagtttgtcaaggtcaaggcgtgtcatgcatgttcactctgaactgtttgcggtgtttcactcgggtttgatggtttttactagtcctatgaactgtgtattcttttgtactctgttgtgagcgcgtttgcacgaagcaataaataaaaataaaatcagcttgtttgtatattgatcatgcatgtgtgctcatgtcgatcgccgcagccacgcaatgcgtgtgcacagctgcacaggtcgaataattagagtgtacacgttgccggcgataactagctaaactccagtggtgcggttatcttctctgcttgcggttttattgatcgttgttctagtgcccttgaagcggaactgcttgcttgtaaggagggtattaatatggcgctccaatggaccttactccccattattgttgtggcggattgcttggtggctgtctctatgatcaggatgcaaaggaggaggcgccaggggcggagccaggattttagatcgatggaggatgcaaaggaggcgtcaaccaggggcagagccaggatattagatcgatggtgtcactatcaatgataacaacttaagtaaaataaaattagtgctaattgataaagtaaaatagaattttcttttcaaaaataattcgacttgtattcatgccaactatctaattggtgaaattaaattataaaagactaaattaaaattgctagatatacatgtgcaagtgaataataatattctttctaggttaataattttgccgttttggataagaacattgtctcataaaacaactctgaccactaactgtgagttttaggctatcaaacaactttgaccacgagtcaaatattgtgagttttgggctatcaatagttaattaagctgctagctactgtctggctgtccatgctcacataggatggtgtcacaaagcaagttaatttggtgtcactcattgcaaagtaaaaggaataatgaagacaagacacaagccattggtgtcatgtgacaccaatggttgtacactggctccgcccctggcgtcagcgttggctcatcttgtcagagacatcgatactctgttgagaggaagaagggagatcatactgaagaaaattcatcgttctcagaattctgtcagtcatgttttagcaaataaagcccgtactgaatatctcactaagttctaggctgatgatagttgtaatcttattttgcaacttgtttgttctgattctgagtaatatatctccctttccccgcaaaaaaaaaaaactagctaaacgctgatgggttcgaaaaataattctccaactcccaccgggtaaagaaaaccgttagatggaagcctgtggctaggcttcaaggttcttcacgtagcgtacggcggtacgggccagggtccatggccgcggcccgtagagccacgtcaatttaaatcttagccgcacaatcgtctccatccagcggttgtatttgtctgattggggttcggagaattctttgccgaacccctacgagccactgtttcccaattacgggataacactaccgatcggtgtgactacatgtactactccctctctactctatccacaatacatgtatgaatctctaatatatttttttctcctaaactaattatctctaaaatattttttctcctataattatctgatctacgattcaattacattattttaattgttgattttttctgtccgattttcttgaggactctcgatttggagttcccttcaagtttaccggctgcctggcaaatgttccacctttccccgcaatcttggaccatttttttttgttttgtagctcatatatttgaggctggagttggtagggagagctcagagctcccacgaaagcccatgaaaatgggcatttgtcttgcatgttagcctgttaaggcgactcgggttcggaaaagaattccccgaaccccacttggtccaaagcaaccgttggatggaggcgcgtttgcggctacgattcaagctgacgccgtagggtctatggaccgtgggcgaggcccagttacgtgagcccagtttccgtttaggccaaataatgtcagcccaacgaaacgagggctggccattccaatggtatcgtttgtgtcactgaaacgaacctggatttggtctaaacgaaatcatcaggtgaaactggcattttgtgctagctgctgcctaatagctcagtcaaggtccagccgaaagcagttggagcatgcaggcaaatccaaacagacatgacccagatttcctgccatccttggcagttctcgtgctaaaagcaaagctagccagcatagcttttggttgtatagcacattgccaaggtgccaaggtgctacgtcacatcattttgaaaattttaaattcaatctaagaatatctcgagagtatcaaaagctcccaatgatcaattggatttgtcaaagaccgagcagcagatcgcttcactgtacttcgtttcctttttctacgaatctgtgccgcgaaaaattttaaaatttagcttccttttactttaaaactatccgtagattttttttaaaaaaaatattttttagatttatttctagagatgctttcataatttcaacgataagtgaaaaacagagtagcagggttgcaattttgcttcacagcaaagacactggacatgttcaagtatgctgttatgcaccgacatcgttgatgattacagaacagtgatagaagcatcaatagctagtatagtcacatactgcagcaagcaacgaacaaagaaagaaaccgagcaaca

SEQ ID NO: 70402 - DNA, 1232 bp, Oryza sativa
ggagaagcaggtggctgatagtaaggacttgacagagggcagtgcaaagggtaatatggttggctgtctcccatggttggcacaggggaataaaaactgtacatcacctgaacatttgcatatcaaggagattacattagtaactgacccttcttgtaaaatcatggtagcagaacaagatggtgaaagcattaagaaagaggggaggtgtataataaccatgtacttacaggagatgcagcatcagttccatctgcactggcaacatgcggatattcttcccattgacccagatggttcaagtatcctgtcgaaagaacattcttcattcaaatcaagcagttgtaattcatgaacagggtaatgtgctatcatctcaaaacaatagagcaaacatgttctacagaatcaacaatggggaaccaaatgactacagtttcctgactatagtgccaagacagaaattagtcaatcaatttcctcaaaatgtgtgaagtaaatgtgcaacgtagagcagcacattagcaaatgccccctcagatagaacctgtgcagctaattaaaatctaaatctatttcagtctagaaacaaatgctacagtttttagtatcttcaatgcatgacaatgtgttggtgggtgtaagcatcaagacagagaaacaaaaaaaatgtgctctaacctccagaaaagactgtatgtggctgaggggtatacacattgggctggtagatgaaatgttgttctccacctttacccaaaaagcttcccttctcttgagcacttttggttgattttaaggaacttgcgccgtgcaaagcagtactagataaattatgatcttcactagagagaatctgacataacaccaatcaactgttagtagtaccgaaacatttgcgaagaaaaaaaaaagctacaaggattatgactgtaataacctgctttttcacactcacacttgtagaaggacttttctcaaccacaaggcgtgactctagaggctccatgtgatctattcaagagggacatccatgtataagtctcagcacagtaaattaagccttttatgacaaaatagtaaactaagttgcatccgggcaaattagaaatggaagttaacaaaagggaactattgcgtataggcgcataaactaagtaaccaactttcatgtacaatcgtacagacgaaatgatgaataatgctgctaacatgttaaaacaaacaaagaa

SEQ ID NO: 70403 - DNA, 12376 bp, Oryza sativa
cttacattgtgaaacggaggaagtaatatttttttactgtgttttaagggtatattgataagcgcatgtaatattgtgtgtgtttgtgcatattaggtgttagaaattaaatgtttgagatgagcgtagctcaacagattagatttcttatgatttagttgattagattttttatggtggaactaacccattcgagtccaagtaagatttgatacgggtactcgcatttattttttttcagtggtaagcaacgtagtgacttatttgttaatctcaagatttgctagcccagttttttaaatgtgctcataaggatgaggtttacatgtgtgtttttatagggtgagagggtgcgtacgttatgaatctcaacattttcattgtttttctcaaaaggaaaacataactggtgagacatatcaacagggagcaattaaaacacccactcatcggggatttagatcctctaatgtaacttttctctgacgtgatggttaacatatgaggccgagaatgatagggcctactgtacacgttagttacggtaatactaacgttagatatatctgcttcctccactggcacgatgaataccaggaaacccggagttatacattaatgggttgcagtcatggccttgcctgtcggctgtcgtctccaatctccatgcatgtcgacggacggaccggccgtgcatgacgcatcgacgacaccgcctgccgatctgcctgcagcctgctcgatccatccatcgatgatccaacagcatcacgtccccaccacaaggcaggcactgccgcaattgcatccctgcaacacatgcatgcatcggatcacttgccgtggattcatatcgcagccgtgacggcgtacggtgccgttgccgtcgtctcgtacaactgtcaagccctttttctaacggcttattagaaaatagaaataaatttatagataaaacttttatatatgtgttcttggtgacttaaaagtcaatgctgaaaaagaagttacgttgaaaatatctcaaaatcaatattaaaattaagtttgaaaatttaaaatttagctttttctttgattgattaggccatccgatgaaagcctcagtgagcttgcatagctgcagctgcaagctgatctctccttcatatcgatccacactgcgtcttcgtcgtcatctctatgatcaccatgaggggagctagctgatcgatcagttaatgcaaccctgttgtatatttgctcatgctggtgctagctgtagtagctagctagattaatttgccctttgatattagcttcatgcctgattaatttttccccctttcccttataacctcctatgattgtgtcagttggtcgcagttgtaaaagttttttcttctgttaaattgttaatatatacgagcatgtaaggttttcgcgcgttggagaaaaaaaaaatactatgctgcccattctgacgaactgtttctctgcctgcttatttctggacacgagcatcagctacgggccagccagacaagacagcaaaacgtgaagatcctaaaaaccttgatgcatatatagatctctgtcatacggatgattggacagtatggccactatgtctgcatccatacatgagtgtgctatgatcatgatcatgatcagtatacgtaatattcagtatagcttggatcggagtattaagcaattcatcaaacctcagaattctaatgacagcaggagtgatctgtgatcttaatccatatatatctcctcctctgcatgcagccatcgtatcaacagcgctgacgcgtcattatctaattgcatgtgctacctgttcatcagcatttgacaggagcggttagctagctgggcatccttacgacagcaagatcgcacaaaatgtggccaacgatctggtcggatgaatggtatcagcacatttagtttttctttaagactctatcagcacatttggtttatgtttgcacttcttttcgaccatgaaaaagcattttgtcatagagctaatcttgcagagcatatatatagtactgacgaaagatatcgactattgtatatgtcgttataattagtacctctgccattttcagaaatggagcagctatctaacgtttgccaggcataatctgaaaccttgatatcttctcacatgactgttagtttgctgctataattaagccctaattggtcctacacacacatgaaacatcagctaatgcatgaatatcagattaagtgtcatgtgcccctgtatctttcttctgtaaaaccatgtgtgtatatctccctgaatttctcttcagaatgcagaaactgaggcacaaacacatccgacacaattagaaagaaaacatgagcaaaaaaattcctcgtatctcatcacatgcagctgaataacgaccattagttgcataaggttctcatgtttctgtgttattggcagttgcaaacacccccacatgtacaaggtttcctgtaaccgtggtatccatgcttagatcagaacaaacaatgctgagtggccttaaaatcaaggtgccttctcacatggcgctgtgcatggcaagagcattttggttcatgcttccatgttcatgaaacatgaaaacatgtccaacatattgcttcaggcttattaattactgttatctaaccacaggaggactgagcatggtcagttactttgcaccactgttcaagttcagaagagttgatctttctaatactacaagactttgtgcaaggagttaaggagagatgattgcattgtctttcttccaaaaaaaaaaaggtgtgatgatcgcattgccctgtaacttgatcccaaaagcttttcctgcttcaaagaaaaatcattatctaaagaaaaaggcagctcaaagaaaactgctggaacatgcatgcataaaggtcttctcttcttaattatgtcttagactttatgttctactagtaattatacagttctcgatcctgacttcaggacatcaggtcaaacactgatactatgtgagtttagttgctagaatccagaaaaaaaatgacgcatgagagcctttaacactgttgcttaagccatttgatgataagatcaactggaagattgaatttcactacagggtgcatacttccagagcaaaaacaccattgtacaccgcctgatctggatataaatttgaacataaattctttttttttctgccaaattatattaagatagtgagaagtgtttgaagattaaaaaagtgcgtttgtcgtgttacaacttataaagctacaatccggaaaactcaattcatccatttttttacatgttacttaaaaagtcatcaaaaattttaaaaaatttagtaggatagatcaatatataatatgtcacttcataaacatgcaaattcaactacaatccatcttaactaggtgatgatttgaacataaattcgttgtggcttctatcgttaggtgatgatttgaacataaattcgttgtggcttctatcgttatggagctcaattccggtaagaaagtaaagctgtccaaaaaaaaaatcaagctcgatttgagtttagctaaagacccaaagcctaagccaaagcttacgagttttaccggggcgagctcgaggtcctaccaaatcttactgtgtatagcttttattatttattcatcttgttaacttgataagctaatagataaatatatattagcacctatctacacaataaattagcatgtattggcatcatatatttatcttagtcatttttctactttttattagtgtgattacatggaaaatacttatacttataaagaggttgtcattaaaatattcgttgtactacttatatggacgagcttgcttaaaaagctcaaaggtgaaataggcttagctcaagcttgagtctaggcagagagctgacagccctataagaaaaggagagcttctgaccttctgtaattctatgaagtatggaccatttgtacgccaaagccaacttgccgtgaaatctcccattcttcttgtgcatgcgcactcccattcttctcatccaatttataatgctgtagcaagaaatctgtctgcctgtgcatataagataagataatttcaatgacaacaaagcagtcttcttctgtcacaagtcattttttcctttgttagcaactaccagtagttcgtgatgcaatgtgctgcctgataaatgcactgcaatgatctacgtacccaatgcaattatgcattgaaatgcagtcgttgggacaaaggccctgctcaaggagctggagatttagagaagcataccaagagagagtatatatatatataaggtttctcatcttatagctgctactagttcattattattttttgattatgtagctattgattgtcagaatttgagtaaaaatttgaactattattcaggaagaaactatagtcgctagaaacttctcaaagaggaactgggtatagagtattagctagcatctgaaggtacgctacgtctgtccttgcaaggtacttgggcaatggttggctggcaactccatcaatggccataaaactattgggctagccaacctacggggatgctccattacttggttgacacttcgcaacgtgcagagcacatgctactcggccgttcgctcacctttcacatggatcatggacggatggatggatggatggatggctcttggtggctcttgcaggctgcagatcgagaggctcctcatagggatcggcaagaaccctgaaaaacaagctcagatgttcagtggttgacgctgagttcgcattccaatgctcattattggacctaaagctctttatactccatccgttccctaattttgtaggattcaaattttgtacgcaatataggcctggtttagttctaaattttttcttcaaacttctaacttttccatcacatcaaaactttcctacacacacaaactttcaacttttctgtcacatcgttccaattttgaaatgaactaaacatagccataagcatttctaggacaccgatttcaaagcacgagaatccaaccattttcagccaatcggatgcttaggaggggaattcaaacaattcaaaattcaaaatttgaattttaatcaatgaggtaactcaaaggaaatattttccattattcctcatctttattaaacaacctataaatgcttatatttaggaacggaggagtacaaccctctccgaaactggacgtggaacgtggtgatgtgctgagtgagtggtcaggggtttttgttctgcctgtcacaatcttgatcttgactagcacaagccatgcattgcatcaagaagcaatgcataggatcgagaccagcgtgtacacgagctgaggtcatgttcttgacaaagcagcttgaattgttcatcacattgtcactttggtaatcgtggtggacttcaggggatcagcatctaagtttaaaatgcctcattgggttgaacaatcttgtgttcctagtcagagtttcaacctatgcttggtattcattggagtgcgaggcaacatttgatcgagatatgctagtaaattgctggattagagaaaaggtcagagaaagatgaagatataaggtcggtgagtgatcagatcgatgcatccattgcatctgcttttcttggagtaatatgggcatcacttggcatcttttaaagaggtctctccccacatttcttggaccaaaccaagttgggcaagagcaacaaaggaacaaagccaaaactgatgccaatttggaatcagttggttgctcctttctgttcataaaagcgactcaagtttttcctttttgttccttgcagaaagaaaaagttttgctttttgttcagtctcccaagaaaggaagaaggcgatcagacaatgagacaaatcagacatcagagaacagatcatctctcatagctgcattacgtaatggataaataggatcacatgagtattcctactagataaaaactgtcactaatgcatgctcacattgtctaatgaaaaccacaacataaaagaggaatccagagggcatcagaacctgaagtctgaagatattgcgcggccaaccttttccttcagaaggaaaatccttaaaattcagagtggagtgcaggacaatggctatgagtcagagtcagaatctgggagcagctgaaatctcatgcaatttgtggtatggagttcatcgagtacactcacaaggccacaagcacagtgctatagcctgaaggtactacagtagcctacaattgtttgctgattgtatgtttctttgcacttaggtgttgaacagtgcttggcaaaacaaaggtactactctgatatttttttcagaaactgatacaatgaaatttcagcgtttgaacaaactataacaaatgatccaaaagtaagcattgattccattagacagtacagcctctctccaaaaataaaaggatggtacagagacgtgcacgagcactatatagtcaagattgacataaacaatggcggtgagatgtactacggtactaccactatcactatagaggaacaatcacagcaaaagcactgaaaggcagaggtagaaattcttactgatggggcattctccatttgaacagatcaaaaaatcaccggcagaggtagaaattctctctggcacttcaacaaatcaaaacgaagatactccatttccatatcaaccataaatattttccattaatttcatccatgagggctgcattacccaattcagatcatcagctcaactcaacaaaataagaaaaaaaatattacgcagtaattctaagcttaggggggagatactatcaaatcatccctcaccatccacaacacttaaaaacacaaatcgataagaaaagaaaagaaaaagaaaaaaaatccatttcttttggatggatgaacaacagccatgctaaaaaccagcagctactacgttcctcttcatctgcacaatgggttgttgggggcgccgagggcgacctcgtcggcggcgtactcgtagctgcagtagcagaaggcggcggcgttgtccttcttgttcttctcgacggccttgaggatggcctcgaaggcgggcacctcgcaggggatgcggagcacgccctcctgctggaacccgaactcctcctccgcctcccggagcagcgccgcgaacgcccggtgcttcaggtagtccgtcgggatcacgaaccgctgcgccgtcggccccacgcacaccgccaggtgccccctcggcggcggcgtcccccccggcgacgcgccgccgtccgtgaacgacagcgtcctcttcaggaacttcttcgccttgctctcgccgccgccgccattgccggcggtggcggccgcgtctttcggcgcgacggagagcttgcgccacttcttgagcatctgctgaagccgcacgatctcggtgatcttgttcgacttcttgccgccgccgccgccgggatgcagatgctgctgctcctccatttctgcggtttcttggtcgctaacttttttggggaaatttttcgtgttttttttcttctctctttggcgttttgggcttcgtttgttgcgtttgtgcagtgatgaagctttggaggcgttcatggaggggtaatttatagggagggagcttgtgtggggcccaccttacaatagtctaattaattatttttctatgtgttttttcccttcttctgatctaggagtaactaatggtgttaactgaataattaattgattagaggtttctgcaggtaggtcagtaaagaaaaggggttgccagttcggggaatctgaatagatttctgattgctaatgccatcttggggaaaatgctggccagagtctggcttaatgcagatcttcagagcaatagccctgcaaattcatttttcttttatatataatcatagggctacagttatgtttattagagctgtatgactaattaatttggaatatatgagatgattgaacaagttaagtggcaaaaaaaacaatatgtttattagagcactatgactaattaattttgcaaatatgagatgattgaacaagctagtggcagaaaacaaatatctttgctaattgagacggtcaacattcggctttaaatggttaagcagtgaaccttttttctttatcttcatcagcttaagtagaccatgatttttaggagttatggaaagtagatagtgttacgtgattcagtcaatgaggcgattctgttcgccttttctgtttcggataactgaaaaagtctgttaagcatgggttggagattttcagatcctaagaaattggatctaaaacatatactgccttcacctgaaaatattcagtcaaacaaatctgttaaactccattgccaatcattattgcttcaaatcaatggctagttggcatttgacaattttctctgcttctgaaacagatctacagcagttcacattttcagatcctttgcagttttggacggccaggaatccagcatgtcaatggctgatggagcagaggataggtttcacatcagaacatggctgttgagccttctaacatgtgatcacgcacttaacaataatgctgtaccggctaatgcattataaactactccattttctgcatcagttcagctctgcttaaccagctagcctgtgtgattgctgctctaatcatttttcttctggcggttggcaatggcaggagcagcagcagcattgacttgattagtttttggcagggttctttcagatttggggatctacggcatcgtcctttccatctcaccgatcggtgataccgttcgtcttgtcgcctaattaacacatggattttcattcaacgtggtggttaaagagaggcgaaacgtatggtattcttcatggcaaagaggttcagagcattgtctcttctgaattatggtaggttgcaaatgtgatataggttttttttttgtggttcatgagctgattatttggttggtaagattacttgcgatcacgacaaagaaccaaaccggtagcaaatacttcttttttctgaaagatcaaaccggtagcaaatcatttgctcagtagcggcagattctctgaacttctttgttccctttttttcccattgaaattttggtctttctcttgttctgttgctcatcactaattaaagctatccttgacttgatatgcttcttctaattaaggtgactcgaggtgaaattaaaagcatatgttgtccttaaacaacagctaattaagtgattaacacgatgcacacttggttgatgacaagtggctgtttctgttagtctaattaagcttctcaggcatgtcatggactgaagcttttcgagtgtgttttttcacctgtataatactcgcaatttgccctggtatacacgtgacatacttgaaagctccagtataatcggcactaattaatgagagcatctcctgtcacttaaaccacaattaacaaacacgatgagtactgttcgacaagtacaagttgttgtaccttcatcatgaacataaactagacagtaagaaaaccataaaatctgcaatgccatctagcatctcttttggtttctagaggttgcaggttgtaacatgacacttgtggcacatactagtccactaggtagaaagaatctacgattaagattagcatggatgtattaaagaaaaacattgttcttgctagcaagctctacttggatcagaatgaacatgactaaatcacaggttatactctggggagtttctcacaaaccgtacaacttgcaggctttgtcatgtgaaaatcctcttgcattatggttttagtacagtgtcatgcgagtcatgccactgattatttaatttatttcattcacatctccgagcaaaacaataattagctgaactaaaacatgtcaccaaatttcacaaggaacattctggactatgactctaacttgatcttaaattttgagatcgagtacagcagtaaaccattgtcacattgtggaatgcaaaatgtgtttgtgatatccaacttcagctctgaccaagtggccgcccagttagtacaagtctgtcaagattttccaagtaattttcagtcaactccattgtacaagaaacacacacaagcagttcatagagaacacaagctgaattctttttaagatatttcaccggttgattgtcgcgaattatttattctgtgcctctaaaaataaattttctaaaaaaacttactgcattgcatagattccttgttctgagctatcaaactatttaatttgttatatttataatcatgttgataatatactataataatctagttaatctgcttcaacccgctagaaaaccatcagctagtatatccggtctctgccgctcacaggatcaaatgccaaaactgccaacggtcaagtcctttatatcttaagttaatctcctcgcgtgtactgtcagtaaccgtcctataacattaattaacactcctaattacggtttaaaaaaacacacctaaactgtacggttacctctgcagccctggccagaagaacagtgaaactgaagactgaagagattcgcggccggccggtcaaaagactgaccaaaccaaaccggcaatggccggtggatgcagaggaacagcgctagtagtatcgggaactgcgactctgccgatgcagcaagctattgacggttaaattagttagggaatgcttgcacagtcaaaccctacaagagataggcagatgaagttgatagctagccaccttgcaatgctttgttccatagtttcaggaaaagaaatataatttctgataatgaatttggacaagcttgaaagtttgaacgggtcgttttatcctttgtcaaatgactcaactgtcgtggctagattggacacttgtttcttccgtggttactgttttttgaaacggattttcttgtttgaagagagtttttgaaggaaaatgtctgaagagaatgtgcctgtaattgttcagaacttcagataagaagtgtcagtctccagaagaagctgatgtaagaacttgtactagtactaatcgactggttggatgctagtggaaaaatcgctaggctaaaaccaagagtaattttcagatcacatctcctgtccactggacctgaactgcgtgtgaaaccaaaccacacccaagagcgatcggcagtcatacttattacagacagaatcacagaaatgaggagctgtgcactgtgctcgtgtcaaaaataccacattttatacaggagttcatgaaatctgcaagaggtgatccactgtgaagagacaaaaagtgaaattcgatcgtttgatgcagtgcaagggctgccgctttggtgaaccattgcatgcgctttaggggggcagcacaatatcgaaatgccgctgagctttttctgcaagtccaacaaagtagagtactacggtgtactactactcctccacttgtctattgcatttgcaggtttttgcagcacgcttcataggcattcgcgtctgcttgcgagagtgcagagacacagtgtggtcactctcagagcatattataatcttatgtagaggagagaggtagaacaaagtcaaaggggttggctctcatgcaagagctagtttaacataatctccaagacaaatgcattaaatgtataagtgagaaatagagagaggaaaaaaaaattgtagctaaccttacagctaatctatctattatataattaaaggaatagaaaaaggagccttcacgttcgctttcatggcttagaaattctcacattaatcagagaaaaagaaaaaacagagtccatatagaaatacaatttagaaatagctaaaatctggaattaaaaattaaaaaataaggaatattagaagaggagactagagtccatatagaaatacactttagaaatagttgaaattcggaattaaaaaataaggaatattataagaagagtatagagtccatatagaaatacaattaggaaataatagaaattcggaactaaaaataaggaatattagaagtagagtatagagtccatatagaaatacaattaggaaataatagaaattttgaattaaaaataaggaatattagaagtagagtatagagtccatatagaaatataattaagaaaaaaaatagaaatttcggaattaaaaaataagaaatattagaagtagagtatagagtccttataggaatttaaaactaactaaaattcagaaaaaaaaggagcctccacgttcgctctcatgacctagaaattctcacattaatcagagaaaaagaaaa

SEQ ID NO: 70404 - DNA, 739 bp, Oryza sativa
aaaaaaagaactgaaaggcataacgcaagctactgaatagaatgaccagaatatgcttaggctggacttcaactaacagagcatcagagtggagtactttcaggtaatagtgcgagcatccatatggcattcttttattcaaatactgacaagaatgactgtgggttcatgcaagatgccatctcttgaaaaagtttgaagcacacaaaggaagtacttcaacttattttccttgtgaaaagctgcatatccatccaataataattagattaagataatccccttttcaatatgcaattgttgcagaatagcatgtaccccatgaagcatatgaatattccactaggaggaactgttcttaccaaatctatcattggcacaatttacggtctatcaggattcaggtataactacttaaattaaaaacgaagtttttgttccctttacatgtgtggagtgaacagcatcaccggtctattctccaggaccactcaccctttcatcacccaactctcaaattgcagcagatgtgttcaagaaaacgaacatcgtccagaatagtctaccaaattaatgagccagtgtacgtgcattttctttttctttcatttctttttttagtttttgatttggacaaagatcttatccatacaatcgaggactcactcatgacaagcagcaagtctattaccattagatattatcaacccccagttaaccactgatgagctacttgcag

SEQ ID NO: 70405 - DNA, 652 bp, Oryza sativa
tactatagaatgccttttttcgagacggagggggtatattttaagatgaagaaaatatatgagaagcattgaaaaaatatgcaaaataagataaactattagtgcctaattaattaaatattaattattataaattttaaaaagaattaatttaactttttatattttttaaaatacatcagtcagcagtttgagatgcgtactagcgaaaaacgacgttctttttcttctcttcaactctcaaacgcagcccccaccaccgctgacgccatcacgtcgtcagtgataacggcgacggcggaagcgaacaaggcgacaccctttctgtgccccgttttgtcgtctttggaagcgacgccgccgtagagagagaaactagagagagagtgtagtgtgtgagttggtccaggccagcacgcaacaaagcaatcaaatactactacgcgatatgagagagagggatgcgtcgtcgccattagcggggagaggagcgggagaaaactcctccggattattccgagctccatatccattgaaccgaaccaactcttaatgagaaaaagaaagagagatccgagctggtggttcttctcggttctttgattgggggcggcgttgaattggattgaattgatccatcgattgtttcttg

SEQ ID NO: 70406 - DNA, 1137 bp, Oryza sativa
tgacaaattcataaaatttaaattcaaaaatcattttggccagtttattccagtaccagtcactggcttcagaccggttaccaccggtgcttggaaccttgttaatataaaatggtaggattgtgatatcgacgagcaagcccaaccaattggataaagttatgcaaaatgaactgcagttctctaaaactgctgctttaaggctgtgtagctttactggtagtatatgattgtgaggtttactcatttgttttggtgatttataagtactgtttgtattagcaattatacgtttctataaaaccagcataatttagtgttaacaacagagaaattcgaagtaaaatacagattatgaaaagtaatgcgtctgagagacttaacatagtaaatttgtgtgtttgtaaacagatacaaagaaaacatacaaccatgccaagaggtatataccttgagcactttattttttctcccacgatcccggtttgtaatgatctttataatcttagtaggatttgccatattactcatttgtgaagcagcaggagataccattgggccaactggtgtaagtgcttctaatgaaacatctggtgcttggttcatcaatttaggcttcttggcagcatgctgaccatttatcactgttgacaagtcacaagtgtgaaaaattattcccatgtcctcttaaatagagcaagaactatttattatagatataaattatgcaatctgaagtagagaaagaaaataccaatatttccatttgaatcgaattgatggacctctgatctcttcttcaaataatccttctggtatagaaaggagaaaacatttatcagatattaatgaaacgacaagcttttgctttccaaaagcatgtggtggttggaattttttgagtgggagaaggtttgtacacctcctgttcttttttacttggtatttacgaccaaataacgaccaatgcacatgtttggtaactaatatttttaatcatatattcatcaaaaacattgtcatatataggtatggaagtatttcatgacggttctgcattttcacatataaataggtctgcatacattagaaggttaagatttcgagggcttagctgcacatattttaaaacatagt

SEQ ID NO: 70407 - DNA, 19974 bp, Oryza sativa
cttgtggcctttctaccctgtcatagtgtacaagatcatcagaacataggctaaaaaaacacatatgacagctaaatttacttcaccgcaaacttaactgggaaagagtcaaacaagagtagctttaaatacatcatagaagcatcttagcccataactaaaaaggtggatactatataggagcatcttagcccataactattaagacggatactatatagaagcatcttagctcataattgttgcgatggatactatactctacaggtacctttttacaccataaattgattcaaatgcctctgcagcatttagttcttcttcattcttttcaacaacatgcaataggtcacttctcacacgcattaattgctgtacggtatcaaactggatcttcaaatatttcctcttcaaaccagaaaggtggtttttctgaaacacaaagagagagttataattaccttccagaattggcccaatcaaatctagataataaaaaatggcatatgaataagaacattggcacattggtgaaaccagtctattcaaagctttcagggaccacccaacccatgaatcttactctaccataacaagtgttagtctctctactatataaaagaagctagtggtggcggtcgctatgcattcctccaccacctttgagctggttggatctcccgaggataataagtatatcatttgtgtatgtcgtttgtaagcctgtgcttgtaataatgttattatggattgatattgtttgttacaaattagataagttttcttctaggatttaaataaaaatttgaagataaacatataatatgtttatttgagattcaatgaaatgcatgggtatttgacaagttagagtgttacttctagtcaaagtcaaaagctccatatggatccatactagagtccagctgtaatcctaagtactatttgttggaaaattaatttgttttcttgagaagaagtcaaatttaatttgactaaggtaaaatgcatgtagactaagtgaattgcttcaagatttcactagaactaactagaacatgcaagtactagaggattggtgatcagctatctgtataaaacctatgtcagcatgcatggagtaatcaaaatggaaatttactagctagcggtgtataggttggagctatgttgtgtttcaaagagaaagaaggaacttcactactaattagttccaatattatgtagcatagctagttttgagctgttagatgagttgtaacatgagctgtaatattgtgtaactgtagcaggtcggttactgtagaaaccaagttaaaagtcctatagaaagacatatatccctatgtaacaaaggtcttgggcatgccagtgagatcagtgaaaatgtagctcctttgctatactcttttctcttgctctctgttcatgctatgagtgaatgtctatcctagttttagagccaacactattaatagagtggggttccaagtacaacactaaattattttcccaaattcctacatggtatcaaaggtgggtcccaaccctaactcaccataaagtttcagcccctttcactaaaaatgaagtttcaaccccacaagtcatcattgtcaactttctgccaaactcttaaccatcgttgtccatgacatacttctcaaccaggttactggtggctcccagcatgaattgcttgtcactgacattgatgtggttaggtcatacccaaccaccacaatgtaatgtgggagcaggtcaccacagctgtaacatgctagaccaagtcaccaagcacagcaagcaggagatcaagtcagctgctactgcttgatttttggcctaatctgtcggccctggtttttaaaaagatcaagattttacgtattattattatcaggattttcaggatgttacaaaatcctccatagagacatgtgctctgtggcggagactggggatggttgatgctgttggtttgaactgttcacaggaaagctgtgcagcctcatcagttattgctttacccaagagggagaaagaggaatagacaggaagggaaggatctgtgctccatgatgttctgatagtgctacttgttagatcaggtgaagtcaattgaggacatgtaatgtgctttgctgttcccagtgtatggtattatctgcgttgctatttggtgcttgatcatattggtttgtgatactatggccagtactatcatgggaatgaatgattgatgcttagcagatcgtcaagattgtgggagacatgcagaaaaatatgttcatggtggtgaacttggcattggaggtgaagccctactggtggaagaatcgcatggccaagtaccagaggttatggtcatatgatggaagttataaatataatggtgatggtagagatgcagagcaggtgtaggtgcttaaacaggagtagaaaaccacttaggggaattgttgatgttaagttagagcctaatacgagtctgagtgcataatcttatgtgaatatgcattattgtccaattgtaatcctaagcactgtacatgaagtgtgtgggatcttaagggtgcaatggtgcatacatgatcattcttctacaacaaacagctaaggtaaaaggacaaaagaaatcacaggtgaagaactcttaacaagatcaaaactcttaaccatccaaatttatcacaacaatagcatttactgatgcaaagaaaatgtagtgaattaaacattcaaagcaaggcacatactagatcaagatcttctttctcaataatttctatgtcagcaatgtcgccttcataacgtcgcctgagatatgcctcgacttctaactccatcttatcctgcgacattttaaaattccaaaatatgatatctgaaaagaaacatcaagcaacggagaaactaaaagtcatcttatgattcaaacacaagctcaagctcaccttagtcgcagcataaaagtaagggggaaatttgtatttcactttaaatgtagaaccgtcctgcaagaaagcatacacgattagacgtgacaaatcaaaagttttttttttgccataactgcaatttacctgggacacgaagtataggtcaacacagctgtatatcttcccagtgtcctcatcctcccatgatgactgcaggtatttgaggtgaatcaagaaagtcacaaaaaggtagttgattacattttgcaaaacagtgagagattaacttaataatcttgtccaatttctacggatctgtccataacgtggatggaccaccaagcttaataggtgtatccattcagtgcgggcgttcattggttccaccagatatggcaacagcagcacagtttttatcatattgtcaagagattgtattggagaatcgtttaagaaacaacttctccatgatgtagctactttattttttttaccaaaaaaagaaacattataactgtgtcacaaattatcccacgagcatctagaagcgtcaaaggattgactgttgctattagttgcagtctgtgacagcatttgacaaacatcccccaccacacccacctggcaaatcaacgtgctagaccaacgttagcagcaactcaccaccggcattgctcagtgatttcacctactgcttactgaactaaaacaaaaggaggctcccgaatttcctggtctgcatactccgactgatcgacccatttctccagtcatattccacttcaaagtcagaagcaggtcccaacatttacaaagttatgccgctagtttccagatgacactcactcccaattcaagctagaaataatcccagagagagggcttaccggggagaaggtcaggagccatccgagccggcgctcgctgtcggtgtagggcgcaaagccaagcctgctctccaggagctcctccgctccgagccgcagccgctggtccttcgccgccgacgacccagaccttcaaccgccttccctttccccttccccttcttctccttcggccgacgggcttcggcggcgaccatcgccgccaccgccgccgcccatgctccccagcgcgcgcgcgcggtacgcggggcgcggggagaggaggagaatcgcctgcgccgctcggctctgcagcctccgctcgtgctgttgtgtgtgggggggaacggggagaaggaaggaaccctagatcagatttgggttttgggtggggcggcgaaatgaaatgggcgccaagtccggggcggcgaggcgggggttttcccgcgcgctgccaccgtctcatcattttgcatcccggtcccttggtttcgttgttttcaacttgggagcccagcccacggcccttggcaagactaggcccactttatgctttctagctggaggcccaatctactcaaggccttgtacatgatgggtcagatttttaagccttctcggggtcaataaatccataaggaaaaaagtatatttgactccctcgaccatgggccgagtatgattggagccctccaaccgagtatttcacatccctcaattatttaaaccggtacaaaacaactaccataataatattgtggggtggtttctggtcaacaagttgagtcagcacgggtttcaacaaccctggtcaacacggatgcgctcccccctcactctctcaatcgtgcatgcttccaaaccgactaaaaccctagacaagttggggcaaccagaaaggcgatgcagggggcggcaaggttgggctccgctctagggcttcgcagctgtcgttttggttggccggaactgaatatgtgcaggtacacctcatccctcccccattcattcccttcccattttgtcccctgcagcatgtggttttatcgatttgggtgtgatttctaccgagcttaaatttactaaaaaaaggagttgaaatgcattttatatgaatttctaaagttcagcttatctaaaactaatcattttgtagatagtatttttaggggcatttgatgtgaagtacgtatactattttattttactttatagaagaacataagttggtggatctatagaaactgagtttgttccaaaatgacttaaattgaattctctatgcattttataagtttgtgcaagccttatgtgtgatttagtttagatgagttttagaggcaaaatttgtactgtgagtgccaagtttttattccataacattaaagttcataatttgatgagttcacagaaatttgatttactctaaaatgtgttgttttcaatttgttatggtttttagaagtttacatgtttttctgttgaaaatataaaagctttaggtacttcatttagattttttccaaattttaaataggttgggtccacaggtcagtgagaccaatatgcaaaaaggttcctaggtttgaaccaagccacagttctaggcccatactccctccatactcgtaaaggaagtcgtttaggacaatgtttaagtcaaaccttaaaaatataaatcataaataactatcgagttgttgagtttgaaaatgtaaaaattatatgaatagatttgtcttgaaaaatacttttataaaaatatacatatatcactttttaataaatatttttatagaaataagaagtcaaagttgtattttgaaaaccgtgtcgcggtcctaaacgacttttatacggatcgagtatgtcattgagtggaaaggttagacattgagttgtttaaattctcaaaacaaagtcgtgtttccttctcccaccgtccgccgcctttcgtcccgatcctgttcggattctcctcgcttttatttatgtgttcggtttcgtggtttctccttctcctcgctcgcacagcttctccatggactcgcccgccggtacagatgatccacccccgttcgcagcctccggtcattactcattacggccacgcgatcgtcgtgctccaccctcaacaaacccacgcaagcgtccgcgcatatcgatccagaatgacgttattggcgatataggtgaggcgcgggggtatgcgcggccgatggggctggcggccgtgttggatcttgctctttccccttccccttcatcggtgaatgcttttttttttccttggtaatactaggctgagtttgtttccttgttgactcctgtttcgacagatgctagatcggggaacggcggggcaatcttgctgctgtttgagacgccatcgggctttgcaattttctcttttgatgggatccgcctcatcgcaccaactgccatggaggcatgtgctcgttatccttccctttgttatatagactgatgtgctgcattttggtcatggatctgattttaaatttgatttctctctgcaggatatctggcaaaactttgccatggaatatagggcaaaatttgtaagtcctttcgtttccttctgattatatattttttctatgggttgctcgtccgtgactcgacttatttattttgcattgaatggatggattttaccataacatcattgttcatcagttatttccttgcctttttaaactctgaaaagtgcataagtttagaacaacaacaacaaatgagaagaaaaagaaaaacaaagaaagattaacggcatgtagtcactaaatccatctgaccagccctggggcaaatgagattctatcttcctcacttctctgcatcttcaaactcgtctctacctttatctgatgttccaatgtttgggttgatttattctcaccttgcctgaactatccttagccaggccacaatgccttccagcttgaagtagagcacagaaattgagctcagcaacagagggaatgaaggcactgtgcttccctccagacagctcctagagcatagccgatttcaaataggtcctgtagtagtagcccagacagttgcatagcttgccttcagcagtggctgcaagggaccattgtagagcatgacagttgtgtagtttcttccaacgatagataatctagtctgacctttgattgaaaatatcatgagaaaaggatcattaccattggatttgactccaatcctgcgattctagtcgaacttgttaaagaaaccaaccaatttcacctgcttccctggtagattctcagactaggatcaacactatgccaatccataagccatgtagccaacaaattaggaacttggtttagcttgcttaggaatagcagccgcatgattgatcttgatggacctttaccatcaacatatcatcggtcttaccgattctcttccaggttgtgggataggttgcaccctgaccagcatttcctgctcttcatctggagcatatgttcgtgcctccacttgaaactgcaaggtggtggggatagtgatcaaccaagtgtattccgaccctgcctagcctcctagaagcccagttaaggttcaaatcttgtgatgttctacgccaccattggagggccaaatcagatttggtggcattcaaatattgccattctggattgatattaagttaaaagttggagtaccgcatgatttatatttttctaactgacgaaatcaatagaatgtttgtaaagcatgttcctaaaagcatggtaacaaaaaggtttcttaaaagtcgattggagcaaggtgaaacctataggggcatttggtacgcaccactttgaaaccaaagagcaccacatttttgaaacatgtcacattagcccatggtcttaattctgaattgaaccgcaacaatttgatagatgaacacttaaagctcccaattgtatcagattgagatgcattacattgcatcaaacatatattgctaactgataattgttttttcccgccattaacatgctcatccctgtttgtttctttatcaggtagtttggcgtcttgcttttcaagtttttacagacaagtctctggcaattaactgtgatactggtgtggacgatcagcttaatctcatgataacaaagtaccaccgcaaaggggggaaaatagctgttgggaaacccgaatataaaacaatcatagaagcaaacctggttagtgcaagctccctactttgttgcatcatttgttctgagctgcattttttatttgttgcatcatttgttctgagctgcattttttatttacattattttcagggtatttcctgtctgtatgatgaatttgtgatggaggtgatgtggggtttgacgaatcttatgcatagtttagtccctgaagaaaactctcagctgagtaaggaggaccgtctccagatgagtcaaggattaaaaatgctcctgaatcgttatggatttgatgtcaaaccagggatggtgagcttactactagttacactcttatagtttgttcattgtgcatttgaaaccttcatttaccgttggtgttaatttttatataaaagttttcatttgagtttttccctattactgacgaaatgataccctttgtttccaggttaacaaacgtattcttgaggcagcatctgacttgtatgattgtgatgattgtgagaagaaaaataattggtccttgcgtcgtgctggtcggaaccttatggatatctctagcattaacagtgaggattggggcctgttgaaactttctacagctctgatgatagtatgttaccctgaagaaaagatcatagcatgcttgctgaaacattctacagatttgctgatagcatcttaccctagaagggaagttatagaatacagtcaaaaggtaaatcgtaattatttttttgttgtgttccagcacatctgatggtaacttttcattcaactaatgggccaaagcattttaatttcagatgttttcaccagatgtgctatctaagctggtaactgatgcaccaaaatatggcatttggataaaaaagcgcacttccaagagaatccatgaagaaatggtatttttgtatcaacaaaggattgaaaagcgaaagctcttggccaccttgataggggaggctacaaaggtttatgaagctgaacaagcggaattgctgacaaactagaagtgaccacaggtattctgaagctgctatctatgcccaagatgacttccagtgatttccagaccaccacttcttttgtgttttgtttatctcaagttaaatttgggaattactgatatgatcagtgtactgtttggtttctactttagacaagttagactgtgcttctccaagctgctatttgttttggttttggtagtattggtttctactttagacaagtcagactgtgtttctccaagctgctatttgttttggttttggtagtactagctgaagcgcacaatgccgcgctgcccggatcaattgaagtccagtatatatatactatttaccaatggcattcgtcttcattcatgttttggtctatatcccataaactatcattataaaaaaaaattggcacataaaaaacatatagtatatagtctaaaggaccaaactaaaagtatagaaagtttgaataaaaagtaaaggaggtaaattacgtgtcaatgacaatgagagtttacagaggtattgtaggatcgtaaatggcatttcccaccccaaaaactagctattgatttgtccttccacaatcaatgtgggactattcaacaatcttctccttcacacattggtaagggcctttctcaccccttcacacattggtaagggcctttcccaccccaaaagctagctattgatttgcccttccacaaccaatgtggaactattcgacaatctccccctccttccacaaccaatgtggaactattcgacaatctcccccttcacacattggtgtccctcagcccttcaccgtatacgggcccccacacccacggtccattaggtatacgggctccgcaggcacctacgatccatcaggccttcacacattgtgtccattgggccagagatgttaacctagccaggctctgataccaattgtaggatcgtaaatggcctttcccaccccaaaagctagccattgaggtgaggggctcccccacttatatcttaggtcctttgcccttccataaccaatgtgggactattcaacaatcttttgggtgctacccttttttctttgtatgcttgggtgatgtttggttggtgggatggaatgggttgggacagggcgaacccgtttttccgttagatgggatgagatgatcctgttagatgaaacttccccttatatccgggtcgaggctgtccgacaaattcgagcggacgaacttgtcccacatgggatgggcgcacagcgtgagccccgttgctacattggatccgacgcaggggatctccggatccgtcgtgcgggctctggtcgactcgctccgccctcacggtcgtcgagcaactcgaagtaggagagcatcgtgttgaggagcttgtgcctgactgcgatggtggccgctatcggggccgaggccgacaacaccctcctcggcgcagcggacaagacacaagcgcggaggtggggcctgacggcgacgcggccgcgggaggcgaaggagagggagagggagccagggggagggggaggacaagaggaggctgtcacacccggagttttccccttttccgtagtttctaaatcattaataaatcgtctatagaaattactttggttaaccaggaggaaatccaaattaacaatgcattaaacaatcggaattgttggggagaaattttttcgaattctctttgctctaaaatcattaacaggacttaaagcggaatattcagagcaccggaggcaatgtggttaatttaatttgtcaaattttgagttaataataattcttcttttcgcctttggtcatgaatcttgcccgattcactcccctctctgtccgcggttttgttttgcatggcgaaccgtatttgttttcattcgcgggggcgtttctgttcttttcctaaaacagcaccgcatttgtttttctttttgggaaagtccttatcctaatccctttctttttttccccctctctccccccgcgtgcccctccccctagccggccgaaccgcctctctccccttctcccaatccgagtcccagtaggtcccacctaatccatctatttttgccccctataaaagtattcataccccctctattttccttgttttcccacatagttgcaaaacccaaaccctagccatcggccgtccctcccctgtcgtcgtcgctagtcgacgctgtcccgccgccactcgtcagtgcccccgccatcgccgccgttgcatcgccggtactctgttctcccttcccatggatgttttagttgttgcaaacatcaattcatctatctaatcttttccgttcaatcctatctagcgtcgtcgtcgtcgatcctgagctcgccgccagaaccgccgccgccatcatctcctctccggtgaggcttctgtcttgtttttagggctagttgttccttcacttttgttggcttgcgccgccgtgtcgttgccgtgccgctaccctagccctagccgccgcaggtagccaccgttgacgctgcctcgttccgcctagccgccgctgccactgccgtgccgccgcccagctgccactgccgtgtcgctgcctagccgtcactgctgtgccaccgttgccgccaccgtgccgcaccgctgccaagccgagccgagccgccctacccgtgtgccgacgtcttgccgtgccgctaagccgctagccgctgttcgttcgtagtttgaccgaagctttagttcattcggtcgttcaagtcattctttagtttagaaccgtcctgagccaccggtttggttgaccgtttggatggtcccgtgacacgatgagttggtatctcgtgaggcttgcttatcgatgttaatttcccctttgatctattttatctttgggcaataatatgtaataaatgactaaggtttttcggttactagtaataacacagttcatcttgtaaattcatatctaaatattctgagctccgttttaacccgttcaaattgcagtgaattcgttaaaatgtatagaatccattaaaattggtttcttttgatattttagtagccttattatgtgtattgcttgtgtgctttgtgtgtcatttagattccggctgttccgatgctccagtttattttgaagtggtcgccgaggttccgtcagttcaagagcaaggcaagtcatacatacatcattgatcatattgagcctattttacaaaatcccctcctttctattaaattgcattgggtttagaatgtttctattattctcagcctgttgattatatcatgccattgacagcttgggttataattgactagatgattggtttaggaatgcttagccatgcttagaccaattagctcacaatgggattcattataatttagtccttaattatgttatgatgtaccaccatggttctggtttaattaaactaaaatatgctttaatggtgggttgtgggtacaatgcatgattgattttggaagtcgtgcacatgacaattaaggaccggttctcgggaatccctgaaagatatactcgtattgaccacaggccagatgggctccaggctaaatctaaagtataatattttctagttaacataccatggcaagggtgggcgtgatggagtatggatggaccgggaagcggtctatgctgctttcggatttacctaggcacgagaggggactgcccactgcctgtttaggggtggggtgaaacctgaggtgagtatgttggttaggggaggttatatggagggttttgtcacgatttccccctttgcagtatcacggtgatacttcggggcatgtaacatgtgtagaatcgtgtcttgtgggtaaagctgtacatatctgatcagagtaaaactatttgaatagccgtgcccgcggttattgggcggtcaaccagctcaccgtgattagtctcatcttaataatttgacttaatgaactggtgtagttcatgtggttttgattgggcctattgcaacgtggttttagcgttgaacagtgttcatgttaatactacctaattatatactgtttttactgctttcaaattatgatttataaatgctacttttactacaaattatcctatgagccattcatttgaatatccttgcatcatgcctccccgttgatatgacttgttgagtacgggggttgtactcgatcttactttatttctccctcaccacagaagtagagattggtttagatggtaagttctctaaggattgagcttgttccagacgtcaaggttttgcctgtggattatggagaaaacttcgcttttgccgagaagattaagtctagttcttttgtttttccgctgcgtttgtgagtttattttatatagtcgtggaattgtatcaaattgtcgtttgtgtactttggctggtcctggatagaagtttaatacacattcagcttgaaattcgagttgtagaatttctggatgtgacagaggctcttcccggcagccgcgatggcggagagggaggtgaggacagaggcggcggtggccatggttgctcctcctgctcacttactcacgccgctcctccaccttctcgtcgccggtttgcttgctcgcccgccgggctgtagtcgcgctgcttcgccttgtcaactatcgtcagtagttgcaaacggcgtccatcccatccctccctcatcccttcaaccaaacaaaaaactaggatcgtcctatcctacaatccaatcacgcgagtggaatcatcccaaccataaaattagggatggtttcatcacatcccatctagtcccagaaccaaacacacggtagaatcgcactgaaaaatgctaaaaacagaagacctacatgccaactggtggttcatattaaatgcatgcacaactaaaataaacaggtagaaactgatcttttcaagtgcaacatgcagatgccctacctccatcgtactacctccatccagattgaagttttgtactgtttatatctaacgtttaaccattagtcttatttgaaacattttatgattaaggcctaaggggcggcggcgaggtggcgctctccaggtgcgacgtgcaatggcggcgctggggaaaacggccagcttggcggtgccctgtttggagatgtgagagggaaaagtgatgtttctctaagctctaaaaggtggtggtttggttgatggaagagaggtgcctgacatgtggggccctgcttgccacgtcaatagaaaccgcttttaaaaccaccgaaggagtcaatttacactggtttttaaaaatgggggaggcgttatatctgattctgtgattgagggagaatttaatcacaagcaatagttaagggaggcaaaatggacttattcctacaataagtaatgtataagtggcattttaaaattgttatatcatatttgtatttaggtgaaggagatatgtggagagagaagaaaagcaaattatagatctgtagttaggtacaacatgacatccaagagatcgacactatgtgtgtgtgagaattgagatatgccaggtagtaattgaccatactttttaattcgctataatcatcatctttgcctgcccatgttttggcgaatttggcttctcatacccattaattcctacttaataccacaaagggggcggggattctggagtatcttgttatatttttcagaccatcatatagaagacacgcaccatgctttgtgacatttcttataataatagtcaagttgttgaagtagaataacgccgccacacattaagcatgtgatgtgcaacccacggtagcacccggaaacacgccgccatagggagtgggtagatgccgcctaacgaacacccgggagggaccccatcaaggtgaacgagcgtcggtttattctagactcggcaggctagctaggtgttgacgaccaaatttggtaagatgtgaaccaggttcgacattgggatcgaagcggattcgataaagagatcgattcgaagaacagagcgtgaatcggctgcgaaggcatcggctggagtctacatcggctgagatggatcggacagaggatagccgatacagccgatggaggtgatgcagctgattccgatgaagacggtttcgaagctgtttccagaatcgttcaaagtgcttcatgaggattgccatgatggagataaagctctcggataaggcaattgtatctattagttaggatatttcatgtaatttccttagagatatgtttggacaaaagtctgccgcaaaggcttatggtatcttagagtttgttagagataagtgtcgtgtccggcaaggacatattttgtatctcgggtataaatatgacccgaacccatgtaatcaattaacaatcgttcaatacaatctcggcgcatcgccaccctttttactttcgtttatttcgatgagttcttgctttcgggttgagctgcatcgattcgatcttcaactagaggtaaaacttgttatggcggcttgcgttatcggggttaatgcttccatctttatgatactttaaccctgttcatgtaatccgtcgagttatcatatacatgctgcaatctatactagttgtgctatataacttgttatcggctagttcttattgttaggaaacaattggtagagttatgttttgttattaatctagattgtatcgtgtatccaccatctcttgcagattttgatcatcttgcttagatctcatatttgtctttatgcttaatgctgcatcggttgagttcgatctattaagtagtttttataattatgatatctggcttgttttataatcatcaagagagatagtattgaggtttcagccgattttacctgatttagctttatgtcttatatgcttaattgatatgctaaatctgccctttatattaagatcttgttacaataaagtatattaggcttctgtgtggtatattctatctgttttaatatcttaatatagagtggtatcggagtatttgccaatacatgctaaatctatctgatcggctatgctataagcgtttataatctttatgttaatatatatttcgacctaaatgatttatactgtctcggcatggcgaccaatctatcccaatcacttgatctaaatatacatcgacatactgattatatagcgttaatatctacagccgatcgaatagatttagtcttatcttgcttattcatagctgccgatcgattcacatcgtcttgaagataaatgatatgccatcggcgactagccgatcggctatcgtttatggatttaaccgcggttttttttgtctttgtttcttgttgtttgcaggttcaaatcaactggcacgctcataaacctaaaggcaagattttggatctgtactgaagttaagtagatcttcctagccagtgtgtgtttttcgcttcaacactagggcgtcctctaacaccgtagagatgagagacgacgagcaattggtggatttgagaacgataaacttgggataggtagcaagaatgagtgagatgtagaatatataagaaggtttggatactaaattgattttgacgattgattggttgttgtttcaatcggacttagaccccttatatttataggagggtggacttacttctgagggtttttttcatatccaattaggtgtggaaaccagttaggactctaaaaatctcaggcctaagcaagaaaaatcgagcaccacaaatcagacttggagtcagactatgtcagtttgactggccaaatgtcgttggtggctagtcagaccggtctcgcgtggcaactggcaagtctgggttatttccaaattggactgtagttttctttttcatttgagcattttcacgaatataatcatctccaatttgtgaagcatatatactgcaggaacacatgtcaacagcttggtggcgacaatacttgcccaaactttgtacccaactagttgaaatccttaaccaatttttaccgtagaaattaacaaagctggacgcctaggagattacaggagcaagaagagctcgtccaattccagtgtccatctcaaaaaggaaaactccaatttgtgctactagctaagtgcaattgatggtctgattttaacttagttgatcacaaacagttctggagggtgctccactgcttcccccttcttttttccaaaaccaaaaacaatatcagaagtttgaaattacccagcactaacacggtgcagtactggggtttacatatgatacactctgcactagctaattcattttcgcttctgccgttttgacgacgagctgatgatagagtgggtgacagtgcttgctaggctagctaagcactagcagtggacctgcgagcttacgagggggaagtcgaagggcgtcatccaggcgtaggtgaagcgcacgggcggcgcgccgcggcggatgactcggccaccgcggagcacgcagcgctcgtcatcgacggggcggatggcgcgcgggtccaccgactcgacgctgctgagcccgtagcatcgcagcaccaccctcgactgcgcgcaccggcaccggttcgccacctccaccgcgtactccggcttcccctccaccacccgccccgtcgccctctgcctcaccaccaaatccgccgccctgcacgccgccgccgccgccgccccttcgcctgcacgcccacaattcgtttatattagcactgcaatgacaatgcagcaactatcaagtgccaagtaatgctagtactataattagcaatttcaatcaccttggctggcgtcgcagaggagggcgagggagacgaagacgaaggccgccgccgccgccgctctcgccatggtcagccgaactgctgtgagtgtgaggtgatacggttttgatttctcgcgagaaggcctcagcttatttgtacccactacccggatgcagagacatggatggatcgatcgatcgattacgcttgttggataagggaggcagggcacggcaggacagcgagaggaaggaatgggttgtcgtgcgtggcgcatgcatgtcatgtggcagggccagacgacgacgacggtgaacggtcagatgtccagcgcgatcacgcatgtgatcgatcgtctgcatgattgacgatcgcgcgcgtcgcagtctcgcaagagggctggctcggtttcgcctgtagcaaacggctcataggttactgccgtagtagtactagtatatactcactggcactcttgcaggtgtcagctagcaacgggcggcgcggtttattatgctactactagtaagtgtaaagctcaaacttggtagctataaacttgaattgagacgatacatgtaaacgataattttgcaacctagctacagtagataggaaaacatggtgtacgattggcttgattgccaatgcatgaacacagaatcacgataatttttcttcctctcttttgatctttctgttaatttttttttctttttgagatggagtgccctggccatcgtgaaccatgaatccatgatcgctgtcgggaactcgggatgatcggcgccaagtgatgatagatttgctctgttttttcttttgcgacgagtttgagttcacgcggcgtgcatgtgggaaccaggacgcatgtgcctgagtgcctcccaggggcgaagccaggataggttgtcaccggggtcactattaattaacgatcctaacaattggctatagcttctaataattttaaggttattgttgtagtagtggttaccttttacatatcagggggtgtttagattaggggtgtaaagttttggcatgtcacatcggatattatatagggtatcacatggggtgatcgggcactaatataaaaaattaattacataatccgtcagtaaacaacgagacgaatttattaagcctaattaatctgtcattagaaagtgtctaccgtagcacaacattatcaaatcatggagcaattaggcttaaaagattcgtctcacaaattagtcgcaatatgtgcaattagttaatttttagcctatatttaatacttcatgcaggtgttaaacgttcgatgtgatatggtgtaaattttttgtgtaggaactaaacagggactcaattacaaccacatcgttattgtactagattactatatttgggaaaagaatataacaacctcttatatggtgaaaatcacctttgttatattcccccggctcatgcctcatgatcatgtaactgaacttgaaaaatcaaacgtttatatttcaaaactctaatttcctcaaattcagacttaagagactaggttcaaccaaattgtgatgataatcaagaaataataataggattagttggctactggagcaattaatcctaaataagggtcactttatgagcgccagtctaaaacgtatatatatatctatgtagactgacatataatcacaattgctaactaattttctatttgctagctgataatagtatcgtttcttgccaccagttgagctttaacgaaacaatcatcggggtctagtgttttctttgaccggtcatagctgtaaaatagaaaggagtataagggactcggaagaaatcatcggggtcaactgaccccaataacttgctatagcttcgcccctggtgcctcctttctcgtctacaggcctggtttttctaggaccttttttcgccatcaacatgtgcgtttttcttgtcactgtccccttcttttgtttttttttttggcagcacggctccagattatgtgcacagggtgcttattcacacatctcactggatgggttgcccatttgcccgtcatcaggaaatttccagatcggttacattgtatcgtttcctaacaaaggttgcatatttgttgcgacgtttggaaagtcaaacaatttgaagcaaatcgactcagatcctgtttcatt

SEQ ID NO: 70408 - DNA, 546 bp, Oryza sativa
ggagaaggcgcgcgggccgcgggagaggaaagaagacttgggccgaaaaggggcccaaagagaggaagggggaaattttatttgttttctttttattttaattggttaaatgatcttcgtgactttaaaactatttctcgagctccgaaaattcacggaaaattccggagagtacattagggcacaaagaatattacaaaatattcccggccaatgatttttaagggaaaattttaattctcccattatttcacttgattaaattgcttaactttttattcaatttctaggaaatgcattattaaatgatttttaatcccgaacgaaaatcggggcgttacagtttcgttgcagccttagaagcgaagcccactctaattgatcaagttagagaagcccaaattaatgatcctgatattcaagagatcaagaagaatatgagaagaggaaaagctattggtttcttggaggatgagcaaggaactgtatggttgggtgaaagaatttgtgtccctgacaacaaagatttgaaaaaaaccattctga

SEQ ID NO: 70409 - DNA, 626 bp, Oryza sativa
cctggtttatattttagcttacttattttattttaaattatctattcaccctcatcaatgtctaagtgaccctttcaaaggtagatcgacgtctacccatagccattataccttgacacctttgatatcttggtatcatggtaccgatatcatttctggtatcgacagtatcatgtgcggtataaatagttatcaaccagaaatagctgctaagagcaggtataatagcagactataagccagctataaacatattttaagaagataaaaaaggagagaaaagacagcgggctacagatttgtagtcagctgcagtacagactctaagacgcatgtgtatataataggtgggaccagatattgattgtgtagtaataggtgggaccagatattgattgtgtagtatatgtttatatgtaactattgtagaattggctattaagttatagatgatttatggccagcagttagctctactattaaacttgctctaacatcggtatgacacgagcatcgtaaaagctcacatcaccctaacaacatcccgtcttcctagtctccctctttcagcaaatttatttattaattgtgaatttaataaatctttggataatactcccaacttt

SEQ ID NO: 70410 - DNA, 6921 bp, Oryza sativa
ccgactccgaacatcaggccacttagctggaagtcccttctcatcccaaccggtctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttattctcgatgtgcctaataattgattttggtttaaagccaatgttaccaacaacactgctgtacatctcacttgccacaaaagcttaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccacttcctcattatccgaatcttccttctccatttcatcaacaattataccgactctctccccctcatccgccatgcccatggcctgctcctcccttggttgattttcctcattttgcatcgatggtccaacaacatcccttgcattgataggaccctctacatcttcggtttgcattgagacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaactaactataaattgactgaaatgttttctccgcaggcctatcgatacccttagatgtcattacaaaatctgacagatcaacaccatctggaccaaatctaatatttccttcaccatgaactatctgaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaatttatactattatattctatgctctggatctacacatatgtgctgtgtgctacagatatgctaaaatatatggaactaaaactaaaacgcaatatatatactcaaacataacatattagtacaaatgcaaaagatgtatgggagcaaacctgtgatgaagtgagcgaaccagcagggcttcgccgctccccttctgctgccctctcctctctctctttcgttttttttggatttttagtgaatataatgaaatttcagagaggggggactgggctttataggggggaggcaaaaatcgccctcccccagggcggcaagggggccgcctgcaaattcccatgccccctcgccgcccatttgcaggcggccccccgcacagtacaaaatcgccctagcggagggcggcaagggggccgcctgcaaatttcgttaacggccgtcgcccgagagcgaacggccatccgccacgtcattttcgccgccctctgggatggcgatttttaaaaatcgccctcccagagggcggtaggcgactacttccgtcaattttcaaaatggaaaattatttttgtataacttttaataaaaaaattaaaaataaaaaaattcggtaaaagagcagtagtgaatggaccatatttctatctggcccacaacttcatgttggaccatatggtaggtggagatacaagttaaaggcccattccgtgtcatttatctattggctgttgggttataactgcaggataaatgtatatcatgatatatcatgacgtcaccagacctgaaggacttcttttcgtcgctactcccccagtaaaaaaaatcaatctaaaaggggacaaatctaaatttgttgtcttacaagaggttaggttgagttttttttttgaacggagggagtggttattttggcagatttgttcagtactcgtattttcttttaagagagaaggcattattcgtgtttgatgggtttatcaatgcggcaccaaatggattgacacatacgctcaggcaggcaggcacataacaactgacgtgcacggttgtactactaccatataaatgaaccatgctcttccaagtaccaaataacccgtacagccgtagtattaataattcgtgtaccgcgctgggaccagtgtatggaccatggtggaaagaacttggcctcaacggctcatcgcctactcgttggtttatcgccggtcagggttataatttatttttttattatagttttatttactatattgactaattagatttcttgtggtgaaaccagtccgtcgggttatcctaaacttagtccgtcgggttatcctaaacttagtttgagtgctcgttttttttactggaaatactgccagggctttagcccagcagtgtgattttcatttattaataaaacatttacaaaatgttacaagaaagaggagaaaaccatataaagtttataaccaattaacaacagattatttaagggggtccttcattctgcagagatgcagaagaattttatttataaagagagacttccaagactgaaaggttggctgcatattcctgaaaatgaggccattatgttgcttccggatgagccaagaagaagatctccagaaaaccaggctgattgaagtgctgagtgctcgtatttatgactaattatctttaaataataggtgacatacccgtcgacaacgagacaccaatgatatctttgttaatctcaaaatatgccagcgcagtctttcaaaggtgatcatagggttaggtgtgcgtgtatgcccctcattggggtgagtgcgcgcgttgtgaacgtctgcatttgtcctgtgttttaaaagaacaattataggacaaaaacatgagggataagtcaattttacacctcttaagtattacgtttgtttaaaatacacccctaaatattaaaaccaggtagttgacacctttcaactatcaaacgattattttacatccctaaaccaaactagagtggtttttatccactgaaactgtatgcagttgaaccaaggaagaaaagagtgggactcacctattagtgaccccttcttccaccctttccctgtctttttcttgtttctcctgatctctcctctctctttctgctaacgcactcaccagccgtcgctagtgggctcctccctgtgggctgccactagcctcctcctcgacagacgtcattgccgagctccttcttgtggctaaggcaagcttgagcgtctcctccagtaaactagcacatgcgactgcaagctcaaacttgagttgtgactcctcaacccctatgccgcagtgacggatgaagaaccccttaccgagcgccccccctgccgatgtcctcctactgtcattgctcccatccctttgcagggagcttgggtaggagacagtcagcgagttcgacgaggagaggacagtggagcttgagtaggaggtaacaacataagcattgtgaagcagagaatcgaagcattgcaccttggcctcatcgacatcaaggaggtgacactcccaaatctcaactagacgccacaatattcagatgctgtggagggtagagcttgggtaggaggtcgccaccggagctctgctctgctccgagcttggccaaggagggcaggctcatcgttaccccaccttttctcgacctcggtcaaaagagggcgggcttccgtcgacctcgttgtcggccacctcttccctcgagccatgccaaaggggcaggttgcttgtcaaactcgctgtcgacctcattttcttcgagttcgctgagggtaaactccatgttgtcgtcgttggcgggagagcggagggaggaaggaggaagaagaagaaggcggcgcgcgggaaggggtaaatagtgtacccaaggcccaggctagccatctcgaaccaatccagccagcaagacgccgtcatctttcctcacgcccgactcccatgcggccacaccttaattaccttagggtttagggtgaggatctatttagtctaaaaattaggttaggattttgttttgttctcgttgtttaatttgcttcgcaatttttaggttatcatgttaaaaatgttaatttgtgccattttagatggtatatggtttataaagctataagtagacatttgctccacgcaaatactatgtctgattttttttatttgtcgttgattagattacagcgtcatataaaaaagatagagggtgtatatacatcaaaccgagtttatatgcggttggtcctcctacggcgagacatgtaatgtttaaccgttgcaaagggatcaagggtaatgcatggaaatcccgtaggttgttgtcggcgtcgctgtggcagtggcaccggccggtagcatatatctgtagtctgtaaatacggagtatatatttgttctctcctcgcatagcacgtagttagctcaatcctcggaggagtacaaatctacgataaatgtggcatgtttggtgctgctaggcaattcctcacccacccagagacgcaccaaaccaatcacgacacagaaaggacggcgcgaggtttaatcctgcacacgacacgacgacacggcgcgtcctgcctgcttcatggtcccccacgcattcgcgtctcccgtcatggagccctcgtgcccgcgcgcgagccgacgaacgcccacgcgcgcccacacggacacggaggcattgctgttcggtgaagacgacgacgacgacgacgatgacgaccgaattcgatcggctacgacggcccgcagacgccaccgcacggaatgaaggtggtcgatcggatcgcggcgcacaccgctcgccgttaatgcgagtcgactcagacacccaaccatcaccagccccggcctccacccttccttaaatgcgacgctatccgtgcacgctcctacaatgccgttttgtgcaaatgcacccctccttgtgtctgcatttgcgccctgttccgctccgatgtcctgtgcagtaggggtgtactagtggtacaagctaatactacttgctccatgtgctaattttgtgggtaatgctggttctttgagttactaaattagagcaagtagtatagttcactactagttccaaatcatctatagccaatgtaataatcaattcatacaatagttgtttactatagtattaagcaggtacaatagaaggctataagccagctgcaaacatattttaaagagataaatgaggagagagaagagcagcgggctacagatttgtagccagctgtagcacggactccaagacacagtgtgtctatgacaggtgggaccagctattaataatatagtactccctccattccaaaatataaggtacaaccactcttaacccaaagaccaagaaatagttattatcaccttgtagtttggatcatcctaataaatataatgcatgtagccaatagagttagagaatatgagggtgaaggatttaaaaaagtagtaatttaatggagaattgtcatagttaatgacatgtatgcatgtatgccttatattatgtaacatctaaaaaaagtggttgtgccttatattatggaatggagggagtatgtaactattgtatgaatcagctattagattggctatagatgaattgaagctagtagttggctatactattaaacttggtctaatatatactcccatctatcatatacacattacgtcttatagtctgtattgtagctgactacagatctatagcccgctgctcttctctttttttttatctctttaaaatatgtttatagctgacttgtagcctactattgtacctgctcttatgcgagctgatcccgttgtgacacatgtgttaacctgcttgtgtcatgaggaaattatggatcatctgtctgttatccatttctatgcggagatttcatcagcaaagtaccgatcacgcaatgaacaaccggtacagattgtacaaggaccttctaccgattcaatggatcggaaaaatgtgacgaccgtactttatttttcagcttataagctgatgtcagaatttatattttaaaacttaaatttagagttaatttttctagaattttcttttaaatcattaaggagatatataaattgttatttataaattatattttaatcgctactaattaagtgttatggtttataattagttataggcaaaatgataaaactattgctt

SEQ ID NO: 70411 - DNA, 79405 bp, Oryza sativa
gtagaagtcgaatttgaacttgcatgtttgtgaagtgatatattacatattaacctatcttgtattttttttaaagttttcataactatttagatgacatgcaagaaaagggtaaacgtccacccgagtgtttaaaacagttccccggcctcgtcctccttggccaaacatgaaaagagaccgtgcgattaatgaaacaaccctgatttgggcgttgttacgtggaggcagtgagacgctagagatcagttcgaattgagaaagaggagacgacgagatcgagtcggaaaagcatgggacgggacagacaggaaaggacgaggcgaagctgacggatcaacgtgcacgcctgaaaggaccttgatgtcgcctagaggggggggtgaatagtcggttttaaaaataaatgcggaagctaaaacaaaatagggtcggattgtctgatatcaggtcggatagtcctatgtgatcagatagtctgaactgagatcagactatctgacctgcacaacaacaatacaaacaagagaacaacctaagagatctagattcaatccacaagcaaagaggagagctcgaccaacaacaatattagcatagcacaaagcaatggaacaagaaggtaaagagagtgaggatatcaccgaggtttatccgccgatgtatttcccggagttcaaatccttgaggggattctagtctccgttgaggggctcgcaaagagccggatctttttcaaccctatcctcgtgaggttgcacaaatgcactcctccttccactaagggtatctctttccttgcggaggcaagatccggccttcacaaacttctcttggccaaccacacgtagatcggtggcccaagaacgacacctagccgtctaggagtcctcaacctccaagagtaataaacaccacacaactcttggacaaatcctagtgctcaagattaagagaaacacacactaggctcccaaactccaaattcacacacaaagatccaagtcataaagaacaagggggatttgagatagagagggagagagctcaaaaatccaaagcacttagcacaaagctcaacccaaagcaagataggaatgtaatcagtttgggcagccctagaaaagggttggtggggggtttatatagatccccaaaatgtgaccgttggaggggaatctttcagcccacgtcggatagtccgatacgagatcggatagtccgatattttaaacctccaaggcaacgagaaatagagaatgaagttccatgaaatttcggactttccgagacatcggactatctgatgttaaatcggagtatgtgatattttagaagcaaaaacttcgtcctcaaacagagactcaagttctatgaaatttcggagtctctgtatcatcggactatctgatccaacatcggatactccgacacttagaaaaactcactcgaaaggatttttcaaacaaagacagagagtgaagttctgtgaaaaatcggatagtctgatgttgctcaagtaaaaatgcaataactttttactccgaactccgatttcgaagatcttggactctatggaaagctagtttcatgggctatcaaacccaacataaaacatggtccaaaacctttaagagattatgaaaaacttgcaaagaaacccggtgtaagtgttgtgataagtgaaacaactcggaattgaaattttggcttagtttttcaactcacacaaagatgaagcattttgagcactagtgttcaaccaattatatgcatgtggtatccctcttaatagtacggcatcctaaactcaaatttaaaaagcaaagttaaaccaataggagtaccttcacaccatattgtttcttcacttggagggttaccaacgtcaaggtcaattgattatcgggaagatctcatcttcttgatctttgacatttcatctttcatttctcaaatgattgatgcggataatccatggcttcaaatggcctcgcacggttcatcacgacacagtcttcactcacccttcaccaccggtttcggttcgtcggccccaagccccttgcttgcccttcaccaccgcatggtccatcgcagctgagcgtcacttgcgcttcaccgtcttgccataggtagtcacttcatacccgcatcttcaatattttctctttaattctcatccatctataagtccatttcctagcttcttcatcggactaatcatttgcttatacactcaataagcgcattagtcccttaatcgcttgtcatcaattaaccaaaacccactaagggcatagatgctctttcaatctccccctttttggtgattaatgacaacacgattaaagcttacaaaagattgataataaatgattttgaatccaaaggttagtttgagctcccctaaatgtgtgcatacaagtttatgaagtgaacacacatgcacatatttttgaaaatgtgagagctccccctaactctttgcatccgtggggtgtattgtgtgtgaaggagataccaaaattaaaacaacacacacaactcaaattcttggcaccaattcaaaatgtatcaaatgaaattattgatgccaattgcaaaaacttgattctatgccaattgattccggtaccgattgagaaagcatgagtaatcaagttttgtagacaatttcaagtatcaaaagataatcttaattgcatgtggcatggtgatcaaataataagcattcacaccaattgataaacactttcaaatattctctccccctttctcatttactctttggcatctttaaagcattcattttgataatttctcacaaatatctcaccctttgatcaatattttctttatcccctttagtatacttctccccctttgacatctaacaccaaaaagggcataagtagggaaagaaaagcaaagggatccttgatgagggatcatcgagtacttacctctcaattttatatttcatcacttgtgattaggaaatgaagcaatttcacataaagatcacaagaaaatcaataagcattgagatacaaattttgcgcatagaaagctcacatgcaaagggtttaaagcatagatgaaaaagaatctcacctaagattttcacaaaacatttcacaaatgagtttcgcatgtatgaatctcatagtttgtgctaagaccaaaaattcacataaacattgattcacttagaacaactttgtgattaatactcgcttaatgactaaacaagcatgtcgtcacaacattttgcaaattaggctaattagcaagaaatgaaacttggcctagatgcccagacaaggcaagtgatccaatcataccaatttaaataacaagctatggatcatcaagttaccttccttgtcgatttttgagatgcccattcaataaaattgatatcttgaacccaatttgaatttggcaccttgatgggcttgatgaaatctcttccttgatttgcttgattccaatcccgagaaagaacttaagcttttccatcatgaacatgtttaactccttgatcacagtctacgtcctgatagtgcttgtgctcttcttgtaaggccatgacccgatccggtttagcatttgcaccatcttccttctaatagtccaaatacaacaagagagagtaacattcacaaatttgcagattgagaatgaatagctactccctttttgtatatcatcgaggatattgtggagatgatctcgttgaatgatgtggtgaattcttggatggtacaccgatgggacttgagcttgtatggtgtaactttgctcttgagttgcccttggtatcaatcccatccatttgtgccggaaacatgtcttcatgttcttcatagacaattgcggtaggttgacttgagttgattgaggttgatcaagtagtccaccttggtcatcatggacttattgtggtctcaccttccaaactatcttcgaagatgtttttgatctcctatgagactaatcacaaaaatacacttgataacaagttagtctcaaaaacacaaaacataggatatactccccctaaatgtgtgcttcaaagtatttgaattacttgtagaaatgcatgtgtttaatgaaaaacaaatggggagtgtagcctatattttggagaaaggcacatcttcccggagtctccggggtatgtacccagagcctccgggctcgaatgcatggtgatagatgagcttgattgcaaaccgagcggtcttaccgaagcctttggttccactataaaatctgcaataaatcttgtagataggtcatagaacattgcatatttttcattttgggagttttacccaattctcaaacaattagaagccacaaaaaaacacaaaaatttagaaaactgaaagtttcaggattttcagaatttggaactcaaaaagagcttggaaagggcatcataaaaatattcaaatgactatagaaaaatccaagtaaatttagatgtgaagtccaaccatagaggaacaaaagtcattatataaactcattccagtttgcaacctattttgagatgtaaaaatcacaaatcagtcaaaaaccatgaattttctgaaaatttcagcaacttgagcaaggtgagaaaaagtcaaattctttccaatttaaatcgaaaccttgcagaaatgatcttttcacttaatagaaaattttccaaaaagaatttctcaaaaaagatttttctttcaagagaaatgtcaaagagagttttgtaggccattcaagtcaataaatctcaaccaaagtgtcaaatcacatccaaataagatttttatgaagtttgacatttggaaagccttagatgggttagagatactaattcatgccattattcacaaagaattttggctcaaattgttcaacccaccatatgcaagttttggccaaatatggtcaaatcaagatttttgatgaactttgtaaggctgcaacattagaatggttggtcttttacaaaagctttgaactaaagatatgtttgaaatgaccaaccctaaaagttttaaataggcaactttttcaaaaactcaatagatttagatttgaggtaaaatctcacttttagcaaaaacaagattgcaagtaggcggttttaaaaataaatgcggaagctaaaacaaaacagggtcggattgtctgatatcaggtcggatagtcctatgtgatcagatagtctaaactgagatcagactatctgacctgcacaacaacaatacaaacaagagaacaacctaagagatctagattcaatccacaagcaaagaggagagctcgaccaacaacaatattagcatagcacaaagcaatggaacaagaaggtaaagaaagtgaggatatcaccgaggtttatgctccgatgtatttcccggagttcaaatccttgaggggattctagtctccgttgaggggctcgcaaagagccgggtctttttcaaccctatcctcgtgaggttgcacaaatgcactcctccttccactaagggtatctctttccttgcggaggtgagatccggccttcacaaacttctcttggccaaccacacgtagatcggtggcccaagaacgacacctagccgtctaggagttctcaacctccaagagtaataaacaccacacaactcttggacaaatcctagtgctcaagattaagagaaacacatactaggctcccaaactccaaattcacacacaaagatccaagtcacaaagaacaagggagatttgagatagagagggagagagctcaaaaatccaaagcacttagcacaaagctcaacgctcttaatagtacggcttcctaaactcaaatttaaaaagcaaagttaaaccaataggagtaccttcacatcatattgtttcttcacttggagggttaccaacgtcaaggccatttgatcatcgggaagatctcatcttcttgatctttgacatttcatcttctatttctcaaatgattgatgcggataatccatggcttcaaatggcctcgcacggttcatcacgacacagtcttcactcgcccttcaccaccggtttcggttcatcggccccaagccccttgcttgcccttcaccaccgcatggtccatcgcagctgagcgtcacttgcgcttcaccgtcttgccataggtagtcacttcatacccgcatcttcaatatcttctctttaattctcatccatctataagtacatttcctagcttcttcatcggactaatcatttgcttatacactcaataagcgcattagtcccttaatcgcttgtcatcaatttaccaaaacccactaagggcatagatgctctttcaatgcctatcgaccggccgaacctacgaaacaccaaactcctgaatcctgatccaatctggacacacaatgactgacgaaaaactacggcaaaaacatcttaaacttttataatagtagagataagtccattttacaccctctaagtctttagtttgtctaaaacacacctcacaactttaaaaccggacatctgacccctacaacttttaataccgtgcaaaaaaccacctggtgtggttttctacactgtttttgtgcactaggatgccacctgtatagattagctagccccacatgtcagtccggttctccttctttctcctccccactctctccccccttcggcatgcgcgcatggattatccctctgcctagcgaggaccgccgcacacccatcgacaagctcgctgcgacggtcctatctcatcccttgcggagctgcaaattcgccgcctgcaaacaccgtcctccaatgcccattccaccaccgtggaggataacagccgcaaccaaatcgagctccaacacacaatgacttaatcctgatccaatctgaacacacaatgactgatgaaaaactacggcaaaaacatcttaaacttttataatagtagagataagtctattttacaccctctaagtctttagtttgtctaaaacacacctcacaattttaaaaccggacatctgaccccctacaacttttaataccgtgcaaaagaccacctggtgtggttttctacactgtttttgtgcactaggatgccacctgtatagattagctagccccacatgtcagtccggttctccttctccctcctccccatactctctctccccttcggcatgcgcgcatggcttatccctctgcctagcgaggaccgccacacacccatcgacaaactcgctgcgacggtacagagctgcagattcgccgcctgcaaacaccgtcctctaatgcccattccaccgccacagaggatgacagccgcaaccaaatcgagctccagcacctacggcggtggtggtggaggcggcaatgggggcggcgttctccagcgaaggcagaggcgcagggacgaagtagctccgagtggagaggtggagctcgccgaagatacatgcgcggggatgagctcgagcgccatgaccaccgcgagtttggcgcacccatccgctgagcttggcggaagcaagctcaagctttactcaatgagcagcgggctcgcctccatcagactgtggtcggtgcgaccggcgtctacgagctagctctgtcatcgttggccgcctagctcctcctctgcgagctccgttctgttgccgcagaccggtccgttctctggctcagtcgagtactacccctgctcctgctcgtgcttgtgctaatccgtcgtctcctgctcagaggcgtggaggccgaagagctttagccttgggattgacatgctaatgactgcaaagatgggcagctagcagcacaaagtactagcttgccgagattagtaaggcagcgtttgtttggagtacattgagggagaaagcaccccgttttcggcacgcacgcttcctaaactactaaacggtgcgtttttaaaaaaaatttctataggaaagttgctttaaaaaatcatattaatccatttttaaaatttaaaatatttaatactcaattaatcatgagctaatgactcacctcgttttgcgtatcttcccaatctcctcaatccccctctccttaaacacaccctaatagtagtatgagtagttgtgatagacaggagaggaaataatttaaaaatatacgtttttttccgtggaatttgcatgaaaatgctgaatataagacgatttacaaaagagtactgttacacgtactaaaattttcttacaaaacttttactaataaatttctcaaccgtttgatttaactagatgaaagttgtaagaaatctagatttactcatagcttgacaaatcagagtttgtaaacattttgtaagaaaaatttagtacgtatagacttttcctttataaaaatataccactgtcgcggtttggtttagcgagaacgcggcgtcgcacgggggatgtgcgagaacgagagcggtatcgctgtttagataagcgaggacgaagtgccggcggtctcgcggcttggagtaacgagagcgtcagcactctcgcagtatgcgttagcgagtgcgatggggccagcgttgctaccagtttcgcggcgccgaaacgtgagagcggcggcggtctcgcgcctgggaagtgcgagagcgagcgggtgccgcgggcctatgaaagcaacgacgggacgcgcgttctcgcacgaaggtaatgcgaaagcgccgcgcagtctcgcgcggtgggaatgcgatagcgccacgcggcggtctcgcggaatgggaatgcgatagtgcacagcacaggctcgcccctgcgccgaacacgagcgatgtgacagcgctgtcgcttgtctgatttgcgagaccgcgcttcgctttccaaattagccagacggaatcagtaatgtactgattattaagttaattacaattttatatttgcatgaattaacaacatgtgataataacatttgttttaaggctcgttagtaaatatatatgagaaaccttctgtatatgtactagaaatataactaccattatttaaacttttcatttgttagacacaacattggccatctatataaaataaaaaatcacatgagctacaaattaattgtaacttacaattagtacaaattaattgtaactttaatttaattttttttaccatataaattaattatgtctatctaatttttaaacccgaaccgactctaacccatataacagaaactacctctgttattattatcctacttaataataatatactatacattattaatattttatatttattaatttcatattttatatttgttgtttgccctaaggaccatgtagctttgcttcacggaagaggccgttgtcttgttcaaaatataaaatttaccggtctcgcaattctaacaagcgatcgagatcgctggctccacgcgcgttgttgcattgctaatgtgcgaaaccgtgccggactaagcaccaaccagaaaatcaccatgggacccactccacagtggctctcgtgctacgaaagcgcggtgccgaggccgctctcgcgcttcaggcatgcgagaccatgggtctcacgcacatctctcgcgcgccagtaatgccacaccacgggccccacaacgctactcctctcgcgcattgaaaaagcgataccgatcccggtctcgcgagggcaatcagcgagaccgttgggtccattcctgctctctctcccaaatcgcaagaccggattaggtcatctctacgtggtgctctcgctcaagggaaaagcgatactgcatcggtatcgcttacccaataagcgataccggagctgacgtcacgctttcgcttattgatattgtgataccgtgtcggtatctctcaatcctcttgcgaacctcggtatcgcgctttcctcccgcgatttcaatagtatatttgtgtaagtcgaccaacatctggtatatttatgaaaaaaatatttatgaacagtatattttcaaatttttttcagacaggagaagcatacacacaggtcacaagagacaggtcgaggtctatatcgtgcttgtgtcggagcagcttcttccctgctccctgcttagccatatatgcgggtcgtgcgcggcttccgccgatgaccgcgcgcagcggcttggatatgctactttcctgcgacaccttctccgccgacgaccgcagctgcttgtcggagatacgcggcactgaccgctcaaccctgccttcgcagtgcctctaccgccgccgctcctgaaaattaaggtcaaaacaaccaagcaatatgggcttgccccatataatcatatgcgctgacgtggcgaagggttgatgtggcatccaacgtatcatccacgtgtgcaaaaaccatcataaacagcccaagggggtcaaatatcaaatattgacagttcagagggtgtattatacccggtttcgtagttcaggggtatattttagacaagttaaaagttcgagggtgtaaaatggactttccccaattttatatactaaaactttatatctggttctaattcgaatcaagtgattttacatataatagtttcataaagtttctacttgtaggtttatatgtataaagtttcggcttgtaaagtttacagtatatacattgagtttgggttcataaacttaaaaatgaaaaagaaaccacgcaaatgcaaaaatggaaaacgagtgcttcgtaggggttaggcgcacgaacatccacgcgttaaacctacccgttattagctacacaaacgacattcatcaacggatccacggaaacgtatcttttgaagggcttgtgcgtgtacgcccgcgtggacaccctcctacttcaattttcatgtgcatgatgtctgatttatagataaagctttatacataaaaattagggcatttacaaatctgccactatttttttttaattttacaaggatgctacttaaatgaaagttatagtgatatttttgcaatttcgtagtggtcgtattatgataacgatttaaattagtggcaaatttacaattgccccccaaaaatacatgtataaagtttctacatataaagttgttgaaagcatgtcacgagggccttcgaccgaggctgccgaaaccagatgggcttgggtgaaacgccagctgagaagactaaggttttcgcctcgaacgtcttcgccactgaaccaaagaagttataaggcttaaaatggcctttcgccacttgagggcccatagtgaagcccattaaggggcccaaggcaaaatagatattagacactagttaccctcataaatgttcatgtacacattaactctaggactaggatgcatgagcttctactaagactataaataaccccctaggggcatgaaatggaggatcccaataattttcatcattaatacatattgttgtcgaaacgacaaccgcatacgtcgaaagacgtggttactcaacagtggttggaaaacagtaaagtgtattaaattaagaatttttctcgggatccccctattacatggccctagggggctatttatagccccattacagattcccactactagggtttaggttatacaggggaatttacatggttacccttatgatagggacattatgaagggcacattgtgtcctttacacacacacgggcccctactgggcctaaacagctcggcctatctatcttgcgaaatcccccgagggcatagcggcccgccaagtctcccgttaacgggttttggtgctatggcgaaacctgtgcccgtgtgccgaggctttcgccacatcatcttcgctcgttccgccttctgtcgagaactccacttgacgaaggtggtgttacccacaatcacggctttcgcccatatggcttcgctcttgtcctttggtgtgagcctgatacttgaacttttcggtttcggcaggttcggccgaaggccttccatggcaagcctccaacacatatgctttacttttccactgtgtgaaccacgtccttcgacatgagcagttgtaattcgacaacaaagttcatatgaataattgagatgtgtataaacttgataaaaaaaatcatgtggatgcaaataaggaaaacgagtgttcaacagaccaaacgcgtgaacattcacgtgttagacccagggtttacgattccgagatggctttccgttttaggctctagtggaatgacggttttcgcgaaatctggtggagagccgataaattccgaacaaatttcataaaccaaaatttaaatataaattccctgattttaccgataagctcacaaaaaccggtcggctttgacaaaattctgagcgaaatcatcaaaatttcaatcggtaactagaaaaagaggtaaactgaaattgttttccttttttaattcattattcttttctttcctattgtaaatttcagtaaatacacgaaatacattaatttttttcaaaaatttatatcccaataggttctatgaatatcatactatttattagtttttttatttttttttcttttttatcaattcaaatttgaatttggatgaaacttatcgaaatctcaaacggcttttattttcgagccttgtcgaaacctttaaatttcgcagaattcgactggttttcgtcagagttgtgaaccctacttagacatacctgttagtaggggtgaaaacggtacagaaacggacggaaaccatctttatcgttttcgttttcatattttattcggaatcggaatcggaaaccccggatacgaaaatggaatcgaatattatcgaaactgaaaacggagcgaaaacaaaccggcgcgaatacggtaacgaaaatttatcggaataaaaactccctcaaactgataaatccaattgaataaattatgtatgtttaaaagagtaatgttgttgataaatccccatgtaggacaaaaaaatattcttatgtaattttagtttgcataacaaatatttttttaaaaaaaatagccaaacaccatggtattcactattcagtgcttaaaaaaagaatccagggtatttctttcacaaaatttctggtaattccgagaaaatttccgaccgattccgagttccgacagaaactgcccttatcatttccgattccgtttccgagaaaatatttccgaatttatttccgtttccgaaaaaattccgaccgacatattccgttttcgaaaaataggttcgaatccggaaagtttccgtaccgttttcacccctacctgttagatgttgcataatcgaaagctacggatggatccataggctaagccagaatcatttcaagtatctcacactctcacgcgcgtgcatgatctagacgcgcgaacgcccgtccgttaaacccactcaccgccatgtgcggcatatgcctgagtgcgaagcatagtcgcatgacgacctacagggctacaactcccagtcccagcactttgccgagaaaaaaaagaaaagacccaaaccgcccatgaccccgcgtctccgccacatcgtgacaccggacaccggtgctatgcaccacgagagcacgagaagagacgcgcgggtacaactacattccacacgcgactactagctaatagcaaagcagcagtaagtaacacgttacaccggcatccccccaggccccaacccgtcaaagcataagcccacacagcgggagaaacactcggcggcgaccggccgtcgcggcctcgccgggaagagcaggttaattagcggccgctcgatcgacgatatggggggcagcctggtgtccatgctgcggtggccgccggacctcggcgtgccgagcctggcggcgctgctgccgtcgtcggcggccggccactacgcgggcgcgccggccctccgcgggtggcactggcagcactggtggccggagcggctcggctcggcggtgcggcggtggccggagctcgtgcaggacttttcccccgtcgtggacgccgtgctctggggcctcgtcaccgccatcgagtccgtcgcgctcttctccatggtgtgctgcttcttcctcttctgcggctgcacgctatgatcggtgccactcccccaccatatagggcgcgcgtacgtacgtacgtatgcataattgtatatgatcgcttcctagctctgctctgaatctcccaactgtttttgattgattttttttttcagatgattctccattttgttgtcggttattcactgtgttcatgcttcatggcaaattaatttagatgccgctaattgtattgtactggtgcttagtgcgtagatttgttactggattttgcttgtctgatgtatgtgcagagcagtgaggcagaagaacagcaagcaccattgatagttttgggtgatgaaatgtttggggagagggattgagtgagattcggttggactagttggtgcgggtgcgcggtcggaacgggggtgagtccaaccctcgaaatatcttatgattttcttaatcgtggcgagtccatgaaactactatttcctacctgattatactcgtcataaaaatataacaaaataacttcgaccactatattttttattataatatataaaaatattaataactgtattaaaatatcaataactgtattatgattttatggaagtaatttttaatcatcatattttataaatattttagatgttatttatagtcaaagtttttaaagtttaacaatagtctgatatgacaaatattattaactgaggaatatataaaattctttttttactcccttgtctcatataagtgcacttactcactccgtcacttaagaaaactaacctaccggaagtaacacatatttttagattaatagtatcataacatgtcacatccaattatatatttgttatttaagattgaaggaatattataggatatgattgaattgttcagatttatagtacacacgtagtactagggtattggaagtttggaactgaaggtgtagttaataccagtaggcagtagctgttgtagacagtgcactgatgagtcgctgattgcatgtcacgtttcggtgttgtcgttctgtcctaggacctcgtgaagcgccactgttgcagtcaggaccatttacaggttaaaaccatgatccgatgactgaccaaaatccggcttcattcctactaacacggcccttttgttcagagagctgtgatgctttcggacgtcgcataacacggcctggcttcaacaggcaatttggcggcatcaacgtgtgtataactgtatatgctcataaaagattatctacgctttgaaatttatttcgactgttaccgtagagtgttcgaatgaaatggtgtctttctgaagctaatgagcgaaccgccacaatttaagatgacaaattttactataggaaatcgtcggttttagctaaactcgtcggacgaagcgtcgccttcctctgctgcccacgcgctgcttcccatcgacggcgatgacccccatggcaccaacggacgggatagagagagaaaagagatgaaagaactgacatgtggatccagggggtaattttaagagtaattttaatatttcaagtgatttttcgctcctctccaaccagaaattattattttaataggtgcgatgtccactgtcaaattaccacgtttatagagtatttactcctaaaagtcactttgtgttgtgttttacaattaaaatcgtgaagtaacgatatactgtagaaaaatttaccatttgagatagcttcgacacttgatgtgtcgagtatccccgcaagattacataattctcttttattactagtattttataaacagactcctaatatcttctctggataacgaaatcctttttattaagtaggtattttaaacagcctcctaatatcttctgtggatatctgctgctcgcaatggcaacgtttattaatgagattgagggcatgtttactttgatgaaaaaaaccttattaaattttagtaattttggcataattgcctgccaaaattttggcaatttgacagcaaactaaatatatccacttttttaataaatttatcaaaatttgataatgttgaaaatgacattaaaatgaaaaggcctgagtaagcgagagctcaacaactgaacagcagacagacgttagcccccattgccccacgtgtagcagcaccaaagcgcgccagtagagagtcgccccggctctcgtccacacaatgatacaaacaaaactaaaaacgacccgtccgctcgacacctcgtgctgcgcggacgaaaaacaacggagcccgtcggtcccggtcagccatcttattttgagcggctgacgcgtgggtcctacagtttgtgatctttatatacgaataacccacgttagagggcagtagtacatgagaacagataaactcatatcccctttaattcaaagaaaatttataggaattcagaggattttattcttatagaaaattttccaacatagccctttgaatcgaagtaatgaaccctatgaaatcgtatggaattcctatggaatgccacttctatacgagttttgaaggaaatttaacgtgaggtaggacctcatgaaaataatcccttgagtttttatctcttctcaaattcttatggtttttcctacatccaaatcaaacggtcattcctatatttttgtgttacaataatttgttttacacttgcatttatgttagaatcctatttttttatttctctttttttattcctgtgatttaaagggttgagaatattatgttagaatcctatttttttttatttttttttcctgtgattcgaagggttcttattattctcaggtgggagagtgtgacgtggtcgctcttgtctctcacgtgccaggattgtaagctgcagcgccggagccggagcttaacgccatttggttggttggtccggtcgcgagaagaatttaccgcgcgcggtgttccgtccgtgccgtgcaccacgaatccgttctcagcgagggtcggataaggacgagcatcccgggcttccttctttctttgagcgtctacggttaaaactcctctactcgaagggtcactgtcgcctgttattgccttgcaaacgtaaccacgtttttcggacgaatcaaaactcagcagaatatgatatgcggtctcaatttcgtagcctgctcgatgcaaaggcgaatgctgcattaatgaagactgtagcaaggccacttgcgattgaaaaagacaggcgagcaagatttatcctgcttctgattttattccgaaacacgcatggcacaaattccacggatgcattttgcgtgcatccaaaagcctttcaatcagcacagctgaattagcgtaaccggaagttgttaaaggtcaggacacaattcggtgttcaccctcagctttgaagattttcgcccgttattcttcctgtcctggtaaaaaatttggggggattaccgagttccggaacgggtgctcactcgatcttaaatccagattttagatcaaccacctcttcgatatttctagccaaaaattctgcctctccgatataagaatgtggtgttagcttcagaagcgacgatcgtgccgcctctggcaagtctagatcttcaatgaattgccgtatgctgtccttggtgacagcctgccctctggtcatttccttcagcttctcataaggttcagggattccataccttcgcatcacctacaaagatgatataataatgtatgatatgcatctgagcttgaaagacgacagacaaatgatgatgaatacagttgatgtatctggtgaaaatgccaataggtgaaattacccccaatatcaaacttataagttctgagaaattttcaaaatattgtacgatgtaggagaatatgtcgttttcgaaccaaacaaaagcaattaaactaaccattctcagtatcaaaattcaccatgaatacacctggctaaaaacgtaaaaatcctacctaacaaagcattaagggcaatgcaaaatcacaaaacaagcatccaaaagacactttcgacaatttgaaagcatctgaagaggcgcacaaatttctaggacaaaccaatacaactcctccatggaagcataccattgtgaaaacaaccagaaaccatatagaggacaaaaagaatggtcttactgtctgtattggctctgcaaggacctcccatgtttgatccaagtcttcagataaccgggattcattcacctaacaacaggcaaaattcagcataaatacaacgaagtgtcatagttacattttggctagtaaacttaacaaagttaaggtcaattacaaaacagactaaatgtctaaaattccaatagtccgaaaatgaaattatgtgtagtgcacaaaggaatatcttgtttctagtacgacagataccctgactgaggtccttcctgtgcatattgagtagatacaaataatagttggggtaagacctagccacatccatcactttatagttcacttagtccaaaaacataaagtgtgggtgggtggatgtgcatgcttgggcatcaaccattcagcatcacagcatgcatagaaagacttcaaatacaaaatatgctagttcaatacttggacaatgataaaattatctatacaagaataattcaagaaacaaccaaatcaaacaagaggaggattgtggccacctacctgaaccttattgattcctcgcaatgtagctttgtaagccaagagtgaatgccctaatccaacacccaaatttctcaaaacagtcgagtctgtgagatcacgctgacagagagacatggttgctcattagttcaatcttaagtaaatagttaggcatgtctgactgcttgctgtattttacatcagtggcaagctacaatttttgcatgcacattggttgaccaaaattgcggttgcattgaaaaatgaggtaagaaagcattaaattgtgcagaggtaagaaagtgtagcgtgtgccacgagttcgacagaaatccatggactatagcctaataaagccaaacttaagaacaccatttgtggcaagttaggcgtctgttcttgcatgtgcatcaacaatggatgatgtactacccctttttcacaactggagatagtaaaagtggaaattgaagagtacagacagtattatacctgcatccgagaaattggtagcttcatgcttaaagaagacaatgtaccattggctatagtcaaattgccgtcactattttcgaaatcaatgggattgactttgtgaggcattgtggaagatccaacttcaccagcctttactatctggaacaacatttggaaggatgcagtaagttcaaacagaatctaaaactgtagaccactaagtttttcccactatgtactaaacgaattcaaccaaaccttaaagaacagtccttgcatgttagtattacctgcttgaagtagcctagtgatatataggtccacatgtctctatcgaaatcagtcaagacattgttaaactgaacaaatagattgaagagcttcgagatatagtcatgtggctcaatctgtaaaaaaaagttaaaactgcgtcagaccaaagagtatcatatgactttagaatttacagcgcagttagataaatggaaagtgtattaataggaaattctccacaccaccatagttcaagaataataactccaataaagcactgaactgggaatacaaatgaaacaactggatatcaaaataatgaatataaaccacctgggtaacataaggattgaactccaagcccaacgatttgacaaaatcttctgcaaccttaggccagtcaacttctggatatgcaacaacatcagcgttgtaatttccgacagctccagcgaatttccctagtatcttgacctcagaaaaactatttcctatgcttgacaatctggccgcaaaattcgccatctcttttcccagagttgttggcgatgctggctacaagcaggaaagtggaaatctaagctagcgttataacttctaagcatatagcatcgattacagtgactctgtgtacatatgtacgacagtacaagcatatattactgagtatacttcagaggtggttctcgtacctgtccatgagttcgcgacagcatagggatggttgaattttgtgttgccaaggagcacattgctttgcatatgtccatcataacagggaacataactgtatttaccccctcttttagagctaatgcatgtgacaagttgttgatatcttcagaagtacatccaaaatggaagaactccaacacctggggacaaagatacactcaacagctagcaacgaagtaatagtatgttcaggtattggttcacacagaaggctgacatacctttgcaatctctggatttgagctgcatttttgcttgagaaagtactcaacagccttcacatcatggttggttgttttctcaatctttttcacttcttttgcatcagcaacactgaaatcctggataatcgcatccaggaataactgggcctccttgctgaatggaggcacctcattgatctcagggatttgggagagtttcagtagccactttacctacagagccagaagtcacttcagataagcaacattgattataacactagcatcatgccccagtttctgtatttaacacatgaatcaagcatcctagtttatgtgaggaaatgatgaaatacactacaaatgatacgagtgcaaaggaatccaaataaatgatacctcaacgatgacccggtatctgatgaggccgaactcactgaagaagggtttcaggtccctggtaaagcgctcgtaccgcccatccagcggcgaaagccccatcaggcagaaagagtcgaagtcctctgcccgctgcatctcctccagcgacctcgtcgcccaatccatcggagcacgcacctaaccaaacagacccccccccccccccccgtaaggaacgacaactactcaagcgggagttcagagtttgcacgggaagagtctctgctcacctcgacggcggcggcgcctgatgcagagcagcgcaagcgtcgcggcgggacgcgggacgcaccggacggggcggcggcggcggccgtagcgcggtgggccgcggccgccgcgacgagggaggcggcggcggcggccggagccttcagcaacggcggcgccgacatgcttggggggttgtcgtgtgggaaaaccctagagcgagaaggacgcgcgcggcggctttgctgggtggctgcaggtgggccgtgcggcgcgcggccggagaagaaaggagggcggaggagatggataggaaatgattcgtagggtttaaggggagggggaaatttttccgggggagatggacggcgaagtggcgaaccgatagattccaacacccccaacaagtgggcgatgccaccgcgccaccatgaccgttcttttcttccaaggcacatttcccttctgtcccggactttctcagcccagcccaatcaccttgcctgagcccaatcaccagcccaatcattcttttagggaataagttcaccagggggtccctcaacttaacagcgagattttttgtgatcccttaaccacaaaaccagaaatgtgtacccctaaactccctcaaaccgttcaccggaggtccctcggcagtatttttgcccggttttgctgacgtggcatcctagtcagcaaaaaaaaattaaaaagtacatgggacccacatgtatgtcagctgcacattttcttttctcgttttcttcagtgaggcggccgggcagatgagggcgtggcgacaggcggcggtgcgggcacagcggcgcgcggggaagaagcgagagaggggagaggaagtgggcgcggcggcgggcggcgtggagcgagtgcgccagcggtggcgggagagggggagagaggcggctgggacggcgggagcggcgggcagggcagcgggtgagagtggcagcggagcggcggcgctcgtcatgctccagctcttcaccgccggtgtcgtcgtcgtgttggttgacctccacgagcgcggtagacggagcagcggtgggcggagggcagcgggcgattacgacggagcggggggcctggtcggcgagcggcggggagggggggcaagtgtggctgcggagcggcggcaggcggtcggcggcgacctcttcgccgatgcggagcgccaccccctctcccgctggcctcatctccgcccttgaagacgaggttgatgggctcctcatcgtcgtcgccgtccccgggtgggagcggcggcgcagggggctcgtaatcgtcgtcgtcgggcagggcggccttggcgctcttctcgccagagaggagagagagccggccgagcttcactcgcgagcttgtcggcggcaatggcgtccctccgcgcacgagagaagaaaggccaaaagcccgtgaacgcatgcatgatagctatgggttctcaagtgagggatacatgcatgcaatagagagaaaaagaccaaagcaaaagcagcttgtgattgatttgcaggctgcacgggttgaaagtgtatatgtatatattcatgaatgaatgcatatatgcatgtaactctaggcctcgcccacggcgacgacgacggtggagagacgacgacgagggcggccacggcgcgcggctgctccgctccgccgccgcgctccgctgcctctgcttcgccgccggacggccgcgccgcgtagcctcgctcacggcgacaacgacggtggagagccgacgacgacggcggccacggcgcgcggctgctcctcctccgcccacagcctgaaggagaagaggagagaagaagaaaagagaagaaaaaaatgtggagccccacgtgtttttttaatttttttttgctgactaggatgccacgtcagcaaaatcaggcgaaaatactgccgagggacctccggtgaatggtttgagtgagtttaggggtagacatttctggttttgtggttaagggacctcgaaaaatcttgctgttgagttgagggacctccggtgaacttattccttcttttagggcattcacgatttcaaaagtacaaatgacctcctatagtatttaatccggacacatggcgcccccttcctgttctcaagcggttttggcactgaagtagcaatccagtcaaacaacatttttaaaaaatggtgggactaaattgtaagtgcctttccctttctcagctccaacgcctagctcaccgggcactccatgaccagcgatccacgttagttgtttttgcccttgttgagccagccagccacaaccatgcatctcctcttggtatccatgtgctaggcagccagcgatatctaagctcgagatgaggtgagggagggagataagataaagggggaagaagtcgatgtcacttcatcctccacctcactagaccctgcctagagctccacattcgcccacactgccactagctctaattgatccgcaccctaccgctccagtcaaaaagggagaaagagaagaggtgatgagatgctgcggtgctaaagctcctagaaacacacatggtggagatggatctctgcagaggaggcggatgcggtgttggagctcgagctcgcctttgctactgctcgtgggcagtggagaggaggcaaattcgccggtggttggcagatgggagagaagtgacgaagagaggaagagtgcatcaagatgaggcgaccattgacacgtgggttcaaccatttttttaatttgtttttttgatggggttgcctcttgtatgtcaagtaggacaaaaatattgttcctcgctaggttaaggcggtattttgtctagtttgaaaaattgagaatataaaatgtatggtattggagttaagagggataatttgtgcttttataatagttgagggggtgggaggtaaattggatttaaccttacttgaaaaagttcatctctcacaatacaagtggcttcaagtgtccacctcagaagttttttttttaattttagcccttgtatatttcaatctacatgtaaattaaaaaatacactaaaatcaaataaaacaaaaaaataatataaaaaacgtagcgtaacctaatccaacatttattccccaccacccacaccggcaaaacaaatgaagacgggtggcaaggacactgccggagtctaagaaaaataagtagagaaggtggtgagggcgctagttgtaatggtcgaggaggaggtagattacagtgactgctgctgcatcatgcatgaacagctctagttgcacgaaggttgtcgttagccgaatctccttcctcccctaccaccatcaccatgcctcccttcctattgttcgttcccgtcctccttgccaccactgcaaatccaacgtcccgttcctgtcctcctccttgctaccgcttcaaatatgatggtttggatggtgcatgtggttaaagtgcaacctcggtggcactgcttagaacaaacggtctcaacgaaaattttgtatgtagtgatggtttgcgtggcccatggtggtgaagaccctaacaacgacaacagagcagcttgacgtgctaatgagggaccgttgcagtatgtagcgaggtgacaagatcaaccaatgcggctccccttgagtggctctacatagcaggagccttttctaggtgaggcactcattccttgcaaaggggcacaagcttcatgtggaagccactcgcctccactcctctctccttaggctgtgtttggtactctattttcctaactctcctctctcattttttgcgcgcacgtttttcaaactactaaatggtgagtttttttcaaaaagtttatatacgaaagttgcttagaaaaatcatattgatccgtttttgaaaaaaatagttaatactcaattaatcacgtgctaatgaaccgctccgttttccgtgcataggagatgggttcccaacccccacctccgaacacatcattaactacttaagtgcactgtgaatgttttcagtagttcatttctttgggatgagcccacaagcctagataatgttcaagttaggtagtttatcattgtcctacatttacttcttttttgctgttctttatcccaagattaaatctttattattctttataaggatctaaatcacttctttaaatgtcacggatcaatgtactggttttttatggacgacatagtggaaattattgtaacatttttgtgagctgtggttcaatatgtcatattaatttgtgtacctcattgtgtatatcaagattagaaatgtaccttttcatggtcagattaatttgtatcttcgtatacccaatggataaacactaaagcatctggaagtaaacaactacatttataaagtgagaaatggttctctatatatatcccatataactcttgtatctcatttcgtatatcaaagatttatgtgtatattttcataaatggtttagttattcatatcttcatctacattgagtaacatctatctctacgtaaacgactacatttatcaagtgcccttttgtataactttgactctagatagcagtcattgataaacataagcatatctgaacataaatgactacattaaatgactacacttattaagtgacaaatcgttctctctctccaaattaatccgcgtatcatttgtacataaaaacttatgcatatcttttttcataaatgaattaattatgcatatcttcgtcttcatcatgagtaactgcaatctatatggacataaatggctacatttatcaagcgcccttttttaaactatagccacagattacagatagcagtcattcaatatcataaaagaatgcaactcattattctcatgaaggaataattacacaatgacaatattttctttctcaccattttaccttggctttaatcctactttcagtcgatcaatccttctccaggttatagaatagcgtgtaccaaaagcacgaatctaatcacggattataatggtgcatttacaataaaacaatataatcgttgtttccattcaagtttcggcacgaaaaatacttataatgttttacatgaggagttatgatatttgtggcacgaaaagcaggactatactatgatactattaacttctctcgctacaatcaatttttttatagtagcactatctagcacatacataagaatatggtgagctaaaatcgacccatactactatcttagaagtttaaaaaactacaaccatcctagagtagcaattttgttgagataggacctattcggtgacaccaacagtgccgtatgcaggagtatactttcttcgtacttataaagagagtcgtttatgacagcgacacggtctccaaaacataactttgacttcttgtttatataaaaatatttattaaaaagtgatatatgtatacttttatgaaagcatttttcaagacaaatctattcatataatttttatattttcaaactcaacatcttgagagttattcatgatttatattttcaaggtttgacttaaacattgtcctaaacaattttctttatgagtacggagggagtagtctgcagccggcttgcagaatagttccataaacatcattttttttttgtcagcagctgttgccgtttgtacccatgccgggtcacgcgtaccctacgccccctaccggtgctccaccacgtcagcggctcgcgctcgccccccctccacccatcgcacacggcaaacacagcgcaaaacccccgtgtccgttggcaccaccaacccccgctatataaacccccccgtctcctgtcgttgccacaccgtcttctctcttctcctccgccctgcctcgactcttttctcccccattttccccttcccaactccccccaatacacaacctctcaactcaaaaccccctcgaggcctcgagcctttttttttctgcctcgaaacaactgaaaacgcggggggttctctcgacgtccccccggccgcggccaacaccaccgcgcgcggcgacgcggaccggcgtggcctcgccggccccgggcaatgtcccgcagcagccgcggcggcaggcagtcggcctcgtcggccacccggatggcgtccagggcccgaccgggtttccccgtggcgccaccaccacccatgggcccgccgccgcccccgccgatgcccccggtcccggtgatgtatctccggggggtcccgccgcccccgccgtggctcccgcagcacctgatcatctgcgggctcgatcccgcggccgccgagcggactgacgctttccggagcaaatccctcctcaacgtgagcaccgggggcgtttaagcttcgtacgcttcatcgtatggtcctatggtgtttgatctcgtggctaattttggggggatcttcttgtttttttttacgaggtttagttcatttctcgtacgggggttttgccctcgccggaggaggagttgaagaggcaagtggtggtgcgggagctcgataaggtaatgatcgttcgggtttcggagcttaaaggttaaagtttgcgatgctgactggtctgagagccttgatccgatggtggtttttgcagatagtgatgggttgggcgaagagggtggcgtacgaccagagggaacaatattggaacacaacagctacggtgttgacctttgggtcgtatgctttgggggtaaacaagaaatgttcgatttgtgcacaatttctgggattttttttttgtgttgatgcaatgtccgattgattttatagtgtatactgttggagtgatataattattttgcaatgcatttagttatctgtcatatgttgtgctcattttgaacctaaaagtgttaccattaattcgtcaattgcccagtcattttcagccactgctcttggttatgagcattttagagctgctacaggagaagccacgagctagacatagctcgttgttttaatatttggaattacatgtatgccatgttaattttagcagagcatgtttatttgtgagctcaaacaatctttcaatcatttttttgagtggaaacaatttactgctctagtttttgtgtgctaaagaagatgaccagaacctgagagagagagagagaaaaaaaaggagaaacttggttctttggcttgctcattgttctttttctaagcctcttggtgacttaatgatttattctggattgatgagccagaatatgccatagtgactagtgagtgtaagcgaataaagtttctgaatggatagatcatatgttcttagttgtgcttgtgcatagtcaacttaatgtggtgtttgttgatttgacataagattatatggttaaggaatacatagaaagattaaatcttgacatctgttcccatggacaatattctacatgtaaataacatgtaagatgtttaaatccatgcttgaaagactgatggtaggcaaatcagggaattagagaactcactaaatatccatttgtattgttgacattgtgcagagttttaaggatggaaatatacttatgcatacaatcttggctcggttaatcttttattacatgttgataaaatagactgggttaatagtagtattttaactttgttttgcttgtctataacattgcctcgtaactaggaattcccctttgagatttttaatatatcttattgtgacaagcgttgcctaaaatgttctgctttgaaggcatatggacctgaatctgatatagacgcagtctgtgttggcccttgtattgcatcgttacaggtgaatatctctttcagttttccctttgtccactagcttggagctttcgaaattaactcagtgtgtatgtgtgttattgtatagcaccattttttcattgtcttgcgacaaatgcttgaagagaggccagaagtatcagacctgcattctattgaaaatgctaaggttccattgatgcgctttaaatttaacgggatgttagttgatttcccatatgtccaattgccagttatcaatgctgcagaggcaagtaccttatgtcttatgattgttttgattacatgactatagttacatgctatcataattagtgttctgtactaccttatatatgtgttataattgtcccatgattaattgttgattcagtcaagttttcttaaaacaacacctttcactgaagatatagaacctgctggtgatgtcctggagctaatttgcaggctttattttttaacttccttcaatattttaccatgatatggtttcattttttgcagaattgcattcaatcatgcataatatttttcgaaagcattgcatgctaccttgttaagtacctattaatggattagatccccccagaaaaaaatgaaatgaattcgaggtcatgtgttattgtggggctccagtatcactggctttgattcaacggcgatactggagtcccaccactgctgttgcaggcttagtttgaatgtaatagtcaatgttcaccataacaccatgacttcatttcaataactgagttgtacatttacttgtgctctgtttgatgagtttaaatggcagagcatttataaggaatgacgccttcactgtctttatgtgtatatatagatgtatatatttaattggtttatggaatgtattttttgaaaataatgtattttatatgcctattaatggattaggtttcccccaccattttttcaggcagtagctttagtttgccatttgactgtctacatttgttttagaatgctcttggcctctgcaattaaaatcagttaaaacacgatacataatcaactagtccattcttaggcctccctggtttgacatgtgttgttcattatcaattaaggctaactgtgaaccattttgtcacacacagattgttaaacacaatattgtggtggttaattcaagttctcacaagttgtttggtgatgcaggcaatacatgcatttgaccctcgcttgctagcggcggttaatgaaccaagctggagatgtctatctggagttcgtgttaatagacaaatcatgcaattgcttccaaatataaaggtcgaacactagcctcgcttgattaatttatatgccattctcatattttctcatggtagttgtattttatttcatattttcgcacctttgtttcactttcttattcctggttattttttgttaatgcaacaataatgcattacggttcccttattctatgttgaatcttttatctgctgagctctctaaatttttcttgctaatagtctttttcttttttttaactgcttcctttttctgacgtttaatgcagaagtttcaaattcttttgcggtgccttaaactatgggcgagaaaaagagggcttcattgccatgtatgtggcttacgttttctttatcaatgacagcttatggttttgtcttcttttttggtcttacagtgttatacttaattttatggtgttattttcagctacttggcttctttgctgggatccatttggcgattcttgcagcatttgtttgtatcatgcatccacatgctactctcagctctttgttcaactcattctttgatatattttctcactggcattggcctcttccagtgagtttacttgatcagccaactccttggagacctcattgctgctctttcatgcccatagtgatgccctgttctccaccagaattttgtgcctctagtataacaagaagtacctttaacaaaatcaaagaagaacttcagcgtggttttgctttgaccaaggtatgttgaattgcttattctttatcaactactatttagctaataacccattgtactctctcactttccgttcagaaaaagaaaatgagtaactagtcttagtgcaactagtatatggtcagtccttcctcttttgtttttgctgaactgttatatttgaataatttgttacttgaatcttcagttaactctattttaagcatttaatatccagtctccttttatgcagtagtcagagcacctaccgtttcttttttaaaaagcattgaatattcaaatgaaacaaattgacccacaaattttgttttctttgtttttattattgctatgccatttttatcttttttttaaaaaaacagaagtatttgaagacttaccaaaaaactttgaagctcgtaactgtagcactgctctacacctcactgaaaaataattaaggtccaatttatctgtatacttcatctgctttgggtagtgagatccctctattagtcaactgttgcaaattatgtaatttgctgaggaagacctatttttaacttatgtcaattatataggtggatctattcatgggtatgttttttaactaagcagacagctaggaagtggtgcttttgccttacatggtcttttgctaacgctagaatcctcgataatgttcttgtcagtcatctgcactttggtggactttagggtgacatttgctttcatcgttgaaatttctgctgctaacatctagcttggtgtttgcactgttgaacagggtgataggaatggtgatattaattggactgagctttttgcaccttttccgtatactgtgagatacaaacattttctccgtatagttctttctgctccagtggctgaagaattacgtgattgggttggatgggtgaaatcacgatttcgcaaccttcttctcaaggtttttttttcatcacctgcccattgtttcttcacatttatagctgcaagttctgattgtaacatatccaaactgatgttctgcagttagaaagcattggtgttgattgtgatccagatccctcagaacaagccgatcatagcatgattgagcctaatgtcgtatttttctggggtctcatgtatagaacgagtacaaacatctgcatcgactctgtgaaagaagacttcatgaagagtgtcaccaacgacatctatggaaaggagaagtgcacccattcagacataacgatgtccattgtctggccaacccatttgcccaaatgtgtgtatgctcactcagtttactcacagaatcgacagaatccgcggcaatttatgatgggcaaccaactgatgaatcaggactgcaatgcagtgcgttaggactccattattatctgaaatttgttcggcatctgcggatacctgtttgagaatagttagagatctgatactcaggctgttgagtacgctaacatcatcagatactccgaatctcttctgttttttggaccgaggcttgggatgcttctgtcacaaggactatggagggttttttttctttgttggagctggccggcgagagctgggtttttcgtgtcgagcttctagggcaaagtaagctcaatcgagctacttattgctgttctgagttttgtgcaggtacatgtatattcatgtacacagcatagggggattggtatacatgtaacagaggtatagcgcataaaaagttttataaactgtaggtccaatgtctgtcccagcagcaaaattgtgtaaatcgccacctgtggttagaactgttgttgggtccagattcagaggtcgatatgatagtgtttactgtttaggatggatgtcagtcattcttactgttgtaggctgcaaaactgttgcatgtactgccgaaaaattcttatgtggcaagtcatccagagaaagaaaaaaacattgccattgtgtactcaacattgtcatgcattctctcgggctctgttcaacatagttttgagttatatccctgcttctctgattacctgcactgattatttacctgtttgagactttaaagctggctagctggggcttataaattccaatttcttacatttcttgcttccttggatgggaaatgggatgccagcttactgtttattgagtgtcatgtttccgcttcagtaacatttgtcattgtttctgtaaaagtattatggaaagtcttggttttgaacttcagactatttgaatactcatctaaccttttccttttctaactccattttcccttttgtgaggtgccgtaactttctagtgtctgttgaaggacaaatattccagatacaccaaaacacaattagtgcatgattaatcggattttaattattacaaactttttaaaaatagatttatttgatattttaaaacgatttctatataaaagttttcgcataaaacataccgtttgaaaagcatgcaaacggatatcaaggtaaaatatgtatcctaataaaaagaacgcttatatctcactcatcccaatgagacaaccaatatttttattcctctcgttaatatacgtgtggaatgtttaaacttattatattttgaaaagtagggagtagcaagttttagctattagtatagaggtaaaaaaagcttggttgtcttctaggggtaggtgactaggtggcaataagaaagctaagaggtaataggggttgtatatgtggtttaattagtagcaaaagtcacatttcataagtactatgttgttatatttgaacacaatttaaacattaaaagttattgtattttgggatggagggattagtcttttttaaggaccaatatatcgtactaaatatgaaagtaaatatggcaaaacataccatttatcatgcccacacacatcgcacatacccacacaagtgcgggatggacctagatggatgaagtgtcctgttgagggtatctctcgagagtgcgagggcgaccaagaagttacggtaatttcccacatcctgacccctgccccctccaatttcactggtggtttaccactgacgagggctggaagaggcttcctccctgtactaatatagagtagtttaggtcaaaatcctcatgtagtcaggtcatcctgtaactcgacttcatcctatttttgggtctcattggtgaagttgccatgtcaagaaagtgatgttggtagctgtagttgtaggtttgggtgtccctttgcctctaggaagagggttctcatcagtcatcaagctcatcctccccatcaatggtccccgcgatgagtgtggacggatctaggagggtcggcgtgatttgcgttgcgacgagaggtggaggggctagatccgacacaaccggatcttgcttgtcggtcagcctggtgaacggagctagagatggcggatctagggtggtcagcccattctccatggtgatgatggctggaggtggggcaaaatgggtgtgctcggctcctacttgttggtatttaaaaggtagagctggtatagttcgcttgatcctccagcctcaagtactcgtggttctggatgtcaagcgaggtggcctctcaataagttcatcaatttcttcaagtaagtctttggtgggcttattgcttgatgcctggtgtagtgtctggggttcatgggggtgtcacttctggaaacaccattgctcttcgtggtagtggtcatctagcgatctgtagtcgcaaggttagagtggaatgcatggtggggaggcttgatcgaatcatctcttccatcgttgctactgtgttccgctttcgcttaatcgttccaaggcttaagttcagttgctaccattcctaatcattttgtgtttaaggcaggctggggtttgggattgtcttccaattttccttgcaacagtatccaagatgagaactccgtttctggatgagtgcggactgtttgttcgacttttgttgataatattacagttagtgctcctcagatttggtagagaacttcttggcaaaccattgttgagtccgatcaagcctaagaaaaatctacggctcaacattaaaccttgaacaacgaagttctcgtggaggcaactgaaggggtcgccgatctatcgagcggtgtgcacatctttagtagtggcttgtggacgtagtggccttggcaatgccatagctccccatcgatctcatcaattactattgttttgtttagcttggaggacagtcttcttagttcaatcggctttgccttctgtttgaatggtgttgttatgtatattctatctttgttgccaatgtattggggatgttgtttcccttaaactctgtccttgatctatataaataaagttttgagttttaaaaacaaaaactctaacctaagacctatgttggcctatagtgttctgacatgagcccggtatagcacatgatgccacccatcatagtactatggatcgatctagcacgaaatgcatgctcagattcgtattattaaaatatatcacatctcgtactaaatttgtttattttaggatggataaagtacacgataatattttattgtaacacaggagcctgggtctgtccttgcacacacgagtgggtgtgtcttagcatcttttgattacataatattataataatattataatgtatgtttatcctcggttttgaacacaggaaaacaaaacatgagtatatgatcaaataaaaaaaataatatttagattttgagacaactatagcagtgttagaggaacgttctatatgatgttagcatggacgtcactgaatggaccatttctgcctacacgagttctatagctgttgataagatatgccatattgtggcctagttaacttgcaggtatgtcctatatattaaaaaagaaaatgaggaaatgagcgcatctctaaccacgtcactagatagggatacatatggtgtgatgttagcatgggtcgtgccgaatgggtcattcggactattcatatattatatatagagagaattacttatatgccactacaatttgaccagtttctttatatgccacttaaaattggcttctcccttatataccactagttcaagtttttctacccttttatgccactcccaccactataatgttagttgactgttagtcaaaggttagttttttttcgtaaatgaccaatatgccctctcaactaaaaaatgtgtaaacttctttttgagtgaacaaaattttgtcagaaccagtgaaaaatgctctttatattaaaaatattgttggaaaactgcatgtttcatgcttatattgaaaatttatttgtgatggtaatggctaaaattgcatgtgatgcagaaaaaaatcaatttttatatgttgtatccagtagctatattagtactaaaatacctattattggttgtatactaattctcaagggcaaatgcgtatttttacaatgaagttaacggttaactgacggtggactgacggcaatggcataaaagggaggagaaacttgaaccggtggcataaaagggagaagccaatttgaagtggcatataagagagccagttaatttagagtgacatataagggattctctcttatatataatatgtatactagtataatggctaaatgaaaacgctaatcaaaatttggtaaggctatttattataataattattcttaaaccaaacccatgtaatatcaaattatataactgccattgttgttggtaacagaccaaatacaatgctgtcctaccaaccaggctaaccgaaaggttaatttgtagcaacattgcttgattgccaaaattttatcattacaaacttaaattttagttttctataggaaaaggtacaacactaaattttccatgaaagtctaaagattatctctaagcttggaaatctgacacttttcatccctgaactttatttatgtaagtaaacgcggtatcggaaatttaaggatgatcagtttccggttaactaaagtttactgagtttcgttttcgtggctgtgtttagtttttgaaattggggagaagtttaggaaaaattggtagtttggaaaaaaaagttgggagtttatgtgtgtaggaaagttttagatgtgatgtgatgtgatggaaagttgagatttggagaaaagtttggtgtgaactaaatatagcctacgtaaaaatttagggatatgaaacgaccattttgctttcccatagtataaccgtgcagtgcaatacacagtgaatcgccgccgatctgcatatccagccgggaagaagagcaaactcgtgtcacgtgccaaacaactaatcgaaaagccctggacaacggcaggagaggaggaggggggcagtaatgaaaagggagaagaaaagaaaggcggccggcttgattgagtggccctttgaccgggagaagaagcccccgcttgctaccccggtcccggtggccgctgcacgcccccggctaccgccgtgcgtccgaagcgatatcgaggagtagcatagcacgtacgatctctcacctcaatcacgtcgtacgtcgcggctgcatgcagcgcatctcctcactgagcggcctccctgtcggcgtgcggccatcaatcgacgacgacggcggcgggccccgcgggggaggggacgggtcgacctcgactaacctgcgcggctgcgcctagcgccgactacgtgcacggcagcaggagagcccaggagaacccccgaaacccacggggtgtccgcagtgtatgtactccctccgtccaagcattttaagttttttttactgtttgatcactcatcttatttaaaaaatttgtacaaatataaaaaacgaaaagttatgcttaaagtatttttataataaagtaagtcaaaaaataaataataatttaaattttttttaataagacgagtggtcaaatagtgtaagcaaaaactcaaaatccggagtgcaattgtacagtaggggcttgcaatgatccgtatttttgggttcagacgtgtatgaaaaaaaggtaggtgtgaataattagataaatattgtggttaattgagaagaaaaaaaacagtataggagaatgatagtgtttaattgagctgtattttaaaaagaaagatcacgtaacttcctgatgtagatccattttgtttctatgtgattatttacttctactagagtttttagtgaaacaaaactgatctaccactatgcgaaatgtgaaaatcgcttgataatttgttgttgactctccaaagcccccgcctaagtttgaggattcctgtggaacgaaaaaaatataggaatttcttatctttgaaattaccccatttgaaaggaggcatgaacatatctcatggggtgggagctttgcaccatgtgtggtcatgtaacagtagtactgtcataagaattgctctcttggatggctaaaaagaaggtattgacatggtcactctcgagactagaaattttcatattaattgaaatgttatttttttattatgattgtatagaaggtatgattttatctagaaaaaaattaagggctactttggaatggaaaattggaaaaaaaagtaggaatataaaaaaaaaatgcaaaacacaatatgggggaaaacacaaaatctggtaaaagatatgtttagatgcatcatatggacatgctgccttcgactttttgaaggaaatgtaaaacacgacctttgataaattttggaatcctccaagtggatgaatggaagaaatcctattgaaattttggaataccttcctatatatacaattctttgagggctttataggaaatatttttataggatttcaattcttggatgaagttcctaagaaaaatacttggtttcaaaggagtcacaggaaatgtatatgaaatctaataatatttttaaagaaataattgcgtagaaaatacaattgcatcgatgaaaaatataagctaatattatatatcaagtccaatttaaatttaaaatatgttatataaatattagaaaaatatttattgaattaaaagctaagagtatatcacatttcgtatactagttttttgtttaaatctgatatgttctttagtatatcattttctatgaaatgcataaatggcaacaaagttattcacttactcgatcattttcttatcagtcatgcacataaaaccgaaacaacttgttgcagtgagctgtatgcagtgaattataaagtccatagctatgatatcattcatttaagatgagcaccggccccggccgcccgcattgcttttgtcccgataagacgacatactgttcatgacactactatgaagaaacaaagagtcaatcggatttagacgtggagagttttcaaaaaaaaaaaaaaagggtcgtggatcgcgcgagctggtctggtttcatacccactgcagttttgagataaatccgagctggtcgcgaccttatttgctccacggtacacaggagaatatccaatgttccaaaccacgaagcagaacaaggttaattgcgtactacaacatgttatcatgtaggagtagcacaatgcaaaatatactgaaaattccatcacacattccgggggaaaacatttgtccatgaatgtacacatttgttgcggttcgtaaaactacttgttccttatattcatggtaaaaatgaaaaaaaaataaagggtcagcaaaatacaatagaacgcttcaagatgtttcgatgtaaagcattcatgatatgatgacaaagaaaaaggggaagcacttgtcattagtgatgacataggtgcatgactccatccactagtatttaaatcctgctatttgcgaatattaagtacatgcatatgcatatggcacaacaacaaaaacctcacgtagaggctcatttgtagagaatttttaaaatgcctgtaagttttaaagctctatagtctagagacactttttaaagacactctcaaaatcgcctaaaatatttttactttagggacactttagagacatttttaacatactttgttaaatttatcttgtagagccatcttttcggcactttaaaatttgccttatatgtaaaggcattttttccaaatattaatatatatcaagtaactagatataagtaacacaaatcacatacttatatgtaattatatgaggttgagatggttagtgcattgaggaaaaaaatggtaaactcaacaggtcatgagtttaaggattgataagggataattttttttctttttttttcatattgatttgctatagttgccacaacatattaatgcctctacaaagtacctctatttgtataaagacatcttataaaatgcctcttagttcatagatacaattcaccaaaaggcacttatgagacactcttcaaaatgtctctataacactgtaaaggcattttttaaatgtctctatagtattaggaaaatgtctctacaagatatatttgttgaagtatgggtttttaacatgattttaaaatattatgcatatgcaggtagactttcaacaggattgtagtgatataagagatgtgccgctaatttctatctcttagagtgtttgtcaggggggcgcataaagggatgggttcactgaggttaccgtaaacatcataacggaaacataaattcggtcacaagttcaaactgatgttatgcaaggctaatatttgttctttataaataatatatagtattcttttatgcacaccatatattttaaaccatgagacccatgatataaccatgcatcctccaatgttcatttcttaacttttttttatctgcaactgaaaattcttaaagggagcttgacccaaagaaatccttattactattttaagattttaccttaaagcacatgtcgaaccttcttcctttttggattgttgatcttattttagtgttactagggatcatcatgatcaggctctcagatcaattctcatgttgcttctcttgattcgttgttttctggcacttgttttgttaggatctattgcactgcatggtaatcgaaactacgtattgtagtaaactatgtaaagataaaacaagcatattaaatatgtaacaatatcttctcaataggtaagactttagttcgtgcacaaatctgtcaactatgagatcatgccgtccatgagccacgacaaccaacttggtactgtattcaatgctatctctatttttgtttacatgagtttgaccaatttctgggattaaaaaaatactcgccacgataaccatgacatcctccaatgttcatttcttaattttttttatctgcaactgaaaattcttaaagggagcttgacccaaagaaatccttactactattttaagattttaccttaaggcacatgtcgaaccttcttcctttttggattgttgatcctattttagtgttactagggatcatcatgatcaggctctcagatcaattctcatgttgctcctcttgattcgttgttttctggcacttgttttgttaggatctatagcattgcatggtaaacgcaactacatattgtagtaaactatgtaaagataaaactaacatagtaaatatgtaacaatatcttctcaataagtaagactttagttcgtgcacagaaccgtcaactatgagatcatgccgtccaagccacgacaaccaacttggtattgtattcaatgctatctccgtttttgtttacatgagtttgaccaatttccagattaaaaaatactcgccacgacggttacgaatgtgactatctctcttttgcccttcgtgcgtccataagaaagcaaaagtaccacacacgctaggggcattctggtcatgttagacaaaacaactgcatttttcatcagattttttttctttgcacctgaaaaatttcaaataagggactttgacccccacacaaaaacatgtctttgcccttttccttaggttggaagacaagccgagctttctcctttttaaaaaattgcttctcccttctgtacatatccactatcaggcccttccaaagttccaattccattttcaaataatttagaaccggaaccaccggactgaaaggccagggccactctgtgtctgtctcactgttcgaactcgagaagagaagagaggagacactggccgtggcaggcatcgtagtacaagaggacgacgcagcgccctgacccacctaccccaccaccacacattccattcccatttccattagccccaccccaacccaggcccgcgccgaagcgaagcggagaccagatcaccaagagaagtgcgacacacacaccttctcgccatcgttttcaccccctcccttataaatactcctaccgcccgcctcgcctcgtctcgtctcctttcgtttttttttcctccactcctccgcctcttcttccgccgccgcgacgcgccgttgataggtctacgacgatgtcgccgccgacgaacggcgccatctcgctcgcgttcccgcccatggggccgctgccggcggacgcgctgatctacccgttcgacggcctctcctacgacgacttcgtcctccctgtcgccgccgcaccgcagcatccgctccccgtcgccgtcgccgaccccgcgcccctcctcctcctgccgccgccgtcctcctgcacctgcaacggcgccagcagcggcatgggcgccgttgcgccgcgcacgttggctctgggcgccaccaccgacggcagcgtgatgacccccaccagctggggcagcgacggcggcggcggcggctcctcctccgcgcgggccgtgcgctcgccgtcgccggtgctgccgctggtgcagggcaccggccagaggacctcctgctaccgcggcgtgaccaggtaatactactcctactaccactataccacgcgcgtagagatagactagagagagtgataataataagtgcatggttagggagtgtgattaacgactaatcgccacgtgatttttcacacgcgctaatcacgaggaccgcacgtgtggcgcaggcacaggtggacggggcgatacgaggcgcacctgtgggacaacacgtgccggcgagaaggccagaagcgcaagggccgccaaggtaatttactaattaaaattaccgctaatcaccattagtccattaccctttctgtaccgtcatttttctgtcaccgatcgaggaggcctcgccggcggggaggggtatcgacggcggcgaggggacggtgatgagttcgccgtgatgggatgggatgggatggggtgccggcgccgtttcggggggagatcgagagacgggtcgcgtcggccatcgtgtgcatcaagttgaggtgacattagcatctccgttagactcgcaacagttcccggattctctgcggtgccgggccccggtgggtcacccctctttgaccgtgcaaccgtaggtagggggtattgtagccgctgcctagtatacctctgtgttctgtctactactagtagtatctcttttttttttaatctttcttgtggccatttctctgatgcaatagatcggctagagcctaaagcgatttagcaaggcgatttatgttggttaatcttgtaggcgtggagattaactggtcccgtggttggtagagtgacgtcgtgtatctgtatgacagctttgccatggcaggactgctgctgtggtgcatgcagcttttgcttttttcctggttttagtagtagttcatgggtgatgtactgcatgtttagatggttttatttgggtcagtttctttcttccttctattgcaagtctttcttttctccttttttgttttcttctgcattacacacggcgagagtttttgtttctgaaaaatttattacgagtcgcaactttgcaacgctaccagggttgtgtaggggacagctaaggtgtgaccaaaagtggttttggaacgcacgtttgaattttattttatttttgctttgccagttacgactccagtagagttgtttctactgtccgtccttgttgattggcatttggcaacaaacttttgtactttactcgatacgcttgcagagttgcacaggtagacatgcgtgctactggtgtctacgacgtcatgggctcatggcctcgagccaaagcagttccagactactgctgaaatagcaaagcggtctaaagttgcgtcgatcgatagtggagatgtgattattggccatggcggcaattccgcaatagagagtgtccacgatcttgtatgatatggctgcatttcatatattaatgcctactatatgagacacccagaaatcagaattccacggatcaatttactgttggatatatagctacatgtaatggtatattttactgtcagatggtacatatatgctgggatatcagtaaaaaaaaatctatcggttgatccgatcatccgaggatagctactctaaaatcacgtgcatagtgcaaaatgcaatttcatcaagtgaacattgcatattctgctgtttggttttgaactgcattatgtaataagtaatacgtattacacaaataactccttacacatgctgatgcattcatatgtgcagattctatcgttagatttgagccacccttgcctcttttgcatcgtgcaagcaaaactccagttctgaggagaaaaatcattgcatgcaattaaagattccatacatataattgcatttgggaaataatatatattaacaggatgaatcacgtgaatagaaatgttgggggcattctttgttgtgtggagagatacattgctttcgagttatgtaagctagcatcctcttgttgctgtccttttattttggaagatatagttatcttaatttttgaaaaagaaaaaaagaatcatgccttataagttatatgttgataaaggaggagagtttgtgtgagatatgtacaatggggttttggggatcccgtaaacctggggggaaaatgttatcttaatttgcatttgatgtaaatgacatgctattttttttttctgaaccagtgcagtggttccttttttttttttaagaaaggactaccagtggttccatgatagtgatactatgacatgctgcttctttgcattcagtgagtataattttgttaggatatctcaatgtttgaatggaagggacatttgtatacagtgaatgttttctcactgaggaagtcaggaagttgtgtgctaaactgttatccctgtattttttaatatataatcttgtttatttgttggaactaacctggtttataatgtctactctgtatgtgctttttatcctgccaactgcatgggggccttcttcagtttacttgggtatgagcaactaagtcctgtcttatgtatcatttcgtatgccttttcctgggtaagtaaaggtaaataaacatgtggtaaattgcaggtggctatgacatagaagataaggctgctagggcatatgaccttgctgctctgaaatattggggtgctaatgctaccactaacttccctgtaagtgtcacgctttcctgatttcctaaacagccccccatagttactgcaaatatcctactgaggtcatataagcagtttttttgtgcctcctaaaatgtgtgcccttatcccgcacctcatattgtagtgatcttagtgtacttctaatgtcttatttacagttaatccatagccttaaaatttgagatctttgtcaaccttcaactgttcatttggattcatttatgctggttgtggactgagacatactcatgtattcttaatagaaagatacacatcattatcgtcgcaaaagaaaaaaggaaaaaaaaacacatcactatgtgctcacctttatgtggagctgtgtgcttagattggtctctttattttaggatgcattcagaactattatcatgtattgctatagttggtcatgatgcaactgaaatggaacttgttctcttcttagaaagaaagttacgtgaaagagattgaggagatgcaaaagatgagcaagcaggagcttgtagcctcactaaggaggtttgtatttaaaaccacgttcttttgctgtgctacaaccacaggaagttcaggcttatatacgtgtttacaactttctcaattctcatgcaaatctgcaggaagagcagtggcttttctagaggtgcatcgatctacagaggtgtaacaaggtaattttcaactacatgaaccaatcaaccaatggtcatcttctttgtcagttacaatctgctcaacttcctgctattttccccaggcaccaccaacatggccgctggcaggcaagaattggtcgtgttgcaggcaacaaggacttgtatctcggcacctttggtaggagcctgttgttctgatgccccttatatcgaaaaagtagtatgacagtatgctttttttcttaagaaagtatgctcatagtcatatatggacaagtgaccatattatagtcttaagtagttaagttatatggcagaatagtcatagataccttactgtttcttgaagtgctgttaatgctttgttgttccctttcaaataagttactgtcatcttgacacaattattatcatctgtgtaccatttcatttgttactggttttacagataatctacaagctatgcactattcaatctcgctctaattcccttactgtggcgacattcagaaaccactatattttgcactctgtgatgcatactaaaccagcatacttgcacattccttgcagcgaccgaagaagaagcagcggaggcgtatgacgttgcagcgctgaagttcaggggcgccaacgccgtcaccaacttcgagccaagccggtacaacctggaagcgatctctcagagcgacctcccgatcagcgtgtccgggaggcggcacaacagcagcagcaacagcaacaatccagcaccagaagcaggaggccaaatcactctgatgagcagcccgccgatctcccagcagtcgagcagcgcgccaccgtatctcatccacaacctcctgcagttccagccatgtggtcccccatacgcaccaccaccaccaccaccaccaccaccaccaccaccacaggctcttccgctgccaggatcgtacaactttgcagagccagtaggcttctactggccctacggcgatggggaggagcagaaggttcagctcaacagcaacatggttggaatggctagtggtggctttcttcatctggccaatgctgccaactgatcccagcgtctgcaattgctggtgttgtgtggttcttgtggagattccgagggagtgagattttgggtggatataggaagggggtcttttggcttttgctgctgccatggactaacaacctgaacatagataacagctggagtagtgaacttgactatgctcgttacaacaacagtgggtctaagctcaaaatgagcttgtggtatgccccagatatgcttagttgttaattaatggtttattttgaacaaaagtggttcatagctttctaccatgttgtatcctttttaagttcgcgagtaattctgcgacaccggatggcctcgacctgctcatctatgggttcgtggcgcggcaacctatcccgtggctgctgcttcgagcagacctgcttttgttctatcagccggagcctagaacatcaaagctttcatttgcactggctgtaacgagcagcaaatctgagcaacaacgcttcagagcttgccgggacagtactgcagattagaagcacaggaaagacagtgatgggtacaaaagaatcgcacgattttagagcacatcaagcagtccgtagataacagtaaaacgtttgcttttcgtcaccatagattaatacagagaaaaagaaaatgatgtccacagtatcaaatatcacacatttcactgtgtggaagcactcagtttaaacacattctttgtagtgctcggtagaactttattctgcttggaacaaccaagcaaatattgctggcaaagaacacatgaaactaatctatagtctactccacgcagcaaaatggtgcaaatggtagatcttggagagttcacgtctttatggtttcacttgaggaggagactcaccctgcagagcaggatcagatttgacagcatctagtgtcttgaagaactcctcagggagtgcaacaggccgatgctgcggaacatgtttcgggataagtgtgtcatcttcaataacctcgcattcatagtcatcaggaacaccccatgggtcccattctgccatccattaaaacattgtatattaaacaactgaggctgtaaggatttatatcaacaaacagaacaaacatgtccatatacttaaggtaaaagcctaaagcatccccataaaagaaaagttgtgctgtatgcaatatttgcagagttcagacacagacactgtcagagatcttaatcaaggcgttacagttttacttgcttgtcaagccatccttgtgatattttcagaacagacatttaagttgattaaggatgccaatctagtgttatagttttgataatttagcaagctattgataaaaaagacaaatgatagtagacttgcatttgaaaatcatgttttagccaaatggtgcttttctttaaaaaataaaaaccattctggcagttctacaggcaaacatatggatgacagattgaaatgcacaagacaatgtatgcaatgcacatcaaaattgccaaacaaactattcctcataaccaattttgcttctaatattctacacattattcagttgatcgacaaggtctatatgctacaattctctatgtccttcatacgggtgagcttggtcattggaaacaaactgaaccatacatataatgcaacagttcagaatatcacagagcaggctaaacagacttaagaaaaaaatgtttctgcaaagcgcttaactcatgcacccaatctgtatcagttgctaatggcagcaacaggactgatctagacagctatagttgtgcaccttatgtcgtaatcttattagatactcagtgtaaagggtagtggcatggttacgtgaattcttaatcactattaagttgctaatgccatgcaaattataatatacttcctccgtttcagattgtaagtcattctagcatttttcacattcatattgatgttaatgaatctagatagatatatatgtctagattcattaacatcaatatgaatgtgggaaatgctagaatgacttacattgtgaaacggagggagtagttacattcattcatagttctatacaaaaaacaatacactgtattgagatttgagagagcatcgatcagtgagagtgctctggattggtaagatgtgcatgggacatgggtgagtgattatttggttcagcctttttttccccagtcgttcggcatggtatttgtaaagtttatttcaattaggtgtgatgaatagactttagatagaagagaaatgctctacaattacgaagattgtggagcatatttcttcttactcacgcaagtaacatcaccatattcctaattccctctctatgccatatcatgtaaaatggaaacctatgtatttcatttgaattttcacaaaacaaatattacactgactcactgggattctagcaaagaagaaattttaaagcactgaagtaatacaccagtacattactacatgcaatgcatagcaccagcccaacgcctgaactagattccagaccagccagattttacatacatggcactccaccagacatacacaaagcaacagtatggtgaatatggcaatgaacacactctggttaagttacaagcaccagtcagttcacaaaaaatcttaggttagtgaccaaaaggtaaaatggaacatccatgatccttaaataagcgctgaaaaataattaaggcattttactaataggcagcacagcagacaacctaaaaagcattccatccccccccctccccaatcaacaaactggcaaacaccatactgtcaacgctgataatttgccctaccagtgctattaaagggagccaaaagaaaatcaaataccaatcgctacgatgttattgtccacggatcagttgtatatcggatcaaataactggttgaatcaaagaaatgggtagccagtggccacatctacacatcaactaccctgattcttgtcgacagatcagtaggaggaataaggaattaatacaagaagtaactaaataagcgacaggaatggagatggggcgtaggggagggggagaaatgcggaccgatcatcttggcgatgagcttgagctcgtcctgggcctcctcgatgagctcctcgacctggccgcagccgatgcggtcctcgatgcgcttccagtcgtcctcctcctggcagatctggaggcggtggcgggtgaaggactcgacggccttgcggtagccctcgtccttggggacggcctcgatctccttgagggtgcgggtgtagaggccgacgagcacctcccgcgcgttgggcaccacctccagccccacgatccccgtcgtctccttcacggcgcgcgccgcccgcagcgccgccacccctcccccgccgctcaggatccgccgcaggaacatcccgccaccaccgccgtcgtctctctctctacctggtgaggtgcgggaggggtcgcgaccgtgcgaggatgctggtgtggtacgtgcgactgatgagcagcggatggggaattgggggagagaggatggagtgggctgtgggctgtggagtgtgtgtgtggatcatgggctgcagaagcagtaggccgcaatgttgaaatcctgccgagcgaattgcgaattcgagggccgcgcaagagcacccgcaacggtaaagtaatgtgctctttataaaacatgtacatctcagcaatagactgattaatagtaaaccacctcaatagtatgtctacataggtatctatagctctctcatcaattgcctctttttatctatagactatctccaagttagtagatagttttactctctctcttttcatttaatctcttccaagtaggaaaatatgctgacatggatcttttatagaaagcttatagataaccattgcgggtgccctaagggagatttttcaccagaattagaagtttttttaaacagttcaacctatcgttccgattcttagaacctataaaatgaactagaaactcagaaggtagaaaattcagctttttcatattctcagaagctgactactgaccaactggttcttaaaatacctatttattagagttacaacttctaaatttagtttcaaaagttaaatctagagtgaagtagtggagcagcctaaatctagctccacctctttagttcattttgtgagagctttacccaggcacccagctcaactgagtgaagctagctagtctcctttataagagcatctccaagagaatgggtaagtgactctccaagccaaattttagccatagcagagaaaaaatagcctccaacagcatctccatcccactggctaagctatatggttagccaaacactccccccaactagctaaatctagccagccacaaccacatccccaaggctggccaaatgctctccccgctacctcttccgatgcaacggcgaggagtagcagcgttgccatccgttgcagcaccgccgtccctccgagtagcctcactctctctctctttagcactgccctccgccgcctcgaacaggtcgtgcccagcgcccgccgcggtggacgaagtcgacagcggcggcgtcggcggcgtccccataggcgtggacgacgctcgctgctgctgctgcatcggcacgccgtgcgagtggtggaactgctgggacggtgatgagaaggagaagtcttcattcggccgcctctgcaggtcgcaaccgcggcctccgctcggcgtggcccgccccgccgctcgccgcagccgccggcatccgctcggcatagcgcgccgcctccgctcgtcgcaaccgcggcctccgctcgccgctgcctgtcgcctcgccgctgctcgctgaagcccgtcccgcacacccgtcgccgcagcatcagaggcaagtccagtaggaggaggaaggtttatgtatgagtggggaaaatggggtggaagaggaggaagaaggttatagagactgacatatgggtcccattggttatagacttgtaatggagagggtagatagggaggctgttgaagcgagcaacaactttaacttgctaaatcaaatgggtagctggctatatggatgtttggagagtctattttagagaagctgttggagatgctctaagagatggagctaaaactagagttgtgacaaacaaaccctcaagttggctagtctactatgtttaagtttgcatttgtaccatacgatgcacgatagttttcatgcagtagtaatacttcttcagtaactagcaaattacccatgtcatctaatggtataaaaacaaaccggtttgccgtgtttttaagtaggcagttagtttttactctctccgtttcacaatgtatttatattgatgttaatgaatctatatatatatatatatatatatatatatatattcattaacattattattattatgaatatagaaaatgttagaatgacttacattgtgaaacagagggagtagtttctaaaaaacattggctggtttttctagagaaactgttcgttttttttccctggaaggacagggcgaacgatcaattttctagtagcagttacgtgggtgggggaaccactcccttctatgcagagaagagaagataaaccatcgccgccctgcaggttttgtttattcttcttgtagaaaacaaactcgcagataattcttctgctactgcctactggtggagtggtggttctttcccaatctgctaaggtagattgagatccgctaagagcatctttaacagcctccttatcccactttccaagttatattatagcaattttggctcaaatttgcactccaacagcctggctggccaaagtcgctcgcgctggctaaatcgtgggccccacctctattctctctccctcctgtagcctctctcctcctcccaaatccagtgccgcccgtagcattctctccgccgacgccgcccatccgcgccacccctccgccggcgaagagagctccctccctgtgccggcgaagagagctccctccctgcctgccccaccatctgcccagtgccgacgtcgtcgtcctcccggctccgtcgtcgttgtcgccctcacagcgccgccgccgtcgtcctcccagtgtcagccgccctagcgccgccattgtggccttccctcgccgtcgcctcgagcctgccttgcgtgcgcacggatttgccgccaagagcggcaccgacgggtggagcctgagcagcggcggcggcggatggggacacagcccgagcggcggtggggatggggatggggcggcggcggcagatgagagagggaaggggggtttggagagaatgggagaaagatgagggagaaggaggtgtagagactgacatgtgagcccaattgtaataaactcaaaatatagaggacgaatagagtggctgttggagtaaaagacaatttgacttgctaaattaaatggagagttggccaaatagacatttggacagtcaaatttggatagactgttagagatgctctaacctacttatatttaacttatatcattgatatgtggaccctctacccaataaactcacgtatcagtgactcaaagtcagaaggaagaaagtcagagggtcctcttccggctaaggttatatggaactacaaccgaacagatttttagctttccttctctcgccaagaatttgcgatgaactttgggcattgcagctgtaggaaacagaagttcaatatcaagttttatagaatcgtggcatacattgccgacatgagcatacgagattgacccagagaagagtcgatttacagactagcaatcagccacccctactgatatgatattgacaatttcatttccgttttaatcacctggaaagaaacaccaggcatgactaggttctcctaaacaccgtcaagtaaacgctacgttcagtcacctgcaagacaaagtaagaacatcagatggaattaaagaatcttaaaactgaaaaccggctgttaaaacatctacatcttgtcaaaaaaagcaatgcacactcctaaaagaaattttcttgtgcataaccactataggattaatacttctcatcactcagaagctcaactcatatatgctcccatttcaacatgaggtgtctatttaatttctaggagagcttcgaatgcatagagttctctgctcaatctaaagacatgtttcatttccaatagcttgaccagtcaaagagagcggtaaataggctgagtcattcaaaccaaaggtagctagctagctccctgccttctcatcactaaataggctgtattatacactcatttttctttgttatatgcagcatgagttaatttctccttggtcttggtgacaaaagtaataggtctaacacatttggatcgagggagtacttacgttgtatgccaggctctcctatgtgtcatcactcatttgctcctatggcatgaaccgcacctggctcatcccacctgttgggtttaaaacatgtccgtgctgtcagctcctttacaattgacggtttatttaagcctctattatcttatcttattattatagtaccaatatatgaatactgtcacatgtacaatataatctgttttttcaagtgaaaatttcatattgctcagcatcctaccttttttccccctagagttacattgttttgaatgtgatccaggactaaagagatctgacaatgcaaatgatcctacaagatatctacaacgtttaatgctcatgaagttacttgccattttgcatagttttagtttctataattattgaagagatatgaaccttttgactgttgactgatttacattttaattacaggacacccttggaactgtaaatcctttcatctcaaataattttatgtaacgaacaagttggctttgagtgtttcatctacctatatgctttgaggtgatagttgagtgtctttcaagaagagattgttgggttaagcaaaatgctcaaggtagtggacacaaagaacaaaggtgtaatgttagaagataaagcgattgccggcagctactcgaggtctcacgaagacgtgactagagtgacgaatgtagcataatcatggttaattgtttgttattaggatagtattgtttatttcagaacaataaattgtaggcaaattttgctacaggacatcacgattttatggttttagctataggacaccgcacaaacttacttttagggaaaaacactctctaaatgtggttatttgccagtggacaccgcgtccattataataatgtattcgtgctgacgaggcaataggggacccaaaagtttacgcggagtgaccaaactgcccctgcgcgttcaggtgatgtttggcagcagcttcttcccttcctctctctacagctacccaagaacatcttctctcttcctgtctgtttctctctctaagctagctatattcaaatcaaatatcagatttgatccacgataattgatccacaggattgaaaaaaaatcagattcgatcaagtctttcatcctgcagaaaaaaatcacagaggaaaaagaaaaagaaaaagaaatgacgatggagctcgctgccatctccaacacctcatcgtcgctgtcgaatctgctttgcgacatatgcttgcctccgccgcgaggagctcgcctccgccacctttcacttgcttcgccgacgtcccgccggcactctgcgaccagctccactgtagccgttgctcgctccgtcaatcatcgagaacctgcttgctccatcgctactgctgctcccctcgccgacgccctcagtgccgctgctcgctttgctaccgtggcttgtgcgctgggtagggcttggagctgctgtatttggggctgatttgaagctgtgcataccagcggtgcctcctctaactctaggaggcgcgggtggtccggcggcgcccacggcatattcctgcggccgtggcactagatgtcgccgtgctccacctcctccgcctcctcgtcatggtcttgctggaaacggttgaggaggataaagggaggacttcccctcaactaattttactcgagagcaaaaggagcagccggatttggcggtcaagcggcgacgactccgactctgccccgaccagaggtagaagataagcctgacagatggggcccctatcgccaggggtagtttggtcactccgtgtaaaatttttgggccccaatcgccatgtcggcacaaatatattattttaatggccatggtgtccactggcaaataaacacacttagagagtgtttttccccaaaagtgagtacgtgcggtgttctacagctataatcacaaagttgcaatgtcctgtagcaaaatttgcctaaattgtaactacacttcgtaccacatatttgctttataaacctatttacaatattactagaaatcacacatttaaaaattaacaaagatggaggtgatagtcacgcaaaagcacgataaattattagttgtcctgataatactgttaattacaaatcaagataaatttgttaacgttgtagttacacttcctgacaagtatgttctataattgtatatttgcgttgttttgttattgcaaatttaagctaattgctgcaaacatgtaagcatattcaataaagagggaggttatagccacacaaaagaacgactctataggctagttattacatattaagtgcaagaaactatatgtagatgagtgcacaagcttttcatgaggcatggcaatcatccatgtgtatgcaatactattagttgctaaaagactataaattgcaggttcaaatgaataactagatagtaacagcgattaacattcaaagcaaaatgacattcaagtatctggaacagagaaacaccatactcagattaataaatttaatagagctctgcaagtgagtacattagggtaactcagattccagcggagcaatattttaataccttataagccaaaatgctccacttcttcatcttccccttcatcctcatcctcatcctcatcatcctcagaaatcctgaaatcttctaatgccgcctcctcttcctcctcatcagcatcatccatcatatccgtagcacgatttttgtccttcaaaccagtgctgagcacaacagtctgtcctttagagttttccatgtctctttgcaacctttccatgttctccttcctacgctcagcctctaacctctctttttcagcaatcctcttgtcaagatcagccctgaaaagtttttttataacaaccacttatataatttttgctatgcatatatcagtcagagatagcagcactacatcgcaagttaaaacacctgtaattctccatgtattctttggcacttgcttcaatagcttcaaaaaatgaattgactccagcgccagatacggcagatactccaacagaccgcagatttttgtaaaactcatccaggacaagagagaggcttcgggtaaatgtagaggagtatgatgagtcagaatccaaggcggtctgaaacgcctcaaagtcttccatccactgataaaataaacaacataatctctggttacagaagatgtagggaaaaaaacagataagacaattaactaacaggcccaatcaaatttgagcaaatatcaatcaagtgcaacagtttcaacttgattaaataccaaagagagtcgttgcataatgccgataccgcattactgaaatgcaacacttatggtgtccagaatcaacaacaaaggaattagatattcatagatggcaaacatacctcaagagcaaactcatgcttggcaacatcaaccttattaaatgtcagaatcatcggtaagcgggtcttgtacagaatactgcaggcataaagcatgttgctcatgaaagtaacagggctcgttgatctgggggtgtcaacaacatatgcgacaactgttggaaatgtcgatgcaaaagcttctgttatgatagctcctgaagccgaccaagtgaagatttcaatctgccctggcgtgtccaccaggacataatccagctggtcggctcgtctttcaataacagatataacctgtaaagacaattattaggtgttacatatgatcattagcagaattgcatcatgtgtcaaccaaatttatctgtacactgcagtaagcaaaaagcaagctcgctttctgaaccactttacatggaattgtggaaatattatcccatcaacatgataagcagactgcattcctttaacaaatttactagactagtcatcaacccgtgcatctgcacgggctaggggcatattttctacccttatgtttattttatatcattattgacatatttgttaaacattataattttatattatgttgaccatccaacagtatcaataagctagtttgttgagaaatgaccattatttagtgtttccctacacacattccatacagctattagaaccataattagacactgtgcaagcatctccaggtaagaattgaaaagttacctatgcagaaccaattagtagcatacatgcacgataatcttcctataaaccaaattaaattagcattcattacattgtatcttttaagggaacaggactcaatctaggcaagtttatttgggaatctctatgtgctgcatgacaataacacttctaattgaatattacgcgtgtatatgtgaaatcttgaactatttagaaactattaatgaaattgaactgtcgaaacttatcgctgaactcttcactgtccatttctgttgctccctaactaactatcgttgcatacaaactaccattgaagtgattaaattgcctaagtattgcctaacttggtattgaagtacttcctgatagtgtgcattcaagtaacccaatcctaacaaccacttgatctaaacacatacggagatgaaatatatgatgatcgaaaagcacacctcgtcaaacttggtggagaataggttgagagaggtgaggataccgccattggggccaagaccatactccttcatcacctccttgtaccgaacggtatcacggatatctatgttggccccaaacggcagcgtcatcaccgcagggtcaaggttgagcacataacccctcatgtttgaagcctgggtgtggcataccagtcggtgcataaaagttgtcttccccgtccctacatcacataaaccgagacccttgaggcctgagctcccaatcccaaaattactcaacaagagctcattgtatgacaggttggttgccactaaacatcaaaggatgaaccaatcagcatgcgaaatcgatgtaccggccatgccgatgacgatgatgatcaccggcttcttcttgaaattggtgcgctccgggccgatggagaggctcccgatggagtccgcgagctcctcgctcttccccttccccttcgcgtcagtctgcacagggtccatcatcaggggcaaaaaaaaaacagtcacaatcaaaaactgaaggtagaatccccgtggggaggagtcgggcggcggcggcggcggcatgcctggtcctcgaggtccatctgggtgggcttgcccgcggcggctgggtcggagtcgacgtccatcggcggtggcgcggggagaaggcggcggccacgcggcgagcgggtggaggacaaccgcccgctaaaaccctagagactactgcgctgcgactgcgaggagaggagagagagcttgagaaaggaggaagtggccgaacgtggatgggaagggagatggtcagtactcggcagtgtgaacatgctttaaggttttggacttaccgactttagttgacccatgctggcccatcaaattttgcgggctgacccacaaggtttcgtgccggcccatcatctgaagcgccggcccaagcacggtagtggcaaatgagccgtgccggcatgacccacaggctggcgtaccgtgccgtgccgtgcctgggcctaggcatgagggctgaggcaccccggggaattccggcggaaaaagtacaccgaaggtccctcaacttgtcatcggatacaaaaacatcctcaaaccgcaaaaccagatatgaggtgtcccttaactatacaaaaccagtcacccgagatcctttagtggttttgaccctgttttagcctacgtggcgcgtgggacccacatgtgggcttgccacgtcaattcccctttcccctcttcttctctcccttcctcccccctctctctcgcactcttctcttgcaggctggccgacgggtagggagcagacgaccggacggcgaggggggttgagcggcggacggcggaggcagcgtgtgagcgcgcggcggccggcgaagcggaggcgcggagctgcggtggccggcggatggggagcggcgccgggacgtcgtcgacaggcgaggatcggcggggagaaggggtgccaggacgggaggcagctgatggggaggacaaccgacgagcagcggccgacggggagacgggacggcgtgcatgcctatccgggctgccaaatattcgaagcaatggtacctgcggaagatgagataggcaatcaaccattcaattcaccgcaccgaacactgttgtttccaccgacaaaactcgcatggcccggagatcgctgatgcacagaactgtggcttccctagcatgaatttccatgtaacttgggacaggatgattgttgttagcttgcttgacaccggagttggctgacggatgcctggtttcggtctggccacagctgttgcgctatcgaaatctcctactccatgcagtagctggtgtggcacatgtgagtgacttcaggaaaggaggacatggacggaggcgatcttggtggcggcgcaaacggggcaagcgtcaacggcggcctcgcaggcgccgcacaggcacaggcggcagcacggacgcctccgtgacacggcaggccttgcacgacgtcgccccggacaccgcgtcggtggcagtggcggcggcgccgccgcctggggtctcgaagcagcacgactgcgcatcctcggcgtcgccctcccccgcggtggcggcgacggcatagggggactggaggagctagtcgagcatcgcgcggaggccggcggcgacagcctcgtggctcttggcaacgcccatccacgcctgcccttccgcgctcatctggcggagcttctcctccagctccgcgttgcggcagcgtgcgcgatccagcttggcctccgccgcacgcgtcctccctgttgtggcgcgcgccgcggccgccaccagcgcccggacgtgccgtcgctgcgcttcctccaaccccgcgtgcatccgctcggcttgcacggcatccaccaaacaccgacaccgattaaacaccactcaccaaacacaaacagaggaggccggcggcgtgagcgggtgcgtggcctcgtcgtaggtgaagaagagcgaggcgttggttgtcgggatgggaggcctgttcccacgtcgccgccgccaccgcgtcgcctgtcgccagcctagagagaggtaaagtgagacagagagtaaggacgaagggaaagagagagatagtgatgacgtggcacgctgacatatggggcccacgtgggtctcacgcgctacgtaggccaaacccggggacaaaaccactgaagcaactcgggtgaccggttttgtatagttaagggatctcgcatatttgtttttgtggtttgaggacgtttgttaatcccgatgataagttgagggaccttcggtgtactttttccaattccggcaccccggttctgttcccgtatggggccgacgaactgagcggatctgccgggaagaatcgttgggcttgatcagacgaagaaggcccaaaatggaatggccgggcccgtcaggaggaaataaaagagacatggaaaagttcgagtaggccccgcatatgctcgccgaaataggaataagttcacttcatgaccctcaaatgtgatcgaaccctaaaccacaaaaccggatatctcgacccccaaactcctaaaaccggtgtaatttaaccacctcgacggttttgttaacgtggcgtctacgtggcgatattggtcttcgttccatgtggcgttgacatggcacttatgtgacagtagaattaaaaaatatatatggaaccattagtcattcaaaaaaaataaatgtgggcccactgacatttgcttcgttcttcctcctccctctctcccttctctttctttctctccccttcttccccttcggccggcgggcgggagggcaacgagagcgagcggcggcgggcggcgacgaacgcgcacggcatcattatctgactgctccccaccacgcgcacgtcgccggcggcctcgcatgtgtcggagcggcggctcgtctcgtagcacaccggcttggccccatcgccgccgcccggtgggcttcgccggagcggcgacctcctccgctgcagcatcacgaggagaatcagtttaattagatctggtcgcggaatctcgcagccgaatccacgccattctttagcgcaaaactccagaaagcccaagaaataaattatgaaccaggatagcaactcgccgggagaaaaaaattcaagaaataaattatggatgcttcgattccttttcctttttttcttctcctctagtccttgtttgaactaaagccaaatcgaaagaacggatatgaaatcgccaagaacgaatcagccaagccagctcaagcaatgcgctgcactgcgccgctcacgcgcgagcagatccaagaaacacatctcgtaattaccagctgccgacgacaacgacgaggactagtcgccggattcggtgttgacgacgacgtgattggtggtgacgacgagcttggattcgtcggccacgagcttgagggcctcgcctccatcactagctgcgaaggagaacctccaaatcagctctcgcctctcgccatagcagcatccaacaaaacaattaacagcggcggcggcggcggcgagaggaagaagaggaggatgggggagaacctggcgcggatgatggagagcgcgatgagggaggagagcatgagtgccaggacagccgcattcctcagcctcctcctcggctcccctcctcacctcgccgagctcctcggcttcttcttcttgcctccctttctccctctcctcagttgccgagctgggaagctgagctgagctgagcaggtgggtatggggattagtagcagcaccggcgagaagctctcctcctccgggcggtggtggtggcgggcgccggagatggggagtaggattccgggctcccagccctcgcctgccctcccgcctgccgccgcagttccggcctcgccgcccgccgccgctcgttctcactgccctcccgcccgccggccgaaggggaagaaggggagagaaagagagagaagggagagagggaggaggaagaaggaaagcactgccacgtgggccccacatatcagtgggcccatatttctttttgtgtgaatgactaatgggtcccactcatattttttaattctactgccacgtaagtgccacgaggaacaaagactcggtcaatattgccatgtaggcgccacgtcagcgaaaccgccctccaaaaccgccgagggagtcaaattgcaccggttttaagagtttgggggggggggtcaagatatccggttttctgatttagggccatggattagatttcgatcacttttgagggtcacaaagtgaacttattccgccgaaataatactgttgttccggggtaccacgcgctgtctccagaatcgctaattctctcacgcgcgtatcaggcccagaaggcccagtgccggcccgctagcgcacgcctcccacgtcttttttttaccgatatttttcttttttacccacttttttctgaatatttttttaatcttttagcatgttttgagtttgaaagtttttaaattttgagctgaaagtttttaaatctcgacttgaaagttttcaaatctcaagttgacagttttcaaaattttcaaatctggacttaaaagttttcgaatatcgagttgaaagttttcaaatttcgagttgaaaatttttaaatctcaaattgaaagttttcaatttttcaaatctggacttgaaagtttttgaatctcaattctcgagttgaaagttttcaaaatttgactttagaatttaaaacttaaatcgaaagttttcaaatctaacttaaaaaattttcaatatgttagtaaaaaaatctccaaaaaaaaatctccagaatctttcctaattactatcattagtgttaagtatattactaatagaggtagttaagacttaagaggggagtgctcgctagcgacacgcacgcgctagctaggagccccccgctgtctcgccatttcatggcttagtaacatctaagaaatatcggagtgatcgtgatcggcgtcgaaccaacatctcatgaatttttgcaaatcatgaaactttaagcatgcctttaagcattcccatcgacgtaagatcagattaaggagttaattactactagcaaatagtattaggaatgacctaatattaaataattaaaaggggtgagactttaaacccaggtcgtctttaaacccaggtcgtctagcccatcaccttatgaagctagccagaagactaatggacgtttttcggagttaattagtgctagagtgcttaaagttctaaaagtttaatatgatcttacatcaaaattttatgaccaaagggttcgttgtggttggaggaagtttgtaggacggattaagggtgtctttggcacccctttttctcaacccatctctctcgttttccacgcgcacgcttttcaaactattaaacggtgtactttttgcaaaaaagtttctatacaaatgttgcttaaaaatcatattaattcattttttaaaaaaatagcaaatacttaattaattacgtgctaatggactgctctgtttttcgtgttactattccgggttgggaaccaacatatgcgaacacaccctaagagttcaaagggatgggactattaatgattctgtttggttaggagacttgagagttttggtaggataagatagagaattgagggagtagggatggtaattggaagcaaaatccttaaatctcaaccattcattttttatttaaaatttaatcttcaataaacttcttatcgagtcccgccacctctattaaagaagaggttgagactaaaaattaaattttcatgttaatctcactggtcactatcaatttttggaatgattactggctgctaaacaagcctctctgctaacaatttcaagccctgcattttcactctatgcacaaacttgtctctgttgtagtgacaattcaaatggggctgagcgaatcctcggtgccacgcctttcttcggctgtagagcagcaattgacacgccgcccaaaccctgacagatcaacaagatctcaaaaaatagctgtccccgatagatttactggagctctcaccaccaagcaagcctatgagctcctgctaccttcatctcaaatggacaagaactgccccccccccccccacccccgaagatacatttttttgttggcttctatcaaaagagcgcctaccaacaaaacaaaaaagaacctgcatgctaagacaattgtctcatccccaacttgtgatatctgtggactcaacgatggaacggccagccaccttatacctgctgtgccctttcacctgcaacttctgggcagccctctttattgaccctggaatctctgatgtacgagatgtcggctgcatttgccccctgcaactgcaaccataccggtggcgcaccatcggaccttcttttttttttttttgagaaccatcggaccttcttcttgctctgctggtggtgtatgtggaaccgctgacacgatgtcatcttcagaaatgagcaaccttccctacgactactccttcaacgctgttttgatgaagctaacttgtgggctgagcgtatccggcgccctgatcagattgtagtttcagcctggaaagaaattttctcccgtcctatgcaactccaacatatgtaatggcaacggcactgtcgttctgcccgtcccatataaccctctttgtaatgaaacctcttatcaaaaaaaaattcaagtggggaatctctcctatccggtgattatccaaaaaagataagtgatcactatcaattttcttccctcatgttaccaaacaaatccggaatttctctttctacacaactgtttgcgtcaacatatagatttacggtcaataattctaggcagcaagcaaccagccaccaccagcagcatcagcagctagcaagttcgcgatattcgcaagcctgccagataatcgtgcccacgctgccggcgaatggacatgcatcccttgtggcaaattcggcgtgcagtggatatggatttgcccacaatctctgaatgcaaccacctgaacagtcaaataaggtctgcaagcaagaacaaagattctttgcggccggcgaacgactttcgacggcccggcgagaaataaaagaacaaggattttgatactacgctcctgttttggctagctgtttcccctgcaagcacatctctccttccccatccactcatctttataagctccaaccagcgaaccgaagacacaacacgcatctaacatctgtacagctactcgtactagctaataacttgtctgtgtaattggcgctatggcgttaagcaggagaacgcgccattgcctggtattactacttgtctccttggcattgctcccactgggcatggctacggatcccattggcggctactgctcggagtcggggacgagcgatgctgaaattaacggcaagacgaggcggcgcagcatcaactccgtcgtctccgacctcgtcgccaaggcggcctccaacggtggctttgccacgtcctccgccggcaagggcaacaacgtcttctacggcctcgcgcagtgccgcggcgacgtctccgccagcgactgcaaggcatgcctcgtcgaagccgccaattacaccctctccttctgccactatgcatcggactccaggatgtggtatgcagctacgctagctacggtccagtgcgtcaatattcgacagattttattccacttaagatacaaattttacatcagttttcatcaacatgttttttaaacggttgaatgatatattttatgaaaatcttttctatataaaaagttgcttgaaatattaaataaattaaccatgtgtcaattggtttcgttatttttcatgccctaacattgggccggttcattttgatgacattttcaaccttatcaaattttggtaatgttgtcaaaaagtggctacatttagggcttgtttggttctttaccctaccaattcattggtagtaccaaagtctaggcaaattttggcactaccaaaatattggtagggccaattatttagctaacatttggattgctatcaatttaaagccaaattcttatagcatagtgaagaaacttctagactatgaccaaatattttaggggcactatcaaatatttggtctcaatccaaactaacacacaaactattcaatttgccaataaattggtagggtatgtttttggcatcaaaccaaaacggcccctagtttgctgccaaattttgataactatataaaaaatcctgccaaaattttgacaagttaccaaaattttggcattatcaaaatttggtaaggttttttttttcatcaaagtgaacatacccgtcatcttcatcttcattaaaaacaaatggtgcctggctgcgttcttggttatacattttacgttcaattggctgttgggtaggcttttcgattccacgtcaaataaaataaaaacattagcacatacttaatcgagtattcatgattgctaactgaaaaatgttatttaatttacaagtagccgttccaagttaccgtttaaaactcagccttttgccgtaggctttaatatggtactgtatctttgtcccgtgaataatttacttcctccgtttcacgatgtaaaactttctagcattgactatatttatttagatgttaataaatctagacatatgcatatgtttagattcattaacatctatatgtatatggacaatgctagaaagtcttgcactgtgaaacggagggagtatatatatactgattcaagtttgctcttttactccctccgtactaaaatataagagatttacgtgatgagaaaactatatgtatgttccttttagtgacttggtttgatcaaattgcactaaaaattttgcttcttttaatctataccttctatatatatatttggtacccactagcaaatattacaagctaacacttaatatagaggtattccacagcatcgcctattaaccagtactgacggagcgtggggcttctcaccgggagaccgcgcaggcccccctttgccggttcggccgggggcgctaagtgaggttcttcgccctcgatctgaggaacgtcagcgagagagaaagtgcacaagacacgggcgacgtagacaggttcgggccgctgagaagcgtaacaccctactcctgtgttctggtggatctgtgcgtgaaggaataccgagagccccccgcgagagggagagttcaggctctcgaaccccctccttttaggcctgggcctcctttttatctgtcaggggtcaccacaggggcctctagctgcctaagaagggaaacatgctttttacaatgagggctagtctacagccggaagtgacctctgacaagcagagcacgcgcctcctgccccgctcgcctgcttttccggtggacgcccatttcaaccttcatttaatggccagcgacttccttgtcatacttgcgctgaagcctggaatggatctgaccgggactgacataccaactccaggagttagcacgccggctccggctagggacaagagccagaaagctcttatcattccgacgggacggggcgaggcgtgtgacaggccgcctgttgccacctaacccgcgatctgaccgatctgtgaccggtcacacaccgcgactggtcacggaccggataagcgtgcgctgcgccgcattgaatgcagcgtggtgcgctcgtccaacctgctataaatgcggttaggtgagccccgctgtgctcacctaacccacacatgtggcgccaaaaccgcagggggtcggggcgccccagccctcggggccgaaacgggggcgccccagccctcggggccgaaacgggagcggtccgacccctcggggagacagagggaggggtggccacgtcatcctcgggcccgacccccccgagggggtcaggccacgtgggtgaccgcggctatccaagcctctagtcacgatacccccagccccatgtcaccgacaagtactattctagagtataatattgtagtgtttaacatgtaaatatgtcaaatcatctttctcacatcattttcacaatatttcaatattcattatttatataatatttaacatatattcatctatgcgtttcgcagcaaagcacttggtatcacctagtttaaatataagaaggcctataagattttcttttaaaaactacgattatgcacgactgttttttttatgacgaacttatatcatgtgttgtgtgtgacgtacatacatatgtaatttcaggtatgactactgcttcatgcggtacaagaacgccaacttcattggacaggtggacacgagggtggacgccagcgtaagaattaggaaagaagaaaacatggacaaccctaagacgttccaaaaggtggtggcgaagacgatggacaaataccccaggcggtggcgaccgcggggagtgccgcattgggaagggtgaaggaaaaatacatgacgtttgtgaacatctacgggctgtcgcagtgcacgcgggatctagcaccgctggcatgtgcccaatgcctgtcgacggcagtgtccgacttcggcgacatctgcaacgccgcggagggatgtcagatcgaatacagcacctgttgggtgcgctacgagatttaccccttctattttccgctcaagactgacgggcgagccaccactgacatgacgaagtacaccaaggtcgttgtgcactgataattaagtttacaactagttatgtaaaggattatgttgtaacgcgtagcaatatacatataattaatttgtgggtgagatcttatatgacctctttgccacgatttgaaatggttctagagttaagtaaaaaaaagttctagaggacgaggtctcttataattctttgatttttcttgcacattgtctacctcccgtgtttgagtgtctcctctcctaagaccccaaccactactacacatcgatgtcttgctaacttcatgggtttttgttcaacaaaaaacaaaaacctcatgggttttaactgtgactctgaggccgtggatattcgacctgcccgttagtaaaaccgtgctctgggcccaaacatacaggcttcacacctgtgagccagcttgtcatcccgaatcgccgtgagacggtgagagtgagagggggaataagatcactttgactcccttaactgaccatcgaatctaaatcgtatccctcaactgcaatatcagaaatcttgacccccgaacttgcaaaaccggtgcaatttgactctcctggtagtttagggcggtttcactgccgtggcgcacacgtggtagtgttgacctggtttttgttccacgtggcattgacatgacgcttatatggcattaaaataaaaaaatatatgcgggacccatttgtcattcacacaaaaataaaattgtgggacccacagacatgtgggaccgacatgtcatcttctctctcactacccttcttcctcatctctcccttatctctctctctctctccccttgacatgagtcggcgacggcggcgagcgggtgccggagtggtggcagcggtgggcggtggacctcgggcgacgagcgtgggagcagctcctccctgaaatgggcggtggacctcaggcgacgtgcgacggaatgcgtcgggggagatgggagaacgctcctcgtcccagctctgtgtcgtgggcagtgagttgggtggcggccgcagcgtcgacggcgaggtgggcggtggccgcggtggaaagagagcgatagctcgctgttaacagtgaaatttggtaatcggcaaagacgtcatcggcttagaatcattatcggctgcagcatctcggaatcagccgatgggagttatcaagtcgccaatagtcggattcctgctatattcggttaaggaaatcaatctactaaaggaagcttatccctaagtgaccgagtttaaagaggatgcggtatgtcagtttatctattaattaggaatagtttgttagtttccttttatctttaggaaagtgtgtttagtgtccgataaggactttatcttttcctttttagtttctttcttgtccgacaaggacttgtatcaacccatgggtataaatatgtacacccggggtctatgtaatctatctctatgaccaatacaattcggcgcatcgccaccttttaccttttctactttattttatcgcccagtgggacttggcacccgacgtggggctgcatcgtcttcgatctccggcgaagggataagtccaatgttccgtcggtccaggcaattgtatcgtctacgttggtgtcgttcaaggctgcatcagtacattcgacctcttggattactctgctttggataatatatttgcctacctatttatcatatgtctctgttaatctagtcttagcatatcaatttagctctatcggctgcttcccgttttagggtttctgccggtatcggctaaatcgcgttgctagattagattagcttagacatctaccaccctgaaaactcagtcaacggcttgattgtctagatattatgtttctttttatacttagtgctgcatcagttaagtttgatctactaagtcgtgcttagaaccataatctctagcctgcttcttgattgccaataagggtttcatcggggtttcagtcggtgagttatctagacgttgcatcagctcataaggattgcatatacatataagttggatttagccgatgacaacaaaggcttcactgtttaatctagtcttgtggatttcatgacatcggacctccagccgatgtgtgctttgaccttcggatcgatgtttatttatcatatcattatttgctgattggtttatactggactatattattgttatattttattatcggtagccgattgcctttataccattatctacattggacgtatagccgattgcttaaaccctatcgctatcagctggtatcggcatcggctattatcggcatcggcttgtcagctgatcggctgttttgatctactatttgcatatcttgtcagttgcaggatcaaactgactggcacgcccgcatctcaacaacctttggacctgcactggagctaagcagatctcccaggctagtgtgttcgattttttcgtcaacactcgcgccccccaatgcgcggtggcgaactggcctcgagcgctccggcgtcgacctgaccatgatgcgtagcgacggctggagctcctcctcctcctccgacacgggccccctccccaaccacgtccgtcgcgagaccacccccttcttcctcttggacttgccgccggccgcgcccgtggcgacctcgcgaaggctgaggaagttggcggcaggagcagggggctcggtggccactagggcggcggggttctcgcgctcctcctcctcctcctcatcctcggtgcactcggtgtcctccgccgtgcacattccttcgtgccaccgctccctgctcgctccctccccgccgcggccgccccgcgccatcatcgctggaatcatcccgctcgtcgctgttgtgccctcaccgccacacccttgctgagcgctgccaccgccgaacctgaatccctgctactgcagcagcggaggcggcagaggcgacgcgaagactgtcggctgccgctccgtccatcgcccaccgtcgccgccgccgatccggacgccactccccacgcacgaagagaaagagggagagatagagaagggaggaggaagaagggataagagagggtggcatgtgggacccacatgtcagtgggttccacaatttttttttggtgtgaatgacaaatgggtcccgcatatatattttttattttaatgccacataagcaccacgtcaatgccacgtggaacaaagaccaggtcaacactgccacgtgtgagtcatgtcagcgaaaccgccctccaaaaccaccaaaggagtcaaattgcaccggttttgcaagttcgggggtcaagattactgatattgcggttgagggatacgatttagattcggtggtcagttgagggagttaaagtgatcttgttccagtgagagggaaatcacatgggctgctcaccgtgtgatgatctcatcaggataaggcccaggataagttactcggaatgctcgtcttgaatgcaatatattgggaggccatggaagtgaatttttgtcccttgaagggacatcttctcgttttatacatgtcgttaaaaaagttatcaaaaaaataaaaaaaattattaagatagatcaatatatgatatatcttgccgcaaacatgcgagttaaaattcgacttatacaattcgaaacaaaaataacaaatttgaccgtgaattacgcgttcaattcatagtcaaatttgttatttttttgtatttgtataagttgaatttgaattttcatgtttatgaagtgacatatcatatattgatatatcgtactaatttttttaaaactttttatgactttttaagtgacacgaggggatatcccgatttgagttttccaggaggccatgcagaatcgcagatacacatataaaaagaaggaaacaatgaaaacgcacagacatggttaaaaatgcataataaatgaatcaaacaacaacaataacaataataaataataaataaataacacaatttttcatactaggaaatctggtatacggatgaattggactgtactatatatatatatatatatatatatatatatatatatatatatatatatatatatatatatatatatatatatatatatatatatatatatatgtatgtataggatcaggatgtgttcctgccgaccggccggttgatcgacccatgcatggacagaactgatcaccacacgcatatactctgtcctgcgtgtaaaccagctagcatgaatgtcatatgcacatgcgcgcgcgcgcgacgccgcgacgcccgatcactcctcggagagcttctcgagcagcatccgcatgagcttcacctgcacctgcaggtcctcgatgtggctcgccgcgtcctggaacagctcgccgagcccgcacggctcgcggcggcagggcaccagcctcctcagctcccgaacctgcttcaccagcctagggtcctccaccacgccgcccctctcgctcccaccggccatggaccgtgccgccgccgccgccgccttgccgctatgccgccctttcatcctccgatcctcctcctcctcctgatcggctctgctcacagcttcttcagttcttctcttctctctcgcccagcagcgagctaacgaagcaggagcgcagcagccagcgaggacgggagaggccggccgcatcactcttgcgcagtagcaatgagtgcgcgcatatatagccgcaatctttgtttggatatatgcacggattgatacgatagaacgtgcaggcgttagctgatcgatcgatcgatcgatgatgatgatgatcaatcatggcgttgccggtgcgcctccatatgcgcatgtccgtggccgtcaccgcgaaccacctacaaaaggatacgagcgcggcttattctaatggcgccgttgctgcggttggccagacacccgccgattctaatagtgatcctagctaggcaagcaacgttctactactagtatattgcttcgcgccgcacacactcgatctctccatcgatcgatccgtcggccgcgcccggcgccttcgcagaaactaagcagctcagctggccggacggacgacggacggctggcttgcacttgcatgtcagtatgctgcatgcatatgcatgcatccgcttggtgtagctaggcttgtagcgtagtgtatagctaggtagccaccagttttaattcattcgctcggcgttgcaacgagaggggaggtctctgcacatgcacccacatgattcgggctatgcgcgccacgccgggccaacaaaccgaacacacaccaactcaggcatatgaatgcaggcattcattcatgcatggtgcgtcaatcgctcgcctttgtgcctaactagcgaagcgagcgatccgtacgtggcgcccgttcgtcgctgggaacaccctggattattcgcccgcctactgcacctttctgttccttgcaccgatcgcgagtatattttagcacgttaggaaggaaggcttgggatgggctccttgggatgggctcctaatcaggtagccctcatgacaccgtcattccagctcagtctgcgtgtactgatcatgtagtgcagttttagagcgagctagctaggtctcttcttgttgcaacgagagaaagagaaagggaggtggtttatattagctggccaattaactttgctgtgcattattggacgacgtctgtgctcaccttccggcaaactctaaacatactgctaatataagtgaagtttcgaagtcatcatgttatgttcggaaaaggcaaccggttgttgagttgatcataataatttgggccctgatttttagctgattctcaactgaccaaaggccatccagaagcatcggcagggcagacattagtatttcgcattccgaatgcaagaggataaagaaaacactacttcatttggtgccggttgagaaacctccatatatagatgtcagatatcccaacaggcgccatggaggtagtattgatgaggatgacttaaaggtgggtgctggtttaagaaccgatacctttgagttatatggtttgcaaataaaaaaaagccagctcggctcaattcgagccgaaccgatgcttcaaagcaaaaaaaaaaataaatcaaaaaatctaacaaaaaaaatacaagacacataaaagaatcaacatttcatagatcacataatcaaatattcacatcagagaatcaacaagtttgtggaggaagataacaaaatcaaatattcacatcaaagaatcaacaaatttgcggcggaggagccccagcggtccgccgtggcaacgtcacggggtagcaggagcgccttgaggagcagtggcgacgagcgaggcgaggacggcgacggccccgtatggccggtcctggggttttggggccctaggacaaaaacttatatagaggcccctatatatatatatataaacataactaatatatgtatatttatatagtcttataaacacacaacattcgatgtgataaaattatctatatataacattttaaaaaaagaaataaatagcagtaccgagctgagaagacgaccggcgaacgatcgacacgagcgtggctactggtgaaccgtgattctccgacttgctgtttccgtttgtgagacaccgagaagtcgagaagtcaccgagagcgcaggagcaacgagcggcgtgatgtgatcaaggcgacatggcgagtggcgtgatgtgatcgaggcgaagcgactggagtcagatgaagagatcgaggcgaagcgactggagtcagatgaagatcgcttcggctttgctaaaataggcctgacgatggactaaaatttattttctgtattggactattcagttgtctagcttaatatagacctatgacccatggactagaattatccaatacgtagtatatatactatatgtgtataggggccccctagattttgggggccttgggcggccgcacggcctgagccccctccccccaagggccggccctgtggccccgtgacgcaagaggcatggttgacggtgacgggcgccggcactcctcctgctccctcacacgacaaggacgacggcaccgcgttggctcggccacatcggcattgtgctttcccttgtgagggcgctgcagcgtcagcgtgcagcgaggggggcgaggatggcaacggcgccgtggcgcaggaggtgtggttgacggtgacgggcgccggcactctcccactcccccacccaatgaggacaacatcgccgtggggtgcccctacgtcggctcaaccccgtcggcaccacgcttccccttgcggctccgttggccctggaggcagaagggaggaggcggcatggtgaattacgactagtgatttagggaggagaagagacgagaagggaggagaggtgagggaggtggtggcttgggaaagaggaaggaaagggagaggagcacgggctggacgagaaaggaaaagaaggaagaaaagagaataagaagaaagcgaagagactgaagagacaaggacaggaggacgggagataggtatctgttgtattaaaaaccagcacttttaccttgtataaaggtgtcgttttttaatagaaattgacacctttctttgacagaaaagataggtgccggtaccatttaaaaaccgacacctatttataaaaaaggtgtcgatttttgccattggcacccttgcgagtgtgcgtgcgtgtggaaaaaacattataaatgtcggtttagctattccaaccctatagtgccgtctcctttatggctttcttagtcgtcaaatgacatatgaacattatatatacataactgttaaccttaaatgaagaacacattaaggtggatttatgtcgtatcctctaccattttaatccatgttatgatttatattacccttcttcttcgatccagctccaacgagatgacgatgtctccgacgagatggcgacggtctgatcagtttgagtttgtggttagggttaggatgagagggattgcgaaagaggaaagaatattgttggccttaattagagggatgtcaatcagagatggtggcgtggtagtgggagaggcgcgcgataccaaagccatgggagatggatgccaacgatgggctaggtaggcaacgggatgagggatgtcgttcggtgcggataccaatcttcaaaggaacaaattattcattgatgtcactcgaattacaaaacttctagttatgtacctaatacagaagaacattcagtttaattggtatttaccgggtatttttgcttaagccgaatttgagttcacagctgagcgtggtgttgcgccacgcattctcttctagtgtgctctatgcctctagttaacatataagcttataagtttcaccgcgttagctagtactaggcttttgtttgtcaagcttgtattagagagacatactcatggtgtatgtaataatgtgtgacaacgaaacgggcatatgtagacaaaggctttgcccaatgaaattattggtaaggagctttaaatcactagagaagtatggttcaattttcagtagcatcggaaaaaaaatccaaaaaggaactcccatcatacagcacatcggctttgcaagaaagccaatggacgaaacaaattaaagtctgacaattaacatctccgattgaaagatatattgcaaattctttgctggataatactccatataagaatgttttctaagggtcagcgttatacgggtattcccaaattacgcttctgttcaatgtatcatattttttttctagctatagtatacattatccttgtactacgagagatggctctttgtgcttccctacaagaaaccagtgatcaagtagcttatgattatgctccaatgatgcccccttgcatgtacatacgcgtgcgaacttgacaatgtctacgtaaacaaacagctgcagagttatataatacctagattctcattgctaggataaggatgtgggtgggtgatcatctcgttgcaacgaaaatatagtttagttagtataagagctcaaagaggcagcatctgtag

SEQ ID NO: 70412 - DNA, 1547 bp, Oryza sativa
attgattcaattccaacggatttaaccggaatgtcatttgtggtttgtccatgctcactccgggatggcgacgagcaccggccgccacggtctcctcatcatcagccgccgccggagcccgccgaacatgaaccgccgccggcactgcacggccgcaccatcacggccgccgcccgacgacgtcgtcaccatgccgtgcgccggccgagccatcactgggtgatgcagccccggtggtggtagcacgaccaccggcgcctgaccatctttcttggcgcacagcgacgcgttccggcaggtcacggcggcgtcgtcgatggcgccgtcgtcgtcggcgtcgtccgacaccaggagctcctccaaagagcttctgctggtcaagaggaggctgctcttctcgccgtcgtcctcctccccggcagccgcataatccggcctgtaactcttgcggcggcagcagagaaggcggcgcacgagcacccagaagctcttcacccttggcctgtagagcgtcgtcctggccatctatcctccagcctccaggtcgctcctgctgccgatctcagctaggacagtacagttatatactactcctagcagctagctagtagtactagtattctctctcacttaatttttcagctggttggtagccctgagatactgttgctcacttggagatgatctgggattctggagctaatcctcgaattgtgctttaccgtctttaaaatttgccatatggaattcttttattattcctatgtcatctgtccgtgctagacctcaacttcaggaataatgttatcacgccacccctgaatgtatagcttcacactttcttagacacctttcttatgccaaggtgaaatctgtaaaatcagtcatgaaatatactgtattctacgtgacgatttcatagtttaggagtggcttgtgagagccgcaatacgcagcaggctgccatatggaggctacgagaggaagacgcgggagttgtctgctgatccagcgtccaaaaagaaagaaagaaaaatgcgcgggagagtacgtcgcatcagcatcaccgtcaggcgctaactgcccgggcgctaaaagacgcgcgaaatttggtgcgatactgttcgaatcatcgggggagtctccccctctgcttattacaccagtgtatgcatgtcatcttcggatcccagtgagatttggacgaaacaaaagcatcgatttatgcgttggggggtgatggggtgatttgacgcgttcattcgagcaagtcgctctgtgactttgttcccatgtgacatgggaatggtgtgtcgtcttaatgaaagaacttgtctgataatgttgaagtggggaccatggaagatgtgcttagtactattatcattatctacatggataaaatcactgatatttagagatagagataattgtacaatatcatagtccactatacgtgaacaaaatcgaaaaaggcaagctcgcaagttagcgaaatagtgaaaactttatcctgtaattaaggcccaccaatacctcttctccca

SEQ ID NO: 70413 - DNA, 623 bp, Oryza sativa
tgggacctgcaagaaggcaaaagtagttttaaataccagaagacatgatactgcagctgaaatgcaagcaaccttgaaaacaagttatttgttccatacctagaatggatgtgatcattgggaacacacgagaagacattttggtatatcttggtgtttgcctgccatacaatatcaatttgttcagttagagaatgaggtaaatgtgttcacagcggtataaacagaaaatgcagtggaaaattatcagctgctgaaagatggcaaaagttgagtagaaaacagtgcaatgccagaacccagaacagtcatattcaaaagtttccaggttgagcagactagcatttcacgataaatctcaatttcactcaccttagcagtgcccatccagatgttgttataagtcaaatcgtccacaggatccataatttgactaacctgttaaggagaagtgtcagcagaaagaaaactcacaaaaatctatgttgtacatgcagcatcaataccgtaatgtattgtgaaaacaatataaatgcttctgtcaatattctttatatggaaccattcatcaagtggagtttacacaggacgttcttctactgtggttcactgaagcaatcaca

SEQ ID NO: 70414 - DNA, 17248 bp, Oryza sativa
gaaagttttagatttgtattgaaggtctttgacatctggctaacttcgtctatgatttgccggcctagtgaaaaggccataatgttaacagcacctggcccacttaatcgaaggcgttgtaatgggcctagaagtaagtccatccagcccacggattacagcaagcgcttcaaagcgccgccgcgtcgtctccacgcctcgggcctagggcacgcgccgactcgccgccggggagaccgggcggccggcgaatcccccaccccaaaacggaggcgaaatttagcacgggctgtgcgcggtcgagcgtccccggactcatcggcgtggagagacgaggacgccgcgcgcggcgcggcaggttagatttggatccgcgcctgccgggggatcagacgagaatcggttgcatctgccactgcattcttgcagccaggtacgctttgcccgcaattccaaatgtttgtgttgcaaattcgtacatgcagttcataggaaaaaggggaggaatgcttgcaaaattgcaacctctagttagggtaacaatgggatgtgttctccctgataccactcgctaacctgaaatcatgaacacactgaacactagattacacgagattgtttgaaccctgtatttctcctaccgcattcaccaattgtctgaatttctgccaagctcatagtcaaacacttgtagtattaattagtccatcaaccaagaggggacaacttagttatccttatttcatcagaatcaatacaaagtttctcatcatccgctagagtttgatgctaccgagtggttagtagattggctatgaaatctatggattactgagtcaggcgaatactgtaggctgtccttcagcagatgcgaatcttcctttggagacgcattcttgttcatcttttccgctggacattccccgttcttgatacaattcaggacctccactacctccttaattggtggcctgctctctctgtccatctgcaagcactgaaaggccagctcggccaccagatctaccatcctctttgtttcactgtcagtctcatagccgatctctggatcaaccaactgatcaacttcatggttctgaattctgttgagagccatgttagccaagttaatgtcactgtggctcctggacatgtccacagctggttttgaggaaattagctctatcaacacaacaccaaagctatacacatcactcttatcggttagcttgtagcactggtggtacactgggtcaacataccctggtgtgccctgtggaacagttgatacatgggtgacttcaagcgggaacaggcgcgatagtccaaagtccgcaactttgacatggaagttgttgtccagcaatatgttgttggtcttgacatcacggtgtatgatttcaactgcatgaaggtatgccagtgcctcagccgtttctatcgcaattgtcattcttacaggccatgtgaggcctcgttctcctgcacggggtccatgtagatggtctgcaactgtcccatttgggatgtactcatagaccaagagaaggtcacggctagaacgagacgtgcagccatataggataacaaggttctggtgcagtaggcgggacaaaatgtctacctcatttaggaattgctctactcgtctgtagttgttcttgtaaaggcgcttcactgcaactactctcccatcccggagctttcctgaatggcagaaaggaagaattgtaactgctaagttaataggggaagttatctattatggaacaaagttcaacggagcccctgtcgcatgcaattaggcatgctaatgaggaagtgattagatgagaaatctattaacaacaagggagttgtgcaaacatattctcctacctttgtaaacagttccaaaaccaccatcaccaagttccctcgaggcactaaatccagcagtagcctcttcaagttcctcgtaagtgaatatatggggagaaccacccaactcaaggtctttgctgtatgattgcattgaagatgaactatgcatgagatctttcaaatctcgggtttgtttcctcttcttgcgtttgtgccaagcaaaaatgaatatagatacaatcaataatattccgccgcttgatccacatgctgcaataacagagacagagcactatcaatatgtgagaaccaaggatctgaagcatatcttcataattacattttgaatggttggggaagtccaagaaacaagaatgaattatactcacctattcctattatgtgactcttgcttcttgaacctgcagaagaacagacttttaataccttgcacaaatatgccatgaacaaatagaatgatcattcataatcacattgttagggtatcattgctcccctaaccccctgttgaaacgaaggacagtgcttatacaacttttcagcctaattcaacagaaatacagatgcaatttatgctttccacatgtttggaacacactaattaaggattagaaaatgaaagggtatttgctgtcaatcagatgagggatttcttcgtcagtcagcaatcagcagaagaaaaattggaacatggtattggtatgatatctttatcagatagtgtagttgaatacttcaaactacacgtaacacgtttgactaggattccataagctgccaaatgccaatgttcccatcagtgaaataattgtttgatgagaaactaacaaccaaaacagcaggaacttgaagcaaacactcataattcaaaacaaaaatatcaatatccactttgcattttatattcttatgaacattgctgtgacaatgctgtgtttaatttctttcctcgatagcaaaactagatgtcacgcgcattattataataagagtttatctagtggacattaggccacagtagcatggaaatcttcctgtataacgaaatgatgtgtcattcttttctatatatataaagaaaactatcaactagatgaacacactttggatgcattgaatcggttaggatggcctaggctgcatgttcacagaactatgttaaaatttttattctaattgataattgactggacaaatttaccgtgctcttccgattttctgaactctctacacttgtcagggtgcatcccgtcggggcaattgcaggcgaactccaggtcgtcgctgtacgtgcaattcccgccgcttacttgacatttgggacaatcccctgaaaccaccgcccactctagtagaaacccactcctcatgctggcaatatagccggccatactcccattgtgacgctgaacgatcggcacaaccgtgaagttacagcccggtggaatcccatcctcgtgtaaatggtggtcgctgacgagccggacggaggagttttggtcatcacaaggcaggctatggaagccgggaggagcagccgccgccggaagtgacttgttacacgagaggaagcgcagctctgcgttggcttcgctgatgacgaacggcgcctgccagatgccatcggagatgttgaacggcggcgccgggcagccggtggcgagcgggagattctcgtccaccacatggacggtgtggtttccggtgaagatatcaacaacgcgatacgcctcgtagatggtgtgcgtgaggtatgcgccggtggcgttgcacttgagctggaagggcggcgacccgcacggcggccggccgggctcctccagccagaacgggtaggagatggtcagcttgccgcatggcgtgggcaagcagccaggactagacgagctcgccggtgccggcaactcgaggaaggaagctaccagcagtagcagtatgagcggaggcatatctggtggacttgggtacgcaaatcaactacggaatgcagtggtgaaatggattatatgagagagaagaaggggacgagagatcgagggatgggatatgaggcgtggggcaaaaggacggtggcgaagcggttttgaccggtcaaagtctacggattgaacatactgctacattgctactactctctctgctgctacagcttcttgacgaagtactccgtactattttctccgtttcatcactatagtatttttcacgtttatattgatgttaataaatctagataggtatatatgtctagattaattaacatcaatattaacgtaagaaacgctaaaatgatttacatcgtgaaacgaagggagtatagtttttgcatatatttctctgatttcgatatccaaaggtcggagatggattagcgatgacgactgccttatcaaccaataaacaagtcactgattgattaacggattcgataaagttgacaccataaattttacgcatttcctcctcccgaaagtgatgattaaatggataatttcgcgaacgaacttaccagatgacggcgtctcttgccatgtcaagaggaagccgtcgcggatgagctgctcatagctcctcgcgtccgtgcccagcaccggcacgacggtagcattgcagccttccatgtaaaacgccgggtagtcgcccgaatcactgtaattccctcctacgcgagcaaacgtcttgttgccgcacctcgtctccacgaggtcgtcgtctccgtcccgcggcacaagcgccttattgcaactgtacaggaagaggttgagattggtggtgctgatggagaacgggaggccgaccttggaggaggtgttggtcctcggaacatggcaggagtattctttgctgacgccggagaagacaatgaagtcaccgagcttgtggatgtcagagacgagcaatgaattgttgccgtagaagatgtcgaggatctggatccgatatctgggcttgtagtagccgaggtatggagtgtcgttgtggcagataacctggaatccaagccagccgcatttgctctccgttgcctgctccggcacgacggcgaacggcgacgagatggtcaccttgccacatacagtactggccgcgcagccttcttgtggacgattgtctgccgccgtattcgctgcttgactcgcccaggcgaggcaggcgaacaagaggaacaaggaaggagagggcatcgaaaacgaagaggatgaattggtgatgtgttgttgatgaggattgaggaagacatgagagaattaatactgctacttcttcttctagtacgatacatttaactttgggaattctctgtagtggccgaaaaaattgactggataatggctgtctacggcctcatcgtcttgccgtatcggttccaattccaacagatgtgcatggtcttctcagtcatgtaccagaacaggatcgaagattggaaggaatggcaccggagtgagatggaatgcgaaaggacggtcatggtccactgctttgatcactttaattctagtttaattcttgctcatccctgttgcccagccgccacgattgggcaagatgacgaccctatcagccaatcgacagattccctgtcctacacgctgatgagcgagaaccgtattctactagtactcgcttggagatcggaagtatcaggatatacagtggattttctatacgaacttgatcctaatagtttcagggagggtgaacttaccagaagatgtcactggcggtggcaggtcccatgttatgaggaagcctccacccacgagctccacatacctgctggcgttcgccttgccatcaggcggttccagcaccggcaagaagacggtgctgtttctgctgcagccttccaaatagtacttgtcgtagtcgccctccccgtggaaacgccctcccaggcgagcaaacgtgttgttaccgcatctcgtctccacgagccccagttgttgctgctgctccgccggcggcgcctcggtgcagttgtagaagacgaggttgtgattggaagggctgattgtaaacgtgatgggcagcttggcgaaggtgttaaacactgggatactgcagccggtggagttattcaggcgagctagcttatggacatcaaagacgagcatagtacggtccccatatgatatgttgatgatatcaaacccgctgtctgtagagcttcgaagagttgcgacgccggtggagttgttgcaatatacctggtaatccagaggaccacacggcttatccgcctggccctggatgatccagaacggagaggagatattcaggtcgccgcatttctggctgcccaggcagcctcctcctccttcctcctcggctcccctcgccgccgcggcgagcatcagcgctagcgaccaggccgagacgacgacaaagaagaagctcggggacatcgagacagaaagaggaggagggggataggggatttctgaaggagatggaagtttgtgggggagatggaagtaagaaactttgcacacgggaactattcctctgtgtcgaaatgtttgacctgatacacgaacgatcgtcgtccacgcgtgcgagtttccggggtgccctatgggcagctagctgttataaccgccctgatgtgactggaccagtttgtccggactcatcgtcgtgtactcctattaaccctcttccagctagctagtgcacgctgctgtccaccattgttttctacctgttgtataacaggctactacgccctttgttccacacctactcttgccggtaagcagagactagtccactttccaaccggtcaacgcttacctgtacggatgtaactaaaactaaaaaaaaactcctacagaatacttcatgtgtttaataaaaacctacctaatttgacatatcctaatattatgagaacttgtagatacatttttctgaacctaataatataggacagaaggagtactttctgataaaaacgtgttaatatctagtatcttctctctaaccaaaaacctaatgcagattgaacacatatgtgctgcgttgctagttcctaccactaaccagtactccctccgttttagattataagttgttttgatttttggtcagtcaaactgtctcatgtttaactatgtttatagataaatataataaagtaatactcaattcatatagtttcaaatttaaaacagttaatactcaattcatataagctaatgactcatcttgtttgttgtatcttcttaattttctcatttcatcactcaaacacaatctaaggattattaagtggattgttgtacagattatctacttgattgtagttataaattaaacatttaataaatgaacttaaaacaagtgtgcaatacaatagaatatttttttgagaaaatatattttaggagcgtagagcacaaaattcatttcaacaatttggaaagtaattttgaaaaaaaagtaagcctaaaaattatgtaggtatctatcaactcctagaatcagaatctttgcaggaaaggcattagcatttggtaccatattttgccgaaatctatgtcattatcagcaaagctcacaatgctcttttatgtaaaagcacttggatagactcatagaccggaattagcttagtggtggcaatctctagtactatcgttaatgggggcaccaaggtagtatattgttttgcattttctatatattttttatttttatataagctttcattccccattgtattaaaatttcaatacaaactacactgattaaagttcataatttcatatttctagcactaccgcatttcctgttttgaatttttcatatattttttgagggaacagtttttcatatctgtttattgcattttaaagttttctttttggaaatagtagcgtttaaaagttgagaagggcagtgtgtactccttccagtttcaaaattattgatgttttgaacatgatctcacataccaagaagtgatttactccatattacagtatcaatttactattttaccatattaaatatagtattgtactcatggtaatcactacactgctgccgttggtttgaattaatcacctgtatcggtgcgagctaaaggtccaattccctagcttttttacttggtttttacttccaagcatgtagggcaaagcggtccaatataacatgctaagatagaagcattaacaattcgcaatcaccatttacaaggttaaaacatcaagatttttgtaccggagggagcagtaactaaggttaagaagccaatagatcgcaccattatgatgtcttatatgttgagctttccattgtgtttccaattatgtctgcgtatatgttgggctccaaaaatttgagaaacgtccagggtcttccggctagctccacaagatggtgaacgagacgatctgggttcaaagtatcaacccttctaattatttgatattaggtctttccttaatattcgcttctttcggctccaaaaattcatggcccgccacttctaacaactccgattgaccgctttcgaaagatataaagcgtaacttatcccgttagccttatcagttcaaagaaagcccctggtagcggctggtgcgccgtgcacgatgccaaatttagcccgtgcccatctgtccccactattttggtacttctacgcagaatgccacttggtgatcatgtactaatgatttacattgtcacctactatgagcattagtttatggaccagctcaacacactcgaagcttcaggcaactactgctaacgtcttatttgtcctaataatgaaccagttcactaatgagaatggtgaattttcgggggaaaaagaagagggggaagcagaaggatcagaaggatctctgccctgggaagttgggagacagagacaaaggaaaggacggaattcatgcgtttacccaagaatcaatcacgctgggtggtcaatggaagaaccagtgactagccgcccatgtcaactcctgcctgcagcctgcttgataagtcgtcgtcaacgtcaccaccgaggcaaaccctcccaaaatttaccaccatctctgcagctgactagccagccgcccatgtaactacccgagaccgcgagcgagcgagaggttgagtaaaatccaaggacattgacgtgggccagtaattcaactccaaatccacatgggacctacgagagattgcaactttgggatcggagtacatggctaccgatcgcaacgcgccaatttggccgtccagttaaccgtacaccgagccaaaatcttcaactagctaacacatgcgtcagattgggcgataggcaagtgtggtactcaccggggcatgtcgagcggcgcagcttgccgtcggagcagaggcacgcgaacgccgccgcggaatcgttgatgtaccggcactgaccgccgctcccgttacaggcgtcgcagtcgccgaacccgttcttctgccactccaacacgaaccccttcttgaactgcgggctgtagtttgtccccgccgtcaagttcgccggcgagtccggccacagcaccggcaggtacgagtacgtgcagttcccggctttgatcgccggtggattatcacggtcgtagatcccgccgaggtacgcgtagataggcttactgcagctggagatggtggcgttcacaaggccgtcgatctccggtggctccgtgccgttgcagctgtagaggaagcagatggcccggttgctgctgctgatcgtgaacgggctgagggctaggctggacgatatgttgaagtcggtgcggcacacgccgtcgccgccgtcggcgacccttttgtgtgccgcgacgaatgagctgctgttgtagtcgatgctgaggacgaggatttgcgagcccctcaacgacgccacgccgccgttacaccacacctcgaaagccggatggccacaggaggccagagctgacgacggcgacgactggttggactggttgaagttggggccgcctagccagaatgggtacctgacggtgaggttgccgcatgtcgccggctcgcactcggcgcgcgcgcggtggcacaggaggagcaaggaggccaagagtggcaagcacaacaaggtcgggtgcatcttgccgctcgtggagctagctgctacacaatggaggccggattggagagcagcagaatgctggaaagggaggggaaggtctaatgctcgagaaatgctattgccattgccttgtttttcttgactagtctttccgatttgttagactttttttttatcagcagaaataatggggaagtcagcatcgtctctgacttgtgaggagggagacaaggacagttttaatcttctaatcgcgatgtaaataaactagtggtgcaggtcaattgtcgacagcgttatgtcattcatgccgtatgaatcactagtgactattccttctttttctccggggtaagtgaaaacttggtgatgggtcactcatgtcgtagtgactagatggaattatctgagcaccgacttggaaatcaatttagaccttacaacttgcaaactactcgtgtgctaattaaacttcagtattttaaagaaacggatgaacaactctgagggcttcagctgaaaaatatttgcacctaacatagcgtgttatatatctgtttgaatacgactggaattccccgaaaaaagaagaatacgactagatttaccaggggatgaaagataagttagtaggttagtaattttagaccaaccgtttctcctgattttgacttttgcagggagtaaaaaggccgtgatggtaagtaactctgattaacggacattggtttggatcaacggtcaagatcggctggtggaatcacctgtcacgattctgtcctcttgtgtgggttggttctaccggcctacaagtaacctaccactaaaaaagagttttcgaggaatatattatctgaatccatcactaacacgtcgattatttttagttccttttgaatttatactaatgacacgtgtgtgcgtactattggcactccccagttgacaatgctagtcaaactgattcggtatgttttatcaacggttgagctgaaatggtcaaactgatcatagtctactcatttcggctgctacgagcagatgatttttcggctgcatgcgcggcaaaagaaatgcagaggtttcaacgagtcgcgggacaaatcactcaccgcatgtcgccggctgcaggcggccgccggggcaggagcacccgaaccccatggcgccggcgtcgtagcggcactccccgccgctggcgttgcacgccgcgcagtcgaccggcaccgacgtccactcgagcagaaatccgcgcctcacgagccccgcgtagtcacgcgccgatctcagctccgaccatggcagcacgggcaccaccgagtactggcaacccaccgtgtccaccgcccgcgcggggccgccgggatcgtacatccgattcagggacaggaaccactcgccgccgccgctgaaaccggtgcagttcaccgggagcgaccccgtcggcggcgtccgcgagcagttcgcggagaagaggaggcccgcgttggcgcggctgacggcgagcagcgagagcgcgaggctgctggacatgttgaaccgggtggcgcggcaggcggagctctcgaccaggttggcatggaaggccacgacggagctgttgccgtagtggatggcgaggacgcggaggtaggagccgttcaggctgggcggcggcgacgcggtcgcgccggtggggtcgtcgtcgtcgtcgcaggtgacggcgaaggtagggtggccgcagtaggcaggctgccggccgcgcagccagaacgggtacttgatggtcaggttgccgcatgccgccggcgcgcagctctcgccgaccagctgcgcgtgcgtcgcggtggcgaatacagccaggagcaccagtactagcgaggtgttttgaaacattttcttttacggtgtatgtgtatcgatacccaaaaagaattctaaatcccccgcgtcgctctcgcgcgagcggcttggggggcgaaaccctagccgcccatgccgccactccccctcctctttcttcaccccgccgccgaaggcggcggcgaggccttccactgtagcaaccctttccttggcgcgaggaggacagagttgggctgacgatgtctaccaccacggccggaggcgacgacggcggggcagctcggggtggcggcggatccggcacttctttggccaaatctggccgccccacgtccggatcgggagcgcgcgacggccagggctcgccggcggcgcgcggtcggccgcggggcgtcgcgggcaagcgcggggtggcggcgcggcgcggcctggtgacggcggcggatccggtggtggtcggatctggccgccctacccccggcgcgacggccggggctcagaggcggcgcgcgtgtcgcggctcggcgcgggcggccgtgggacaccatggtccagcacggggcggcggccgggggtcggcgcggcggcagcagccctcacggagggcggggccaactgcatccagcggcggcctgggcggatggacggcggcggcgaccctcccggagggtgcggccagatcgtggcccgtggtcggcgcggcgcggcatgggcggtcggacggcggcggtctggccttctggtgcagcggtggtggcgttggggtgggcatggcggctcgtaggcactgaggcagggcgtgaagggagtgatggcagtgctaagggagctggcggcagtgggtcgtcttcctcgctgccggcctgcaccctcgcccttcctgaagctcatccccttctctgtggggagtttctatgttggattgaggcggcagccggttagcgaggggagctcagaccgccaacgcgacgccgtccaattccgggttctccttcggccaaagctggcaaggaggctggcgggtggcgggacggaggaggtctgggccagttcccagggtagcggcagctctatgcagcaagtgtggtggtcggccggtggaggggcgccggcgcggtgtggtggaggcctcgtgctgatctgcttgtgaggtggttcctgagttgatgggcgacgaacctcaagcaaggttgaaaggtttccgggtgaaagcctcgcctgatgattcatcgggctggcagcggctacgcttttgggcgtcgtaacctccttgagggcgctggcaaggatacctttctcccttggcgagttttctctaggtgaaaaccacatctccttagatgggcgatggcggcatccttgatgtcgtgacctccttgggggcatcgcttttagagtctcgtctttgtggtgttgtcgttggcccggcggcgatcggccacgcatagcgggggtcgtctcggtgctaggtttttctctcagtgggttgtgcttgtgtgattagcatgtggctttggttgtgcatttcgatgcaccttcgacctcgacagtctctgtcgagttttttcttgtaactttatttcttcttaatatacttggatggcctccttcggccttcccggcgatacccaaaaagaggtataaatgtttatttatgggattttatcatcttaaggttggagtctcaatcaagttgaatgcagggatgaatatgatcgatgaggtagcggtacaagaaaagtgccgatttttctgacatctgacactttctaccatgttccatttacacactgcgtggtcactggttagcaggcagctgttaattagaatctaattttgatcctttttattttcaacaaaatgattttgatcaattcagccagcatcttttacaagcattgctcagctgacattgatgcttgccgaccaaggggaatgtataaaaaaatgcagagagtattcagaggtctaattaattaaactaatggaggtggcgactggcgacggctttggcaggagcaaaatgggtaattgtgggaggatccgtagagtttttcccttttcttttttttttagctctatagggtttcttatgaagtcttaaaaaattaaactcgaaacatttgtttaggagtatcatgatgtattctatcaacaacataactgctacatatgcgtaccataataagtgcatttctagcatttagaaatcaaaatatctggaagaaaattgacctttatgttcatcattaaggctgagttctttccccaaatttcccaactcaactccttcgtgttccacatgtatgcttttcaaactgataaatggcgtgtttttttaaaaaaaagttgcttaaatcatattgttctatttttgaaaaaaataactagttaatacttaattaatcacgtgctaatggaccgcaccattttccgtatgctggaaatgtgttcccaacacacaacaacgaaaacaacctaaataggggagtgattgggagttgagggtgtttggggttaaaataggaagaaatccgaacaagatgtgattgataagacaacaaataatctagaacactattttatgagacgtttgaattctaaaaatcaatgttttaaatagcgggctaaggtatttagcggttaacttctcaaatagctatagcgggctaaatggagctataacggctaaattgtacatgagagcaaatagctagaacccttctcaaacagctatagcgggaaatagcggccgtttagcgggagattaaaaccctgaaaaatgcacttattatggagcgaaggcggtacaaaattaatatactagtgtgaaagcactttttgaagtattattgtacttgtaaaatacttactaaacatcttatgatttgaacaactgctgaaaaaggtggagtttttatatataattgttggatagagaaaacattttgattgtgttaatttgtagtccgtctagtttgtagggatattattggttggtaaaattaaattggtcggatacatattataaaatgttaatgatatgtaaaataaaatatagaaccacatgtgtgataatattcttactttagcccgcgcccaaccacatgaagttcggggcactaataaaacaaccatagtgatgttctttatatgtggactatagacacatgttaagttcttttcaaattcatttgcaaaaaaatcaggtaccaaaatgtttctatgcaaaaattttccatttataaagttctatatgaataaaaaaatatgtataaacttttcatgtacatttctttataggccgaaacattgctcgttggaccgaaagcaatatatttgtgttggtgacaactgacacacactgctgtgcatgcattagacctatccgatgaatatattacactccagaattttagcaccaaactaagctataccatatttatggatgtgtgtattataaaatgttaacaatacttcaactaaataaaatattgagacatatttaatttgtagtcatttttgtgtcaagatttattcttgtcctaaccaaaggtttggtgctggtatatatagaaaccatggtgatagttaatttttatgggctaaagtgtgtcaatgatttaggctacttaacccctaggagtgttagacaagaatagcaatcttggtcattgactcaacgttgccacatgaactccctcaatggtaaaaaatgccatcagtcctactgacattttttctcgataaaaaaagtatagctgataaaatcatttggctaatgagtactctaacgtccctccagaattttagcatctcaaattgagttctaccacgttgatggatgacataaaggtgaacactataataatgcgaattaaatttagaaatatactgttcattcattttatttttagaaatattcggaattcaaaactttttacaaaaatataccgtcgatctcgcacaaccgttgcgcgaaagtgacgtggacgtgacatcataggcggtatcgcgctgggaaaaagcgagaccgcgcggtctcgcgaaatggaagagcgagaccgtccggtctcgcttaaccaatcagcgatacaagatttcaaaatggttaattagtgattaattaccatgattaatggttaattaattattaattaatcgctaattattattagttaaataattaattaggtcattagtcactaacctaatgtagtttaggatggtgtcgctctctgcttgagcgagaccgctcgtccttaccgcgctcttgcgccgtcaccgcgcgagaccgcacggtctcgcgccctagcagcacgagtccgcggggtctcacgctttctccgcgcgataccgtcctcaacgtcacctctgcgtcattttcgctcaacggtagagcgagatcgatggtatatttctacaataaaatttacatcccgaatatttttaaaaataaattaaataaatagtatatttttaaatttaattcataataatgcttccccattgactgtagaattgcacgtggttattattcacttattcagaaaacagagttaggttccgagaacaaggatagcttttcctgaacactaaccaatgcatcaccaccgataatattgattgagctaagtgtaccaactgtgattgagaagagagatagagaaaaatgagaagataagtaaaactacgaggtaaactattaatacataattaattaaatatgcttattttaaacttgaaaaatctattaatatgttttttaaaacaacttttctatataaagctttttttaaaaaacacaacgtctaatagttcgggaaacttgtgcgtgaaaaacgatgctctttctttctctctgtacatcatttgttgagttgtgatccaaattcatttgcacttaataaagaccaaactgacccattgggttgtgcacctggggacgcctaggggtgcgggggcggagtccccgcggtacgaatcgtcatcccttttagggttccacttcatatatatacctcttgtaagctgccgtgcagcgctgtaacctcaccccgatatagtgaagatattttgttggctggcgtccgtggtttttttctcaccccgatatagtgaagggttttccacgttaaatctcgtgtcttctgtgattgatatattattttttatcgtttatttgcatatcgttttctaacatgattcgctggccaagtcgatgttttgttcgttttggatagcctatgtaactgtagatggtcagctaattgggttggtaaatcatgcccgtgaacaaccatttttctcccaacaagggtacgatttgtcgatatgatcatctatcattccatctcgttagggctagcgaatcgaaatcaccgcaaaacagaaacgaagggaatgctgatgaaaaaaaaaacggaacgg

SEQ ID NO: 70415 - DNA, 3624 bp, Oryza sativa
ccgcctggaaaaattgattttcgcaggcggacggtgagctccaccccggtttacattttcctatatggacatttagctccgatggtcatatccgtctggaaaaaaaaaatctcccatcgtatgtgaaaatgctttttctagtagtaggtgtgttattgctaggccctgtttagttcgcgaaaagaaaaattttaggtatcatatcggacgtttgaccggatgttggaaggggtttttggacacgaatgaaaaaactaagttcataactcggctgaaaaccgcgagacgaatttattgagcctaattaatccgatattagcatatgtgggttactgtagcacttatagctaatcatagactaattaggcttaaaaggttcgtctcgcaatttctatgcaaactgtgtaattagtttttctttttaatgctacatgcatatgtcaaaagattcaatgtgatgtttttgaagaaaaaaattgggaactaaacatggccgttcggtttggcaaacagatggctgctgtggctgagctgtgcatacagttcgaggcggaatttcggccctcgtcgtcagggctctgagcatgttagagagcagcacgtcaagcaagcaaccgagcatcggtgaagcagctggagcgtgaagctcgccgttccgttggatatagggtgattttgttgcatgatattgtgcgttcaaaggaaggaggtttcatgtgggtaactatttgattgttccatattcacctaactaaacttgaacttcactatatagtttgtttcagattgtacatatgatttaattattacgaattcgtgatgatcggtctcatttttggaacaaaagagtgaccatcgccgtgtttagttccaaaatatttcttcaaactttcatcttttccatcacatcaaaacttttctacacacataaacttctaatttttccgtcacatcattccaatttcagccaaactttcaattttaacgtgaactaaacacagcccatacatgaaaaacaaaaatcaatactgtacataattcctgacagcagactgccagacttacacccagcacaccattgtcatcttcgctagcctactgcagtcggcttcggttgatgcattaaggctatgtttagttcacactaaaattggaagtttggttgaaattggaacgatgtaacggaaaagtttgaagtttatgtgtgtaggaaagttttgatgtgatggaaaagttagaagtttgaagaaaaactttagatctaaacacggtgtaaggctgtgtttgatacttgggttaggaacccaactccaccgcacggaaaacggagcggtctattagcgcgtgattaattaagtattagctttttttaaaaaatatattaatttgattttttaaagcaactttcgtatagaaactttttacaaaaagaaaacataccgttgagcaatttgaaaagcgtacgcgtgaaaaatgaaagagagtagttgggaaccttgtggaaaaagaacgcagcctaatctggatacgggccagcaaatccttcatcactgtctgctggatcggccggatcaaattgtaagcagtactcgactgtaactgcgctggccgcctggcctcttcaagatcaccgctactatatgcaaaaagtgacactcgaagagtatccaacgtcaacgtacgtataagttccgcgcatatatagcggagcagaaatggtagcaaggctagctgatagacgggtcgcctggatattttctccgtcgattggtacagtacacaggtgtgatacgtccgcagctgtgcacacacatcctctgccgcgctcgcagtagaacaaggggacgacgatcgacagtctcgttatttcggcgaactttcctgctcctccgatacgccgagggagtacacgctagcgacactaccggtgaaacattctgtcaggttggccaaaaaccataatattctcgatttgaataggaaccgagaccgactcaaaaacctaacggcactttttttattttcaaccggaactaaagattatttttagtcccggttcaaaatatgatagacgatatcagacccctctactatctttaatctcggttgttaaacaaccggggaaaaaatcagcaagttgccttgagccgcgcgctaaaaaaaaagcaaactgtcccaatctattctctccttatctcctctcctcctctcaaccttatctccttctcctcctctcctccccctcattctctcacccccatctcctcctccggccccctcccctctcctctcctcccctctggctccccttcagcgggcggcggtgcccgacatgcgacgacaggggtgataggtggtcgggcggcgacggcctgtgcagtgggtggccacggtggtgggatgggaggcggtgcacggcgggcggcgaccgacgcggccccgaagacgacggtgaaccgccggccgatcccttccctgcggcgaaggaggcgacgagcatttggatatgtgaatttgctgattttattgatttatctatgaatttgttgatttgtgatgtgtttggatctgtaaatttgtgatgtggtgttgacgtgaaaaaacacctaattttatccttaacatgtggatatggataattttgtgatgtttatatgaatttgttgatttgtggatgattttgtgatgttttctgaatgtgaatgattttattgttgagtttggttagaaatcaatatgcaaaaaaaaatgaaaaaaattagtttcggtaggtgattttaaccgggactaaagatcgcttcgtagctccgatttgctacccaaaactattagggttgtaaacggggtgtgcagactgcagagggtttgtgcaggagtggacgacggacgtaagaaaccgccccatgtcccaaccccccccccccccctcccgcggtgaaattttcccgcgaaattacggcgagtcaagtcgccccagggccccggctcccaagtcaagtttggttagctcccagctcatccttaatgcagtcctccccactaagcagacttaatttatctaaaatatataacggtttgactatcctttatatgcgtagccaccatcattgtggcggtattccggttgtccgccattcccaaggcgcaagactttgcgtctaccgtcgtcgtctccatctccgtctccgatcaggctaggcggcggccgaaacaggagctaggcttaatgtacgagaagacagtaggtacatcatcgtggcagagcagtttactctgtcctccataccatatcttgttcaccgttcgttcattcatatttatgttttcttggtatgattatttcgtatcatcggtgatttgggtttggagatttggtctaaccgcatgtacatcttatgtggtatgggcatatatcacgagaaattggtttggtagccgatcgaataccgatcaggatttacgattcggagatggccttccgtttcgggctctggcggaacgacggttttcgtgaaatccgggctctggcggaatgacggttttcgtgaaatccggtggaaagccggtagtatgaacaattttcataaactaaaatttgaatacaaattccttaagtttaacgat

SEQ ID NO: 70416 - DNA, 617 bp, Oryza sativa
agcttttatttatataattattttttaagtagtctatatttaatagactaaattagtatctaaatgatccaaataccacctaaagttccaattcaagtcaggttcttaaacgaaacctaacaacattgtttatacttttgtttttgtcctgtactaggcattagatgatctcagccctttccctgctgaagctggacaaatggtaaatcccttgatcggtctatcccagcctcccaggctcgccgctaaacaactttaattaatttatctaaaataaagaggaagcatatcatcaactgctatcctcgtcacctctcccctcccgagttgacttcccctctcacgcgtattcagggtggttcgccatgccggcgcgaatgtccatcacatcggcgtcgcgtcgtctccgatgagtaaagctagtcagcggctgaaacaggaagggcgccttaacgtacgagaggacacaggtacaaattgttgtacttttcaaatttaaaccctagtttagcttctaactttttgttcaaacttttaacttttccatcacattaaaattttgtacacacgataacttctaactttttcatagatcggttcaatttaatcaaacttcc

SEQ ID NO: 70417 - DNA, 10378 bp, Oryza sativa
ctcgagcaatcttcgcaatcgtccggccccgccgcggccgtgtagtcgagaagaaatccacccttgatgagccgctcgtagttcttcgccaccgcaccgtcgtaccccagcaccgggatcattgacaccgtgcagttccccggcagttgtctgaaatcgtcatcaggcttgtacttccccgcaagccaggcatacgagttggacgattcatttttcgcacaactcacgggcgcccaagagattggaagctgccgtcgactctggctgcagttgtagaggaagacgagctcccggtttatggggctaatcttgaactgcgtgaggccgaggtcggaggaggcgttgacaaaactctcgatgacgcactggccgtccgtcagctgctcgttggtgaccatgaaggagctgttgtggtagaagatgcgctggatttggtacgtccagatgccgttcttgagggaagcatttctatggtcgcacgtgacctgaaaagttcggtagccacactccggcggatgcttgccggcgagccagaatggatagccgatggtaaggttcccgcacctcgccggctcgcagaacggcgatgtggtgttggtcgtgtttatggcatcaacggtggagctagctattgggagagtgatcagcagtagcatggctaaacagatcatggcagttgcaggagcacgaaacggatgcatgctgcagtggaagcgatcgatcacgcagcagatttgggcgagacgaagaaggcgaggaaatgatgatgcatgcatcggggaagaagataacggattggtcaggcaggcagcgcgaaacatgttgcttgccgaatgtgttgaccattcctcagtctccttgttggaccattcttctccggtagctgatgctgcttattggtcactgatgtggacatcagcgagtgccgcccagtggcacagtggcagctcaccaacatgtggggtcctcgctaaatcgggcccaccttccagtgaccgcagaggattaggactacccacggtggagacctattcgattcagacttggttttggaaaattcgggggtaacccatccgacgcgagaaaaataacggtccttcaattcgttctaactgaaacgatgatgactgagcagtagcagactagcagtctcacgtcgctggagaaaatatggtctcaagaactctcagctggattattctacgtgttactacgtagtatgtgcgtgtggatttttgttacgcattctgaacagtgtccttttttttttctttgagagagtatgagaccgcgtagtagtacgtacttggctgctaagtttctgcacatccgcgttgtgatttgggttgagcgcactactccacgagagaagcgcacatcggtagaaacgacggtacgacgcgtactatttttcttcttccaaccaatccagtccgtccagaataagttttaccgatccatgtcggcttatccaaattaggttatggttaattgtacctggtcgcctgatcgcgtcactttacgcgtgaaatttcgtaataaaggttgggcgacagaggcgtatactacgtcacgggatttatcattattgggctgggaaaaaccctggcctttcttgggccggcccaaaacatcacgaaacggaacaaacaatgtatacgtgtactcgagtgggcgtacctggagatttcgtatcagcccgcgcggtgattgtcacggtccggaagcacgcgaaggtccagggctcgtgcgccgcgcgccggcggtggccgcaccagccgccggccttctcgcagtcgccgcactcgccgtcctccagtggcctccagccgagctcgaaccccatgttgagcgccggcacgacggcggcgtcgagcgggctgctgtaattccctccgaggagggaccgcctgagcaccggcatgccgacgacgtcctggcacagcgccgcgtacccgtacggcgtgcggtcgtcgccgtcgcggaagacgtaggagtggtggcggccgtcgccctcgaggcaggcgacgaggtgggccggcatgcccatgaaggagcagtggatgaagaaggtgaggttggcgtccctgtccgtcagcgacagcggcgaccccgccgggagggacaggttgcggccgacgagcgggcaggtgttcgaccgggagaacaccccgaggtcgaacagggacaccgtcctgtcgccgtacaggatgtgcgtcacggcgtactcccccgacgggagcgccagcaccggcgtgtcgcggcggcactccaggcgcaggctcgggtacccgcagtagtaggcgccgccgccgctcgtgttgtcgtcgatccagaacgggtaccggatgtcgacggcgtggccgcaccggtacgacgggcacgacggcgtggtggcgttcgggatgatctctgcggcttcatgggtggtgatgaggttgcttaggaacagcaagagccaaagaggagagcttgatgttggcattgttgcattctgcgagattgcacactctgctgcacgactttggtgagaatcttcagttggtgaaaccacgcacaattgcacatttcaattttgcgtgagttatccttacgtgaatgacggttcatgcaagatgtgtgaaccgtgaaggttgttactagttacagaattctgtcaggggcatgcacaaaaaacttgttttgtgactgaatatgttacacgtaggcaaattttaacttctctaacagatcatcaaactgcttttctgaatgtgccaaagtagccaaaccactggccaacaagttaactcagttacagccaaagacacataaacctctatgtcttttttcttttcatgggaaacctctctttctctgacaaacaatagcacacaactctgaatatttacggtgtctgcagtcagtagccagtattttctgaacatcttgtcaagtctcagctgctgttattggaagtggtggatgggctaatccactggtacatgacgcagtccggagagccgtctcggctcttcttgaccagcccggcgtcgtccttgacgtagcctaccttgtccatccgctgagcttctctcagcgcgtccaacacctcaccgatcggcggcctcacgtcctgctccggctgcaagcaccggaacgccacctcggcgacgagatcgaccgtcctcctcgtctcgccgtccgacgcgtacccgagctgcgggtccaccagctgctccatctcgtagctctggatcatgtgcacggccatgttggccaggttgacgtcgccgccgcgccggttcatgtccaccgccggcttggaggagatgagctcgacgagcaccacgccgaagctgtacacgtcgctcttgtccgtcagctggtagcactggtggtacatcgggtcgaggtaccccggcgtgccctgcggcgccgtggacacgtgcgtggcgtccgccgggaacagccgggagaggccgaagtcggccaccttcacgtggaacccttcgtcgaggaggatgttgttcgtcttcacgtcgcggtgcaccacctgcggctccaccgtgtggaggtactccagcgcgctggccgtctcgacggcgatgccgagccgcgtcggccagtcgagggaggacgaccgcgccgccgcgccgccgtgcaggtggtcggcgagcgtgccgttggggacgaactcgtagacgaggagcaggtcgcggctgttggtctgcgacgtgcagccgaagagcgtgacgaggtttgggtggcgcagccgcgacaggatgcccacctcgttctggaattgctccacgctcttgtagctgttcttgtacagccgcttcaccgccaccgtgtccccattccggagtatccctgtaacaagacatgtcaatgttttactctcaactgatcaagtccgacatggacaatgggacactggctttgtgtatgatcttgtacctttgtacactgtgccgaagccgccgacgccgagctcccgggcgtcgctgaagccgtcggtagcctcgtcgagctcctcgtaggtgaagatgtgggtatatgccaagccggcgaggctgaattctttcgtgagtgatggcaatggcgtccctccatggatgagaccttcaaaggatgcagatcttttcctcttcctccgggtatacaacacagtggagccaacgccaagtataccgagacatacaacagccgctgcggttcctggttgtgacagtggttgaatcacaagaacagatcaggagatgtcatatactccctctttttcaaaatgtttgacaccgttgactttttagtacgtgtttgactatttgtcttattcaaaaaatttaagtaattatttgttcttttcaaatcatttgattcattgttaaatatactttcatgtacacatatagttttacatatttcacaaattttttgaataaaacgaacggtcaaacatgtgctaaaaagtcaacggtgtcaaacattttgaaacggagggattaccatactagcctatcttggtaaatgtttaattgaaatcagcattacctgcggcaatcttgattcctcgattaaccttgcctgcatgtaaagagcgcagaggaggagaattagcatattatgagagggaacaaataaagggggctatagcttggtttgctaccctactaaaatttatactttataaaaaaaattgaggttgcacacaaattgtttcttataggacattattggctttatcttgtaccttttcaactctacccgccaaagttttggtagtggacatcaaaccaaacagaccataaaatttgcccatgacgaagaaaccagaaatgacaaattagtaaccagatggtgtatcttatcactaactaaaaatattgactatttaaagcttgtatttatagtgccactttagtaaagctttatcgcaacatttagtttttttaattataattttgtattagtttatctggatattttctttttgtgctcgtctagattagagtttgcttgttttgtactttaaaattcgtagaaaaagctctattttactcccctaactatttcattggttcacttaacccacaaaactatttttaactcattttaccccttaaactattaatagcatttctctttatacgagttgtactttaatctgaaattttatagagccatagataacaccattatcaaagtttcaaaaatactttcaaaaaaaaatcatgactatctgtttaaaatttaaaacctcgatgtttaaatcaagcctagtgctttaaatatatgtatacaatgataaaagaaattctaaaaaatgttgggagataggttatgatatatctatcagtccttccaaatttcattgcaaaatacaatttatttggagagaaacagagaagagaaataccattagagagcaagatgatctgttttcaataatttggggtgtaaaacagtggctgagccatgttaaaactgtggggtcagctgaccccacaggtatttgcaagatatatattgataatatgaaaaatagtgaaaagtacatgaaacaatgaaaatttgtatagattgaccccccacattgttatatatttatgcattttgacccccactgggttgagaacctagctccgccattggtgtaaaatgagtcaaaaaaataatttagagggttaagtgaactaatgaaataatccgtagggagtaaaatggacccttttcattttattttgagctataacaatttttgttttacccctaaagaagtaaacatgtgagcagatagatctaatggtttaaaaaaatgattatagatgggcccaaaagattggttaggtaataattagcataatctatcttatgatatggattaaccgaactaatgaaagcataaagtttcacagtaacaacagtatgaacattacaggactaacacacatcattttcttcttttaaacaaagaagacttctaggtcgtcctagtccctttcacctttcccctggatttcatttgttccttgccgggtcttagttcatgtgccagcccctttcagctgattaatttactctattccctaacatcaaaggcatcatttatcgacaaatgtaactcttatagatgcatgcatatgctacaatccgatgtggatgacatgacacatcgcacattttgatgaactgaagtagtacttggcagttgacacaaggtttgcacagacatatatgaaaacgatatgctgtcacaactgactgctcaacttgatagagcgactaactgctaccctctgcctttttgttgattccactgctaacgtttgttttgaacagtgcagtaggtgctataggagaacgaaagaaagaggttcaatgaaacagtttgccatcaaagatgaaaccgaagcaattcaagggaagtttcagtcaaaaacaaaacgaaaggaagttaaaagaaatcaaatacacgaattgaccatttcaaatgatgaaagtgcattgttatattatagtcaaggggaagtgccattcatagtttcagaccagaggtggcgtcttaatgttagcagcctttgaatttctattatctctactctttatgaaaaacgaatagccagcaatctcttagctctaagaaataatgaccaacaaaatttgcagactcgcagtttcctaagcttgtttggaattcttatacgaactttttccctcaaggtttgcatacaaaaagcacaacctaagtgataagtaggaacatgtatctcaatgcgtgtaatatgcataatgtattcattctcacgccaatgcaaaagtatttcttcaaaaaaattttttgcaaaggtagcaaacgctccttacctgatggatggcttgacgttgtgttggtacgggttgaattggagcagagcaacccgtcggggcagaagcactggaacgaaagctgttcgaacctgcactccccgcctctccttctgcacccatcgcagtcttgatctcccattaccgacctcatccattccaagacgaacccatctttgatcaattgctcgtagtgtccactcaccggcttcattccatcatagtacccacgcaccggcacgctgacagagttgcagttccctcgaaccccggacggtggtgtgctgttccacttgtcggagatgtaagctcccatcgtccggtttccacatggccgttgcagctgcccaacgtgttcaggaatcgagcagtcatagatgaatgcgagatacttgttggtgttgctgatgatgaacgggtagggactgaggctggatgtcacgttgaaatccgggacggggcagtcggcgtcgccggcgaaggtggtctctacggccgccaccagcgagttattctcgtagaaaatactgtccacgcgaaacaggtggtccctgaacgtcctgctgaggaacgcgcggccggttcggttgtcgcaggtgaggtccaacaccgggtagccgcaggacaccggctgcacgccgctgagcgagaaggggtaactgatggtcaggttcccgcatctcgccggcgtgcagcttgtgttgccactggtgctggtctcgttgtggccaattgctgccgcggcatgcagcaaggaggcgagggggagcagtagcaaagcaggatgcatcgcatcggaggagagaaagaagatatcaacgagacaacaaggaaggagagggtggttaaggttgccggcagattcttgtttgcatccgtgcaagcggagggtggagtggactttggagagatgaagagagcgaaccaccgctgctgctgcttcggtcacaactcgcggccatatactttgaccgtgaattcattcgctccctgtttttgttcgcacctaagctagctctctccatcctctgtggtgagtttgcctgaaacgataggtaaaggtagaagttaatggaccatattatcattgaccgacccttagaacatggctcgacaaattctagccaggcactccaagctccaagagaaagtccgacgcaagttccacggcatcaattattggtcttctggtttccatttcagcattcaacacacaggctgtatatgtgaccactttttgaatggatgagtatttgaatatgattgatgaaaattctatgctgctaccagtaaattagacctaaaagttttcgatcatatccttttgctggcccttttgctaaagcaaggtactgcttcgaaactaatcattgtaaaaactgaagatgctcacaaggcacaactattgtgttctcatcaaactagtctggagactttggtgtcgtcggcgtcaacagagaaaaatgatgcaccggaatttctctttctgcagataaaatggctatctgaaactgaaaaaggttcagaggctgaaaactatgtacgcgaagcttacgtcggaggatgcagtctccatcacttcttccgtagctacgacggcgccatggcatcgaagtccttgtccatccattcgcatggctccatccgctccagcgaaaaatctcttcgccgtgatctctgcaagcgtgcattatcctaactgctacatggaaataatacaatagtgttggatcgactttttgtttacctgtggaaaatcgagcttcgttacagagaaaactggcatttaggaagtaacttgcatatgaggtcaccttccggctctggctttctttcatgaaaggtatacgcgttgacctgctaggcagtgtagtaaattaaataaatacctgtattttcttattgagctcttacaggagagtgacacgtaagaaggcctacataagctaaaaaaggaagtacacttgttaattacataaatatttgccaagcaaataggataaaaactatgcagcaatagggcacactacggttgcaagtctggaaaggaagacagattgccactgaaaatacaggcaagtagtgtcacagagtattgagttggccaccaaccatttcagctaaaagattgttattgatgaaaggtggaaacggaaaatatttcaacatagcaaaaggttcatctttgaacttggtagactcttaccattaaactacatctagagcaggcttgaattgttagaaaacgacaggtaaacaacaaagctttttcaagaactaaacatgcagatttttatggtacagaaccattataaggaaaaaaaaaaggtgcaccaactattctagtgtggattacatgaagtatgctatatataaaggtctaaaacaactagaagcacagtaggacagtaaattcaggattccgaagatgtggcaacactagtatctgtatcttaggcaagaacagtctcacatgacgtctcactgtatgaaaaccttgctcagctattcccgtgttagaaacaaacatgttaacgacgtatttgtcatcaaatgctagagtccaatgcgcatgcggcaagacaagtccaaacagcatcacataaattgctaaccttaactttcaagcagaaccaattcactttcttgtctcagatttttacaagaagcgtcaattgcacagaagaaaaaaagaatccaacattttgcaatgcataccaagttgctcctgttgccaatcttggcctctttgcagctactaccaggcgctgccaatggcgccaccgtggacccaagctgcccaccggcgacatgcgggaacctgactatcacctacccattctggctgggcagccagaaccagtcgtcttgcggcccaccgtcgttccagctcacgtgcaatgacagagcatcaggtcccttcctaagaaactcctacatcaaggtcctcggcttcgattatggccgccgctccctcgtggccgtgcacgccctcctcgctgccgatgctgcgtgcaccgtcatgttcaacgtgtcctccgccttcgcgatcactgacaggttcagtatcagccagagcaaccgggagctctatgtgctgtccaggtgcagagagagactgccaccgccagacgctgtcccggtgaccaactgcagagccaacagtagtggcatgtacgcctaccttgggggaagctatggcacaggccagacaccggtgaacaatggtggttgcgagctttcagtgttcctggtgcttgggtccagcaacgccgccgacatgacagcggcaaattacagacagcttatagcgggcgggtttctgttggagtgggaacctgttggcgactgcaacgcctgcacagcgagcggcgggaggtgccggtacgatgccagcacatcggcgttcgcatgcctttgctcggatggtggcatgagaccatcgatttgcggtgagctaagcatgcagaaatgatagtcttgtgaagctgcatatattcagatttctgcttttctttcagagctagct

SEQ ID NO: 70418 - DNA, 544 bp, Oryza sativa
ttacatctttggatcttctaacagcggaaatacatccaatgtgggtacaagatggagaacaccaacattcagagctgcacttgcatctgaccgcaaaatgtctcccttggcggtaggcctctcaaaacctcccatacctgttgtcacaggaaatccaacaggtacgggtgctgtaatctgagtacccttctgcacaaacttctccatccatgatatctgggaagaagtacagttccacatgattattaatctagcagccatacatgatgaatagatcaaacagaataacagggagccagagaatgttaaccacgagccaagagtaacaacaggtggaaaagatttcaactcatcccagcagctgtttataggggggaaaaagaagtccaagagtgtgcgtttcagttcatgtgttcattttagttggatgagtgtggtttccatttcaatgtggacttctttcaagcaataaatttgttctaaaacaactaaaaccccaatgaccaacaaaaccattaagggtaccatgatcaagagtagatgt

SEQ ID NO: 70419 - DNA, 2529 bp, Oryza sativa
aattgtgatcggcatcgcacgaggactggagtatctgcaccagggctgcaacacccgcatcatccatttcgatatcaagcctcgcaacatccttcttgatcatgagttttgtccaaaaattgcagattttggattagccaagctatgccacctcaacgagagcatcctttcgatggcggaagcgagaggaaccattggttttattgctccagaagtattctccagaggattcggagttgtgtcaaccaaatcagatgtctatagctacgggatgctgcttttggaaatagtcaaagtaagaaaaaacataaaaggaattgcagataatttcagtgaaacatttttcccacattgggtttatgacagtctggtgagtgagatgcaatgttgtgaaacggcatatggaaccgaagagattgcaagaaagatgaccatagttggactgtggtgcatacaaatgacacctgaaactcgtccttcgatgagcagggtcatagagatgttggaaaggagtatcagtgaactagaaatgccgcccaaaccattcctctgctcccccatccactcaacgaatgtttcgtcttataaatcagtcaattttacgatgtctgcatcatcatgatatgttgatatgctgcattatgctactatatttgtagttcttgttttttagctgagcacttgtaattattttcattgttagtaccatattaacatcaatgtatatatacattctatttgaaaatctaaggatgtaagtacggattcacggttatgaatcatgactagcacataaaggcgttatactgaagaattatcagagttcagatacttcactatctcgacatcgtcagatacaattggccaaacgaacttcacatgcaatttctataaggaactaattttacaaaatgtttagcagtcaatgcaactatcttagaggacaaaaaaaaaaacaaagaagagtttgcttaaaaaaggaacagggaattcatggcatgataaagatgcagaacttactggtagtgggctaatctgcaaagccgtcggaggaacacgcgctttcatcagcacccctgcctgcctgcctgggtggatgccaatgctcgtccagttcccccgccccgccggccacggcagttcccttgcccaaggcacgaccgcatcgccgccaccccagtgcggttgacttgaccagtttccgccgcgcactccgatggcatagcgctggaatccgctcaggattggtcctgccggttgccgcactaccaccgccgagccgtcacggcggcggccggcggccggggctgtggcggcggctcgaggggagtggagcgagagagagagagagagagttgaggccccgaagagtagcatgacatgatacgggcccatgggccgtggataacctgtaatgacgggcccaaacaccaaactgagatggaagagaagacgctatgcagagattttttttctagttttagacatttttaattttaaaaaaactctctaaaaagaataattaactatttgccactagacccacatgtcatatacacatgagagcccacatatcatagacagcgagtgacaaataatcaattgccacagccccccccccccaaaaaaaaaagttgattctaaatttgaagcaccacgccagtctaattggcggcgtcagaaaaaactgtcacgccacatgatgccgttaacatattttaaaaatagagagaatccattatataccactgactttatcatacgtctacgatttgccactgactttatcatgttctacaatatgccatcgacttttgcttaacttctacaatttaccatcgccgtccggttagtctccgttagtattgtacaaatttgtcgaaatgaccaaaatacccctgggagaaaaggtttcaaaatttggataaaaattatgaaatatcatatttcaagtttttggtcaaattttggatgtttacaatcttatgtttataatataatattttgataattttatccaaattttggaagtttttgtcataggggtattttggtcatttcgacaaatttgtacagtactaacggtggctaaccggacggtgatggtaaatcgtagaagttaagcaaaagtcgatggcatattgtagaacgtgacaaagtcagtggcaaatcgtagacgtgcgacaaagtcagtggcatataataaattatctcttaaaaataagtcttgggaggggtccgttttaaaaataaaaataaaaatattaataaaataataaaaatccttgtgcagaagacttgaacgagtgcagtgtaaaaaaaaagtcaaaaaattactatgggtatgtttagtgctttagatgtaaaggctttgaagtatacggacacatttaaaatattaaacgtagactaataataaaacaaattacatttaaaatattaaacgtagactaataataaaacaaattacagattccgcctgtaaactgtgagacgaatttattaagcttgcatgcctgcaggtcgact

SEQ ID NO: 70420 - DNA, 6696 bp, Oryza sativa
tctcccccggccctctccctcccggcgcgctccctctccccctctcccgggcgctctctctctctctcttctctcccccggccctctcccctccccggcgcgctccgctctctcccccccccactcagctccgctccgcttcgcccgcgcgccgcgcgcgcgtgcgcgaagagccgcgccgagtgctcctcctcctccgctccgcccgcgcgcttgcgcgtgagccgccgcgccgagcgcccccttcccctctcctcgctctgccgcgcctgcgtaagccgcccgcgccgagccaagtcctccctctccgctccctcgctgctacttcccgcgcgccgtgttcgcgtgcgcacgcccgcgcggacgccacccgttgcaagccgcgcgcgcatgccgagtggccgaccgcccggtcgccgccgccgtcagcctctgcacgcgtctgtcgcccgtgtcgtcgcgccgctccaaaccgcccgccgtcatcgccgtcatcaccgcccggcccccgccactccgcgcgcaagccgccaagggacggaggcagcgcccctcctccctttgccgcgtcgcccccgctcccctcctcctttttcccggatcggcaaaagggcaagcccctttctccccctcctttttccccttttcccccgccagcgtcatcctccctgtcgccgctttggccgcgaccgctgagcgccagctcgcgccttgaccgccctaagttggttcccaaaccgacattgccgccccctttaaaccccagctccttcccctccaatctccctcgttttcgcctcctcgccatagctgccgcccccgtgctctgttcgccgtcgccgttcgttgttgcgcgtgtcgaaggagtcggcacgagcaaggacgcggaaggggacttcggccgcgccctctccttcctcttccccggcccgaggccagagagattactcccgcgccgtcggcctctcgtcacagcgcccctcctcatctcggtgatgcctccctccgttcttccgcctcgctccatctcttccccctagctttcggtagtagctcaagtagactccccgtagttagccggcgtcgccccgaccgttgccgtcgctcgccgcgtgctcgccgccgtcgccgctcgagctccgtagcacccacacgtcgccagcctcgctcggcgtagctccgtccaatccgacgctagcatcgagttcccgaaaccgcgtagatgctctcaccgccgggaatcgacccctcgtggcctcgccgccgtttccctcttccctccccgccggttgtcgccgccgcgattcgccgccgtcaagcttcctccggcaaatccgagccgttggctcgtctcccctcatcacgagcaaccgcccggtgtgctcgcttttgtccgtatcgccgtggttcgctccgccactcggcgccgccacccgccgtccattcgcggccgggtcgtcgtctacctcccgccggcccgcgtggcagccacgtaggcgccacgtcggcgccagctcagcctagaccgggtcgagccgaccccggtctgtccctccccgtgcgcgcgttccaccgcgagccgtgaggctgcgcgtgggcccgccgcatccgcgtccaccgcgaaccgcgcgcgtgcaccgcgtccctcccccgcccgcgcgcatgagccgcgtactccctccgcacggtgagccgagccactgacaagcgggtcccacccgggaccgcgcatggtgagcccggtccaccggctctctctctcctccctcccgcgcgcgcgcgtcttgggccgctttgggccgccttcttgggccggccggcccgttaagctcggccgagccgccctttctctcgggccgcgccctagccgcccgaggaaagtctatattccctccctctccccttttcttttctttttcttttccaaaaaaaaagagatttaattaaatccttttcctttagaccaaaaatccaataatcttagaaattcaatatcttcccaaccgtaaatccgtttgactccgttcgaattccaaaatttctcaaatctcgagatctatctaatggcacgcttagaggtcattaatagggctttattttcgccgtttgttgagttatcccgttttgcgtatagtttcggagcccgaagacccgcagtgcgaggatttcgaggatcaagctccagatctcgagcaaggcaagccacctttgaacatcttgagcctatatttgaaatctaattatattgcttgcaaaatattatgcattgataggattgcacttaatctgttgttccgtctgcaaggcagattggcagacctacctaacttgttgcatttgatccttccattgttaattgctataccatttccccttgtaaccatccagttgcgcctcgatattcgtgcaccctgtgccagtatcgacggtcgccttcaaacttaaaatctgagtaacaacttgggtaaaactggagttttacaaaagacttggaaaacccgacacctgggtcggtgcttgcgaactaaatgaatttccaaaaccgcagaccgggaaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatcggggttagtaatgtcgtgtgggtaaagtgtaccccctctgcagaggttaacaaactgttcgaacagtcgtgcccacggtcatgggcggatgtgaggtgattcctagcgtagtttggtttgactactgcttgtgaaattgctgtgtgaaaaggggttcggtgtttgaaaaatctgcagctgatgggatcagctaggcccgggtggccgtttgaaaagttgttggcccgggtggccgttgaaaaagctgttggccgggtgccaatcttgtttaaattctaaagactgatacattgcacatactccgaccggacgagacgcactgtctcatccgtgtcgtttgagaagcactcacttagttgtttcagaaaagagttcaaataaaattaattgcaaaaacaccagcctttccttgaagcctgcattaaacacttatttcccatggcttgctgagtactcccgtactcacccttgctctatataaataattccccccccagttgctgaaaaagatgaagcggatcctgctgatgaggagttcttccaggagctagccggctacgatgagttttagggtttcggcctagttcccaagtcgcgcctgtgttgattagtccaagtcctggcttccgctttccttttgtaatgcagttgtgagctcgggatctgtccgcagcccaacatgactgtacatctactctataataaagagacctctgttgctgtgatattctgtctccctgtgataccagcactgtttcctgggactggtatcgattaacaggttaatttggagcgtcacgggctagttccggtcgggactagttcggggcgtgacaagagatggtatcagagcacaggcttggccctagggcgaaacccgacgcttaggacgaccctaaggatactaagttcaaaactacttgcgaaaagctaaggattcttttgttttctttattttcaatagtttgtttctaaaatggttactgatccttctccctctttcaaaattgtagatggcagtgaacgccagcttcagttcccacggttttggtgagggtcaccacgtcgctcagcttcgtgacctcgcccgtttccttggcttctcgtgtcccgagtacacggggtactctatggaccgtgttccccctcactgtgagctctctgtgtacctttacccccatggaggtatacacggagctggccttcgcccacaccacttcactgtggctaggcccaccctccagatcgcataccaggacctctcctggactgcgctttgtcgcctggcccacgactacagccaccgtctcggaggctccgccttccggcagcttccacgccttccttctggccactcagacgccaggtacccttgtccgtacagcgagtctcagccagtactgactcacatggttgagctttcggaggctcaggccactcagcacgacctactccttgaggcttaccgctcccttgcccgccgctacgccgctctggaggcccgtctggccgaggagggtgtcacctcagttgacactgtctcttgggactcaggtcgcctctgccacgccagccacctgtcctcccacagctcccgcggctctgcccgcactcccagtggcccgcgctcccccagctcgcgtgcgccgtactcaccagtgtactccccctacccgcacccagttagcccttcctacacccccggacacaccccagttgcttcctcccgccgtggcccacgctttatccgcactgcgcggaagcgtgttgttggttcttccaccgtgttccgtttccactacccagctcccctaccgccagcggcccgtgctgctgtcggccctcgacaggttccgccggtcccttcgcgtcagccgatcgacgtttcttcgactgaggagccgactactggaggcagcctggccgacgaggagtagaggaggcagtcttcagcagccgtccgtgtgttaggcccttttgttccgccgccaactcttttggagtcgtggcgaggtagtgcgtgcgtgagtttgttgtgggtgttgtttggtagtctggttctcctaggtggtgtgcgcacagtcaagctcggcgtagctctgtgacttgtccacacccgttgtatcaggtgtttttatgatttgaaaaatccagtttatgcctagtgtgtgctatctgagttgctatttactttgctccttgctctcctaagtgcttatctgactcttcccccgcccttttctgggagtttagatggctagccgcccccgccgtgcagctcgtgcaccagcccgctttggttttgaatatggtagaaccgagccggcagcaaatcatgagtcagctaatgagcagtctcaccacagcaaccgttcacaccgtactgcttcccgcaatgcagaagttgagcaaccccgccgcagcaaccgctcgcatcgcacagcttcccgtgatgcagagatggaacagtctcaccgctctcaccgcactgccagtcacaattctggagaagaacgccttccttccccacctcatgtggaaaacaacatgcagcacttaatggcagttcagacacaaatcttgcagggattaaccacagccatagccagttttcagcataatgcgcatggaaatggccaccctcacgtgggcaacaatagatccaagctgacagactttctgaggtctcgtccgccagagttctctcagaccgtcgagcccgtcgaggctgacgattggctaaaagatgttgatagaaaactcaacttagtgcagtgtactccggttgagaagacgctctacgcctctcaccagctaagaggacctgctgcagattggtgggagaattactgcaatgcacaccctgaacccactaacattgcttgggatgagtttgctacggctttccgtacagctcatgtgcctgaaagcgctattgatatgaagaaagaagaattcaacagacttaagcaaggcaacagcagtgtcaatgagtacctaagtatgttcaacaagttggctcggtacgcccctgaggaagtggacacagacaagaagaagatcaggaaattcttgaaaggaatcgcagttggaatgagactccaattgattgctcatgatttccccacttttcaacatatgatcaacaaggcacttctactcgaggatgctagaaaagaggctaccgaagaatacaagaaacgcaagtctaaccatcagggaaattcttcccgaggcgcacctcgccctcgctacggacaacccatgcaataccaccagtcggtcactcaggctaaccgccaaccaggctacgcccctcgtcctcagatgaaccgtccggcccctcagccacagcagcgtgcccctggttgcaatactgcgccaaacagtgttacctctttcaagtcaccgcagggaccgtcagcagttcagtgtttccggtgcaaccagatgggtcactatgctagacagtgccctcagaaccctaccaacaccaactcagggcatgcgaatggcagcactgccagaactcctaccccagcggcagctcagtctcgtcctagctctcaggcaagtggacaaggttcacgtgtttccaacaactttggtcgaggccgggtgaaccacattcaagctgaaaccgctcaggatgctccagacgttgtgatgggtatgttctctgtcaactccgtacccacaatagttctgtttgattcaggagcttcccattccttcatatcacaagcttttgtgaaaagaaatggttggaaaacccaaaatttacgtgtaccaatgat

SEQ ID NO: 70421 - DNA, 1225 bp, Oryza sativa
ctagcttctacttacaaatttacttgatgcgaagttggaaggtgcgaagaaccacggagaaacaaggtgacatatcagccatacttagcgaacacctccatagaacctgcatactgtagtactaattgacatcctaaaattggcaatccaaccaatgccagacatccatgtgcttatctgtcagtatcaaaaaaaaaatgatgttaggtcccagagagaaacaatacctgaaaaaaatgagatcgtacccaataataagtagttttcagctacaatattccatcaaggaatataaaagattgttcattacagaataattcgttagtctataacaaggtgcagtagttccacatattagaacaattttgagctgcaccatgtttgcccactgagatgaactccgagttttgtactctgaaattgtttccaaacaacataaacgagggtactaaaactcacttctgctcaggaatgacgtcaacagacaaaagtaaccatctgcaggtatataactgattctccgacaaggtaatgaaatgaccgttctctgtaacaaaaaaagtaacgtcaaatcagtgttctgcgcttcagaaaattgaagtgggaattaactctcaacaaatattttgtgccaaatgtgtcaactaatgtggcagatcatgagctagtctaaatcatatcttggcaaatcccaggaatatgtaatcttgtgtaggatacgaacctatttagatactaatggtaataaggtatctgatgttggcaatgaaatgctggactgctagaatgctatttgcattgatggacgttttaatagattctttcagctaatagaactgatctggagtgagaaagaaacagtgttattttgccaccatataatatgggttttgctggattagcctgcgtagactatacagtgtataaatttgctttgtcaagatccgtagtcaatgaataacagtggacctcttagtatgagaaaggtacttgagcatagtgaaaatatgaatataccaaatgtaaatcaaatagacagatgagtgtttgtgggaaaaaaatagagacatgagagtttccacttgtccagactaatgactaaaattcaaaatttcacccaaggaacagaagaagcaaacagagagtggcagagtgagacaccctttaataatatagaattatatataataaattagcaattttaacacaaactagtgattcgcag

SEQ ID NO: 70422 - DNA, 5928 bp, Oryza sativa
taaatgaggtcactatgcaaggtttatgttgagaattgagcttaagagtttatgcaaaccttcactgctagccatctaacatatccagatctcctgattgcatgcattgatggagcataacaggtacaagcgggcctcattttcacagaagaggaagttgagtacagagtgcgcaatgttctggccagtgttgaatcatctctctctaatgcatcatacctatcgggaaaccctcctgagatagtggtttggagtgcctcattgtatgactacaaggtaattttttatctcaggttatcattccctattgctatcctctagcaacctaattatgtttggcatgctaaaatcattccaccagaatccgagggaattgtcaacatcacacaaccaatttttgaaggaaaaattaccgatgaacacacctcttgctgccccgtctttacctgctctgaacatagagatagagacaggtgtatttcagttctctttttttttttggttagtgattatatccttgatcatttttggtgtgtgcattgtgatacttgtgggctactagctaatatgttcaggtattttacttttcttttttccttcttgtagtatagcgaaggcaaccgaatatattttttttttcaaaaatgtatttcacttttctttgaatcaaatcaatccatctcttttccttgtgatcagatttcttgtgctattgatgcctctaaacgcacacacaacacagtgtcaaacttaaacgaaatcctctttagctacacatacaaaaacatcctccttagcaatagcatggtttaatctcatcatcctgagtatgcattacatcagtgctgcgtacaagttcgattcaacgcaagctgccaatcaccagagcctttggaaaggccatgaaacggccctgtcagtttggtcaccttctcccctcaaaaagaactgaagcattagcactccatgacagcaactgaagcattaagcacaccatgacagcaatctggccccccctgttctgtctagagtgacatcctttcatgacagtcactcatcatacatgctggagtatgtacttatctagcatcctttagctttgatgatgtatgtagagccaaccttctgagtgactttgcatgataacaaagcagcataagtacttagaaccagcatcagccattggtattagtacctcttgcccattattacattttgttattctttatttggtggccatctcaaaaatgcttaagcagagttcccatcagtgaggccataaacaaattaaagctctgattaggattacccaaccaacccaccttatctaagcacaagctttctttcaccagggccttgtctttgagtctcaccaaacctgacagtgacacaagcaattaatcctggcctctgaaatatgtcaagttgcagatgacaccaattccttttgacaagttaccccttatcatcccttcttccttcctgccccctaatgataggctaaggtcctatgctcagtagattatgtattatggattaccacaccacgcttcccgaacccctaatgaacggtactatatgttttacaaaaactttcttcatcaacagttttaagaaaaccttttcaaatcgacttatcaaccaatatttacttcattcatttgcatcctcaaataatatgatcataaactcaatttcagtttatcatccatcttatgctaagaacgcccttcaagagatcgtttacacaagaggagtgaaagaacatgtagttagtgattgcagtgagtagcaatctaagaccctagcttcgaatcttcgtaggagcaaatatcatattggattgtttgaggggctaaattttcaatttaaataactgtgtatattcggttggattagaggccgaataaaaattaaccatctctaaaaaaaatatttacaaaagaggtaaaaagcaagctactaattacttgttgctatcaaatggccaccactaggagtagtactagtgtactactagccctgttgcttgctctctctgcaatcctcctcggatttgttaatgattctgttcttttttttcatttcgcccttgtcatgccgtctgatcacgtgctgtgatggatgttaacaagctattgctcctgggccaccagctcgattttggctctgctatctgctgcattctcgctgtctccttcgtgacgcactcgatccccctctcgccggctagatttcttgggcagttgctacgctaccgcctcgctcgccgacgtgtgtgccgggcaaatcgaaaggcaaggatcccggcgagcgcactcccggatcggatggtgagatctctctggggcctttttgcagggcacacttggcatctgcttcttctgatgcggatgtttctcatgatattgcggtagctagatatgcaattgatagtgcagcgataaggggtgtatagtttcaacatcaaggtcctatatttaattccaacgcgctcacaatttcttctttaaaaaaatgtttggagggacatctcttcaaatctagtttttttgacgcatacatttctcagggtaaatatcggtacctcttctactctatcttccataaactagctacttgcctgtaaattctaacaggtcaggcatatataatgtatgtttggcagagctccaacttttaaatttagcttcgggagaccagctccactttcattttgtgaaagtgctccaactagctctactcccattttaggtagagttgaaactgttttactgtgagctggagctgtgccgaacagacccataaccagagagaaaaagttgttacttttcatgtacggacgcttaagcaccttgagatagtagagaatgactttgttttcaagaagtagaggtataaacatttctaacgtttaaaatttacaattcaccaccaacgccaacaaaatggatggaatcacttgaaagctcacgagttacggagagtactggaccgatccacctataaagcgcagttcctcggcttcattaacacgatcatttagaaaccttgctacccgctttgccgatacaccctggaaagtagaaacattcttttcacctcgtcatatacacaaggagaaactcatgtgagcaactcaagctgacaacgtgaaaacacaacaatgatggtccactagtggtgctactggccaaggtatattaaaaaaagggtccgcgctctcatcctactaacagtataggaaatatggaaggagaaaaaacatagagtgttttaacgcaaggggctcttggcaatagctaataggttgccaaaatcaaggagactaacatcctcatctttttgctaaggcttatacttatcaactaaaatttaaaatttaaatcttaaatttgaagttgattttgggtttttttatcgaaatttatttttcagcctttgctttttagatagttaagaacacgtatataaaggttttattcacaacttattttttatttgcaaatatgccgtttggcttattcaccgaataagcgaaacgattggactgtataacctaggacctagcatgagcaaaacgacttcggagctttttttttttgaaaggtttcggagcttattctttagctttgttctactttttttatagttctctttcacacgtatacaactcttctttttctcttattatatttaaaagtaaatttcataaaacttgaagtagtttaatcaatctatcacaaaactacaaatttttaataacatgtatcacaaaactacagatttaacatcataatttttttatataaaattacagatttaaggtatgatataaaaaaactacagatttaacgtcacttttatcacaaaaactacaacttctataacaccaatagtgctaagatataaactctaaactaaatctatagttttgtgatatgatgttttaaatctatagtttgtgataagtttggtgctaaatctgtagttttgtgatacatatctttaaatatgtagttctacgacagtttgatcaaagtatatgtagttttgtaaaatttactctatatttaattaatgaaattgtcacgatctagtacggttcgttcatttgtttttatttctagcatactacttcccaatccaaccggccactgttcatgattatctatatttacagatgtattgctaggcacgattttttttaatcaagtaaatttctagtgaatatcaccttaagtttaattttaaactcctaaaagtgtatatatccgtggatggaggaagtagatgccttctccttgaacaaattggaagtggtcgtattactgcattcaaagacatgtgttgaatgttctaaaaaaagacatgtgttgaaatgtcatagggcaattgttggatgagttagaatatatttatttagctcgagtctgatttgctgaacataataaattaataattaatagacttctaagagtgactttaaaaaataaggacagttgctccaaactagccctagttaagtcagaagggaagatggataagatgcaggtaaatgttcatttttggtatatccttttggcttgttctgcagaagatacaagcaagtacatgtcacagtattagttggaaatcaacaggctggctgttggatttgcagattaacttaaaagagactgtcacttgcgaagttggtatgactgcaattgccgctcttcgaccctctaaacggatgatgaggcaaatgaatgatcccgcgaatatatcctctaacataaagaaaaaaaaaacagataaaggccataaacaaactctgaaagaaaagtgttacaacattttatatctagccagtaataaatatatagtaccaaagcttactggtccatccatccgtatgactatgttctgaaccttcaaaacatgaaagagtcatttggttacaaaattgactttagttatgagtgcaacttgtcgtacaaaggtcaatggtcttggtgtgttcttatgtggtctctaactactacaaaagaaaatcatccgcatacttttaggctgtgtttagatcagaggtgtaaagttttagtgtgtcacatcggatatacggatacatatttaaagtattaaacatagactaataacaaaacaaattacaaaatcctcctgtaaactgtgagacgaatttattaagcctaataatccgtcattagcaaatgtttactgtagcaccacattgtcagatcatggagcaattaggtttaaaagattcgtctcgcaatttacacgcaatctgtgtaattagtcattttttcgtttatatttaatactccatgcattcatgtgtccaaatattcgatgtgattgggtgaaaaattttaacaggtgatctaaataaggccttagtctatactactgcatttgaggtctcatttatgtagagtatttatggagagaagcttcagaaattttctaaaagactaaactgtcaaaatagtacaatactaggacttcttatattgcagttgtaactatcgccataatttattagagctggcaagtttctactcttcgttcttagttaattctccatcaattcattaaggcaacatccaagttactgattaaatcttactttggatccttctgaagcatttcaaatgtcactgattgtgaaattatgcttagtgtaatgttgccgtagacccgtcaaaaaaaagttcacaattattactccctccgtattttaatatataacatcattgattttttataagtttgaatattcatcttatttaaaaaaaatatgtaattattatttatttcattatgccttgatttatcgttaaatgttcattacgtatgacttattttttttatatttgcataaaaattttaaataaaacgaatggtcaaacatttgtaaaaaac

SEQ ID NO: 70423 - DNA, 18326 bp, Oryza sativa
aacttcatctgttgatggcaccattcgtgtttggacctaaaagtgggaattgctgttgtgctggactcatatcctgacaacattgcttatgtggcattattctccaattcatctatttttgaagcagagaggattgaaaaggatagatgttcgcaagttcaaccctaactggaaccaaggagctgggtgttaagataagattgtgctacttggcagtagttctggacacggtcaaggcagcaatttgctagtgaggatgaactatatccaccaagctaagtcttctgcgcagcaagctccgacatgtgaaatacagtctgccgatgtaccatggccattacagctagttcaatcgtgagaactggaccagtcgaactgagtatccgtttggaactttacgatctggaacgagtgtacccatttgttactacggtcacctacgggtaatttttaacctgagattgatgatgatataatacggctcttttggtcataaataacttagttcttttcctctaaaaaaaatttaacttagttcttttcgtattgtcgatgacgtcttcaaaattgcttcccataatcttcaaccgacaagtcgtcttgcttgaaatactgaagagagccaagatttacctcaattggcaaaacggcaatttcaacaatgttttattactcgactcggcttatccattagcctgagcgtagtaaagagaagaattcaacaacttaatatcataagatttggcaaaacttctcacttctttggacataaaagaagctcctttagcgtttgaggaataccgaatctatgaacaatatactccaaaataaagtcaattacctccgcacaagtaatattctcgagcggcacggcttcggcccacttagtgaagtaatccattgctactagcacgaaccaatacccttttgataacgaaggataaatttgaccaatgaaatccaaagcccaatctcggaacggccatagtttaatgataggattcaacacagcggtacccgctaattgaacattgccgatccgttatcaagcttcattccctctatagcatttgaaacaatcatcaattattttcggccaatgaaaccccactctcctaagcaaccaatttatcttacgggccgattgatgaattccacaaatctcttcatgtactactctcctagcaactttagattgatcattatctaagtacttcaacaatacttcatctatttttcggcgatataatatttgaacgcttgccgtcgaatctcccgatcaaccttaagtgtaggatctttcaaatatctaatcaaaggaattctccaagctatttctacctcatgggcacaaacgtccgaattcacaattaattcggccttttaatcaatcgtaacgtgcccccagcctcctgtctgggatcggtcagaccagccacgcaatgccggtcagaccgccctgtctgcacggtcagaccggccatgcaaagccggtcagaccgccggtaccaccggtcagaccagccatgcaatgccagtcagaccgcccctggtctatggttttaccaatttcgtccaaagttttgaaatcaagcatcggccttcagtatataatttttcttcacataatagccagatgcttggtgtatcaaattattggaccaaaatttcttctctctagacatataaaaaactataacatccaactaacatatctagatgaatactaattcaaatggcttttgaaacaataatcatcatggcatcaaaacacttagccaattgaagtatgatcaataatgaatcaccaaagtcatatgcctcacacacatgaattccaataaactacaaatgtaaataatcggcttgagcatgtatgcaaaatattaacaatgccaatgtttctaaagaaaacaactgtagaataaatcatcacattgaccattgacattagccgaattactaataagcaaaactttcatggtgcaataaatatgaaatctatatcttatatagtgatccataaaaacacatacgatttggctttaaataaatatcaaagagtcacgagccaaatcatacttgaaacaaattatatgccaacctactaattctactacttagaactggcatttgcaacatgtatgtataatatcaatttgataagcaaaaacacacatgtgctagatagcaagcaatgttctaacatgacataggcatataatataacgatgaacaccataaacccataccttgccttagcatccaacgaacggcggctcgaagatgtgatgttgtatccattgccattcttcttctcttggttccctcatgagcatattaatgtcttgccccccaagcaaaatcggctttcttgattgcacgatttcgaaggcaagatgaataccgcactaacacccatagcatcatgtgaaggagacttatctttaatgaccgatgattcttctctcaccaaattgaatccatcactactctgtgaaagcaccgatcttttaacttttacttctttaggcctacacactcgcttaggtgtcattcgaggctctaaattattacatgttttgttctccacatcttcggcctctttttcttttttacctatggcccgaagacgttgtagcctcttcttttgagagcgagataagccagaaggtatccacttcggctgtggttgttttccaggagctaaataatgattcttaatatttttggtcgaaatagaagctcctgtgttgctctcgattttcccgctcacctttaatgccccttggtctgatcggcctctgggcccggtcaaaccggttgcaagccgtcggtcagaccggccaggagggtcggtcagactggctgtagacaggcggttagatcggccagctgtctcggttagaccgccaatgttgacagttatggcgtcagcttcgatgtcctttgcttgcatggtttccacggcatctccagtaggtacatgaacatcttgagactcctccttgacaacaacgacctccggagctttggcttcttttctcacccacaccttcttcacctttttcaccttttgtcgcgaccgagaaaattaccttttcccgaacgctactgtattaatccccgtcccaggaaaagccggggtacaccaaacaaacatgatacaaaaggcacatctttattatatcgattatatttacattattacaaaggcactttaggcctgacaatcaaaaataaacagcagcggactagcgggcctacggctccatcttcacaggcgctcaactgggatataagccaggactccacctaagacttcttctccaaagcttctcttactgaaggggggaaagattgagtaagaatgagtacaaccaccgtactcagcaagtcacaccgggagatgcatgattaatgcaagggagtacaaggggtaataatataggggttaagttttgcagtaaacagcatttaaaagtcacttagttgcccaaagctattttgtaaacacgatcctagagctatacaatattattaatcaaggccgtggacccacacgaacctgccttaacccaaggcctacgatgattcagaccgaactggcaacccgaccctgggtcccagctcgtcccaagccaacccaggccaaccattccacattttagttattaagcaggttttaagaatttaaaacactaagttgggtatattgctaggcttgcccataaccgagggcgcggctattcgaatagattatactctgatcagatgtgtacatctttacccacaagacacatcttcctcacgtgtaaccacgtgccacataccaccacggcatacggacgaaagacgtgacatagttcccaacccatcctagccatagacaagagtaccgacccaaccccacctacggccggaacctccgggacaggtaggcaggactgagcccctggcagcaggacaccagccctgtgccatgacatctcgactaccgggccgcagctcgtgtagccttcatttgtcctagagatgtccttcggcccccgacttcgtccatctccatccgtgtacttttgtttataaccagactgagccacaaactaagccttacctaatgtctagagttataaaaccacataatgttgcctaattaatcaacgaagcatctacctaaattcatattagtggaaccatgaatagagtacccattagttggggttttatttattctagggtgaacaaggtaataataacaatagcaataataatgtcataacaaaggtaaataggcatggctaaataaaacagtgataacgcgggaatttaaataaagcgataatgcattaatttaaatcaaaataattttataaactgggattcaatatgctcaaggatgatgtgacttgccttgctcagagagaacggccttccgaaccttcggcgacgaccgcgaaccacgcttcgggaacctccggaacgacagaagctacgcgaagcacacaagcaaagctacaagcctataaagaagcaataacaatacataaaaagaaagcacagggttctttaggttataacaaacattaggagacttgaacgggtcgattcgaggttcgtatgatcaagatatgatcatccgaagtttaatgctgttatatggagatttgcggattattataattaggttttgcaactataaaacatgtgtaagcgctagcctggaaaagacaggaaggctgcgccgttgacatgcggaccccacatgtcaacctaaaggaccgcggtagaccgagtacacagagacggtccacgggtcgacggaagcggaccccgtgtgtcaaccgaggcgagtggccgacaaacggactccactagacaccacacgggctgcacacgtggaaaccacgcggctaccgagcgggcacactaacacggacactacacggtcaccacccgcacacgtgaacgactaccgacaccggtacgcgggtaccggggtcgacaaccgcacaacgggcacgggcgacaccgaaaggacgaggacggggcagcgaaaggagagatccttaccaccacgcgacgaggcgtgggaacgacaacgacgaacgagcgcggcggagacggctcggggacgacggaggcgaacggcgagggaacgacttcggcggcgatccttggacgaagtcgagacgcggccggcacgaggcttgacgacgcggagccgaggacgaagacgacgacggggctgccgcggctcgcttgacggacacggacgacggacgagaacggctcgacggagggacgaacgccacgacaaccgggaacgacgagaggacgacgacgacgacgaccggggcgggcgaggaggcgacgagggcagccggtagcggctgcacggagacgaggacggcgtggagacgaggcttgggccgggcggccggcccaggaggagaggagggagaggtggcccggggagagagggaggaggagggagtgggccggggaaggagggagggcggcccaagggagagagggggaaggaaaaagagagggaggagggaaggactttgggctgggctcggcccaaaggaggaaggaggatttatttttagtttttctttttagtaaactttgataattgtttttgttgcttaataaatatttccggtgctctgaaaattcaagtaaaatttgagggctcattttagaccaaggagaatttaacaaaaattctccgggccacattcgaatttttcttgtatgtattttagtgtttgccaatttcttttcgaattttaattaattctattatttcttttagaaaataaattttatttcgggatgaatttatcaggacgtgacacctttgatccaccggaccgattcttttcgtgggaaacggtcttgtcttgagttaaaatgagttggtaccgtcctaggtgattgcttccatccttgatgacacggcataggtggttgaggcatccatggcatataatacataaaaggataaccatatagtgacattggatatggataccatggcatcacaaccggaggtttatatggagttggtatagttgatggctccgattgctttgatgtttgaccaaatctcttcctacgagatgatcttggtcttttcgaatcactagtttggttatcaaaacgttgaccggctaatcctttcttgtacttagccataagcatctcaaaagtgagtttcggctttttagtcttttgggaactagatgagtcatcttttgtaactttatgatcttcggccttcgcattttttgtcctattcttgggccgaggatccccaataataacacatttccctttctttttgccaacatcaatagaactaacagggagatgatcactaacgattccggtcttaggcatagatgtaaccgaaatagtttcacaagtgaccgatgaagtatcaatcggtctttgctccatcaagcttgcatctttgaaataaccatgaaactcatgctccatttgtgaccatgtagaaattgaattaggagcaagtaaactataccatgtagatgcaaagtttgacaacgaaagaggaaacaattttaacttaagcaaatcatcattactggccttaccacattgatcaataaattggccgatatgctccattgttgttctagcatcctcacatatgaatttcgtgaagttgggcacctcaaatccttgcggatatgagatcgaatctacgtgctcaggatacggcatttgatatgtatgcatagctacattggattttatttcactactatcccgcaagacattatcatcatcttttccaacatccacatgactgatttgtgattcggtcttaggtgataatgctatttcactttcacttgtgatgcaatccgaaccgtcatttagttcggctatatcttcaatgatgctattgtccaagctagcaacacaatccgaaccaccacttggttcggctattccatcattgtctaaactagtaacacaatccgaaccaacacttggttcggctataatggttattgcataatcatccaagctagtaagacaatccgaaccaacacttggttcggctataatcgttatggcatcattgcacaaattattaacacaatccgaatcatcgcttggttcggctatacatgatattgcactatcatctaaactagcatttaagctattgtcatccactcggctttcctgagccagagcttcatgcaacacatgatcaacatcaagaaatatttggccattcaatttctctttattagaatcaagcaatccatcatatgcaatgttggccaaatctttatcagttattttcaaactaaaacatcggattttaatatctctaaaccttttaatataatcagcaacagattcattgtatttatgcctaaccgatgttaaatcagacaacttaaactcagcttcattagtgtaaaaataatcatgaaatttttgttctaattgagcccaagtactaatagaatttgccagtaaagaagtaaaccatataaaagcagtaccggacaaagataaagaaaacaagcgcaatttaaaagtatcactattagcctcaccacattgcgctaaaaattgacctacaagctcccatgtggtcctactatcctcaccactaaatttggtaaattcgggaattctgtaaccacgaggatatagtacattatcataataatcaggatacggcctttggtaaaccttagcacgattcctagttttaatcccgaatttatccctaataatcccactaattatttcctccatattatcaggcctatgttgatttggtggtggatttggtggcctaataggttgtgtttgcggcgcaatatggttatattggccttgcctagtatcgggaggatacccctagcaacatcattataagcattagaaacatgtgggggaacttggggattagttgcagcagtagatacaggaggatcaaatgttctaagatgatacaaataactagcattggtcattggatctatcccctgaatcggtatgattgcgccggtctgaccggtccagagcctggtctgaccgacatccagaggcgcggtcggaccggcctgagtcccgatctgactgccggggtaatacccggtcagaccggccgtttggccggttggaccgacggcgaagtcgcggtctgaccggccatcaggcctggtcggaccgtctatatgcgccgctccatcggttccactgcttgtttgatctataggagcttggctagcagtggtagaggctttatctttacaaataaaatcggccaagagagggccaactttaaatcttaaaatctcatcaaatttacctccaaaagttgcatctaatctatctttaaaaacaatcatggatgaatctattgtagatgctacttgttgttggatagattgtgttacctctccattgcgtaccaaatcgggagcgagcttaggaagtggcccgggcttaatgatcacaccttgacgagtcctagtgcacgcccttatcaacgcctcctgtgtgatctccttgatatactcctacatggacttgcggtcttctccttcgaaatcatccaatgagatcggcatgatctcgttcccgctcatcatggttgatgaagaaattccttgattaattccagccatatagctcatagccgaaatatttgaccgaataaattaatatccggtcttgatttttcctttgaatataacaagcgtgtgtgcaagtaaaacagaattgcttctgtctcctcgtgtgtaagcaaaaattcagaaaatcgatctcacaataacagccgaaacaatatgaatcggctttgatttttttttaattctcctcagtagatgtgctaatgtatgtactaacagattgatgttgcttctgctgcttgtgacccggtagatcggctctaggagcctgatctttttctctgttgccgtgtgaaacaaaaaggaaacgttgccaagccgtctgctgcttcctgataatgattttcgatacacacgacatggcaagtgcttatatgaatttgatgaacgaccaaatagcttcgccgccgaatagattaatccagcgataagaacagtgcagcgactaattaaggtatagattaatttcggccgtttggccgaaacaaactattcgacgagacgactagattaaacgaaattcggccgtgatatggccgattagatcgttccccagcggagtcgctaaaaatcgtgttgccaacttttttgacaagtcgacaagcatgatcgcaacacctaaacgccttgcggtggtatggagtcgctaaccacctcaatctagctaaacggccaaatcaagatgggttttgaggaaaaacagctaaaccggctagtggagccgatttagagatcaaaatcagcctctaggccgatttagatcgatatgaggataactacccgtctcgtgggcaaaatggaaggttttcaggacaaacctacaaagaggtgtcgcactctcgcagcggcggcagacggtttacggcgcaaaccgataaagatggactaaactagggtaaaatagaaaaacatagtaaaagaacgattcaagtaaattgtattaggggttttacaataaaccggccttttcccttaaatgagggttggtcttgccctttacaagcccttctccacatccaactcgggatagaaaccaatagaaacacgaaacatgccttcccaagcaaggaaacccgagacccgacgaaaacagactcggactcggaccctgacagtctgaccgcccacatacctgcggtcagaccggccctactagccggtcagaccgcccatatacctgcggtctgaccggccctgcgaaggaaacccggtactttccaaactttgacaattttcccctatttcgtccataggtgtcaaatttgggtgtaaacaatgcctattaaaactagatggagggagtactatattagaagtcaagcaactctaattgagctactactccattattgtgagcttaattaagcgtggttatctataccacatgagtgacaggaaagctctgatagtcgtggtgcctgtgcacacgcacgccggcgtgcgtgatcattgcccagatgtgggtgatgaactcgccgccgttggccagcgccagcgcgtgcccctccggacccgccgacggcctctgcgcgacgacgacgagcaacgccgcccagaactcgagaagcatcgtccacacctcctcgaagccctcggtcgactcggaggcgcggtcctcgagcagcttcccgagcttgacccccctggccatggcggacggcgcctccgcctcccagtcgtcgccgaaccgcaccagcttctcccgccggcccgcggtggcgcagctgcagctacggaagaagctgccgaggcccgacttcacgtcgttgtacgccttctccgtccactccgggtcgtcgggaagcagcccgggctcgtaggataccaggtaggcgcagtacctcgacagcgtcaccgccgcctcgcccttgcgcggcagcggctcgccgtcgcagcgggcctcgagcagcgccgtggcgaggtgccacgccaggatcaccgtggcggcgcccttgctgctgtcgcacgcccactcgggcccgtggtggaagaacccgtgcctgcgcaggacggccacgcagctggtgaactggaggtcgccgccgtcgccgccgtcgctctcgaggaaggccttgagggccgcgacgatggccaccttggcctcggcggtgacgacggcggggcggaggccggcgaggcggcgcgagaggatgcgcgacgcgagcatccacacgcggcgcgggtgcagctggtggagcttgagcatggtgacctggtgcgccttgatgacggggcgcgaccggtgcctcacccagaggccgctccggatggcgcgctgggcgtggcgctgctgcgccgcctgcctgcgctggtggtcgcggttgatccgcatccgggcgtagttgcagagcatggaggcggcgaaccagtcggagagcaggtacagcgcgagctcgtaggtctcgacggagaagagggtgagcgtgaggaggaaggtgacgatgaggtcggaggaggagcacaccatgccgacgagcgccgacacctggtggcggaagcacctgaactgcaccaccgtgtcgatggagatgccgatgaatccccggaacagggagcccagcaccctgaacatgttgccgttgccggtgacgagcagcacggcgatgcagtagaggaggatgaagacgacggagaaggcgaagttggcgatgaagatccccggcttcggcagcgccagcgggatgatcgcctggtagtactccaccaagaacctcagctccatctccaccacgtcgaacgccctctcggcgtcggcggcctcgccgccccggtcgccgccgccgagggcgaggaggcccctgaggacgaacgcccgcgcctccggtgtgcctctctccgccatgtggcaccgctctatcctccgccggagcagcttgtagagcgctatgcccaggcagatgtcctccagcttctgcctcctccgcacgttgtacttgaacagcgggtcgctctcggcgagcttccagatggtgctcactcggaccagctgctcctccgtcttgccattgccatcgccatcgccgctcgtcccgccggcggcgaggatgtcctcgaggccgtcgatctcgaagccgtgcggcgtccggttgatcttgagctcgctctcacccatcaccgtgtagttgcatgctctcatggtgcggttgccgcggacgtcgcctccgtcgtcgacaacctgcaggtccagctggcggtgctccccgacgagctgcgccatgtagccggagacgagcgtggcgttcttggcgaggtcgaaggagcccttggcgaggtggatgcaggcggcgcgcttgcagagcttggcgacgctgaagatccagaggatgacgaacagggacttgacggcgaagccgtgtacgtaggagtagacgaggtagccgatccagatcatgcgggcggcgtcctcgacggcgtcgaagaggctgtacctgccgacgccgcgggagaaggcgtcgccggcgggggcgaccatggcgaagaccttcttgcggaggagctcgacgaggagcatccagaggaggatgaggtaggcgcggaaggggaggtccctgcccttggcctgggagaacatgaaggacatgaaggggaggaagagcgcgaaggaggccctgaagaagatgcgcgtcgccgacgagtggcccctgtgcctgccggagaagcggccgaggacgccgacggcgaacagcgccgcgccgaggaaggtcatgagcaccgtcgtcgtcaccatgaacttctccgtcgtgcgcaggtcgggcgacaccgcgaacgtcgccaccagcatcggccccggcgtcgtgcacaccgtcttgttgttgatgacgatgtcccgcatcactacccacctcccctcgccgccgccgccgcctctcgagtagtgctccatctctcttgcagtagtgtcttgccaatgcatgcagagcgcagtatttgtaggcggctcgatcgtatcgtatgcatgcgtaccggagagcttgtcaggacagggtggtgaagaaattaggcggtgtttaagatcaggggttgaaagtttttcatgtcacatcggatatacggacacacattttaaatgtattaaatatagactaataataaaataaattatatattttgcatgtaaattctgagatgaatttattaagcttaattaatccagtcattattagcaaatgtttagtaccacattatcaaatcatgtagcaactggacttaaaagatttgtttcgtaatttacacgcaatatgtataattaattttttttatatttaatactataatcatatccaaacattcgatgtgacggggtgaaaagtttttgcatggaaagaccttaaaatactttgctcgcaagagaaacaatgctgtgcgcgctgaggggtgggagcatatatgcgatcgatcgacaggggtgaaatctagtgaaaagctgtgtcgggtcgagaggctgctgaacattaacgtacctagctagccggcacacgcaacgtgccaagaatcgaatcggtccttcttcttcctgcgatcactgcgtgcagccagccatgcattcaggagtgtgtgcgtcaatggcacgtgttctaagcgagcgggcagggtatatgaataatctttcaactagctagctgtttcacactttcactaatcactcggtggagagaaaaactcttgtccttaatgacagcaaaatatggattacatagtatagaatgggttgtgaactagcagaaggtgagagcacactagtacacacaagatttttccaaacggtcaaaatgcatttttccgtgcagaggtccggtccatctgcacccatgtgtcaacgaaaatccatattttcgcgtgcgggtggccaaccgcacgggataattcatcttcccatgcggtccgattaaggggaccgcacaccgcatgggataatcaattatcctgtgcggtcaaattataccgtcctcacacaaaaaaaatgaaaaaaaatcgaaaaccctaaccctaaccctagaatcgcccgacgccgctgctcgtggtcgccaatgtcctcgtgttgtcgccttggtcgcgccgccaccgccgcttctgagcccgccgctcccggccaccaccgccgctcccgagcccgcctatctcgacagccgctgctcctgagcccgcctccgtcgcaactggccgccatcaccactcccgggctcctcctcctcctcgttgtcggcgcgacgtggatccggccagtcgcccgccgcgccgcctccgccagtatccgctcgctcccggccatcgcctcgtcggtggcagcggtggcgagccgggcgcctgccgcgtcctgtgcgctcggtgggaaggggaggagctagaggagaggagaggaaagggagagagagggaggagtgattgagggagaataaaagggaaaagaaagagagaagatgaaaattttgaagtgagtgagagggaaaagaggaagaggtatttttgtgtgcggtccacttaagaggcccgcacgtgaggcttatttttgtgcgcggaccgttaagagtcccgcatgcgaaaatcaatttttgcgtacgggcctcttaaaggtccgcacgcgaaaataggaggccaatttttgcagacgcacacgaaaacggttcgtctgggaaaatgggagctccttgtttaggaaaatcttttgtgtaccaatagcaccgagtagcacactatgcaccaacccctgacaaatatgagtaaattgaaggcaaatgggtacaaatacaatttatgtcatgtgaggagtgaaatggcacatatcaacaattataaggcctataaatctgcgatgataaatagcagtatactacagcgtgggagagcttgagataaccaatcagaccccatgaaaggagctgtatatagctgacattgttatacaacctcgagttgtctcagtctcagatagcagaacatacgatttctctaggtgatgtagggaaacatatatatacgatgtcttcggtttgcctattccccgatcagatgagtataaatagtcggtgggtttgggaaacaccaggagttcatgccccacaattggtcttgagttgacagtagtcaactcacacctcaacgcatctacagcacaacattcttaagtttgagttgcatttaacccctaactagaatttgcacatcccatacataccgacgttcgtggttcgatcgctgcaattttagaaaaggtccacgggcaaaaaaaaaacacatttttcatttgttgtcgttctgctaatcatatagaatctctagctaagaccgaagttggaacttattttattttctggaaaatcattggctgggttctttttaattgatggggatttggactgtgggattgagagtactcgggaaatagttagtgtcggggttgcttgttcattgattcagagtatatctttctacatacaagacaagctaaatcagtacattttgtctttgccttgcaaaccaacgagagcctaagcacttgacaagtgatctctacagcatgctggatatccagggttggaaattcaggaacgaaatttttgaaatttcggtcattttggacccctccggtacgatattatttcggtcggaattttttaatttttttcgtgaattttagtaatatttgttaaaattcaactaaattttgttcaaaattttggaaatttttggaccgatccaggatatccaaggcttcttagcagtccgtgctgccatcctcatcagctgaaagctccgcagggtatcaaaacaggtcattttaattgtacgaaggcgacttattttgagtatcactgtaatcaacagtttgcagcacagcagcagcctttgtcaaattatttgagtgtatacgaaggtttcttttcatcgagaatgtatcaagtttttctggtgtaattgttggtgcctctccatagtccgtaccttcttaatgtcagggtaccaggaataattccaaagttactaaaataagcacggaaaagcattgtagttttttatcccttcaaaaaccctcaagctgatttacgtgtttggatgaaaatatttgttaatgtccaaagcatagtgaaagttaaaacagtttgactttgaccagttaaaatagtttgactttgaccaaaatcaaaacgtcttataatctgaaacgggggagtatgatatatgcgtcgtcagtaactgaaaattgatctaattatgttggttccaaaccgaaattagtggcctttaatcaaaccatcaatgtgatgaaatgccactgataattagagcaagctattactagtgaatgctgacacaaccaggctaacatggctttaagaaggacacagcagaagaaaaacatggaacgaaagaaatcagagcacgaaccaaagagagtctgtgagataagagcaggtacaatagcaggctataagtcagctgcaaacatattttaaggagataaataaaaagagagaagggcagcgggctacagatttgtagccagctgcagcacggactccaagacactatgtgtgtatgacaggtgggaccaggtattaataatgtagtatgtaactattgtatgaatgagctattagattggctatagatgaattggagctagtagttggctatacttttaaacttgctctaagcagaaggaagatcagagagtagtcacattcacaggcgaaagagagcaaggcagagcaccaaattaaacacgcaagcacagcctaactttctagatcatgggcatggaagacaccgggaatgagaacccctctactcggaatctacacagggcatacttgctgttctctaccatccatcagccctagcatggtcgacgcacagtatacagatggagggagcaaccgaacacaagaggtacatcgatgcactgccggtgttatattaggtcttgggatgctgccgtgcacgtccgggaattagacagctagcgcacgggattccgttggatatagatgtcacgggatagattaaatgagccagagattaatgtctctcttcacaaggtgctgatttcccactccgtccaagatcttcctcctcggtatcgcgatacctcgtcggcgccggcaagatcgagctctgtatcgcgcgcggagcgcgcgacctcaccggcgacgagtccttgcggcagcatctggcccgaagcagcttgctctccccacccctagctccccccgcaggaaggtacttgatacctcgccggcggtgactcgctgcaactaaccgaagcagttgtgctctccgacgccgtccacaaagtttctcttcacgctctgcagaccgcagctctgctctccgcaccagcatgaggttacctagcaaggtatcatagcatggtttggccatctgttggatttgggctgtgcaaaagcacagttacgtgtcaccggtacgtatgtgatagctataaatggttctggatttgttggaaatagctatagctactactacaacttgttagctgaataatacaacattatcgatacttaagagttatttcatggtactccatgatgatacgtatgtatatgtacaagttgagctactgttaattgggttggattataaaatcttaatacttgactggtacccatcagattcatatgcatgggttacttgactccctcgtcggtcgggtgtgcgccggggagtcgtcgccccagggagggcagaagcgggagctcccctcatcctcgccctcggcctcggcgtcaccgtcgtccccgctgcggcctgccactttgcgcctccgggatggacgccggcagcctgtgtcaacctgcagcaggtatagccgtcaacctcctcctcggctcctcctcgagacttctcgcgctctctggctcgggcctcgaccctcacctcgccgtgcctcctcgacgccatcctccaccgttgcagccctccctcccccacatctcctcctctttttgacagtaccctccgatactccacaagtatcaggcttgataccttggtaccaaggtttgatacctaggtaccacctggtaccttaggtaccaggcatcaggtatcggtcgatacctaatcggtaccaaaggtaccaggtactaggtaccaatcggtacctaaggtaccaggtactaggggagcacacgtccctcacctcgccgtgcctcctcgacgccatcctccgccgttgcagcgctccctccctcacgtttccctctcttttttacggtaccctctgataccccacaagtatcatgcttgataccttgtaccaaggtctgatatctaggtaccacccagtatcttgggtactaggcatcaggcatcgatcgatacctagtcggtaccaaaggtaccaggtaccaggtaccaaccgtgtagcgcccgttccgtcgtggcgcctagcgggaaaattatctcttaaaaaccctaattgcgaaatttatttctttgcttgttgtctagtgtccgtgccatctcaagatctcaatccccgatctatcgtcgagtccaatttcgaatccaatccttccaaatcaaattcctccgcaaaagtctattttgcctcccccgggggtcgatgggccgatttcctcccggcccatcgacccctggggg

SEQ ID NO: 70424 - DNA, 102900 bp, Oryza sativa
aatcccaaagataggacctgcgtagagtggcatctgttatctgaggcctagtgtccttcctaatgatgcatacacctagtgtccttcctaggtctcaaataacagatgccactctacataggtcctatctttgggattgtatggttcagttgaagcctgttcgcaatatgagagtgtagagcgactcgtggtttgcggactacctccttcgagttgggaatggcattgaagaggtgaatgaggaaggacacatacacctgacttcggatatttgtgtgacatgcaaagggattgactcggacctcgatgggctcatggataccgtgttccccaacctaaatgataaccttatggacccaaactacatcacatctagggccataatgtccactcagaatgagttcgtggatcgaataaacatgaaaatgattgagcgatttcgaggagaggtgatgacatatcatagttttgatcgagcagaggatgacccttgtaactattacccgctcgaattcttgaactctctaactccaaacggtctacctccacatgtgttaaagctgaagataaactgtcccatcatgctattgaggaacattgacccagccaacgaactttttaacaggacaaggctagtggttcgtgggttcagaagaaatgctattgacgtggagattgtggtatggaaacatgctggtaagagagttttccttccttggatactcctatgcccttcggatgatgagatgttcccgtttcgctttaagaggaagcaatttccaattagactgagcttcgcattgacgatcaataaggcacaatgacaaacaattccaaatgcaggtgtctacctcccgaagccggtgttctctcatggtcagctctacatcgcgttgtctagagcaacctctagaacaaacatcaagattctctccgtgcaggacaaagagaaggagaaaaaaaatggtcagctctacatcgcgttgtctagagcaaccgtctaaaacaaacatcaagattctcaccgtgcaggacaaagaggaaaaaaaacaaacggtctaaacagactgcaacatgcacaaagaatattatgtacaaggaggtcctcacaacatagacgaggtatatctaatgtgcacaaagaatattgtgtactaactaattatctttgcaatttttatattaactattgaacacatttgatatttcagttgaaatcattacctactggaatatcagtcaaacttatttcatatttcatttgccgtacacaatggtttatcacatgcagttaaacatgatagatctggctatcacactcctttttttttcaattattgttataactaattcgatcagtattaattgagaaaataagattaatatactatttgcctcacttgcatgatcagatttgcagagtgatttcaccaaatatgaatatattgatatgttcatatatgtacacatatgtagaatttatttcagtttgtgtagcttcccttatgttgctaaaatatccagcgtaattgtccaactaacatgttcctgatggtatttcattgtcaataaattaaatccttcctgtatgttgaccaataagatgtaagattgttatcatcatgtctgtagtttttttgttagttggacatataagtcatctcggcatattaaattgtccaaagtagtagctggttgtatttttaaatttgtaagccatgttgatttttttccaaattaatagcaagttgcttctttgatttgtaacccaggttagttctttatttagaaagagttaacatctattacaatagtatgttgacgaatatgctaagagaatacagttttcattctgcaggttttactccttttgataacttaaagcatgtggtgaaggcaaacacgtgaattcgtggcagaaatttttgtatggaaatttaacattgatcagaacaatttgtatgcaaattatgcatcacaaattggcatatatttgatacatatcttcaatgtaccgtattttatcatttaaattaagcttctatcattggatttaaaatgtagcatacagtctatcgagatgattttcattttttttaatatatcgtgagtttttatgatggctagatgattgttacgtcgtatatttgatacaaataatcattgactggtcggattcgaattcacctaacgttatgtgtacttcaaaaaacaattaggaacttgttgttcatgtattcgtactattgtccagctataaaagaagatacatatatttcatgcttaaactttcttttcaagtatttttttattaagcaaattatctacttattacttcccttttatggcattggctcaaattttagtcacatgggatcgtgagtgattaaaacatgtgatcttaaattgatatatatttttttcaagttgcaacgcacgggcacccaactagttcacatcattttatcaattttaggtcatgttctccaagcaattacacaatattttagtgcttctatcccgttagaatggctgactcaattaaaggaacaacaaagaaatgtgtcattagaattttttagaaacaaaaaggtctgcattgttcacatcagtatttttgtttcaaaaaaaaaaaggtctgcatttgtaaactaatgatttttcaaccttcatcttgcatctaaaaatattgatcagccataaaaaaaagacattcgtgaaccagggaatagtgtgaacacatatattatagcaatcaagagttgagaagttaagattctcacctagagatagtagcatgtgagttcacaagatctgaataactggagctgcaatccttaaagcatcaatctgtgaacagaaaaaagcaaaagaagatttcgtgaggtgaaagcatgtgggtttgcaacagttgaaactcgaataaaaagaacaattctcaccggacactatgcacctgggtcagcttcctgtcagccagcttgtaaactctgaaactcgaatcagaagaaatttattgtttgcatatacttgtggtcatcgcaacgcgagatggaggggattatctgaaataccagatgtaggggattaccaaatggttccaaacttaactttgctttttttacatacaggtgatttttacatataggtgattatctgaaataccagttgtcatgggcgttgggccggctaaggcccatcggcagcccatgacaccagttgtgcagacaaatgagtgataacaatctgaatctctccagtagagaacataaagcgaatcaaggttgttcttgttcatgatttttgattatattcaaaaccgtatgatcaacttagtaggaaagaaaatcagcagattttatacgtgttgtgcctatttacaacctgaaacttatactaatgtatgtgatggcatgagctccctaacatggctagtatgtatatatctgctgttattatgaagagaaaacatggcagcatatgcagtcagcagaacttaccaagaagtgtattatactggagaggtagatggcatgatgctgaacttgaacagccttaagagagattgaattgaggaaaattaagagatgatcgaagtgtagcctgaaaaggaaaagcagagtgagaaaggttatccaatttctctgcagatattcattaaaaatatattgcagcgatcctttttaatatatcagactacccaacatacataatcttgattttagctgctataattaaaatcattgaataaacatgagaaattatggttaatagtgaacagtggggatttagtcaacacagtggatttctaaactcgaaagccattatgaatctctatgaatgaatgaaccataccctgcctcgtatgcctcctcctgtacaggaacgggatcgtctgtacactaagtgaacgcaacatttaattcatacatagtaaaacatcaagtacactaagtgaaacatttttcggtggaacaaaaaacaaaatgaattctcttaataggaggtttccaaaatatgtggtttttttgttgcactggaatatttcgttcactgcaatattagatctatatatagtaaaacattgtgagtacactaagtgaaacatttttggtggaacaaaaaataaaccaaatttccttaatagagagtttctaaaatatgtgggttttttgttgcaaaagagtattttaattcactgcaacattagatttataaatagtaaaacattgtaagtacattaggtgaaacatatatttggtgaaaacaaaaggagggagaagtaggtgggcccacgtggggggaggggcgcacggggagtgcctgatccggctctcccgcgccggtcgcgcgacgtagagattttcgaaagaaaggcgatccagacgttggatttcgcaatcgatccaacggttcatactccgcgggtctgcctggcgaaggatttttaatactactagagattatgccaagaccacctatacttgtttgtatatatataaagaaaaaagacgccctgaacatcaagtgcagcccatcaaaaagaaagagttgtacgcatgcctaaaccacctatacttatttgcttggttttctttataaatttgtcatactatcaagagaggtgataatcttggcaaacatataagagcagctctagcctgcacctaaaatcgatttcaacgtaaaaagaaccgaactatgcacactgtgggaagcgaactgcatgtgtcagatgaaaaagcaactccaaaacaaaagtcgaacactgatgataaaaaattgcttgttgctataggtgggattaagattttttttatgggtcccacccaaaatcgattttaacgttgtaggggtcgaatcgaatgtttatttgacttttgtggactagacttttgtgttcgcaagtgcaggatgggaacacatccctcctgcacgtaaaacggagcgtccttttaacatatgattaattaagtattggctatttttttttcaaaaatggattaatttgattttttaagcaactttcgtatagaaaatttttacaaaaaaacgtaccgtctagtagtttgaaaagcgtgcggacaaaaaacgagggagaggggttgggaacaggcgttgcaaatacagccttaccgaaccaacactacaaatgccctaagcaaacacacgccacattagtacacgagcgcgttttttttatttgtagctttgattttgttttctgtgtacgagaatctatacgataggacatcaagcacacatgagacaaagattatactggttcaggtcccttgcgaggaagccctaatccagtttatatgggattatggagaaaaccatatagattataatagagaacaatggaaccctgagattgccgacgagatccctatcaagaacggctcgacgagatccaccggtgagttggcttcgcgttctcttgattgtttctgctatggtgtgtgtcttgcgctaagattcgatgccatgtgcccctccagggtcctgtatttatatcgtaggttatcttgacctccagtagaactcggagatacctttctacgtatgggatcacaaatcccctatttcttccgaatatgactcttgtcgacgtttgatgtcgcgattccggtatttgtatggtatggggatcgtcggtgctaggatatatgcgagactgaggtaaaagagatatgtacaaggatttttatacaggttcgggcccctgaattgccaggtaatagccctacatcccgttggccgaagccggtcgttgctcttattcatcataatcacaccagtacaatatttggggtagcctatctaattgttgtcgacatggtggtctgaagttctgactcgtagtcgacaacagggtagtcttcctcttcgaatccgtgcccggcgagatcagagatagagctttcgtttctcctgacagtatccggagacaccgtagggaactagctatgcttatccctgaagtcgatatccgacgtcttgtcttggcgtatgttggcttgtatgttgatcttctgtcttgatctattgttccgtgtatgttgattgtggtgggtgtgtccctctcctcctaggaggccttgtatttatacccataggtgtctccttgtccaagtagaactagggaaaccaatatggatacaatccgagtagtccttgtcgtttccatgtagaactctggttgtcttttcttatccggaactccctccatatccgaggtcagtttccgtataagatatggtatgtggtgggtcctaccaagatttagtcaactactattaggtatgtggtatccgtaaccctgacaacactaacatcttttattcggggagacggtttccttgcggatcggctgttttccttagtttggaggtaacattcccgtatacttgaggatataccgtatttgtatatcttacgaccccaaggataggagatatgccttattcgtaaccctgatagtggaggccggtcgaaccggggttttagaactggtcgctttgggttggtccaacagattagaaaacctttttggataaggtgaatagaccgggccctaggccggtcggtccgggcatgcccatggcgctataaccccctcaacaccttcctcctcggcaaggagacactcttggcaatatttttatatttcacttgatctattgtatttactctcatactacttgagcacttctccattcactgttggtttttgagggagagtaagccaagataagtgtattgcaatttcatttctacccctactttgatgtctaatattgattttacccttattttttagggttttcgtttttaccctcaatttttcgaagtgaatgcttgttttgcccctactttggatggtgaagttaacggtgttaagtgattgagaaaatgacatttataccctctcatgtatgtacattaattatgtttttgtccctattttatacacgtagctttgaaactttatttttgggagtatatttaaaattagatgacgcacattgactaatataacaatttggacaaattctgaatttgatggaattttgacaaaatttcagcattttgatagaacttaaacaaaattttgacaacattttgtaaaatgtaattatatgttccctttagatattagtcaatgtgcttcatttaattttaaatatactcacaaaaataaagttctaaagctacatgcataaagatggggacaaaaacacaattaatgaacatacatgagagggtataaatgccattttgtcaattacttaacatcattaacttcaccatctaaagtaggggcaaaacaagcgttcagttaaaaaagtgagggtaaaaaaaatcctaaaaagtaggggtaaaatcaatattagacattaaaataggggcagaaacaaaattgtcccttgtttgaactattgtggcacttaatcacattcgagcatggttgccacctgttacttttgaaggttgctgcatcctatatggttggaacgagttgtccagtgacctctacgagaagattgtgaaggaggcttgatattagttgtctgtgatgccccagtaataattaggaaaaagaaaaaagagaggaagaaaaaaaaagcaagcagcaaatataatggacgcatagagcaaagctagctagcgtgcagcactagtctggttggcctttgggccttgaccggcccacgcgaggagtagcggtgctatcaacgtatcaggctagcagcaacaggcagccagcaaagcgcaacaagctagctggtcccacatctctagtgaagcttgagatataatactagcttacttatatattaacatcaaaattgaaacttttttaaagcgaggataaaagcacatagtgttacattgtaagtgtgttaacagtgaaatttggtaagcccctaaaagaattatcacatcaccaatagtcagattcctgctatatttggttaagaaaattaatctatcaaagaaagcttatccagaagtgacagagttcaagaaggatgcggcatgacaagttatctattaattagaaataatttattagttttcttttcatctttaggaaagtgtatttaatgtcctataaggacttatatgttttccttttatctttaggaaagtttctttattgtcctacaagtactagtatgtccccataggtataaatatgtacacatggggtcattgtaagagatctccacgatcaatacaattcgggccatcgtcaccttttaccttttctattttattttatcgtccgacgggatttggcacctaacgcggggctgcatcgcttttcgatctccggcgaaggggtaggtcaaatgttccgccggcctagacaattatatcgtctacgttggcgtcgttcaaggctgcatcaatacattcgacctcttggattgctcaggtttggatgatatatttgtctgcctttttatcatatgtcttagttaatctattcttagtatatcaatttagctctatcggttgtctctcgctttagggtttctgccggtatcggctaaattgttttactagattagattagataaggcatctaccaccttaaaaattaattagtcaagggcttgattgtctagatattatgtttcttttcatacttagtgctgcatcagttaagtttgatctactaaaccgtgtttagaaccataatctctagcctgcttcttgactgctaataagggtttcatcggggtttcagccaatgaggtatctagatgttgcatcggcttacaagcattacatacaagttggatttagctaattgcaacaaaggtttcactgtttatccaatcttgtggattttatgacatcagacctctagccgatgtatgctttaatcttcggatcagtgcttattctatcatatcatttctagccgactggtttctactggattatattgtttaattatattgattatcggccgattgtctttatatcattatatacattggacgtatagccgattactcgaaaccctatcgctatcggctggtatcggtatcggctagaactattccatcggcttgtcaaccgatcagctgttttatctattgtttatatatcttgtcggttgcaggatcaaactgactggcacgctcgcatatcatcaagatttggacctgcactggagctaagcagatctcccaggtcagtgtgtatttttagcatcaatagtatggtccaacaaattgagttgcgcctaaatccgcctttagaccctaggcatcacaaccaccttcagctgaaggaataaccgtcctagtgatcgagccttatatgaacaacttcaggtttggcttccaccttacccattccttaactaggggatttggaggtttgacggtttgatcggtgaggttgggctcttgtgtaaaccatttggaaaccggctcccaccttaccgtgagttcttcctgctgtgtagttgaacatccaaaaccctcggtacgcattcactctgtttcgtatattcaatctattcatgttttacgtactgtctagttttagtttacatgtatagattgtatgatacgattatgctagtttacatgttcaatcttatgatttatttatagaataaattaaatcaatatgtatatttttaacaagggtcaccctgactcttcgttggtatttgattagtgttgttccattaatcatgatgtgtactttgccggattccaaaagctgtttaatccatgtgatccaaactgaattaaacccctgtgcgatagtatggtgtagagacattcccagtttaaccatatgcacaattttagggtaaataaacatttgcagtgtatctactgcattacttctatgtgtttattctttctttattcacttttcagggtgctcagattgttggaatggttgcagaagcactgaatgttccagcaactgccaaactatttgattaaggccaatgatgtactgggtatcccccaaccttttattctatcaatgtgatttcacctgtttcagagtacttgttctgccatgttaccaagtttctgtgctctactccaaagttgaaaaaaatagtgatcatgctaatgtttttaaatcaatggaccaaaatttgttggatctttgaatcaatggaccaaaagaaaagcttgattcaattaggtttgttgatgaatctaggggttgtttagattgatgacattttaaaccataccaaattttctaaagttaccaaagatgtgcatacatttagttttgtaccaaatattgctaaatacataaggaatcctgcaaaaacttggcaatattgataacttaccaacattctagcattgccaaaatttgataatgtttattttggctataatctgaacagcccctagttaaacacctctatattttcatcttgcaatttctgctagaagtctagcccacaatttttttgagaattcccagctatgattttatcaacaattgtttgagtgccaagtatgacatatttcagatatggttccggttattgtcagttaaaaaagttgaattcttatggtagaacaatactttttttagccatctatgtatgggacttcctccgtttcataatgtaaaattttctagcattgcccacatacatatagatgttaatgaatctaaacacatacatatgtctagattcattaatatctaaatgaacatgggcaatgctaaaaagtcttacattgcgaaatggaggaagtaccagccttgcagctgtagaagcactgcgtgcacgtgattgagaccaaaatgtaattgactctgtagatgtcgcatgcagtctcagcttatgagaatacactgcacttgcatttgctggtgttttcaggtaattcctttgtcatgttcataaaatcatgcatattttgttttgaaacaataagcacgtgggttccttgcctatcatgggggtgaacatatatacaatggtttgatttgatcgatcttttgttaatacctgtaagatggaattcctaattgaagcatcatactttttcattctgctatgtgccaagtttgtatacttaatcatagttctaaacatgcagggatggtttgaagctgtcaagcttagaggagaatccgtgctggtcactgtccaaaaaacactgagatatctctaccttgatttttttttttaccttcgaaatcgataagttttcattatctgtgtaggatgcttcagatgctgccagcagtgctatggttagtgtgttggtctagattcagaaacggtgcaacaattatgcgatgctgcaatgacgaagtagatgaaaaagaaagagttcaaatagctagcaaacttactgtgtcaagtgtttcatttgatgttttcggttccctatttggtaccattgtcatgttgtgttattttattgcagggaaattacgctgtttgtggtgatgtgaagggtattgaagaagttgaagtcccttaaggccagaacgatggttaagtgttcccatgcatctatatgtgttacctgactatcataacttgatgtgttgtattttggaaatgcagtaaggttaatctactgaatactagctcctttgctagaaagaatatttgctcccatccagcagctctcccggtaccgaatctcggcccttcatcctgcccgatcgaacggttggaaacatacggtacctccaggtacatatttttttatgagatggtaccacctgtattgagagtggtggaaaggtatttttgtcttttcgtgtagataagttttctctagctgaacaccctagtttaattccccttgtgtgtggtagcggcggcggctgcgaggtagcgagggcccgtggccgtgactttggtggcgggcgtggggtgccgactacggtgatgaggtggtggtgctgtggcggcggtggccggtgcgttagcgaccttgattgtgaggtggtggcgtcgagttgttgcggccgcggtatattaaggtggtcgtcggagtcggtaaatgacttagctgaggatttatcaataatttcacagcgcgcacagagattgttggtaatgttctttcatcattgcttgtatggcattgccaggtcaatgaaggaaaaggcttttcagataatccccatgagaaataaattagagggaattaaaagggattagttccaggtatatgaaatttcctttcgattttcttgtgaaaggaattgaccaaacaagatctaagagaaataataaattaataaaggtacttgaattgagaacattgatgcgtgagatctgtaagtatcctaatgtatcgaatgttagcaacaggggttttgtggcaaactgtcagtagcccatagttcagagtttctttttgtggtttcatgtttatttacaccctgtggttctttgactccaggggcggattcaacgtgggtgtagggggacccacaagacccatagatacccctcggaacacctcctttaattttttcaccatgactgataaactaaagatccctaaatgactggaggttaaaaaaactgtgtaattgaatccccaatattttgttcctggatcaacccctgtatgaccctccacgtgtgtgcatgtgcaacggggtacaaacaagacccataaatactgctatagtttacgcaaaaatccttaatgctgctcctacgctgagactgatataaattatatttgtattcagaaactattaagaagtggagtactccatattatcatttcacgaattatactcctggtcgcaaatactgttgttgtggataagatttaatcaaacttttgatgcttcgactgtcaatggtttatgaaatacttaatttgaaaaaaatatattttatgtatatttgttttaaaaatacagtaagtataacttatagtaccttataaacttaggctgctttcagaggtggagattcggagcttcatctccccgcacgtaaaacaaagtgattcattagcgcatgattaattaagtattagctaaataaacttgaaaacaaattaatatattttttaaaattaattttttatataattcttttaaaatctaccgtttagaatatggatagcgtatatgtgaaaaatgatggagtagaaattggtaagaggtgtgtatataaactaattcgaatataaaatttgtggtcaaaatcgcatctcaagctcagttaatgaaagtcaaacgtcgaagtctttggtgactgaatggatcactttaattggagaactattaaagaactgcattgtagcctgtaggtatcgaagcagttcgcagtttcagaaagaagcaccttttgttgcaatgtttagtattctcaatcggtttataaactggttaggtaagaagcatggatggctgaatcgtcggcgttagttagctcaatcgattggtcaagatagagaaagaacatcgacaatggatgtgctgacatttgaagaaacagcccggccaagaaaatggatacagatttacagtaacagataaagaaagtgttcgaaattttagcaaaaattgggttatctgaattgaacagctcagctgtctttctactaggagtatgcctcccaacaggctgaaggggcctcaacctttctcgctgtcttctttatagccaatacatgatcggattgaactgagtttattagaattatttgaggcccaaacaaatgaattacatattaaaaagattttttttaaaaaaatatcgtttaggagattgaaaaacatacacacgataatcaccaaatccataaagagagaaaaaaaagtaggcatctccatctccaatatttatggccttaataacattaaggtaggtctcactatttcttggttattgccacaatgcttaaaacaagagtgtatactaagatggacctcacaagtgtaaagtttattacctttatcaaccatcttagttttacatattactttattgcttgtggttgagccataagtttggagttatcctttgcatttagaggttgtttggttacctcctaaactttgccaaacattgttacacctcatgttaggcaagtttgatcaagttagctcattgtttggttcatgaccacacttgtgataagattctctttcatttctcatggtcccatatgtcatcaactcaaaagtgtatggcacacttttcttttgctagctaaagtgtggtttacattttgttggtcataacttagctaaagtgtggtacaaaagtattataaatttgtaccggttaaaaactacaggagaaacgatctttaataccggttgtagcaaccgatccagtaaatcgagactaaatatctcgatctcaagatgcatactaagacaaaaaaaaagtgagatgtggaattcgaactcaagagctctcacctcagccctgctttctttttaaactaaccctggaggcatctttagtatcggttggtaacaccaaccgagaataaagatgtttctaggtacttcgactttaactagtactaaaacatctttggtactagttcttaatctagtcgagatatttatgttttgggacttaggataaaaaatcgtttctcatatattaaagaatgaaaatgttaatatagcatccaaacaaccatttagtgtattgtggcttacctccataatgtatatggtcaccataaggtctttttataatcactttttggctgctcatatagtatatgtaaggttgtcagtccagtttttggttttcttctttcggggaaccactatatttctgtatggccattttagctgatcgtatgctttcttttatactagaattaactaggataaaaatagtttgataccctgattgggatttgacactagagtagtactactattttttatataaaataaaaatcaagggtgcatcatacattcaccaattcacgtcacagacgaaagaatgcactggccctctttaccagcaaaccaaactcatcagtgcctaccgatcgtagcaagtgaaaacaatgaaggcaactagtacaattatttcttttccaaacacttttttgccatcaacctctattgtcatatactacctccgtttttcaatagatgacgccgttgactttttatcacacgtttgaccattcgtcttattcaaaaattttacgtaattataatttattttgttatgagttgttttatcactcaaagtactttaagcatgatttatatctatacatttacataaaattttttaaataatacgaatggtcaaacatatgttcaaaagtcaacggcgtcatctattaaaaaatggagggagtatgtggaatatcaccgtatcatatcctctaacaaggtggggaaggggaggggaggggaggggagggggttcctaaaatccatatatacaattcgtgaaaaatagaaatgattccgtaccaccacaatttgaacttcataaatatcttaaattatgatctacatatgaaatgaatgtaatccccacataaagatctggatccctttcacacatttaggcagcgtgtcatctttaacccttgtacaccaaggatagaccaggtttttcacttttggtttttaccaaaattttagaattttggtgcaactgaaacttttggtaattttggaactttttgcccaaaattatttgaaaaattagcaaactttgactgaatttggataaatttttgaccaaattcacataattttggggaaaaagcaaaaattccgggcgagatatttgcttgctagaggggagcgtaattacaaaagtttcaaattttcaaaccaaaattggaatccctgggatagacatgtcaaaagcttgttagtgtagccacaaaaaccctcgagagaaagctgcaatcccgatcttggcccatcccaaaacctaaaatacatactcccgccgtcccaaaatataaacatttttttagtatagtgataaatcaattatttctaactttgaccattagtaacaaaaaaaataaaaaaaaagatcaataatgtaaaattgatgttactagatttatcattaaacaaattatcataatatgcaatactttttattttaaaacatcttactttacagatattgttggttaaagtagcatctcagaaaccgtgtcagggtctaaaaatgcttatattttgggacggagggagtagtattttgctagttttcataattgaatagttattattattattctaaaataaaaatgtataaatattggtatttaatttattttttggacttgtttaggctttggaataggtttttgggtgaaaatataggccaaagctagcctatcaggctccgtttggctaataggttatacccattgggaaatggatataatatcctggtaggatgtggtggtagtttagagcaagtataataacaaaatttcagtcagctataagcctgtacagctcagcttcgtctgacgtggtggagagaggcaagatgagagagaggggatcgggcgcttatgcaatcgccagccttggcacaggcgcctagaaaacttagccgattatcttcatcagccatttactctcatgcatgcattggatgatggtgggccctcctccatataataaaatgaatgattagtattggagtatgtgttatgcagctggttgatacaaagatctatctatttgattgcttttagatgacgtgtcattggcttatagctaactgatgactctcttattaaacttgctcttatatgaagggaaattttatcccatgtttggttggatggattggaaaaggaagtttctagaagaatgaccaaaatgccccttcaaactatgctaaatgagtaaacaaacagcacagctattatctataagttcaaatggtgagggtaattcagtaatttttcctagcagtcaatccaccctcaatcaagcaggattctatatcccactcccatccacacccaaacggtggaaatatgaaaaatggaaataacatccatttcccacactcctcatcccatttgccaaacagagcctcaaatgcaggctgcccataaacaggtctaggcaatggtatttctgtaaacattatatttagctaccgctctttacggcatgagctcatctctatctacatcaatcaatgcacttcctctataaaaatatctcttgaaataaatctagaaaaaaaatcagcatataatcttttacaactaaatttgtcccggcatttactaaacgccatatttacaccaaccaacacacaactcaagtgacacttgtaccactacctaagtgacgctggattccacccttgaatccacatatcaacagatcatattctcccatctaaatccctctttgatttaagtttactaggattctctttccttccacgagcgcaggggtggtgatggcaaacctcaacacaaaacacagcacaactattaagaacgtttacaacttaggtgatccgtagttgacaaggaggtagatgttcttgctaaaacgacatggggtaacttcgtcttgccgtgctgaagcccaggaggcatgaggagtcgaggaattgaaccaacggtgataaatcgttaaaaactagtgaaaggggaagtaaaagagaaattgaacttgtaggggtccttttacgaaagtgagttgtagggggaagggcagaaagactagtgaacttataacggttattttcccctatattgagccctgatccctagataaagacagggtttgtaactcttgcttgccattctgaatcttcatggagtccatatatatcattggaattttggcatgtccaatagcgcttgtaccaccatattagcgtagtcgatgtctttctctcttttgggtattaatctcccttgtcatagttatggaatgtcaccagatcatctcctctaaccggatccacatctgtacttgtgaataatagaaaagttttcgtaccaccacaatttgaacatcgtaaatatctcaaattatgatctacatatgaaataaatgtgatccccagttgaagatattgatccctttcgcacatttgggcagcatgccatcttcaaccacagtatgccaaggataggcatgtcgaataatgcgggttatcttgggccatgaaaagtgcgaggaaaaactacaaaactgagctagttttcatatctgaatagatattattattatttaaacaaaaaagtataaatattaatatttaatttttatttttgggcttgtttaagctatggaataggtttttgataaaaatagagacccaagctagcctatcaatgtgggttgccaataaataggtctagtcaatggtattttcgtaaatataatatttagctaccacccgttatgtcacgagctcatctacatctacatcaataaatacacttcctcctgtaaaaatatcttttgaaataaatctagaaaataattcgacatataatcttttgcatccaaatttgtcccaacatttactagacaccagatttatgccaaccaccatatacgtcgagtgacacttgtaccaccacctaagcgatgatgttttccacccttgaatccatgtattaatggaccatatcctcgcatctaaatctctcttgatttaagttttgtaggatgtcaaatcacatccctttgcacttgtggctcctggggaggggggttggggtgggcgcccaacttttggtgttaaatcaagtgttcgctttgtagtcggttctgatcctgttaggaagatttaccaaaatccatatcacacatttgtgaaaaatagaaatgattccatatcatcatttgagaatagtaaatatctcaaattatgatccatatatgaaattaatgtaatccccaccttttttttaaaaaaactaatggaatccccacttgaagttctctatcccttccacacatttgggcaatgtgtcatatttgcccatagtctgccaagggtagatatgccaaagtaggttaagccgggtcatgaaaagcccgagagaaaactacaagcccacactagttttcatatctaaatagttattatgtattatttaaacaaaaatgtataatattgatatttaatttatttttggggcttgtttaagatctagaataggttttttttggatgaaaatagagacccaagctggcctatcaatgtcggctacccataaacatatctagtcaatttagtcaatggtattctcgtaaacattatatttagttaccacccattacgtcatgagctcatccatatcacatcaatcagtgcacttccttctgtaaaaatatatcttgaaataaatattgaaaaaaatgaatatataatccttttgtgttaagatatgtctcagcatttactagatgccaaatttacaccaactagcacacaactcaagtgacacttataccaccacataagcgatgtttgtttccaccattaaatccacatatttatggaccatattctcgcatctaaatacgtcttgatttaagtttagcaagatatttaatgcacgtccctccacgcctgtggctcccggtgcccgactttggtgttaaatcagccgttcgatttgtagttggttccgatcctgtttgaaatatttcctaaaacccatagcacacatttgtgaaaaactgaaatgattccataccatcatttgagcatagtaaatatctcaaattgtgatctacatatgaaatgaatgtaatccccacttttttttttttgaaaactaatggaatccccacttgaagttctctatcccttccacagatttgggcaatgtgtcatctttgcccatagtctgccaagggtagacatgtcaaagcaggttatgctgggtcatgaaaaagctgagagaaaactacaagcccgagtttggcccagcctataacctaaaatacttatcagtttccatatttgaatggagtagttattattattgttactctaaaataaaaaaaagtatgagtattaatatttaatttacttttttggtttgttcaggctttggaataggtttttaggatgaaaatagaggcccaacctaggccggtcaaggcgggatgcccataaacagatctagtgaattgcattttcataaacattatatttagctaccaccagttatgacatgagtatcacacctatatctacatcaatcaatgcacttcctcctatataaaaaatatctctcgaaataaatctagaaaacaaatataacattataatattttgcaaccagatttgtttggtatttactagacgtcagatttacgtcaacaacaacctagctcaaatgacacttgtaccaccacctaaggtctggtgttggtttctaccattaaatccacatattaatcatcctcacatccaaatttgtaataatataactttagtaggatatcaatacgcgtccctccctccatgccgcggccgcctataaaaccaccccatagcccttcccccctcccccatcggccatccatctaccatcacattcacaaactcacaatttttcacatcaccatgttctttagttccttaggcttgagagcaaaccctacccagggtagcccaagctggatctgaactttgtgttcttcacataatcaatcacacacacatcccgaccgggtccgaatagaagtatagaacacaaagagggggctgacgctgaccggtggggcccaccggcccggcccgaccacaactcctagtgggggtcccccgtggtgcagcgcacgtgcgaggtcgttacccctctccgactccctcccccgtaaaaccaagccgcggacttctcttttttcttttcttttctctatggagatagcttccgcggccgcccaccaaatctcgcccatggtttcctcccgcgaccccggcgaggaggccagcgcgccgccgcccccgcccccgcgccgcggcgagaagcggcgaatgcgcggccgcaccccgtcgccggagccggcctccgcgccgcaggtacgtgcttacgaggccggatttgcatgtggtgttagtagggtagatcaggggggaacacgccgccttcttcgtcgtcgtacgtggtggtggattcctttttgtttgttatatatataatttttgttccgtctcgcccttcacgtttcgaggaactgttcatttggtaggcgactgttgcacgtaaggaatcgttgccgtgggtttggggttcgttcgttttgattggagaggatagaattctgtctgtatggatcgtgaatttagttctctggtatggagcatgtggggggagtttctatttgtgtgttgtttgggtgctatcaggtcggatgagtagcaatgagatgcgaatttctggatgcgatgcgtttgatttggggttcttagattaggtcgggagagcattgggtggatcgatgaataatgtgtcctagagagaaaaacttatggatcctgagaattgtaggtttaaaattgatatgcgattcggatgccgcaacagattggcatcttcccctaggtaactctgggttctgttgttcctgatttgagattaaaggaataatttcccccaacctatcatgtcgatctgtaaattggtgatgcaaatttgtgtgtgatttcagtggctgtaactaattcgatgttcttggcctattgggggaatttgggatttggcccggcgaaaaaacttggatttgcccttgtgctagtagattgacaaatccatgaattgattatatgatataaatatatgccaatctatgagaaaattctactaaatcaaatcaactttcctcaagtaatgatgttggaactaaagtccattgatcgaccaatcatgaactcaagcatatacatgcggatatgtaaacaaattttgatgaatggtatcgtgcaatattatttattttccattggtaaatgttaaattgttaacttgtaatagaaatttctctgtcctataagaacatccaatctgtggcactttcctgatgaatgaaatattcaaggtacaagctaattttgtaagactactccttttcaggatctctgcccatcaggagcttgcggggacaatgttgctggagctacaactgtaattccttgaaaagttttgattttattagctgaatgttgtcatttctattcctctacagctttattattattggctaattaatttttcatgctattttatcttacttttatgaacagacaaatggaaagtggcatccacatgaatcgtacagacctgaaattgatgatgcccctgttttcactccaacggaagaggtttgtgtacatttatcttacataactattccatgagatatgctgatagcatagtaatagttagctaatcgttctttcccttcaggagtttaaagatccaattagatatattacgagcattcgtccccaagcagaaaagtatggaatttgtcgtattgttccaccatcttcttggcgaccgccttgttctctgaaggagaagaacttctgggaatgtacagagttcaatacccgtgttcaacaagttgacaagcttcaaaaccgggaacccacaaagaaaaaatcacaacctcgagttcagaagaagaggaagaggagaaagagactgagatttgggatgactcacaggcgtcctagtgcaaatacatcagaagactgcgcagatgcagacgagaagtttggctttcaatctggctcagatttcacactagatgagtttcagaaatatgcagatgagtttaagcagcagtattttggaataaagggaagtgacgaaatccctctttctgaaattaaaaagaagaaaaaaaattggcaaccatcggtcgatgaaatagagggagaatattggcggatagttgtatgccccactgacgaagttgaggtatttagtttgctatctgtgcatcatcttcctatttaactattaatacatactgataagcatcggactctctttgactaggtggattatggtgctgatttggacacttcaatgttcagtagtggattctctaaattatcttcagattcaaatagacgagatccatatggtttatcttgttggaatttgaacaatcttccacgtattcctgggtctgtactgtcatttgaaactgaggatatatctggcgtcgtagtcccttggctttatgtagggatgtgcttctcatcattctgttgggtaagcttttattttctcattgacccatttttacaatgttatcattctgttggtaatagtataatagccgtttgcctaggtaaaagtaatctaattaacttccttgcttgttgaagaatgaacatattattgctctatgggattggaaaatgctactagcctagtgatattctaacctggcagtgctattcaatcttcttagtggattaacataagatgaatgtttacatagtaggaaaatatgtgatttttaattgattatgataattattcttggctgatatctctctcttgaactttgtagcacgtggaagatcatttcctttattctatgaattacatgcattttggtgaaccaaaagtatggtatggtgttcctggtgctgatgcagtgaagctggaagaagctatgagaaagaacttaccaagattgtttgaagaacagcctgatctcctacatgagctggtaaccatttgaaattgcatgtttgttatgtaatagaattgaccctgtgattctaacaacatgaattcactgattgcaaaataaactttttggatatattgcgaactggaaacaacttagcatccatgtactgaaattcaaaggaaaacattattttctgttccattttagtactctatttattatcattgcctagtgcctactaccagtcacaaattcttgctgacactacacagtggttcatctgagaataattatcttcctgtattgtacaaataaatatgctgcatcttcattcattttcatcctaaattttcatggtgcaggttacgcaattatctccttctgttcttaaatcagaaggagttcctgtttatcgtgttgttcagaatccaggcgagtttgttctaacgctaccgcgagcttaccattctgggttcaactgtggcttcaactgtgcggaggcagtaaatgtcgcacctgtggattggctgcctcacggacaatgtgctgttgagctctacagggagcagcggcgcaagacatccatatcacatgacaaattattactaaaaactgcaaatgaagctgtcagacagctttggatgaaccttagcgactgcaaaagtgaacaaggagtatacagatggcaggatacttgcggaaaggacggaatgctgacaagtgcaattaaggtactcactagtttaggccgttgttatttatcactgattattaatcagctgtgactcaaaggattaactctttctttttcatcaaaaagactaattactcatattttggttgtactatattgcagacaagggttaaaatggagaaggcagcacggggagggaatatggcactgcgatataagaaaatggatggggattatgattcagctgaccgggaatgcttttcatgtttttatgatctccatttgtcagctgtcagctgccaatgctccccaaatcgttttgcttgcttaaaccatgcaaacattctatgttcatgtgaaatggacagaaaaaccgcgttgttgcggtataccatagaggagctccatactcttgttgcagctctagagggtgatccaactgcggtctaccagtggggacagaatgatttaggtttagtctgcccatctggttctactcagtacaagaagatggacttgggtgaaaacacggaatttccggattcagcaaccaacgtcaatcatggctgcagcttaggaagtcaagatcaatatcactatgaccccgcaaagccagcaggataccagcaagagaagggaatccagattgcttcagaaaaacatgataagaacaagatggttgtcaatcttgagtctccagcaacagctagtaatccaagcaggtcaaagtctgactgcagtggctcactgtccttgaatcattcatctgagttaccatcttcaagaattcaaacaggaaattctacgctagcttccattaccacagagaaactgtttggtgttgacattaaatccaatttagcacagtcttctgatggccaagttagtcaattggccaagccttcctcgagccaaactgatgaagtctctaagccagcaatagctaagtatacggttgagctgctagacagtggaacaatgatgattggtaaaaagtggtgcaatcagcaagctatattccccaaaggtatatacactgaacaatgcaatgattatttttgtcttctggtaatatgtacatcctccagaaatatcactaatagaaattcatctatgcaggatttaagagtcgagttacatttcatagtgtactagatccaacaaggacatgctgctacatctccgaagttcttgatgctgggcttcttggaccattgtttagggtacgcttttattataaacgcttcttgtttttctaaatttcaggatttgtctgctttccttcattgtgctcacataagctactgaattaataacaggtgactgtcgaaggtcttccagaagtttcgtttactcacacatcaccaatgcaatgttgggacagtgtaagagacagagtaaatgaagaaatagcaaaacaaataagttttggaaaatctggccttcctgattttctatcctgcaattctttgaatggacttgaaatgtttgggttcttatcctcccctataattaaggtagatttttacgatatccacagtatttatttttgtgaaacctggtcacttcaagtaactagttgaatattacacaaaaattctttgttgttcaacaggaaatcgaggctctagatccctgtcaccaatgcttggactattggttgtcaagggtttcttctgttggaactgaactcccctcggaatctgtgatggcagcaatggttaatgactccactaaccccccaataaagttgctcgggattgagattaaccggagggaatcagaacaatcaagtagcttcaataattcctgtgtgaggaggtcacacttggcaggttgctgaagaaggctagctaagctcccagaagaaccagagctaatggcgatgaaaagaagtattcagtagcagtctagtggatcagatagcagtggtatcatctggagtggcaattgccactctccaggatgagatgaacaataatgtagatacatagtgccatgaatagatcagaaatttcagataactcatcctagacagcttccctagggaaccattagaattgaaatagagccaccattggtttgcattcttctagaattgcatttcttgatattcatttcagcttgatcccaattcatttctaacttgatggcaacaagttattgtattctctaattgtttctggattagccagtttattgtgaccaatgtaacaagttgatgtttcctgtcgacataaagcttacatgtacaaaccttggcagctaccaattggaaatgaaaggaagaaaatgttttcggacttatggctatttcttctacttcaatttaaatgaattgtcttttcttaccatataaatgcgatgaatctgtcctcattcagggctaatgttgcaaggggttactttaattgattgttttgtccttaatagtgatgccaattaaatcatactcccaccgatttttaaatatgcgctgtttttggcttttagatataacacttaactaatttttatctaaaagtatttctcatggtgaatatcacataacataaatctcactatgtttaactatatctaaataagtgaaaggtgaaaccctgcatgcaaaactacagtgccacatcattaagtgattataaagcattcgattttcaattcagacattacaggccgttggatcctttaattggcaaaaatatcttcccagtccttttagaaatttattttacaaagagttcctcaaataatagtgttattcttcgccgcctgaacgacacctccccttctctcagacgcctcagtttcctcctccgcaccccatgcagtgacgcaactgtggggctatccttcctgcacctacgcagcatccgctccaccatggtccatgggcattcccaacctcctaggtttagacattgcctatagcagaatgcatatgtgctgttcaatagtccattgaaatatatgattcagccaataactaattaggaaagcaattttgtcctcaaagcatcatttgaatgaatgcagatgtgtagataaatttattcaggcacctcttgcggcaacctgataactcagttatcagtaacaatacccttcattattgcactccacataattggctttcagttgctcaccttgcttatgttggccatttaccttcattaggtttcaattaatgttatattgcgttcatatctggaaataaagaaaacaatataatgagaaagtaatcttagggcatgttcaaagctagagcccagtgcaggctctctacactccatgtcagcgaaaaaactcctatatacaaaggatggtctctttagctgactctccattaatacaggctaataaatggctaataaattcatcatgtatactagatcaaatgtaaattttagccttccataaattgtgcaaacaacaagctattatttaagcaaacagtaagctatcatataaaaaaagacaatgagcataccagcacacacatactattattttaagcaaacagtaagctaaattacattatttcgttatatagagtagttctacttttttccaagcgctgccatatatgtgcaactaaatctttcttgagttgcatatgagttggacgatcacgaatagatgaattccttcgtagtactgcagcaaagcatgggttggggttggaggagttgctcacttccggtggcagaacgattgatgctcctgggttctcattcaaatccaaaggaatttcagtcatttccttttcatcttcaactatcatattgtgaagaataatacaagcttacattatgttgatagcatcacccctctgtcacatccgggctggacgacatacgatgttaaagtgagactgcaacacaccaaaggctcgctcaacatccttcctctcttcctcttgacgggctgcatataatatatcttcatctgtctgagaaagttgtattgtcttcacgaatgttttccactcaggataaattccatcagcaaggtagtaccccgtgttatattggttcccatttacagtaaactgcacacgaggagcttcccctatcaatgcatcaatgaacaacggtgacttgtttaacacattgatgtcgttattggatcctgtagtaccaaaaaaaagcatgctatatgcgaaggtctttcgatgctaccgcttagaggatcatggtaggaactcccttgtcaccacgagtaaattggccgcgccgagagaccgggcaattttttcatgcccaatgcatgcagtctatacttcctaacatgccaggaaaaccacgcgacttagcaacctgtagcaatctttcaacctcatcattccttggagctcgtaagtactcttcactaaatatttcaatgactcctttagcaaatttgcccaaacactccaaagctatactaggaccaatctttaatacctcgtcaagttggtccaccggagttccatatgctagcatatgaatggcggctgtacacttctgaagtggtgaatgtcctgctctaccagtggcatccactctattagtaaaataaggagaccattcactaagggcctcctcatccgaaacctcctatggaacatctcatcggtgtagataggggactcggagaagtagttggccacaagatcctcattgccatcttcttggtttcttggtatatacggtcttgtaccactttgacgttgacaatgagatggctcagctgttatcttgtccttcatcctgataataatctgctcactatattcatctaaaaacaccaactcagcaagaaaatcatccatgttatatatatccataggatcaaagttgtcgaggttgatggcggcatcgtcgtcaaggtcgatggcagcatcatcgatgttgagttcggcgccgacgacgtcaaggtcgatgccggtatcgtcatcgagatcggtgtcatggtcgaggtcgacggcaccatcgttgtcgaggttggcgtcagagtcaatgttgatggcaccatcgtcgccgaggttggagctagcaccagtgtcgagatcagaatcgtcggcgagaccatcttctaactggttgatttcatcggaagacaccatgtgatctgacatacattcatagatacatatatctcagattgagattctgaagataaacatgcccatcaatcatatcttggaatcaatccccgcataaaaaaaaaagaacaggtagtatagtttcagtaaccttcaataaacagtcatccagaaacaaccattcagcatgcacttagtaataatatggaaatgagttgaaagtgtaaacttgcatatatggttattacatgaacgaaagaataatcttattcaccacacaccgccaagagcgtcgtcgttcacaaagcgtttcgatggcctctttctacgtttctcttccaatgccaacttacacggtaacaaagtcataaataaaaataaataaaatttataaaactacatgtactttgatgaaaactatcgcaaaagaatgcgcatcacaaaattatagattttgtgttaaatttatccgatttaaggtatcatataaaaatatagatgtagcataattttatcacaaaaccacaattgttataacttataataaataatagtgctagggatctaaactctacaatttgtagtacaaattttgtaatttagtgaaatttgtagttctttgataacttcactaaatctatagttttgtgataaatatatagttttgtgatgcaatgactaaatctgtagctttgtgattcatgtagtagttctgtgatagtttgatccacgtatatatagttttgtaaaatttactttttttaaaaaagatattttggtcaattgtgataaagtgttaagtggctcataaaacgacttgcaagtaaagtggtgctagttagatagccgttcagctccacgaagaagtgcaattttctcacaaatataaaacaagactgccatataaatggtaggagtaaattcagttaattttagaatctgccattgtaggacacaatactgcactactagcaaatagagataatagggagaccatctcttgcaacaatattctaagttatctcttattcagataaaaaacaaaatggataaaaaaggatgccagcactaatattagtcagagcacaacatcgattgtagtggggcattagatgcgtgacattttgatctgtgagggatcatttggagttgcactttcccattgctgcctttatttgcattgccattggcatcaccgacatgtggcactacctccacacctgtaaacacggcaattggttcattcccaaagtcactgttactgcggaagaacctagcgatgcagaacctgcctgagccaaggttgacaagttgtggatccttgcactccctccattcctctggcaggttgagttccttccaagggcccactagctgtggctgggagtccatggcagagaggtcagccgcagccaagcgccgggcctcagcagagaggccaaaccagaggttgaactcaggcacataatcaatcctgccatggaatggcagtgtccactttgccaacttggctccatgagtggcttgctgtctccaggcagtaggtgccgatgccattgacagataagcaaatgtgtgagccaccgccaagcacagcgtaggagctgatctctgggtctgggctgctgcagcagctgtgacagtgcttgggttcacagacaaaaggcggaggtggaagttaatggcagtgccaggcctttctgtaggaagataatgtagacttgcggtatacgaaggcctcaaactgatcgctgttgaagcccaactccggtttgggaatcctctccatgacaaagaggctgctgccatagccatcatgggaacgaactacgaagacagacaagggcatcgacttgggcttgtgaagactgggcatggttcctacctcgcacgtatctgcgttgacgaggaatgcgcggccagactgatccgtgcaaatcacctcgcggctagcaagcgggaaacagtccatcttcgattggttgttgacgttgagagctgaagctcggaagttgatgctggagaagggaagccccatactatccatcatcgtgccagctgcctgtttaaacttttgccagaattcgccaaccttctgtgtcggtggaggtgttgccggatagaataactgctggtgcatcatgtcgaagtaccatagcgatttgacatcagggttgcggttgcccacgatcagattaagaaaccgccgcgagaaatcaatcgtatcccttaaccagtggcttaacctgattcgtatccctcaccacgatactgcatatcttgaccccccccctcatttattaaaaccggtgcaatatgactccctcagcggttttggagggtggcttcgctgacatgtcatctacgcggcggtgttgacctagtctttatgccacacggtattgacgtgacgtttatatgacattagaattaaaaaaaatatgtgagactcatttgtcatttacaaaaaatgatttgtgggacccacatgtcatgatctctctttttccctctcacccctttctcttcacatgagcactgctctaaggcatgttatttatcttctctaccgaatgtcaaactacacatgcaatgcatgattatttcagctctctttgttggggggaaatagcaccaaaagtccaaaacagagatcaaatatggggaggcgaaatatcccgcaaaaaattgaccacgagacaagactaatttacctctagaacgcacgaaattgggggagaaaaactggaaacaaccgaacacgcacagcacaaaacaaccagacgctgctcgcaacaagacccaaaaaaaatgtggaaacacataggcgaatccatctacttcaccgcaaatcagcatcaaattacaaggggaatagtaaccaatcgaaaggcaaggcagaatgagcactcgcacgcgcgaacacacacatgcacacgaggacgagccaagcaatgcagtgcggcatacgagacagggggaggagaggatgaagagtgaggatgaattctaatctctcgggtggatgcccacccgtttcttgcatgtcaattaaataattatgaaaaaatttcaaaaaaattacaagatagattaatatgtaatatatcacttcacaaacatgcaagttcaaattcaaattttacaagttgtaacgaaaataacaaattaaacttttagtatacgtatatttacagtcaaatttgttatttttgttacaacttgtagaagttaaatttgaacttgcatgtttgtgaagtaatatattcatattatcctatcatgtcaattttttttaaaactttccataaccatttagatgacatgcaagaaacaggtggacattcacccgaatgcttaaaacagtttcccgatgaagagttcctcggaagcttcattcgccactccagcatttgcccgcccgccggccaccgtgcccatcgcccaccgccgccgtcgccgccactcaagccctcgcctgccgccatcggatgaaggtgaagagaaagagagaaataagggagagagaggggcatgacatgtgggcctcacaaaatattttgcataaatgccaaatgggtcacatataattttttaatctaatgtcacataagcgtcatgtcaacgccacgtggcataaagacctggtcaacattgtcacgtagacgccacgtcagcgaaaccgccctttcaaaccgctgaggaagtcaaattgcaccggttttaatagttagagggtcaaaatatctgatattgtggttgagggatatggatcagattaggacgctacttaacggagccaaagtgaacttattcccatcccgtgaaacctcctcaacccggccgttcccctagaatttgatcggcaattaagggtgtgtttggttggctgcaccgggggtggctcgcatcccgcatgcaaccagcaacgcgtttggttgcctgcatgggtgagcgagccaagatcatctgatgcaaaaacggccgctgagccaggctgcgaggaaacgcggaaatcggccgtaggtcctcagccaggcccagctcacgccgacgcggggatgagcggatgcaagtgtgggatggacgagaaaatgaacatttagccacgttcgaaacacagttttcctagaatgccatctcgaaaacgcgtttcactaaaattccaatataaagcgcgtgctcatcaccactttgccattttggcccttttgtgcattttcaaaatcatcttcgcttcttcagtggataatgagacgaaattgccctccatccttccccttccatggtggcagccttggcagcgccatcggatgagcccaccaccgctgccgacgacggcgggatggccaacagcgccgtcggatgagtccacgcccgctgccaacgagggtatctgggtgcgtggagcgacaaaaccaccggcagctgcccctgcctgccgcatccggacggcaccgacgaggcggaagcagaggtgaggtcgtcgaggaggcccccccttcgcctccgtcgccgacgaggccatggggccacctcgaaaccctagccgccatcgtcgaccacggcgaagcgacctccgggatgtcgtcgtcgaccgcggcgaggtagtcggcggaggtggcaaggtcgagggaagagaatatgtcggaggactcgccggccacctcgttgtctgggctccccatatagcactgcttcagatgccatccatggaggaggaggaggaagacggtgagctgctcatggtggacatggagatggccgacgaggacgagctcctctccctcaatgatggcggcaaaggacatgaaaggcaattttatctcatcatccggtggaggagcgaaattgatttcgaaaatgtacaaaagggccaaaattttgcaaagtggcggtaagcacgcacttcatattagcattttagcaaaaacacgttttcggaatggcattagagtgaaaccgtgttttggaagtggctaaatgtccattttctcgggatggacaggtgcagcggcgcgcaggggtcgatgcatccagaagggagggctcgaggggcaccgtcggcggcagcggcactgccatcttctacctcctctcctcttctcctagtagttgtcggcgccgtctccatggggagcttgagctcaacgaaatccagaagaaagagagagggcaggaggagggacggagggagggctaggggcatcgtcgtcgctgccatcttcttcctcctcttctcctagtcgttgccgacatcgtctccctcatcggccaccgcttccctccttcacgagctgtgacgcaccagatccgacggccacaagcttcgacacgctagatccgggagtcttcagcttcgacggcaccggatccgcagccatgaactctgctggcggcggcaaacagcgggactcaaagggagagtggcgagcgtcatgtaggcgagcggcgacggcagttgcgagatggcgatgcatttctctcttccttttttttttcatttttttcttttctttttctatccggttgaccggataatcccgacgattaatttataatagtgtaatttaatgtttggcacaattttttgggacttcctagtttggcgaattttttcgtcattgaaatttgtgcatctccaagaagtcagtagcactgcatgtaatatgttgttatcctctccaatacgaagaaactatactcaatattccgaaaacttcatcttggacttagttaaaactcaatttaatacccatggaggtaaactcaccctccaatccagaatgtatttttgatccaaccaaccaaacatctttcgcatacagtatctttaatacaactaaccaaacaatatctaaccatatgcaggtttattcaatacaaacaaccaaacaatgcatatgtatatctttaaccaggccaatcttagtctggataaaggagatgaaccaggctagaagtatacgagcaaccaaacgcacctaaattggggagtgtttcctgcgccgctcatctccctctgaaagtctggatcaaactagctggctacccaaatagcctctcacgatcacaggctcacaacctcacagatatagtgacaaatcgcacgagctggagctatcatagattgaaggaaagtaaaaaaccaaggaaaaattaataaacagataagggaaagaaataaaaatactactccttccgtattaataaatagatggtgttattgatttttctttatctaacatttcatactcgtcttaggaaaaatataagtaatgattaaaatatctttaatgataataaattatatttatatgtttttcttaaaaaaaatatccaaacatcatatctaaaagtcaacaacgtcatatattaaaaaaactagtgaacgtgcacgtgcaaagcacattgatatatacaattgaagaaaaatgcattcattgctaatgtacatctacatatactcacaaattaaagctcataatcattgataaaaataaaagtattgtaaacattgtcttggtaattcattgaataaaactaatttgttattgtattatatagcgtaacagatgtttttcagtgagaatcttattttcattactttatgccttggactacatgcaatagataatggttaagcctgtaagagttaaactattatgagaacaaacgacgatagataactcaagaaaaagtgagatagcagccatgtattatcaaaagctagtaaatgtacaaatgcagcttaaaatagatcagtgaatcagcaatggatgtttcccaattttcctctttcacggtctgctgagcattaaatagtttgatttggatatataaacatgtacatgagattttaatgagataattttccacacatttagcagggtaaactcaggccaaaataatgattgaaacaaaacttctctaaattattttctttgggcaaaaaacaaaattcggtttcaacatctcataaagctcacagaaaactgaactgcaaaatcagtactgcaaagtttaggcgcatatattgtgctgcatttgaagttactttattatgtatagatagacattattctttcatttgtaacaacatgattgggcatcattaaaatccccgtccaggaccggccggggtacacaaacgacaatgttgacattcagatccacgtcttacaaacatcataaaagtcttacataaatgcagcggaaaaacgaaagataacaggaactaagccttgacttgatctgcagcgggaacaccactccacagacatcctcgacggcacggacgaagcctactcctcggagaaaccaccatctgacacatacttgtactctggggttggggaaaatagagcaagactgagtactacccactgtactcagcaagtcataccggaataggggtatgatgcagggaattatcaaaggagagctagagtggttcatttgcataaagcgagcatttataaacagaagttgaaagaattaaacagttgtaataattaatcatattattcatccactgtccaacgctataccacgttgcgacaggcccaaccatccacctatagtatccaatttcattagactaaactagggtgagactaatcacggtgaatctggttgaccgcccataaccgcaggcacgactattcgaatagttttactctgatcagaggtgtacaactgtacccacaagacacagccccacgacacgtttccgtgcgccgacatgccaccacgacataccggaaagagaccgtaacaggacccttcgcataaccccctctaaccaagcacaccacacctcaggtttcactcccactcctcacaaggcagcgggcagtcccctctcgtgcctaggtgaatccggaagctgcataggccgtagcagggcccatccaaactccatcacgcccacccttgcctggatgcgtcggctaaagaaaagctacactacaagtccagccgttgcccacgctggcttgtggtaagtacgataagttcttccagggcatcccgcgaaccggtccttaactgccatgggtgcgaccaacaaaaccatgcacccacagcccaccatgtgatttattttaattaaccaacactgaagcggtgtcactaatccaacattaccattagaacctacagtctaaacattaataggatttttccccaatgtgtgctagttgaactaagcatggctaagcaattcctagtccaaagtctattcatgttataacgcaagctaacaaaggagcatggtatcaaaatagcatggctgtaacaataggtaaacatcccatagtaacattataaaacaatgcagtatttgaagaaaaacaatagaccatttgcaatataggatcaacatgttcaagtgacaggcataacttgccttgctctgcagttggaggaacctcggcgactatctcgaagtacaccggagcatcagaagaaccggaatctaagcgacatacaaagcaaacaatgcaaacaggctataagactactgaaacagagaacaaaaccatttttaatggattctacacatttttcttgatttactgagacttgaatgggcttaaacggagcacggatgaattagttatgaattttagaagattcactgtgtttattactataataaaaagtccttaaatcatttattgcgcaatatgtcccagggctgacgtcatcaaagggggggtggtgccgacaggcggggcccgcatgtcagcggctcaaggggagagaggggcgccggcaagtggggcccccgggtcagcggctcaaggctgccggtccaccggaccgacggcccagatcgcccccgaggccgatcggacgggcggcggcgacggcgtggtgcggcggcgagcctagcggcggctagcggcagccggagtagcggaagcggcggcggcgggtggaagcacggcgcgggagcgatgggaagcacgagggagttcggcgagatggggaaaaagagagagggagtggcggtggagcttaaataggggaggggaatcccggacatggccggtaggggcgggattccgccggccaacgcggggaggtggaggtggagagagaggtgggattcggaattcgaatcctggccatctcgggcgcgggcgcgagcgggagagagggggagtgggtgcgggaggcgcggcgcatgcgcgggcgtggccgacatgacccggaggaggcggggacgttggcacagcggcggtttcggcggtggtggcgacgtggggcgggcagccggaggaaggggacgaccccgacaggtggggcccacctgtcggcgtcccggggagagagggaggggcggcttgggccggcccacaaggaggagggcgcgcgcggcggcggggtggactgggccgacggcccaagaagaggaaaaggagggaaaagaaaaagaaaaggaggaaaagattttccctgggatttaaaattgcatgtgctcaattttaattggttaaaattatttcgagagctctgaaaattccactaaaaatcttgttagcgtatttcgacatgtagaactcaagaaaaattccacatgccaattccgattattatttgcattaatttattaaggttttctcttgatttgcaccggcattttcttaggatgatttataaattcaattttaggcttaggaggagaactttagggtgtgacattgatgctcataggatgctgaggtgactaccacacaagatgaagaccatgtgtgtagttgttcttgatcacttaaagtcgtggtacgtggactgctacgtcactggtcgaagaccagttgtagttgtaccttgtcacgcccaaaaatttagcccaaatttccagactattttgtgcattaaatctctgtccaagaatcacccagggtaaacaaaacgacaagtaatatacggtttcaaacgtaaataaagcgtaaaatacttacagaagaggcacttagtcctcacacccgaaacgaaagcagcagcagcggaaaaaggcaatcctagcagggcttcagctccactccacaggcaaaactcaactggggtctgagccttggtcctctaactccgtctttagctcagaagcactacacttctgaaaagggggaataatagcaaggctgagtacaaccaccgtactcagcaagccacaccaatgatgcaggcgtgcaaggggatacaaggatggcttgaggctatttgcataaaggcaattgtaaaacatttattgagcaaaacagtaaaatagttgattaattaaggtaatattaaatctccactgatcaacgctacaccacgttgaataggcccaaccaacccacctgaactacagtgcattgagtcgatttaataagtgtgtgactaatcacgatgaatctggtcgatcgcccataaccgcgggcatggctattcgaatagttttactctggccagaggtgcacaactgtacccaaaagacacaatccaccggcatgtcaccgcgcctgtccggacacgtcaccatgtcgagtgattgtgacaagacccttcatataaccctctctgaccaagcacaccacacctcaggtttcacccccactcctcaacaggcagcgggcagtcccctctcgtgcctaggcaaatcaaaaaggcgcatagactgtcgcagggcccatccgaactccatcacgctcacccttgcctggatgcgtcagagaggaaagctatacttcaagtcagacagttacccattcccgcttgtggtaagcgcggtaagtcttccagtgcatcctgtgaaccggtccttaactgccatgggtgggactagcaaaaccatgcacccacaacccaccattaagtcgcattttagttggataattatgaccaataaaacatggtcggatgtctcgagcacgcagctcgtcatgatactaaaagttctacaagatcagccagtcgtccatcccatgatgaggacaagcggccatatattcctgaagtcgttcccacgcctcaggaatggactcatccctcgtctgctggaaacttgagatccttccagaagggcgttggttttgcccatcgggaagaattttgacaggaatgacgtagagcatttatcccaggtgttgatcgtggcacggttggcataaaaccattgtttcgctttcccaaggagggaaaacggaaacaattgcagcctgacggcgtcaggactgacacccttcattgtgaacgtgttgcagatctccaggaactgttgcagatgagcattggcatcctcattaggcttgccgcaaaacgggctagcctgcgccattgtgataaggctggacttcagatcgaaatccacgtctcccatgttgatttgcggcccagtggccacgttgttagcagagggagcagcaaattcgcggagggtcttgtcagccatagtcttgaaagttggtagcgctggtatggctggtttctatgtcggaagagtttactgcagagcgacgactcgtggcttacgctccgaaagaaagcctctggattttccttagagttttccggcaagttgaaaccagtcatgtactaccctgtttccacaataaaagtgaaaacaaccatggttagcctgcaaagtacaatgattatatagaggtaaatataaagtattagtaatggtaatctcttttataaatcttccctggcaatggtgccagaaatgcttgttggtatttcttaacgacattactagaaatttaattcccagtaatggcgcaaaaatacttctggtatattatggttacagagttcatccgcaagcgcatgaatataccattgtagcatttcacctgagagtattccaaaggtatcgtatttgtttaatcccgtgggaagattataatagagagaacagtactaataatttatatattactgtacgaataatttataaccaaagtctaagcaggggttaatataattcatagggtacaataacactaagtagaagcattcatcctcttactcgtgattatctaagctaagtggaaagaatatagaaagatcctattcctatacttctaatttacatacatattatatatacatcctagttatagtattacttagctaataccctccatccgatgccctgctggtgcttcgagaagccacccctgattgtcgagttccttacgacaatccgtcatgactatacaaccgggactaaatacggtggagtaccctccccaggaaagtatcttaggactatatacattcgtggaggaatacccatactgagctgtcaccatcagcggcccacctcgcttccacagcatataaccccaaataatgatatctagtaatctaaacactacgcttaaattaccaaatactatctaatatcatcgtcatgacatagagttatcataaatacgattattatacccacaccattgcatctcccagataagctagcatcataataaatataactcgaacatatagtaaagttggtattcatatactcggaaagtaatacaataccaaagtagtataaagaagagtattctaaataaagtacaagtcataaaaaaaagaaaaaaggaaaagctactagagccatacacgaattcttccgaagactctgaggactgaagattttattctatttctattccattatactctagaaactatgctaaacttgagagatgaaatgaacttcttgcttgaggtgtgtcttgaaatggaggatgagagggctttatatagcttgagaatgacggttatgacggttggaaaggtcagtaataccctccaaccgccataggggagcaatcctgaccgcccatccaaaccctgcatcgaacggagccacggtgggttcggctgaacccaatgattcggccaaaccatgggctgggccggcctggtccaaattcggcaggtggcctcctctctcgatcccttctgcagacttatgaattttggcccaattggtcgtgttatttctgagttcttggcccattcgttgataagtctgattctcaacatcgtccgattgattgatcacctgttttgatatcgattctcctccattttatgtcattctctacaagaggttagtaatcctagtgctagtggaatatttattattctaacacaaatatgcattgcaagtataactagttctcctttattttggtagtattgatggtcgaaactgatcgctaacgaccgtcaacattggtcctttgatccagtggtgtgaattgtgggcttgtttgctcgtggtaattccgtgttgtcagcccatctatccacaagtctgattctcgacagcatccaattgattgatcatttattttgctgtcgattctcctccatttatatgtgcttctcctggatacatgttagtagcatagtatatagtggaaggagatattttatttggaaattatgcattgtaagcatagttagtctttatatattgggtaatattaacggtcgaaactggtcaataatgaccgtcaacaataacatcgaaaaaaacgtgtaattagctataggacaccacaaagacgtgaattggctctatgacactctaaaaaaacatatgcttgaggacactgaagacattattttattcttttcaaacaaaacagagaaagagacaaaaagaaaagaccatattgccctttggctctctcggcttggctttctcctggcgccgccgccttcctcgatggtgttgtcgatggccggcagctcggcacggcacatccagagccacggtaccagtgcgtgcaggggagacgcaccacgggtgtccgctaccgcgatttcctccgtgcacaccgtcccagccacgcccaccgtcgcgcacaccaccggtggctttgacaccacagcttacctcccgccgcacgaagggggagggtcctcgacggggaaggactgctcgttgcagctgccctgtgcccgccaggccggagcagctccctcgcagtcggtgtggcccgtaaattatccgcaagagttagtatagaacaagaatatggggaaaaaatctcaatgcatgatagtgtacaacataacattatctcaatgcgagggttcgcatcaattacacaaattttatttcaaaatttccaatcacaaatctgtacactttgaatttgcaatgtgctgaaattctaaacaattgaacaatatgtaccactgtgtgatgccaagaccttccccttcctctccctctttttattcctttttagtttggcaaattttgctacagaacactactaatgtgtggttttagccctaggacactgcacaaactcacttttgggggaaaacactccataaacatgataatttgtcagtggaaaccacgccgattgaaataataattttcggttgaagaggagagagaaatcatgtgaaatgtcaaaaatgcccttgggcccacatgttagctctcttatctctcttctctctctatcacctccttccagcagctggcgagagcggccgtcgcctcttccccctctcccgccggtgcagccgtatcctcccccctctcccgccggcctcatctccccctatccggccggcctcctccccccttctcctgccgccgctccgctctactccgccagccacgacctgcccgctccgctccgccccgccccgcccgccgccgctccgctggtcatcgtgcgatcgcccgccgccaccagcgctccaccccgcctgccacgcgctcgctcgacgttgccgccactccgctcgcccgacgctgccgctccgccggccgcacgctcgtccaccgccgccgccgccccgctccactccgccagccaccgtgtgctcgcccgcctgcttcggcctctagctccgctccgccgcagccgacgctgtgctccactccgccgaccgccgtcctcgccatctcctccgccgcaacaagctcgagccccagcgaccgacgccgccccgttcccctctgggagagaagatagagagagatgagaagagagataggagatagagctgacatgtgggcccaaggacatttttgacatttcacgtgatttttctctcctttttaaccggaaattattattttaatcgtcacggtgtccactggcaaattactatattcatcgagtgttttcccctaaaagtgagtttaggtagtgtcctagggctaaaaccacacattaacaatgtcctttagcaaaatttgccttttagttttgcttccttgctccttggcttccttgcagacttgctgcttgctcttgccactgcggcctgtggtgctgcagtagcccgcagcttcgccaaattaacataaaacaaactcaatcgtgagagtgacccaggcgcccagcatgacttcgccgcgccgtcgccctcgggctcacttgaagaagagagaaagaatgagatagagagaaaagaacaaggataaggaaaaaaaaataaagggtaaaatcgtacttacacagctgtttctctctccaattccttcacatataataacataatctggcaggtgtccagcaactaattaccagttttttttgtccactagctaattatacgtttttttaattttctgtagcaaattttgtctttaatatatgcagcaggtatatgactcttggctgattttcttaaaatactcacatgtattactaccaatgtgatctaaaccacaaggcataaccgtgcgagtatttgttcactttaatatttgatactttttatcaacatattgtcagaaatttttatatatttatgttttaaccttgtcattttttttaggcttatgaacctacaacacgcatgcattaatattatattttttactgcactttatatatgatgcagggatatatattgcttcgattaaacatatgggtgcagtgaattcatgttacttttgaattattttaatttttactctgcctgtattatcaaacatatgggtgccgccggagtcgctgccgccagatcgagcaccggccgagcaccaccgccacccattggatctgggagaggggagggggttagaggaagccgctggaaccttcgaggcccggccgtcgtcgtcgtgtggcagccgctgctggatccaccgcgaccgccactcttcgccgccgcccgcacccctccccgccatgggacccaccacgccgctccccgccgccagatccacctctccaccacaaccgcccctctccttcaccgcccaccgcctcctgcgactccccgggccgccagatccgccgcccatggcccgagtcgccgcagctcacgttgtcgccgcaccacgagcttcgtcgctgcacctcgttgccggatcagcttccgtgccgccgtcgccgttaccactgcaggcaccctttcaccgcctctgagaagactagagaggagaggagagggagacggccgtgtatgggaggagaggagagggaggcgactgggagaggagaccgccactcttcgccgccgcccgcacccctccccaccacggctccaccgaccacgccgctccccgccgccagatccacctctccaccacgaccgcccctctccttcaccacccaccgccgcctgcgactccccgggccgccagatccaccgcccgtggcctgagtcgccgcagctcgcgttgtcggcgcaccacgagcttcgtcgctgctccccatcgttggatccgcctccgcaccacgagcttcgcctatgctcctccccatcgccggatccacctccacgcgccgtcgttgttaccactgcaggctcccttcacctctgagaataccggagaggagagggagacggccgtgtatgggagaagaggagagggaggcgactgggagaggagagggatgcggtgggtggtgggttgtgggctgtgggggtttttaataacgcggttgatttttttttgcaagcgctgctctctatgagtatgtactttttgctgtcggaggtccttagtaaccgccagcgaaaatcacttaagaggtccgcttataaaaagtcccctatttttacaagcggtactcttaacccagccgccagcgaagatccattttcgctgacggtccttaacgcctcatccctcgttaaaatttcgctaacggtttccacttatggccgctagagaaaacaaaaagtcaacgccatgaaaaatcgattttgtagtagtgtatgcaaatttcatgtttgtatccgtgatttgtatccattcgtaggggaccgaacctgagagcgagaatctcgtctaggcttgtatccactaacgagaccaaatcagagggtatggtaggataacatgaaaaaaaacgtgcatagaagccactcctagacccatactcatctggccgaaccatagaaaaaagtgtgaaattatgttaaaagccatcaaataaaacgaactttcttgtctcatatgcattggttgagacgaaggacataacaaaagacgaaaaattcctttggcttgtactcatggtggtcaagcctaagaatatggcaagaagatgacttcctggttcgtactcattagccgaaccgaacaacatagcaaaagaatacatcaacgtgagcagaagaacgagaaccgagagattctttgactcgcacacaatgaacgagcctaataacgaaggaggagcatgattcccaccttaaacacctctgatcttccagcacagtggagcgaggaagcagaggctgacgagatggcataggagcaaagcggaacggcagcagtattgcctagcaacaagcagcgcttctgcaaagcctacgaacagcacctagcctctacgctaatctcccctggaacttcctttgccgctagggggttaaccagcttttcgtggtttagaacagagtcccgcgcgcatccgtgggcagatcgtgggaaatggactcaacagcatacacctttctttggcttacatgtgggtcccttcattttgactggatgaatgtggcaacgtgcgtgcaggtagtggggtgaacatgagcagaccggtcatgcccctggtcgttacatgctttcccatttattgttatcattctaatctttattactccagttagccttttaattgcctggttattgagtgagagagagcgcgtgtatcctctcactgacatctggccctctcttatttggcgcgtgcgtgtttatatatccgcatcattatagcggtctgcacgtgacatgcatttttatttcacgtcgcaaaaattaggagtataattttctcatttgttgtatgaacatatattttggttttctttttaatttattggatgaccgtagtctaaaactattttatatggtgcgtacacctttcctgaaaatatttaggacatgactattttgggtgagtgggaaaaatcctattccacggccatatgttttaggccaggtgtgtacttagcgaataatcgtagtctcaatatatttatacgatctcttttattatagcacgaatttcatatgtgcacacgaccagaaagctaagtatcagcgttcgtcggtccgatgaaaagcacgtaaaaaatatttgttcacgttttttaattttttgaacgtgtttccaagatgctaatttatttttatatggcacgcgcatacgcatttctatttgcgccggaaatcatttcactctgaccgagcggattttatttttatattgcggccatatatttttggtcgccattttattttatttattcatttgactgttttgactgtttattcctatttttgtttatttatttttttacattatgtttgagattatatattagtttataatttaatacatcttatttaagatacgagccaaaatcagtgtcaacaaatgcccccttgccaaaattttggttttgcatccggagctcgaaacataattttggattcgtagggacatgatgcatgtgaagtttatcctcacaactatcgatgtgcccgttgtttgaaagattgttgagaaaattaaggagcatctctccgattatttggccacgttccctatggctaggggcagtgaggcacttgttcgttgaactcatctactactccagtcttctccctctttctcctcttctgtgcaaggatttgaggagagacttcatcaatgacagcatcaaaggtaagaccttgatttgatcttgcatactgaactggcgatctttttttttgtttcctttttactattattgttggctttcattcctccattaattaattccatttgggtttcttccctatgcacacatgcccgaaacctaccaagtcttaatttcagcgggtgattggtgatttaggtgtggcaagaggaaggtacagagagattttcttcaccctctttcagtcattcattttttttacaggttgatagatacatataactttctttaaccacatttgtatagaatgagttgctcgtataatcggggttcccggaaattttgtgatatgttacgcagccaatccgggttgttaattagatttgcatgtcaaacttgtctaacaataccttttcttcctcattgtatatttaggctgcacctatatacatattccgatatatttttttcatttgtagatgacagatgctggctcttctcgagcaacacataacttgccgctttttagaatggcgcaacttcagccctatgaacctgaaacaagtgacttggggaaccctactattgtggataaagaattgatcggtggtgaattttcgcgtaacactcgtggcaggacttctggtcacgctttcaagggccgctgttttcaccctctcacccctttgccttgagatgataaggcttccaccttagggaataggatagtatctgagggattgggttgggaaaaccataaggtggaatttgttctagctccttcaggatatgcggaatggggtaaagcagtcctgcgtcatcattcccttcatttgcgtggtagcgaagagggggtagattacatttatgggtctatctattgctcccttggtttgtactgtacatcaccattcaccaagtatgctgagatctctgctggaaaaatgggatccacacaccaacagcttcctttttcctcatggcgagaggaccatcacattactcgatatatacaaactctcaggactgccccttgacggtgatctttttgaagagtacgttccacctcacagtgagttagagccatctctcttgatgtacccaaagagcttaatgctacatatggacattaggaagagtcttgaagttggtggagaagtttcgcttcaggattggtgtgatcattttcacaaccgcatggaggggttgccagattcctcgggcattgagtcctcacgcatttacatagccgcctttatagctttgtggctttgttgcttcgttgttgttgggttgggtccagtccttcgtcatgggggtattggtcatggcttcctggatggccctagggtggagaaattcgttggctccgcccgccctatgttctttgtactattctttgatattggctagtacaaatcttatcatcccctcccatgctgcaagtagaccatggcctatacactttttggttggatgggcatttatttgaagaagttgtatggcaacaaaaaacaacacccatatttcccttcctacagacacccttctgctgagaagccactcatggagcataccatgtttaggatcccctaattttatacactgttgacggacgttatagaccaatctcgaccgtcaatataactataataaaggagaactagctatgcttacaatgcatatttgttttagaataacatatctccacttgtacttatagtattatttgttacaggaatttagcaaataaaataaagagaaagtgaagaaacctcactcctaagcaagcttatggataaggagggtccacaaatcaggtgtaaccatcctggaaaccgcattaactgccacaaccaccaataggacccacctgtcacccaccctgccgaagctggagacctgctgggctagcccaggttcagccaaaccctggctacgtcggctcaggtcagccctccacgtggacgctccaaattgattcccaatgacggttccgggggaaaatggacaattcgcatagctacaaccatcataactgccctataacaggaggagttcattcactatctcaacacactcaagcaagctcaagatttctcttcatactttagtttagtatttttagtgctaagtggagtagaatagaatagttctcggagtcctcggagtcttcggaagagttccggtatggctctagcagcttttctactttcatctataagactttcgaaattaatgaaatattcttctttatatactttcagtactttgcttagtctgagtattgctcttgctttatgtttgcgtcggtataattgtgtgggtagcctaccagagaggtgcaatggcatgggtttagtgtccgatttatcggttgctctatatcatgtccagaggtgtagagtagtatttattaatgtaagcatggtgcttagattactaattatcactatctgggcatatatgctgcaggacagtagaggtggaccactgatgatgacagctcaatacaggtattcctccacgttagtatatattcctaagactaattcctagggagggtactctcatgtatttagccccggttggacggccatgacaggttgtcgtaaggaactcggtaacccaggatggtctctcgaaacaccaggagggcactgttagggggtattagccacatgattgtatacttctgggtgaaatgctacaatggtatatccgtgcgcttgcggattacttctttgaccatacatatataccaggattattcatgcgccattgctgggaatgaatatttgtagtaatgtcgttaagaaataccaactagcatttctagcgctgtttctagggaagattagtaaagagattactataagctaataatcttttatatataattacctctgcataaatcattgtccgttgcaggctaacctttgtgtcatgaaaacagggtatgaaaacaggatagtgcatgactggtaaacctgccagaaaacttcaacgaaaatccagaagctttcttccagagcgtcagaccgagtgtcgtccctccgcagaagaaactttcagctaagaaaccagtcatcccagcgtcaccatgtttcaggaatatggctgagaagacacttcgtgagttcgctgctccgtccgctgacaatgtgcccgtcgggccacaggttaacctcggagacactgacttcgatctcaagagcagcctgattactatggcgcatgcaagcctattttgtggcaggccaaatgaggacgcaagtgctcacttgcagcagttcctagagatctgcagcacctacaccatgaagggtgtcagcccggacaccattaggctgcgtctgttcactttctcactcctgggaaaagtgaagcagtggttttacacgaatcgggttgcagttaacacatgggacaagtgctccactgcgttcctctcaaaattcttcctgatgggcaagacaaatgccctccgcaggagaatatcaagcttccaggagttttacaacgtctgcaggaatatgtagctgcctgtcctcaccatgggatggacaactggctcattctacagagttttacaacggacttactgtttcgtcccggaatcacttggacgttactgctgggggtgccttcttatcaaagacggtcaaaggggccgttgatctcatcgagaagatagtgtcgaacatgagctgcagtgaagaacatctccagacccatcagcatggcatgcatactgtcaaggagacaaaaatgctggccgcaaagctggacctcctgatgaagaagctagatgatcaggagaagaacaacccgtaggccgctgtcaaggcactagactcgcacatcacttgtgaggtctgcaggaacactggacactcggggaacgactgccccgacattcgtgaagaagccatgttcatggggaacaatggctatcatcccaaagaagaccaggggtggaaccagccctgcccgttctaccaaggaggcaacaacaacaacaataacggtaacttcaacaaccagccctccttaaaggtctatgtgggctccaccagaagactcatcgaggtagataagtcaaagtgtcacgtcaacgaaaccactctccaaacacagttgagagagtcaagttacaccggttttaataatttgggtttcaaagatatccggtattatggttcaaacgacatcaattgaggattggagctatatttgagggacacgaattggacttatttcctttttgttttccgtaagtggaccgagccttagaggctctgtagtaggccaggccgcgctaggagttctggcccaggcagaggagagagggtccagcgctagggttggcccccgctctcttcgccctttgcgccgcttctcctcttctcttctcttctcttctcttgggaacctccacttgtgctcgcctcctcgtcctcctcctcctcctccccctcccggtaaggcggacgaccgagctgaggctgagctagggctagggcacccacctcctccccttccggtatggcctctcccctctcctcatgatttcttttgcgagttcgtccctgcgatcgatttgttaggcgagcgctagggatgcgcagatctgttacctgggtgggttggatggatggatggaacctgtcgattcgattcttctgtttgtttgtttggaacgtgtagatctgcccccaaatgggtgctttggagaatcacgcggatctaccatccgccatgggatgggatgggatgggatgccattttgactagtttgtttgatgcctgtgaaccgcctagatctgcccgctctgtttggtttccttggtacttgttgttagaacaatggaacccctagtggatgagggacggactagtgctgtggatttgggcatatggtccagtacgtgaacacgcatcgtgtaccacatggatcatacccatttttttccctttttcttgtcacgtaccaagtaatctttttcgctagatagattaggcacggctgagatatcactacatcatcatgaaaaattgagatgatttattcctgtggctacttatgttcaatgtgccttacagttggcacctaacaattgagatgatttcgcatggtatgtgcttatttatcgacaatagtgcaatgctccatttatactaatctaaactttttgcgatgcaagtttcatcttgtttctttgatatcatgttttaggtcactggcgtatctggtacacttctttttgtatattttcttgtaaacacactgattagaatactgcaatttgtgagttatggcctagatgaggtgttagataaaagttttgcaccatatgtctttcactatcttcatcctacttttagcaaattagtttacatgatatcgatatgtcaggtatgtcactataggcacatcaatataggatgttgccgtcatggtttacgtgcatgcattaggtcttctgcaaatgcagtaacagcactatcctctaattaggttattgatataatggtcttgtgttaaccacatagatggataaattggcctagttgctattacgcggtcttccacggtttgcatataagaagggggctaggggttgtagctagacaatcaaatctatgctttgtctatgcaataacaaggttccctttttcgacctgtgtaacttgtttaggtagagcattgtggtgagatagcatacatacttctttcaaggagcaagtatgtagtaagttaaggtctgcagtaaggtcaatttaaacagtttttttcagagattgtaatgcatggcaccaaatgtatgcttatttcttttcatgagttaataaaaaaataccattcagttgttttaattttgacattgggggttgattttctgacatatactccctccgttccagaaaaaaccaacttctggggacaaatctagacaaatgcatgtccagatttatctccataagttgattctttttgggacggagggtgtaaatttgcggtgaatcctcctggttattactcaaattcactccacttggatggttagatactgtaaatgaaatatgcacagttgcttctactaattatgatgccataacctcttttattgtacatctcagttttcaatatttgatgcagtatcctggatggctgctggtcggggcattaaccagctcctacggagaacactccataatcagtcctcagtaagaattttaatgaactatttattttgtattacttctgtcaaaaaccgatcgcttaccaatctttttaatatttattttctgtctgatgcctgtatgaaatgttatggtataccaatcttgaattgattattgaaatggcatgtagaaaggtattaccggacatcactataacgtgaaatgtatcagatggggttttggaaagaaatcacagttcacattcttactagttactactgcacagtttttaggggtttctgtttggcaggattgatctttattctactttttacagttaaacctgcattatgcatacaatgcttatttttgctgttctggttgagtaattagaccatgatatcaactacttatcctaattttgacaaagtttataatctgacagtaaccatttgttcaccataagtttcagtacccatgatcatctcctttttagtgtggtgacctgcttttttttaaaacattataatcatgttttcagggctcatctctgctatcctcgttccggataaagcatgaagaatcctccgctggactgagagcattggctcttcttggagttggtgcttctggtcttttaagctttgctacaatagcttctgcagatgaagctgagcatggtttggcagcagctgaatatccctggccacatgctggcattcttagctcttatgaccatgcatcgtgagtcatcctttttcaacttccttacaaaatagagtttagctcattgcaatatttcagagtctttgcatacggtatttggttattattaattgatccatgctcttggttaccccaatccttcaaacctacttcaccaatttagtttcccagtaggatagcgaaaagaatcacaatattcttttgctcccaagaaaatccttttaaccactactaccctattcttgctgtttactcattgtcttatatttgaacacttctatgatcagtattcggcgtggacatcaagtttatacacaagtgtgtgcctcttgccattccatgtcattaatttcgtaccgagatttggttggtgtggcctacactgaagaagaaacaaaggctatggctgctgagattgaggtggttgatggtcctaatgatgagggtgaaatgttcacacgtcctggtaagttaagtgaccggttcccacaaccatatccaaatgagcaagcagcccgttttgcaaatggtggggcatacccaccagatctcagtcttatcacgaaggtaatgatattttatgccattggcgttgcattgtttaatcttccaccttcaagttgtaatttactgtttgactccgtatgttcaggcaaggcacaatggccagaactatgtgtttgctcttcttactggttaccgtgatccacctgccggtgttcaggtaaatctcattctctgtcagttataccttaggcatttgcagttgctacttgctatgtgtatcgcccttaattcctttacaaacaataaagatgctcttgcatgtggattgaatcacttgtgtcacagggatacatattttacagacacatgatattgacatcaaatttgacactgttgtaactctgtaattgcaatactggttgaacttggaggtgctcagcttcaagttgtgttgtcccattgttgtttgagtgttttctctgttaatttacaattattcagcctctcatttgttgtcagttattgtttggaattcactacataatcactatttttgttcataattatgatgttgaactctattttgaaaaaaacctaacctgtcccacgaagtgttatttttctagctgtaatttttcaagctggttgtgttctgttatttgctttctgcagtgtgcaacattagtaaactctctggttgatttgtattctagatccgtgagggtttgcattacaatccctacttccctggtggtgccatagctatgcccaagatgcttatagatggagctgttgaatatgaagatggtactcctgccactgaagcccaggtaagtttctaatgcgttgttgggctcttacagttgtgacatgttgggttagcattaagggcctaagcatgattgttgtcatcctctaccacagatgggcaaggatgtcgtttcgttcttgtcatgggcagctgaacctgagatggaagagaggaaactggtaatcagctcaacttttgtccatttatatattactttcaattcgcaatatttcctaataccaacctactctaatttgatgtagatgggagtgaaatggatcttcctactgtcacttgcacttctccaagccgcatactaccgtcgcatgaggtggtccgtcctgaagtcacgcaagctggtccttgatgttgtcaactgagggaccactgtttcttactttcattaaaatgttttgagcatttaagcggaagcatttcaaataatgagtatgatgtacattctgccactggggtttcccatgcctagaattttctgttttcttcctctgctgcaaaagcattttcttcatgggagcacttgcaatttttgtcaatgttacctgaatggtaccagcaagcttctaacagaactgctaaagttcataaatctttatgttttgaactgtgcacaattcatttgtttcgagcacgctgatgatttgggtttgcgtttttatgtgacggatgcctgttgaactgtcctgttttgtgtttttgtcaagttctgtgtcgaatctatgcgttcattcgcgctcaagctacatcggtattgtcatgcgcatatcatatgtcaagcggtaccaatttggtattttttttccggtagcttcatgtactatgctgtcagaattttgcgaacggtctaatgtaacagaagatacatctaaacgaaatttaacatttgtcacaactcacttttgcaatggctaggagtagagtttacatcgacctgaactcgtaggctctgtttggcaaatgggatgaggagtgtgggaaatggatgttatttccatttttcatatttctactgtttgggtgtggatgggagtgggatatagaatcctgcttgatttgagggtggattgactactaggaaaaattattgaattaccctcaccatttgaacttatagctaatagctgtgctgtttgtttactcatttagcatagtttgaaggggtattttagtcattcttctagaaacttccttttccaatccatccaaccaaatatgggataaaattttccttcgtataaactaccaccacatcctaccaggatattatatccatttcccaatgggtataacccattagccaaacggagccgtactcctaatgagtcactaggcatttagctcgtaagcttatatgccagctcgtgaattgtccgtttagctcaaacagttgtccgtttagctcaaacgagtcgaaccttaacgagccgatgacttgtagtttgtgcttgctttactttggaccatccaaaaacaacaatttgttttgcataaaagaaagcttaataatatcaatttatttttccaaaaaaagttaacatgaatcaatgatgtctcatctaaagttttttttttgtttgagttggagttcgtttaatttgttcttcgtgttggatttatttactagagcttgtagaaatttttttcatggatttatcttgagtttatggagatgttttttttgtcgaatttcttttaattccagtagttcactacatccacaaaatccataaacctaattcaaatacaagggtgtatcaggagtacaggttgctaactcattcatctcgcttagaagacgaggttgtttattagtgcataatccattaagtttttagctaaaatgacttgaaaaatagatcttatatatatatatatatatatatatatatatatatatatatatatatatatatatatatatatatatatatatattaaaaaacatactatttaaaagttcagaaaacgtacacgtgaaaataagggagaagttgagaaatacgagtgccaaacacaaccctcataaatattaggcatacacatgcatttcaattaggaatccagtgagcttagcgattaactccctccagttatgagtatctgtgttcaactttaatcgtccgtcgtatttaaattttttttaaaaaattaaaaatttaagtcacgcataaaatactattcatgttttatcatctaataacaataaaaatactaatcataaaattttttaaataagacagataattaaagctgaacacagaaatttataaattgggccagaggaagtaccattttactgtaggtctttgtcgaatataatggtgcgtgtgtagtggagtggtgtttccatgtaatccggggaaaaaattccctaaaccctgtcaggccaaatctttccaacccattctattcatctggctgaacccactcttctctgtcttcctccactcatcttatgtatacttcgaggatgagcagagcacctaaaataaataaagaaatatttgccgctactaaactaaactagtatcgccaaaaatactgaaatacaaagtcacaatattaaagaaatatatggtgaggaaaaaaacactttatgcgtgaaacaaatcaaggccatatcttgccatatctggccttatccaatatgtggtttgagtatcagctcttgataaatagtctcaaatgaacatgcaaaggagctcaccgttcagcaagtaaatgtagctaggcaactcaaactaaatcaaagccattctaggtacatcaagatcttaaacacaaagggaagatgaatggcatgcgtcgtttacaggatgcacatctgattttgaatacaaggatctaacacacaggcaaagcatgcttcacacaatttagacaaaccacatgcttctgctatgttgagcttttcctagcttagcaaacaacagggaaaaaggaacggtaacttcattgcttcatgtttgcggtgggggtgtgctgtcacagcctgctggcttctttcctacagctttggcttggctgccttttgcacctctatcatcctcatcagcctcatcgtcaatcagcgatccggagcgcatcagctccttcaccttgaggaattcatcatagtgagcacgacgatgttccttgaaactcagtcttgacttttcagcttctggatctacatgaacaccaacatataactaactctccgatgataccaggaaacatcccacaggaactatcatactccataagatttcaggttccctatggtgaataacagattattgccaattcgtaatgatggtatgtatcccttgcttatgtcgtcaaaagaaagtactccgtatacaacatgattttaagatgaattgacgaaatttaccaacgaggaagcaagaactaaacatttgtctaattatataaaacagatatattaagaagagctgtgtcatctgtcatcagatgcatctaggtcaaaattgaatttgctttggaagttaatagataaattggagctagcttaacatgtggaaataaatgaatattgataatcacttctgttcttttctgaccatcaaactcaaaaaatgtgttttaatcatcatcattttgagctggtacaaagtataaccttcaagatttattttgaactggttctcagaatctctattaaatgcctcctctccagatatgtacgttgctttagtagagcaatgctaagggtttggtcggtgtatgtgctttactattacaaaatgttaacatactataacttccagtaagatttgcgctacttatccaatgacaagacttttcagacatattcatgtaatttcctgataatcaattaattaatttttccatcaaaaacaagatgtcttcaaatgcatttaactgaaacagggaaaatataagagcaaattactacatgcagggtagatatatgaaaatgggaacagggtaagaggcacaaccatcatcttgttccatggcatctgcatcatcatctgaggatgcccaaccatcatcctttggatcagttttgcttgaagaagccacaccatttaaagcagttaaaatagcttcagcattaacagtctcatccagacacttgtcaaaaggacgcgttggtgacaatgaccctataaagaaagcaatggcaagacatattcaacaacgacacagtaactaatatggtcaagtaaaggtataatgagatcagaacaggaaaacatgtaccatcatcatctaccatagggtgatatggtgtcttaggctcagttatcttctgcctaacaggtttatttgattcaatctcatacaggttgtcttcattccacttcacacgacgagagctaaagaaaaacagtaaaatcaaattaagtaaactctaaactcacgcttgtgcagtagttttttttcaactagctcttaacagtccagcatttccacaccaaaaaagaaaaaaagatggtgtatgaatctaaaactccataaagttctttaatctaaaaatcaaacagtttttcgaaacaaaattcatgtacaaatcagcagctatggtgtatctgtctaagcacttagggccttattgtaagttattccaccatggtaccatcatcaaaaggagccgtgtcacctttttcttaacacaaaactttgacaagctctgtttgccctttcatcccttcagttttaacgtatcaggttctgaaatccaagcagcataaatcaacaaactactatttctgggcctaaaagattgagacatcatacttcaacaatcatacagctctaaattctcaactttttagtatttatagtaatatttgattttactaaacaatcatacaatcatacagctctaaattctcaacattgagtcccatctaaacaatatttgaccctgaagtaatccggaatggaaccactgatttcatcatcattgaaactgctgaatctttacaccacctcatattaataactgcctggctggaaccttaacttttgtaaggtaaaaaggaaaaaaaaaggaaaaacaactgtaaacaaagaggtgctgcttaaattgattctttgtcaagggcccagggttcgtggcctttcttgactagctttgtctgtggtttcttcttagcttgaaaagatgagggggcggtctttcccccgccggccgagttttgtttttttaatttacatatcatagcaactggaaaataacaaataatcctcagaatttaccaaacatacttcttggtaacgtgttatgggcgtgggcctaaggtatgcaaaccagcagaaatatgtccaaaggtaggaagcaagaattgacctcatgattaagcttcaacacctcccagtgatggaaaataaatgaagtttgagaaatcctcactcacgaaagctgccaaagtcatataatgttaaatggcttcatcatgttttcatgcaggaaaattgatgatgcatgatgccagaaagaaaaataataacatatagttggagatatgcaaatacggtaaaaacattagaacattaaggcccaaatgtaatgtgagattttttctggtttgtgtaggaattgaactgatatctgtgaaattcctgtgttttaaattaaaacagagcccaactgtcagtggcataagtgtaagataggaaagcacgtgcaaattcccagttccaacatatcgacacgacttaatatcatctcaagttgatgatcccgaatgactcataatactaacaaagttaatcaaacaattttctgcacatgacaaatgagataatgaactggtagaatgtaacttttttagagagtgcatcatgtgcatggaggtgaatggtcttgcagtgactgaagatcaataaagatatttgagcaggacaatctataaatgcataactaacccagcttggagagagcaccacaatattttgaacatagtatgctgtcgagacaagctattggcttaaagaaaaaataaacatagtgatacatttagcagcagcgatggattaactggtgaaaatggttactgctcctaccagctcagagtgatggttccatagtagtcagaaggggtaggatacccctgccctccacacgcacaacacacacacacatcaaaattagcatgtgttaagacagacacacacaaattgtgacatgctgatgttgccacaacgttacatacactatagaaataaatattggcatcatccaacacaaattactcttctggatgtgtgtagatttcataatactgagaagaaaaaccaacaccatatatatatatatatatatatatatatatatatatatatatatatatatatatatatatatatagaccattttctggttttcatttgtctgttatgataagagaaaggttttgcagcccacaaacaatttggcctgcatcaatggatgtgggggcacactgggtaccatccccaattcttgttacaagggaaccattagtaataactatcttaggttaactgacttttcatggggtcttaatcaacaacacagctccactgctgaatcgtgtcagccatgacctagtgatcactgattttccttggtagcgatggccactagacacacttgcatcaatacgcatatattatacccaccagctacaaggatggtgcgcaatagtttgtgcgtgctcaggaatggagaatgagcaacggcgcaatgacgagcaacgaattcatttattatatagaaccacaagtagtgcgggatggcagtgtaatcaaattttctagtcaggattacgatcgcccatcgactatctctacagagagaattattgtcaactgtgttcagctttatcgcaaggcgaaaaaccacaagcggatcataaatcctttggtactcgatcataaatcccccaccctagaacgatgaatccaggtgcaggcagacctaaacctaacacgcgggggcatatggggtttaatcctccgttttccgtttctaacaaaagaaaaagctacaggctagggagagaaacgagatcaaaccaatcgaatccaatccacgccgggatgggggatctccagtccacaccgcccccgctgatgaagtggcgcggaaggaggagggatgggggagaggggggctacgagctgcgagagagaggaataggtaccttccggttcgactcgagcggcctcgccggccgcgcgcacgacggaggccttcggcgacggcggggggagggggggggggggggaaggcggcgcgggggcacaagcggctctgcagatcgcgggagagggagagaggagaggagagagcagaggggattggtcagaaacaggggaagaggtgggggtgaatgttgtttttgtcattgctaatttatccatttttttaaaaaaaattcatgacatgaaaaggtcaaacttgtaaagggtgatgaaaggcaaagacgattttgttcacctcctttaaaatacttctttttataaagaacaaacatgatcacaatacgcatccacttatttctatgaaatcatacacgcatacctcatctctattatcatataaaataactgggttggtaaattttcgtatcgaccaagttatcgtgtgtgtctcgttatcgacagatacattatctactactaaaaaaataattagccgtgaatacttgctcctttctcattagtcacaagagttgaggcgtacaatatagtctttgacattgaataaatattttgatcattaatttcttcctaatataggtacaaaacaagaagcattaacaattaaaagtatttttaaatattaatataatgatattatgtcatacatgaaaatagatagggttaattagatacatgccattaaaaatttgctggtttcgaaatatactattactatttacgtatttgtaacaatgctactgctatttgtaatctcaattgcgtatttgtaacgatgccactgctacttatttgtaatttcaattgcgtatttgtaacgatgccactgctacttatttataatctcagtggtgttaatacccacaaagatacgtattttgcatgtattagacgaaaatgcactcatcttttacctctctctcttccctcgtcttctacctctctcttcccgctgctttcttgctccaccgccgctccgttctctccgctctctccgccgccgtcctcgccgttgtgagccacaacttgctctatcgctgccgccatcgccctcgctgctcgagcccatccgattccagcagtcgctgccctagtcgcctcagccgccgccgtcgcaaccgcaacactgcactccgtgtgcccgtcgccgtcgcaggcgtcccccagtagcagcagcagcagcaggcggcggccgcggcgagggtgcggagccccgaggtggagatagcgctgcagtcgcaggcgtccccctaacggcagtgtgaggtggagggagatgcagatgtcgcgtgcaaaataacgctggagagggaggagacaatgactgcaacactcgtatgtttatcgctggttgtgcttgctgctgccgacactaagcatcactggtctctgagctgtggaagaaagaaggggagaaaaaggaagaaggaaacaagggcaatttggtccacattttttcgtaaatgcatctaagaggtaggtagtggcatatcttgaatatgtgtaaattatatggcatggattcaaatatgtaaatgctcgtggcatattttaaaaccggaatatttttaatggcacggatctaattaacccagcagagtaatcctagttgatcttgtaatacaagcaaacaaaaatgataatattttagctggcttgatcccatgtctgatgtttacaagcctattttcatctgtttatttctcttggcacagtgaattcattcgttaggagcaccgtctaccgccataggtaaagagaaataatattgcttttgagatctcacatgtctcactggacgttttgacgagccagtccgtggcagagttgatactacgtacaatccattaattcaagttattagggttttaacatattagatgagcttttaggagtccagaacatgaagatgatacacccggtggtcaatctttgttatttcagactgtcaactgcgaaaaatgactttggcttttttcttttctcgaaaaacacatgagacgttatattttattaagaaaaaaaataaaatatgattagctgtcaaacttcttttgcctgatcttcaacttcccatgatgaccctattaggtgaatggagcaattagcttagtactaccatgaaagagttgctgtctagaaacgttgcaatgttcgtgaaaggtattatggcatcttcatgaaaattacatatgaaacaaggtgaaaggtcgcgtgatttgctattaagtgcaaaatttcaatcagtttcaggcggtcacaagtgcttatcatgttacaaggtcctttgaaactcccagcctgaatgactgagacaggttatcaacaggaaatctacgagtatttgattcgaattcgagcatatcaaattcgcacaatgagaaaccaggtgatccattctccagtctaattgctaaattgacataccatgcagcgccggattcgctcagatctcactgatgtactctaaaagagattcgacctcttgcctcagggcagcaactttctgctgctgggcagcaatcctgttctccacatcttgccctcgcaacttcttttcaaagctgtcaaccacagtggaatgccttgtcatgagcttatcctgcaactctctctccttggcaaccaattcctctacctgcattaaagaaaaaaaggccaactgtaaccactatggcgcatatacttaattagagaatgtgggcaaagaactcaaattcaaattaaatggtgaataaagatgcactagtaagtatctctctcttctaggtggtctatgcacaagacgttgagcaaacctttggccatatctggtaagactgagaggatgactgcagggatgtcaacaatggcttcaactcttttgctaattccttaaactgtgcatcagctgtcttacgagccactttgcatgatttaacatctcctgacctagataactcgtgtaatgaggtctccagtttatcatgagctgctagacattggttgaagatagcctggatttgctggatgatgctctgtacctgtacaaaaagtatgaaatagattgtagaggttagtctgcagaaagtaagaggtctccacaagtttaaagcattcttcaattccagaaacactacaattaatgttgatccagcttaactgcttaaaccaatgatacgcaattattatcttcttaactttgaagtttggattgaagatttaggacttttcaagtaacatttttttccctgtcaattatgaagctcgcttttaacacagcatggactgctctttacctccagattcatttagagcttgttttgcagattctattccaccgtggttaagacccttcacttgtaacttgtccatttttggaccaaagctctcaaaagccaatctttaacagaaaggacagcgttctcacatgattctgatagtaaacttgtcacttatccaactaaaagttctcacatgattctgatagtaaacttgtcacttatccaactaaaattactagtaaacaagccctccccaaaatttaaggccaccattcaaccctgcacattttgagacctttcctagctatttgctcaggccctaatatgtttgtcatctgatatttactagttcaagtttttatcattgcattttttttctcccataaaaataacaccgctacatagtactccgtatgagctagcaaaccaattcgaattatgattcataagtttatttcactgtaattagtgctcatcctaaacatagcagcagtatagtaacaaactgtagttcactagaagaaaggttatggcaagatagatttaaacatttctcgtaaatcatcaaaatccaatcctcaaaggggagatttgactaaaacgaccatacctcatcccactgcacctttgccagataagaaggagaattcttagagattgacatgtcagtgcgcatgtaaacaatacaggccatgaagaggagaaagaagccagttatcaacatcatcggttctctgagtagagagatgttgttgaacctgtagtaaacctgcatattgtagggcattaacaccataagtttgctatggttcacataaaacaccatgagatagacaactcacagaaagtattcatggtgcagtaagccttttgcatagcagattttacatactcttcagtcaggttaataatttagcaacgctcaacttttcatggaggggtaaaattagttgcacaacaaattaagtctgaagacaaacctggaaatatagattatgctctggaataacatcaagcttctccaagacaaccactggccttccagaaatatcaaggtgtgaatacttcacctgcaccacaaatcattgtcattacaacaaaagaacaggatcagctagttgttcagaatatatgtgtgtgtgtgtgtgtgtgtatcatccaacaagaagtcacctcttgctcttgctttgttggaaatggaactgaaatatcaatatcctttgaaccttcaggcagaacaacctgttcaaaaagaaaggtttttatgcagggagggaaattaatatgtaacatcacgttcatggaaatatgtgcaaatgtatttcttattgattatctaaccatgacatgtcatctacatttttttagaaacataaaataaaaataactaagtgaaggacaatacaccagaagatagccaagacaacaaaagggtatgttagttgcaggttcccagcaataaatgaagatctaatttcaatatcaaagaaataggcaacacaaggaattatgtttggtgtctaaaattctatatcagtgcaattaagaacaaaacatggaacacaagggtaaaaaatgaaagattttaccgtgcgtgccagatgggtacaggagaacataccttcacaataagcttttctatgagaatctcctccactggagaaccaaatgtgatattgaggaatctctttccatcagaattgaaaacaaagtcttgaagaggtaaaccataaccaatggtaaaggtcgtttgccaaccaccaaacaaaggaaaccttggctcaacttcaagttgagtctgcaataggataaatattcagcatatgcactcacttttgcaattttgctgggaatattatagccttgaaactgagataataaaaagcaagtgtaccttcttggaatcactccataaatgtgatgttgaaatgttaccaatctcatctctgtagtatatagaatgtgcccttggaggcagtctagcaataagatgcctaaaagatgagacccctcttatgtacggtctagattggtaatcaatcctgcaaatttgaacacatcagttatctctggacaaattttttctatccagctaaaggtgagctatttaaagcacaagttagaagggagaagaacctggaaaattcacccttgagtttggcaccaccatgagcaatgttgtaatgttctgtaatctgtacattcccccagtgagatatctctatctcccttataacttcctttgcaactgcaaaagggttattgttctcatagtgcacaaccataggggagtaggaaaacggtggaagatcttcatatggtccatattttagttctgactctgcaagttttgtgtttgggtactttgtgtaggactcaactcttccaccaggcaatctgatactaagtgtctgtaccttaacagggtaaggtgacagatactgagcactgtcctgatagacaacaagctgcgattcagcttgtgtgatttcttcggggaatggctggacagagtgcgtaaatacggtcaggacatctaagtgaagagtcttccccttctccaaaggtttggataaagatgccgaaaagaatgtaagttctgggggcactccagaaggctgaacaacttcaatcggaaggaccatacttggacctttcaccttttcctcagtaccaaatgctcttatagctgctaagttctttgcttggacattgggaaacgccagtagaaattgagaaacagcctccggtccactattctcaacctaaaaaaaacagagattacaacaaaagcaaaacctcagcatatcacatgtgcatagacaaaaccccatatattactctatctactagtgaggactggcatcagacaaagtgtaattcaaaaagagttactcggagattttagaattggtggtggcactgacaaacacagaacccctattgccagttaaaccccaacttcaaatcaaccagaagagagcttgcaacccaaagaatctgcaggccaaatcatgcgagacatggaattgaacatcccaaattgagacgttaagaatttggagcactcgtgagcacacgtcgaggcgatgaacctatacaggacaccattaatgatgaaacgctaactccatccatgatccatccacacattacagcgctcttatcatattatcagcgatgaagagacaaacatctacccatccagaactatatcacgatgaaatgagaagctcccttaacagatcggacgaacgaaccggggaacggctgaatctccccccaactagacaaacaaaattcgagagaacacagcaacaacaaccgcgtgtaccttgagcgaagtgaggacacgaacgatgtgcgaagtcaggtcaacctgcaaaaaagaaaaggaagggcaaagaggcctcagatccgggggcagaaggcgcggcgtgctcgtcgggagatctggagggcgcgcagagagacaaagaagcgaggcgggagctcaccttccgatccgccctggtgacgacgagatcggcccgtgcggtgggggtggaggcggcggcgacgaggaggaggaggagggcggcgacgcggcggagcggcggtggcgtcgccatgttggggggcggagggcagatcggtgggtctctcgcggcgagatcgagtgaagaagcgctttaaacccttcctctcctcggctcctcgtctcatcgtggaggagaggagaccgggcggctagacctgctcgtgggccgcccgacccggcagcccaatcgggccgggcaggctcggtcctgcgttttgcagcgcggtaagtctacattgagtccctcaaattagctgcaataccagatatattgaccccccaactgtcgaaaccggagcaaaatgactctctcggtggttctgagggtggatttcgatgacatggatcattgacatagtctaatcagctgagccagcgtgtgggacctacatgtcctcctctctctctctctcctccttcacacacctctccggtgggtaggcgatggtgcgggcaccaacgatatcctgcgtagtcaaatatggcgggctcctcctccaccaccacatctccccatcgtagcagggccatgccgccgtggttgagctcctcctcttccctcgagaggaggcgcaagcaacgacgaggtgccgtagcatgtcgctgtccctgtccttcgcgcgggccgctgcgagccccgagcccacctccattcacaaggttagcccatgtcgtggtggcaatggccagggaaaagcatcaacgtcgctgggctgacggctgaacacatctatcgcgaggaagagcaacgaggcgagcagcaacaccagcgtgatgtcctctcacggtagaatgccggaagagcgagtagccacacagtgcttcggcttgcttggcagcaacgacattgggggaggagaagagagttatgtgtcggtggacgcgatccctgtcatgtgccgggctgcccacatgacgagaggaactgtgccgagggagatgtagggggagaaaggggagggaggagaaagagatatggatgcaggggggtgggtgggtcttcctcaccgtctgaccagtcaagggcgacgaggccactgccttcgtccatggccgttgggttagggcacaccaccgtcaagccgtagttccaccagttccaccaccacgacctcaccacgagccaccaacaccccatgccgacgtcactttgtccttgtcacatgagccgtgtgcttcgtcggctgccaagtagccgccgcctactcctccctggtcaatggtgacgggggtccaccggcaacctcaaggaacaattcgcacaggaggagataaaggtgtgggtgatgacgtcgccgcaacgaggcatcatgttagccgcgcagatggtcacgttgtccaacctctgcgatgaggacgaggatgagggcgagggcggtggtcgccgcaagctggctcctaccgcggtggtgttggggaggcgcctcacgctactggacgtcatccggcgtcgactagcctccgtggaggtcgaggacaaagatacagagcgaaggaagggagcaccacccacggtggcgtcggcgaggtgacatcgtgatgtgaccatggctaccacggatgcaaccattgctcacatcatggatgaacaaaaagatatcgagatcaagtactccaagtgctggaatccgattcggccacctactacactgctgacttcaaacggccaccgaatctgcatacgacctccgttttcggcccgtgagtacttgatggaaagctctcggagccctctttctaacggatccagcctcttctctgaattctatctcgtgtggccagaatcacaggaacaaggtgttgcatcacctataatgggcctatgggcttgtaacttcatttgggaccccgggccaggtggggcccatgtggggtgcgccccaagctggtggagcacgaccctaggcacccctaggtcgtcctcccacccctatatatagctagttaccccttcagggtttctcgggttttgttagattaaagtttagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatagggttgatctgcaccggcaagatcagcaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcatcaggtggtatcagagctttcgttgctcggtgagtttttatcttcctataaccagaaaatagccatacaaaaaaattcgtatcatttacctagccatattgtgccattgcattgttcttttcagtttttgctttgttgaattttgtgttgcatcgtcacgtcgtgttgctggtcttagcgtctagttcgtttagagtttcgagttctggtcacgttttgtaccacagtcgtcgctgccaccgtgtctctgttgttgtcgggacctacgaaaacggaatcggctcgctgccacggttctatttttgtagttttcagaagtttctgtcggttagttttggagttcttgagttgcatctagagtttgccgatccttgtgtgtgtttgttttggccgtgcctatgtcgtgcacgagaggaggaaggtgaattaccatatctgattttggaagtagtcaagattgttttggaaagatatagtagattggattggttaaaaatcagtttcctttttatcccatacaccaaattcggctgccatccactccacctcctggccgagtcccactcgcccctttggccgagtccgactccctccctctcttccacggttccgagttgtgtcaaacaccttggcaaatttttgtttggtgtcggtttcgagatctgtttggaaaaacggaaccggcataaattcagcattccattttttgtataattttaattttgggtttagacttttacatttgagtccctgtaaattttatatttatgtttgagtccctgtaatcttacattaaggtccttgagtcagtttttgttaaaaaaaaatcaagaaaaaaagtgaaaaaaaaggcagaaaggtgcaaaaaaaaaagccgcacaaaaaaaaaacagaaaagaaaaggaaagaaaaaaaaagaaaagaagaaagaagaaagaaagaaaagagaaaatactgttatgtttgagctgaacttcatatatcagagttgtgcatgagttgttcctagtgctatcttgtggtatcgtttgtgtctaggctcgcgtctctagtacgttctagcctaggaccagcacggtacttgactttgaacaattattcaactttgcattatctgatttgagcatttgctattcctttgctacatatttaagcctacccagagctccacatatttgattacagctgtaccgcaagtgtttgccaaggcatcgatacatccaaccttcattggggtgcttggttgagtcggtgtatgtcaccattccacttgcattggtaagatcttgtaagagcttggttaaaagcttgagtgtgtgcgatttttgagctgccactacctagtagttaataggaacgcgcatatttttgtgtatgtttcttgttttctactaacaatggcagggatacgcaagataattggggatagctgcgctcaacatcgacatcttcgtcgagacatgaggagggatcaacatgaccattatgaggtaagtgatgatgttctaggtaagatcaaatctgcactgccttatttcgagggagactatgatcctcgtgcttacattaattgggagctagcggttgatagtgaatttcaaaagcatgtcttgtcggagaaacaaaaggttatgtgtgcctctagtgttttaattaaacatgcttctaatgattggaaacatctttgtaggcataacaaaataccacaatcttggaaagacctgaaacgatatttcagagatgtttatgtttccatgtattatgctgacattttgttcaacaaactgcaatgtttaaaacaagataccagaactgttacttcatactatcatgatatgcaagcttgtttattacgttgtggtttagatgaatgcgaagaagctaaagaattgaggtttttatgtgggcttaacaaagaaattcaggacatgcttgattgtcaaagatatacatctctttctcatttgttacaacttgcttgcaatgctgaaagtaaaatagaggaggacatgaagaagcaacatgctatgtttttgtcttctattactaaccatttgcaggaagtgcataatcatgaaaaggaggagagagacatgaaagagccaccagtcccattgatcacactcaaagtcgaggcacctccattatctgaagagggcatcaaaggtaaacttaatggtgctgaaattaataaaggtgagtgtgttgttaatgaattgaatttgtccacttttcatgctatagcagagcaaccattagtggaaccaactgctgagattcctttgtcacaaattgatttgtttgctgttccttgtgataaagaagagttatgcgataatgcttcacttatatccatgccacaacttgtgaatgaacatgctattcctactgttaattcatactgcactgattttaagcatgttgttcacattgctaatgaagtagaggagcgtgaattgagatcttctttaaatactatgggctatgttcagtttgatgatttttgtgagctcgataatttcaaggagaaattatttgctaagtctgatttgccatatccaaccaatgttctatttcacatctttggtgaatataatgatcttggaatatattttgtgcatagagtttacatctgctcggatttagaacctcctgtacatgtggataaaatatgcaagctagagaaaaatgttattgctaaccaaattgtctcgagtttgccttgttttgattggaagaaacaggttgttgtaaatggactacgcaaagagcaccatatggaaaaaccgaggacggttttccgtgaagaaggggaggatgatgtgaccatggctaccacggatgcaaccattgctcacatcatggatgaacaagaagatatcgagatcaagtactccaagtgctggaatccgattcggccacctactacactgctgacttcaaacggccaccgaatctgcatacgacctccgttttcggcccgtgagtacttgatggaaagctctcggagccctctttctaacggatccagcctcttctctgaattctatctcgtgtggccagaatcacaggaacaagatgttgcatcacctataatgggcctatgggcttgtaacttcatttgggaccccggcccaggtggggcccatgtggggtgtgccccaagctggtggagcatgaccctaggcacccctaggtcgtcctcccacccctatatatagctagttaccccttcagggtttctcgggttttgttagattaaagtttagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatagggttgatctgcaccggcaagatcagcaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcatcacatcgtctccggcaccgcgagatggccaccgcagaagctaaggctgaagacccggggcagaggaagggagtgcggcgcccacaactgcgtcaaatggataggtcggagaggaagtgggaagagagaaaagatatagtgaaagaaggacgctgactcgtgggtcccacatgatgacttagcaaggtggactaggtcaacatgccacgtcagcgaaaaccaccctcaaaaccaccgagggagtaattttgcactggttttactagtttagggttaagatatctggtattgcggttgagggatacgaatcggattgtagggtctatttggcacaactctagctccagctccacctctcgtggaattggagcatagccaaatagtttcagctccatctaaaatgggagtggagcttggtgagcgctctcacaaaataaagtagaaaggtggagttgagtttagactgttccacaactctactccagacccaaccctcggaattaaatttaggagttggagctctaccaaacgggtctgtacttatatttgagggagtcaaagtggcttattccttttgcagccccaaaaatgtgaaaaataatcattgaaagaaaactagcatggtccatggtagcccaaggtttggcatcatcatcagagaaggcaatctacatcacaatatttgcataattagtggatataccccacacgttgcaaccgggaatttagaaatattttaaagaaaacttgtatttttttaaatcgtgtactcgtaatacctaaatggacaatattttgagctctatatagtaattgatgtgaaattgcaattttataagtgtgagagtaatctaatgattattacttttctaggtgtcatggttcaatgtacattaagccttatggcaataaacgtagtggattttaaattcatatggcatatgaatggttgacatcaaagcataggatggatccaaaggctggtattttctatgtgatgttatggcatatgaatgattaagataaaagcataagatggatccaaaggacaatattttatagatgatgtggctcaatgattgttaagcttttggctccaactatgtagtgtaggatatataaattcacgattcctagttgacaaggaaattcaatttccacgtacataaccaattttgaatgaaaaaccacggttgggggacctcagaattgtcctcaggcagaggtgaaaacgatgttgggggaccttgaagttgcacaactagagcacgggaggggaggggggggggaggacttccacagatgccttgcgttattggggaggaacacgggagtggttgaggagctcgggaaagccttcagcatggatcaaggagcattgggaagactttagtgtgaagggaggagctcgagaagttggctgtgcagctacgggcagatgcaccgagcttctacagtatgtcttgtggtgttgggacggcagaacaacgactgctagcctaggaggcatgggggaggtgcggtcacatatgcagcgtggaggagcttaggaggggttggagacagcatggcggcacttagtgcctgctagggagtgcgcgaatgatggcatgtataccagcctagcaggatgacaatgagtggctactctatggttttagggtctcaacttagtggcataggggacggaaggagggggatgagggtgggaaagttgcgcgagagaggggctcaatggtgagattgcatacttttttttgcacttaccctgttgttcatttcaatgccatctttgttgacctttgccaccgaatgatgctatgatatatgacaagatatgatctctaagtggcctttcgaatttaccacatgaaccctctctccatatctctaaaatgttgactcgttagggtgtagtggatgatctaaatcctcaaaactaataaatgctttagttataaaactggatgtatcaattagagaacaatttatcctaaagaattaactttcaatatcaaaatgtttttttctctattaaatgcttgtgtaatctcctagaactttctttggccaaaatcctgacccattttaacaaacaaggccttctgcatctaaaaacatccatagataaccaaggaagtttttatgtacccttatagaagaagctgcttcctccgtttcacaatgtaagtcattctagcatttcccacatttatatgatgttaatgaatttagatagatatatatgtctagattcattaacatcaatattaatatatgacatgctagaatgacttacattgtgaaacggatggagtatataaggaccatttgtactcagcaaactctgtggtccttgcctcatgagatgcacatctttaactctcctaaaaaggaatttcagtttcagactttttggagctttttttggattgtctttattaacctcttttcacttcctagtactccaagaccaaaatcattataaacaatatcttcactttcctaacctctctaccagaaccattgcctacctaagatagagaatgggggagaaagaggcaatgctagtggtgtgtgctaatgatgtagggttggtgtacgatatcaacacatgcgagaagattatgtacatacacgactgcgttgctcctccatgtggcctcgcttttgttgatggatttctcctcgctgcatctcggacagacaaggatcaaccaatctttggaagtgctatatatttctgggctccaagtaaggtaagatttcttttgtgccatgtgatgtcttttcttcgtctttgccctttcaggtaatggattttgtgtagatcataggttggattgtgtggatcatggcagcaaattagtctagagaatgaattaattgcagaagtctagggctagaactggtccttgtgttatgattggttccaaattaaattatatgtttcattaaaaaataagatggattattttatcaaaatactctaaattttgttagatttttcgctatcatgtttgtaggagtagatctaattcgatcagtattgacaaattcaggtttttcaattttagtcagaaatcatatgccagattatggtagaagggattcaagatgtaaaagtgtgattgtgattagggtgagtcataattcagatgaaaaatgtgatccaagttacaagctaaagtgataatacattaagtccatttttcctatttcatctaaaactcggcatgtattgctcatttctagatgtaatagttttttccctcaatcaaccgaggacatagaatcaactaactacaacttctcattacccttacacaacaagtacatacggtgtatgtttctatatggtaaatgactaaaactgattgattgtaaaatattataagtgttcaaatttaacatttagtgagaaaacaaaatggcattacttttaacatatgggcccaaaggattaatgctcaaacatgtgagtgtttatatctcaattgtgaataccctatagtcctattctagttccatttaaattattttccttttacagatcaaggaagtgcaaaaaagttatgtagctgaagccattgggcccattgcttgctcaaaagatggggtgtatttggttggtggtgctagttctggacatacttatatttgggaggtaaataaaaaaagcttcctctttctacaaaagaattaaactattcatacgtcgttctattctagctagattatgatcaacaagagactcttgatgcattgttcgatgtttgaattgggtatctttatattaaaggaaggtatggcttgtgtttatgtttgttttttaaatcattctacgaattatcctgtcatcactaatgcataattatatccaacaataccaagttcttttattttgatttatgaaagacatggggatttcctatttaaacatgtatgaatctaccgaacttcaactggtttgtccagcaatacaaaatgaagtttgaactaataaaagatcacatcaaaacttatgccccgccaattctttcatttataacctagtattcgttatgctccatctttatcgaaaggatgccactctgatcataaattggtttgctccatttgttaatgttagtttggatgatctaaataaggaggtccatgtaactgacaaacggaagaaagtttatgaccatggaagttaattatacttctagtcactatgttaacttccctaaaaataacattacgagttcatttagcgataaattggtagtgctgttccagcaaggatatataatgatttgtatttatatttgagaagcagttcagttgaatatcccttttgtatgtatgatttcgcttgaacaaaatcttaatgcctctcattctacttcacttgacatactaacattttttaacctactgcattgtttgatattctacttggatggttagtgtatgagtgtattttttaatccaaattcataaataaagattgcatcttctatgggaaatattcttgcaaatagtacaaatatctaaaaagagtaataatttaaattttgcatcacacacttagtgacaaatttctgtttaatatgaactctttttcacttgaaaatattgttcatttcagatagcaagtggagcattattgaaaagatggtgcggacataaaaatgctataagttgtttagccttctctcaagatagttcgtttctcatctctggatctatagaagggatggtttatacttggtcaatggtcaggtactctctacaagctagaagtcggtgaagcattttttttaggaaaaaaatacaaattactccctgaaatatcgtggtcgactgaattaccccctgaactcgaaaaccagatatcgctcaccttgaacttttaataccggacaaaacaccccctccccccgagcactgttgcaagcggtttaggattcaaatagcacacgtggcagtccagacatcagttttttttaaaaaaaaattgctagggcccactcgttggaatccccgcccacatctctcttctccatccccttctgaagtgggtggtggctagggagagggcgtgacgcggcgctcttctccctcctcttctgtagcgcgtggcatggggggagatgggcgacacaacatggcgacgcgaccggcagcggcaagtaggcggaagcgaaggcggcgcgtgccggcagcggcaagtaggcggaggcgagggcggtgcggaggacgcagtggcggtcagagtactgctaaaatctctcctttctctttcttccctctggtgcggcggtgagattgggtagggcgcgtcgcgacggggctagaggggtagagccgccaacgagggcgtcgggaaggagaggtgattggagcggaggcggcgatgacagagcggtggagcacgcggtggaggaggagcaaccgggcgctgggacgacggggatgggctgcaaactcgtcgccatagcctgccgtctccaatgtcctcgtcggcgcccaccgcccgcctcgccctccccaccgcacgtgtcgcgccttccccgatgaggactttgtcagggttatggatatcacatacccaatagtaatcgactaagctcggcagggcccaccacataccatgttttatatggaatcatacctcgtatatagaaggagttccggataaggaaggacaaaaagagttctatatgtaaactacaaggactactcggatcgtatctatgtttatctccctagttctacttggacaagggggcatctatgggtataaatacaagcccccctaggaggagaggagacagaagccaaacgccacaaaaccacaagaccaacatatacacacgctaacacacgccgccagatctcgacatcagagattagccagacataccccatccggtgcctacggaggccggtaagagggatctagcatcatctctgatctcaacgggttcatattcgaggaggaagactgccctgttgtcgactacgagttggttatctagccgccaagttgacgacaactagataggttatcccaaatattgtacttgtgtgattcagatgaataagagcaacactggcttcggtcaacaggatgtagggctattacctatcagatgaggggcccgaacctgtataaaaatccatgtctccatctcttttacctcaatctcgcatatacctggtaccaacgatccccataccatccaaataccctagtcgcgatcttaaacatcgacagactcatcgctcgccgcctgcctgagttgagagagagagagagaggcctcaccgccgtctccagggaagggagcagcaacagcgctggcgcttttgcctcagcgccggccaatgacgtcgacggcgatggcgacgatgaaccactcgtctactcttctccctactgctcacccgcgaccctgagctgcctcacccgtgaccccgagttgccttagcctcgccaccgaccgcgctgccctcgcctctatggtcgtcagcctttgcagccgccccgccgcgtcacccctctcccccgccatggctgccttctcgcgtaagtccggcgcgagccactactcccctaaccacaggaggacgaggcctggtgagcctgatgggccggccaccgccggcacgccacatcctcggcctctgcctcgaggagactcgcaaccgctggcgcgccgctagtcctcgatcacgctaccttcgtttccgcggtcgccggcctttgcagccaaccaactgcgtcgggccagccaccgtcggcgcatgcgctgctcgttctcagcggcgagtgagcgacatcagagagagatagagaggtgagaggggatagagaggagagagactatgatatgtgagccccaccattttttaaaggcaaattttgctacaggacactgcttatgtgtggttttaaccctaggacactgcccaaactcacttttgggggaaaacactctataaacatagtaatttgccagtggacaccgccccaattaaaataataatatctggtagaagaggagagaaaagtcacatgaaatatcaaaaatacccttcggcccacatgtcagcactcatatctctcttcttttaatctctccctatcttcctccttccagcgtcactctgataggcgagccggcgtgcagaggaccggcataggcgcgacgaccttgcgggtggcacggcgaggcgaggcggcgagcgccagtggggtgcggcggctgtgcgggcggcgcggtgaggtgtagtggtgcggcagcggcggtggctcgcggtgacaccttgcggggtgctccggcggcgaggtgcagtggcgcggcggccatgcggaccgtgaacgtctccgcaccgtagcgctcgcctggaccacgaacttctccgcgcgctagcaggggcacttgcgcgcctccacgacaacgtccgccgccgtgctcgcacggcacaccgtctgcacggtcgccgcgccactacacctcgccgccggacgcaccttgcatggtgtcgccacgagccgctgccactgccgcaccgcccgcacagccgccgcaccccgctggcgctcgccacctcgcctcgccgtgccacccgcaaggccgtcgcacccgtgccggtcctccgcacgccggcttgcctctcagagtgacgctggaaggaggaagatagggagaaattaaaagaagagagatatgagtgctgacatgtgggccgaagggtatttttgacattgacatttcatgtgatttctctctcctcttcaactggatattattattttaatcggcgcggtgtccactagcaaattaccatgtttatggagtgtttttccccaaatgtgagtttgagcagtgtcctagggctaaaaccacacataagtagtattctgtagcaaaatttgccttttttaaataaaaagttgctgactggactgccacgttggactgaaaccactctgatattgagtaggggggtgttttgtccggtattgaaagtttagggtgagcgatatctggttttcgagttcggggggggggggtaattcggtcgaccgtgatagttcagggggtaatttgtacttttttccttttttttaaggcccaacttttcctgttgggtttactagtattacacgcaggcttgccattcaagcataggaacaaagcaccactacattattcagcactaccagaaccaactagcaagaataggtagctaaagaactacttatgacaaagagaaaaatgtcccaaatagcttgcaaactatataagcgcaacagtctcatcaggcttgtagactatttgagacaatccttggattgcaattagagttgtttatttttttattggaaatagcgagggaggccctcacggcatctttttcttttattcaagcatgaaatttgctcccttggaaagtcgaatgaaggacctagaggtgctacttgagcactgtaaccactaggctacaacccctttagcaagttgtctcatattcagttgatccagcaaggtgtcaatgtcttcttgctcttcccactccattagtcactatcactacacaaactattttttacagtttgatttggaaaggagtcttacaggcaagtattaaaacatatagatcatttttaatgaatcgcattaaatgtcaatgcaatcacattagtccaataggatgatttcacctataagctacctctgatagaaccaacttgtttgtggactcattcaagcataagataaaacccatcatatataagccgtaaagggatgttgggtaaatatatttttatcaatgtttcccaaccaccatgagacaaatgaccacatttcctagaactgagccgttgtctcactatctccaccattgaaatcatctatgcaacaattttccagaattcaatgatatgtatgtaggtagttgaaaataagctatttttacaattcatcatgtcaacaattgtcctctgttcttctcactccactccagagacaaagtctcactcttctaactatatattatcataccaaacatctcataaaagcagtacaataaatatttgagaaatgctccacttcagaaaaagaacagtgttaccagtatattattgttggtatgtaaggctatttgatatcagatgaggcaccaaaccctccaatgggaataatcaactaagcatttaagttaacacatgctttcaataacctatttttcgctctgcatatgaactttgcagtttatttcaagcagaggaacctcgacccattgaaggtacagagatatatcccaacttttataatgtaaagaaaaatgagcacaaggcgtcaataactggcattttaacaatgctaaggggtcaatgtcccattctaataacgagctcactcgatggcaattgcaaggtttaatgcacctcagatgaaatatgttgtttccttttgcagtgatcaatattgcaactttatcagcatcctatatgaaacttgaaatctagttcctgtactaaatgtcatgtacactttcataatttagcaatgaattatgactactgatactccatacattcaaaatatattattcagtaaaatggttctatatgcttagttctttttaaacaatataacttacatatatgtttgttgtctatacaatttactattctgatgtttgcttcaatattataactagatctcatatcaacacaaaactcgatgtggtcaatttcttgtgcttgtgttattcattgcttaaaatatattcaataatagtaccaagaccaaaatgcaacagaacacttactcgtaagatttagcacactttttgaatgtagatttgagcatgatttccattggcgctgatgacaactttgagaatatgttatttttctaggttacggatctattgtctgggttactacttcacaccatttcactctccagttcagttactacaatcgcagttgatcctttggaacaatttctactttgtggggctggtgatacttgtatatatgtcactgtgttgaatggaattgggacaaaaaaatccagtttaacatgttttgaggataattgtcaaattctttcaggacacaagtaagttatagttgaattaagagcattgattggtaaattttgcaaatgttactcaagacatatcaataattgacaataagatgcaatgtactattttaaatttagaacaaatattattatcaagaatataaaacaattatagggatttccaaaatgagaacacatttctttatcacaattaaaacttcaaggaaacggtgaacataacctctaaactttgggtaaaattccgtgtagcaccctaaacataacccccagactttggaataccattcatattatttcctaaagtgattttggatagtggctttgtgcatttggaagcttaaatgagcctgttacacatcatcagtcattggtcatcaatatataagatatagttatgccatactagtattatatcgacattcatttgtaagttcaagaaaaaagtgggtaagaatgaaagatttaggtggagatattagcatatatgtccaatgtcatgcagtcatcgaacgtatatgcaaattacataaaaaccagtttgcaaaatgcactagtatttggtttatgtatgatattatatagttcggagggttgggtatttggtttaatagattagggtgccaaatggactttcaatcaaagtttcttttgggcggggtgtatttagacttttctaaacttatgtaatatgtatctatacgttagtttctattgtatccaatcttgagtattagtttctttctatgttagattatgattgttccgaagtattttttaacaaagttctataaagtcttgatatctaatctatacctaacattgataaaatatttgattttaagtgttgtgaatccataaaataattagcacaacataaaactaattggctgattccaacttgtcaacagcgctccaattactgcattagcattttgttctaaaggagtaaggttggtttctgcatcaaaggattgcactatccttgtttgggacacaagagcatggcaagttattaataaaatagaaaacaaaataggtaagtctacatgaagtccattttagttcacttttgttctttctgaaagggtcacttttgttctttctgaaagggtcacttttgttctttccgaaaggttcttattttaacattttttttgccttgtcatttcgtcactaggtgggcatataacaaatttgctagtctttccaaagcgagcgatctcaactgttcatcaagaaagaaatttccgtcccatcaagttccctaaattagagaagatatgcaaaccaacaaatgaaacaatggcatttttggtgccatctcaattctccaaagatgtcaattctagcatagtatctttcaatagttccaaccttctggctgagcaactcttggatttagaggtaagacttatatgtattattattatttctgaaaagaaaattatatattattatattaaaaattatgtaaagaaaactaattggaacactttctactatttactaggaaaagagaacccttgaagcagtagagatgattattggagtgaacattcaagaccgggtgaagaaccaaaccatggcaaaggaattgactaatatgaatatgctactgcagggacaagtatttgatgtgatggatgttggtgcagatgaggattaagtcattgatttgttgtttcatccagtatgtgcaatgaacataataaaatgattgaacatatatcacagtagaaagtgacataatccaagtatcagaaagtgcaatcttgaaaatcatatttatctgaaatgagaatgcctattttatttggtattgttgtcctgttaatttatctttgagataattcgttgtatgctgcctattattttattattctattacttatatacaacttctaagtttagctcgatatcatgtatgccaatatgtttggctcttcattccatgcatacctttttgttcctatatcattggttgttctagaatgaccatatcacccctcatttttttctccaatacgtaggagatctgtttatcatcatattaacaagaaaaaaagatgggctataaccctgagtacagaaccaaacacgcacataatgagttctaggaaccatacatgttgcaaaccaaaccacaacacaagaccacaaccacaaaccaaaccatgatgtgagactaaccacccggctcttgagtagtcaataatgatagcccctgaggccggcaaaaaccacagttgtgcttcctccttggcaagcaaaagagcatcggccaatttaggagcagtcccataaaaaacacaatggtttcgatgcatccaaagcgtccaagaaccaagaatgactatagaattcaggccatattgcaccctcaatgattatgctccaccacttattttgatcgtcattcaagggggaccaaagaatttaggacaaacctctacaggagggagtaccaaaactgtttcatgaagacacaatttgtgagaaagtgatcaatagtttcatcatcttggtcgcaatgagcgcaaaggtctggatgtggcagaccttgtcaggcaagacaatctggtgtctagcagtgattatgcacgacaagtcacatgaaaaaagtgacactttccagatgcccatgttttccaaatacgttcccatggcctgaaaatttagtggcaccttggaaggaggaatcataagcatccttagctgaatattgtcttaaattcatagtgcaaaaaactggactggtgagtgacctggatgaccccttggtgcacctgtccgacggtctgaccggtggactgccggttgaaccgtggttcaatagcaaatatatacggtgtgtatttgctctaaaatacaagggaacaagggtaggatggctagagccaagcgctctcaatgcacaaacccagtttcgagtccctataccacaagccttcctatgatttttgtaaaaaaaaacagccgcgtgggcctgaaggcaatggactgggccttaatttggcccatttatctccttttacccggttgtaccaaagtggtttagtgcccggtatagtctaaacctagtccgttcagttgttttttatccgggtcgaatgcatgtccggtctttaagctcaaccgaaccatggagatctaaacccggtcggttcagtcgtttctattcgggttgaatgcatgtccggtctttaggctcaaccgaaaattggagacctttggttctagttttttcctgttgaaccaccagcccggtccgtttttttccactatgcctaaagttgagaatctccatctatgaatatccttcatgccgagctataaaacaatcttagaaagcatatctcatagattgagaaaatccgctaggactccaccagaaatagcaccttgaatgtcctggatccaaccatgatctatcattattgcccctcactagaaacccaaagaaagaagacaccctacctagatcaaaaccacacctagtaactattttctaattttgaaaaaaagaatcaagaggatgaaattgccaaaaatacataaattttgtaattttggtattttctcactggattttaaatttaaaatcattttcttgtcccattaaccgctttggcattgacccaatgaattacaaacagatttgaagggaagcaccgaagcaatagtaatttgtaaaatgatttattatcaacaataaaaataaaagtgcccaaccaaaatagctagaagttaattttcttgactaaaaaaggggtcaaaacaggccttttcatacttattagatagatcaggcatctaagggaaaaaaaccagaactcagaggtatatagagaattgagcaaaactcgcaggtctagaagggattagtaaaaaactgcaatacgtaaaagtaatttctctttgccttttgtgatgtatttggtcttgcttatgatcttcacccaatttttatatacgagcataggcttgagaaaactatgccttaataacattttaaaagaataacatgtcgattagatgtaatttattctgcaaacaaataatgaagggataaataacatggatcatgttttacaataatataaaatatcacaaacaaagatgtgtagactccagttggcgaggctttggctactccaaattaatcttgacgattattatgaaaataataaatggtgtatataattatggaaataataaatgatgtgtactcaccaattttggagtagcaatgaaaattgtgaagagcttcaactcaatgggtgggaaagataacttggatggagtcccgtagagtttcttaaagggaagttctatgcaagttataatcgtattgtaacttgaattatcaactccaatgccacataataatatatcatcaattagttattgaaaacgcatgagaattgtgcttcatttcatgaagaagaaaagaaatatttacaagagagagaaccaaagtatccctcaagcgacaccaaaaaagaaaagggcgtcacaacatgacacaccactaaaacaacctctaaggccccgttcgttctctccgattagagggacatttccggtgcacatgaaatgagaaaactcattagcacataattaattaagtattaattattataaaattaaaaaatggatttattcgatttttttaaataacttttacgtagaaactttttgccaaaaacacaacatttaacagtttgaaaaacgtgctaacggaaaacgaggaagtcaaagtttgaagttgagaaaaagaactaggcctaagaggaattagccatcaagaggtagcgacctacaaaaagctcgtggagctttggccccagcaatactccaaagggtactttcctgcttgaacaaccaccaaaatattaggtgtaccccattaaaaacacggtcgttatgacccttccaaatttcccaagccactaggataaacaaggaattcaagcccttcttttccttcttagggactttttgaatggccttaaaccactagttagagaaacgagttgaagaggactgaggtgctgcagctgccattccaatcttctcaaggatcaaaaaccaaagttgtcgggagaaaacacatttgacgaagagatgttaaatggtttcttcttcctgatcacaaagtgtgcatgcctcccggtgttgcaacccgaacttggcaaggcggtcggaagttcaacctcggttatttactgccaaccaagtgaagaatttgcatggtaggggcccaacttttccatattctgctccaaggtgcaaatctgatggatcccacaaagtatcataagcatatttacttgtgtaagatcccgacccagagattttctaaacatactgctccaacacattgcaaaattaacccatccaccaagtcacataattgtaaatattcataaatgaccagcatagtgaggcttcctagtatatcatctacccatcttctatttataagagcttgcactattgttctctgctttcttttatctttttagggatcataagaaagaggttaggagcccattctacaatttttttccctttcagccagcagtcagtccaaaacttggtctcctcccattaccatctgtagtaaccaccacaacgttgaaaagtgcgtgaacactttgcggcacttgaatgggcagcccagcccatggccttgtgggatcggtcttttggagccatagccatcacattcttagagcccatcctagtttctcttagttatgaagtccaagaccaccatattggagtagtcggtaaacatgatcccaaagactaggcagctaccatcactagcagtctagcattttcctgtcctttccaaaggaaacaccttcgccttttactctttatcaatagctttgatcacccattttggaagatccattaccatcatgagataaatatgaaccgccgtgaggaccaccttgaccataatcagcctactagctatattcatgagggaggcttcccaccccgggagattatcagccactttatcaaccaaagtcaacccggggtttatcatcgattagttattgtaagtaatatcttgatggtgctgtcagtctgaacatagcccaattaagcttacatgattgtgtacattgttagaacaacaaatttcattgcagttggggcttagttggatgtggatgtataaatgttgaatgtaatttctgatttgaatgaaacaatacattttgttcaggaccatggatcctcaatatattgacagataaattgctgccatgtacatgtttaagtactaatagacaaatccattcaaattgcttgctgtgtatgttaactcatgctgtgagaggtcagtccaaatgtaacgtaggaaggaagaattaagtgcccaatatgggaggagattttgggggcctaaggtggccagcaatagacaaatgtgtggattgggctgacccagattgtggatgatgtttttgatagtgtccttatccagataatgtttctagtagtgtcctggcttggacgctatccactctagcatccttcttattttactaaatttctgccttcaattacttgttatttaattaaggatctgttgattattgcaaataaaagaaaccgatttatctagtgttgggagttttttttccattgttctttcaaacagattccactgaacagatataccttgctaggatgaaaatggtcatgaaaattcccaaccgaccgagcgtcatttccatataagtcatactatttctgattgtttccctttttagaaatatataaatgttgaatttttgttctcatttctttcagcgttgtattgatgttgacacggaacagttaaattgataaatatggtgaattactaactgaccgaacatcatttctgaaaagatgctaacgattttgaccttttcggaatattttcatcccatccatgaatagttgacaaaatttgcttcagtgctagtgctggataaagtgatgtgttcagcaattgttttcctgggcaacattcttggatctccttgatagagttccaaattagcagatgtgtgtctctgttccaaaatttttcttccactgctgatcgcttgcttcatctctgctcccccccccccccgcccctccctccgttaaatcccctgttgttgtatacacttgtaccttcttttggttattattttttttctggttatctgattattatacccatctagtggctgatctctagggtttatgctattgcaaagtttccttttgcaagtggcagattagtatattcaagtatgcatatgtataaattgttaatacttgctgccttgatctgctagctagttgttggttgctagttgttgttggaaccaaatccaatagctatgggagtgtacaagttgtgtgaactactagaagagtgagacttatgagattgatgagaatcctgccttcactaaggcgacatcgcacatttatatgcttagcatatgtacatgggaaattacatcattgatcatgtaggcctcctacaagtaggcccgggaacttcctactaacaagtgggctccacctaggagcacacccgtaactacaccagacaccgtcgtgggtggcccaagatgttgcatgggccgacatggatcctgtggatcctaggatctgatgtgtcatgatgggcccaagtcgcaaggatctcgattgcctcccgctgcacgacttgttggagcaaagcggctagtaggtgggcattaactgcctcctgccttgtctcgtctttaatggctcatgagctgaagcctcggagtagtcttgatcatgccccccaactggagcacggggttatgcgcgccagtggaaactggctagaggcctccgcttcttcgaaatggaggggtggggccccatctagcgcaaaagggagggatctttcctatggagacaggctccagaaatccttcagagtgacactggagcccatccctcaactgttgctcatcaatttgtatattttatcaaagtgcaatcttttatgcagcaaccacgataacaactattgctgctgcccctgaggctgggtatgatcctataactgatccaaaacggaggccaccatgcaaaggatccagcttggaagtgcggctatttgatagtaattagaaacacaaacttagtgacatgtaatctttgtggggaggtgacaaatggaggggctacaaggctgaagcagcatctagcaggtggctatggagatgttttagtttgtatcaaaattgataaagaactcatgaaacaaatgcaaaatcggttgcacaagaacaaaaaaaaaacggacaatattcttgggagatgaagaaagggggaaatgtggaggttctgctagatcaaaatgtaacaacatccttttctatgccagttgtaccttctagtgggataacagcaaaaagaagaagagcaacctacgatttcagagctccaatagtaaaaaaaaaaagccaagccaaaggagaccaagacaattattgctacggttagaaaaacagttgaaaagattgtagatggacgcgctttgattggttccaaagcaccatggagagtacaaagagaaaggaagataagcattatgtggatatgcaaggggtattgtggttctatgagtatggcataccattcaatgttgcaacctcaaggcagtttgagattgcttgtgaggccaccgcataatatggttcgggttacaagcctatgagtaagcacatgttaagggagaccttgatttaggactatgtccaagacacaagtaaaataaaggtaaaataaaggttgatcatgagctacagagctagcatggaagtagtatggctccacctttatgtcagatcgatggatagataggaggggcgccacctaattaacttgcatgctgtgggcttacttcttggagtcttttgatgcatcaagtgaaacactgtagacccccgattttggaaatcggaaatcttctgtgtttatccgtaccaatccctggatcagtagttggtacacacattcatagttggatcacaacatatcacgaatgaattcaggctaagagagttaatacttacattagggccaggtaggctaacaactatcagagagcaacagcggaagacaaaataatataagggcccggttaacatgccacaggcagtcgactggggaacgagacctagaacaagaccgcactccgatcatcttgttggatacgcaagcgtactaacaagggcttctcttcagcgctctcctaaaagatatataaatagcaagggtgagtaccaaccgtactcagcaaaccaccacaacagcaatgcatatgataaagggtattcaaggaatggcttcaggttcttttgcgtaaagctgcgttttgcaaatatttttacaagcctaagacctagcatagactgatcaaattttagttccagtgttcacattaaacaacgacggttctgtccaccatccattgtgatcccaatgatagcttcccgccattgaatcctcatggttttctgaggacgtccaccttccctcctctcaggaagtggctccaacagcataaaaatcatcatgcaatatcccatcccacacaagttaagaatttagagtctagccaagtgtaatacacgtcccggtgctcaataaccgcgagcacggctattcgaatagatttggtttactcacactgcagtggatgtacactttacccgcactctgcgactgcccaacacatgagcctcatcccaacacatgagacgcgtcacgacaaagcttttcgataacctcgcattggcagtatccgctccatgaactttacatcctcatgcactctaggcatacacggtttctagcagtgagaggagttctagcgcacccgggaagggaagactcacacatgcattaagttataattatgtttagattctcacatggcagtcctaccgatggcgacaccactgtagacacccgcctcgtggtcctaccaatggctgccccaccgtagagcccctgcctcacacatcaagaaaccactatgcatggatactgcctccgctcagctatctactccgctaggtctatacccatacgagaagtgcggttgtacggggttcgtttcatgcttaacttcatgactcggtccttaattgaccggggacggtactagccttttccagataccacccaaatcctccgtccgccccagtcaaaaacagttgtttagtttcatttctcctttcacaaatcatgtcatcaatatcatggcaatgtggtgctcatgtctccacatgccgtatctcaattatcttcccaaaggtaattgcccaagcatatagcatttgataaatatgagtatgcatgattctagaatagcatttctaagcaattgtcataattgactagggacttatacgtaatcatggttacaaggatcttaagggtaaacaataatcaaggcatggcataatcacaagtaggatgttcatcattgcatgcaattttatttgtaaacaaaacaatttcgcaattgggatcaacatgttcaaggaatagtgatgacttgcctgctcagaatagtccttattcttgatacaatcttgatcaaccttcacctcctggaagttgcagacgttgcctcacgactgaccgatacacaatttctataatacgcgagaaaaaccaatattcaagcaacaatcaaatatgcacaaacaaaatatatttgttgaggtcgaacctagggttgctcatattattcgcgcttgctaatggattctaatcaaggtaagagctaaagtttcttagtctttctgttgtcatggtggtttagtctagctaatggctatggaaggattatggttacacatgcatctatctaaataaaatggtcatatcctagagattatgttgtcagatggatttaggatcaatcaaataattacagtgaatcatttgtattattattttattgatggaagctttactttgattatcaacatattttacttgtcacaataaattagaaaaggttaataattatccgtgctttgtatgttagagttgtttaggttaatcatattatggttacaaattatcccatcacataattttacaatgaataatcctaatttacaattgaactataattatatgagatcaagatttataactagtatttatctaatattcctgtttatcatatagtccctctaatttaatatatgcaacaagcaaattaatactataccgtatagctataatgggatgtacagtataggtgtgtgcacaatatcttaatattgaatcatttatttgaatagttgctatttactacgagctacacagtacatgtgattttaagtggatttatgagtgagttaccgtctatacaacttaagggtcgatttccaacctaaacatatactactgtacaggaaatgccgttaattaatttcgtgcgggtgattttagtcacactagctctgttattatctctcataaacaagttaaagactcatctacgtgtgttcaacttttagtcacaaagtatgaggctaaacattatttatacaattcggacgtcatgagtataattatatattgacatatattaataattgacactagtatttcctatgctttaattaatttgaaacaatgctgctaattagtttacataggttttacagtgagaaagcatgttaaggacaattatttgacatctactttatagtacaatatcaattttatttattagcacatttttaagttgactattatgcatcatcgtggtattaattatttaataattataaatatattttattaaatagtgaactatataccattggaaagcttatgaatttagatgaatttaggttcaagattcactcaaatcggagctaaaatgaataagttatgctagtgtaaagattcaaatttgaattaacccgagaaattgtaaaaagctactgttcataaatgatttatttttaatccgaaatctaatccataaccctagtgaccgacaggtgggacccagggttccttttctttcctttttctctctttttccttctctctcttttctttcttttcttttcctttctttttccttctctctctcttttctttcttttcttttcctttctttttcctttctttttcctttctccccctggcttctttcttcctccctctctctctcggctcacggcctacctgggcggcgacggcgaccggacgcgagggggggcggcttaccgacggcggcggcggcggcgcaaggcggcgacgctcagcgcggcactcggcgcagtgcggcggcttcaaggcaacggcgcggcggaacgaaggcggcggcgcggcggcacaaaggcgacggcgtgtggaggaggaaggggaaacggaggggaatgggtgtgggtggagaaggggagggggccggggttttatagagcgcgggggaggggttggatgaccctaacggcgacgcgacgggcggcgcgtggggctcgaggcgcgacggcgatggcgcgcggcgtgacagcagtgacgagacgcgacggcgacggcacgcggcgcggcagcggcgacgcgacgggacggcacgcggcgcggcagcgggagtggcgacgcggcgcggcatcggcggcacggggctcgaagcggcgaggggacgggcgcgcggcaacgggacgggcgacgcgacggcgagacggggctcgaggcgacggcggcatgcgcggcgcggcagcgggatggcgacggcgacggcgcggcagcggcggcgcgcagctcagagcggcgacgcgacgggcgggcggcgcggcgcggggctcggcgcgatggtgacaggcgacgcgacggcgacgtggcgcggcagcggcgcgggcgcgaggtggcgatgggacggcgcgtggcgatgggatgcgacggcgacggcgcgcggcgatgggacgcgatggcgacggtggcgcggcacgacagcggcgacggcgacggcgacgcggggcgcaaggcagcggcgcggcagggctaggcgcggcgcggcagggcaggggcagggctaggcgcggcagtggggaggaagagggctaaggtggctaggaactccatcaaacacctcatgtgcaatgaatagtgctatccctaattaaaccctattttagcctatctcctatacaattttaatcctacaaactctaattttacttagttaaatgttaactaaatttaagtactaaatcctcatgaaaatttatccaaattattaccacccatatttatttatttatcgcacaaatgaattctttttagattaatttgggttattgaccctaaggtgaacttatatatttttgaagactttggggtaatattgaatttaatataacgacttgtcatgattaatacattagcagattggtcgagtttagttgtatagcaatatattttgcacggatgggttcaatctatttattctataaatagtaaattgagactcggcacaatattaatctaattgtttaattaaaaactcacataattttataaagcttaatttaattatatgaccattattttatatgagtgactttatcaagtgttcaaatattaatgtatatatattcccatgaaattctcatttgttaataggatcattatagtagtaatcatcatttcatgtggatttataatacttcatgtgagattggatccaaatacattagatttaatcttacaatcccattagttaaacatgacatcgagctatcaacatggttcgaatatttaatatttgatctatgatttataatagaaattaatattttatttggcttgctttcttgcgcactaatgtatatatttattgttcaggtgtacgccattaatttgattctccattgttacaatttatatttggcaagcaatgacaaccataacacccagcatgatgcaaaagtttttaaaaagttcgaaattttagtgatttttattattaggaattttcagaatgttacaaacacataatgcaactatgttagctaatttgctagagaagagaattgagatcattggaaaggagaaggttgttcaagttgtcactgataatggtgctaatacatgcaacagataagcttctaatggagagaattctcacattgtataggactccttgtgctgcacattgtttggatcttatgttgaaggacatagggaaactgaaggaatttaaaaaccccattgcccgtgctaagcgtgtcaccactttcatttatagacatgggaggcttcttagtgcaatgagggagaagacaagtggaaagaatcttttaagaccagctgtcactcgatttgccacaacttatcttactttgaagagcaattatagccaaagagatgaattgagaagcctatttgtgagtgaacaatggactgggatcaaattagcaaaaacaaaggcaataatataagtgactggcattgttctctctaagaaattttggtcctctattgaagattgtatcagagcttcaaccccattacttattgtgctaagagttgttgatggcgatgagaagcccgctatgctagaggtttcaagactaatgacgcatgccaaagagaagatccaattgagcttttttatccagttgtgagctcaattggagaacatttggatttgcgagtcagtttatctgtagttttgctttaaatttctttactatatcagcaagttatttatccttttttttcttcccttgttatttgcatccctgcagatccatacaaagaaaatgaaccagttagtacacaagagattgaatgatgttgtttttgttgcctataactggaagatggaaactaggtttcagcttaggcgtgagaaagcaggaaaaggccagatccttaagtcattgaggagtttgattggaacaatgagtgggataattccttacatgaaccagttgaaggttttcgtggatgtgacattacataggatgatgttgatgaagttgttggtgcatcacgatctctttgagctcgctgttggtatttgatacggtcacagataaatccgcaagcgcacgaataccgctgtagcacttcacctcagagtattccaagggtatcgaatcacagaaaacatgtgcatatatctaggaacataattctatccaaggacaacaactaatggtaggctaaggctaaagaggattcctatggattaatttactagacttgagttaaaggtaaaaccctatcgattgcttctggcactagccctccgctggtctgccaagctgaatccagcctacggctctatgatgtacctgaacatggagggatacaaaggatggacaaggctatcaccaccttccgcctacctcactttctatggagcacacaacaaaaaaaggtaaccgctaacctaaacaccacacctaagttattgattactactctagccccacgcaggaacttccttctttatctagaatcctagtactagagcacttaataattcaactaagcgacgaacccgcaacgatgggaatatatgtcattcaagcaactaaattaaataccataaggagatctcaaatacttacttaagaagcatccgttaagatacaaacgagagaagaaggccgataactccatcacttctccgaaactccagtggaagaagaactccgatatttggggcactccttccggagctttacctcactctttacctaattccacacactaaagagatgcctaaaatatgaaagtgagttgtactccacttgagatgtgtgtttcggaagtgagttgaactcctccttttatagccttcatatgacgcttgaaatggcggt

SEQ ID NO: 70425 - DNA, 2311 bp, Oryza sativa
cagccacacccaaccgcgaaggaagggggaaaagagggaaaaccgacccgtgcgaaggtgaaggcccacgcggctttgtatggccgcgcgcccacgcgcgccttatcggcccacggatagggcgcccagggccgtggcctccgccacgtcgcctggtatttcctgggccggcccgaccgcgacagcccaagcaacactccacaaggaatgttccagaatctctcttatgctttgtttagttcctggtccaaaatattttttaaagtatacggacacatattaaatcgaacgtagattaataataaaataaattatagattttgtctgtaaactgcaaaacaaatttattaaatctaattaattcattattagcaaatatttactgtagcaccacattgtcaaatcatgatgtaattaggctcaaaagattcttctcgtgatttacatgtaaactgtataattggtttttttccgatcacatttaatgcttatgtatgtgtctaaatatttgatacgacgaaaaaattaaaagttttttaaaaaaatgaatctaaacgcggccttagcttccctcctccgctccactgactgtaaattggaaggttttttaaaaaaatgaatctaaacacgggcttagcttccctcctccgctccactgactgtaggcccatgtaactgggggccacacttcgtgacgtgacgtaacgtgaccactcactctccgtggggaccagcgaggccctcgcagagttgcacacgtacgggtagaggagaaaatgcgcgtatcacatgacactgacaagtggagtctagtgtaatacttcctctatattttaatatatgacgctgttgatattttatccaacgtttgaccattcgtcttatataaaatatttatgtaattatcatttattttattgtgacttgattcgtcattaaatatttttaaaatatgatataaatattttcatatttacaaaaaaatttaaataaaacgaatggttaaacgttggttgaaaaatcaataatgttatatattaaaatatggagagagtacttaccccgacgtgtcagccaaaaatacctttcatcccgtttataaaaaatccgtagttataaaatccaaaaagcaaattaatatcactatctccacttcagtcgttttaatctttttagttctaatcaaatttataaaaaagtaatatttttacaaaaaatataaaaatattaatatccaatttaataaaataaattgatactataaatattacaataattttctataaatttagttaatattttaaaaaatagctttaataaggtcaaaactacttcagaacggagggggtattattgagaagctagaaaaaaaatacagtgttctaaaaaaaaaagaaaaacaaattcagcctttattttcatcggcttctcagactcggtctcgacttcagactagtctgtctgaacgaggtcgagtcggaggagttgcatcgctagcttaacccgaccgctttttaaatcgaaatcccgcagttaaatcagagatttatgcagacaaaagaaaaacacacacacagcaattactattctccaacccaacacgccccccgcaccttccgtcctcataaacgcgagtgggtttaaactcgagttgtttttttgttcgttaatcctcgccccctctttctctctaatctccgccaaggcgatggcggattcgaaggggagcggcggcgccgcaggagacaagcccggcgccgacgcgagccccgccacgaatccggccccgccagctgccgccgtggccgtcgccgctgcggccgcggacgccggaggggacgacgacgtggccgcggccgcggaggcgcggcggccgttcacggcgctcagccaggtcgacgccgacctcgccctggcccgcgtgctccaggagcaggtatatgtgggggagatctcgcggtcgggtgttgttgctagggttccgggacctctcgattgacaatttgacatggttgttgtttggatcggctgcaggagcgggcgtacatgatgcttcgcatgggcggaggcgtcggcgagggcagcgattacgggagctcggatgccgggagctacgagtacgacgacgaggccgaggaggactacgaggaggagctggagcaccacctccgcgtccaccaccacgagcacgccgttggggagggtcgtggcgagggagagcgagatggggatggggagggggctgagggaagcgagttcgaggaggaggggttcgacgaggagtatgatgaggaggaagtcgagccagagc

SEQ ID NO: 70426 - DNA, 47495 bp, Oryza sativa
gccgccccgatgccgccacaccgccgttaacgaacgagaacgagaacgatcgaacgaacgagagcgagaacgaacacgtcaacgtacgttgccgcgagaacgtgaacgagaacgagaactatcgaacgaacaagagcgagaacgagaacgatcgaacgaagacaagcgagaacgagggaacgaacgtgaatgagaacaagcgaacgaacgtgaatgagaacgagcgaacgaacgtgaacgagcaaacgaacgaggacgaacgttaacgtgaaatgcaatatatatatatatatatatatatatatatatatatatatatatatgttacttcgcatttatcctaatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattcgacctgtaattagacttatcatataagattgtgtagtgttcttatattatttgagttttaatataagattattttattgcaaattagacttagtatgacattattgactacggaattggtgcgactcctagcaattgactattgtagtcttaattagacttagcatatacgcacgaaacacttagcatacatgactattttagacttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacaaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtgcggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggcgatcagatacgagaggctgcgcgacgactaacagatgcagtggaagcctcctctcagggcacgttccgaccagacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccaaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccattccaacggacccttcaggtacttaccactgcaggccgattccagcaggatactcgaaggtcgaagttgagttggtcgaaggcgcgtacgaggaacttgagctggattaccctggaggagacggtgagacgcatctacgagacacatgccatgccattattctatggcgcaggcggtacatcatcctccctgggcgacaagcggcgtctcatgcaccatctcctccggctccgccatctcctccttaggatcctgcaccgtctcctcctcatgctccgccagcaccgtctccacctcaggctccagcatcgactcctcctcaggatcctgcaccgactcctcctcgtgctcctacacctactcccccgcaagcttctcttccgacaccttcaaagtcaagggcccccccagctccaccgcctacccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcagggatatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtaaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagactatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacatacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatattatgcatgtatatacatataatataatataatatatatatatatatacatatatatatgtatgcatatatatgtattgaaacatatatatgcatggtttatatatatatatataaaccatgcagcaacagggccatgcaaaaaaaaaggtcagatctatctttagtcccggttatttcatccgggactaaagatagcgatctttagtcccggattggtactcccagtttggaaaccgggactaaaggggggttacgaaccgggactacaaagggtttctccaccagtgatacctcctcactaccacttggtaagttggtacatgggtttatcaagacgatgtgaatgcacttggaagagagatttatgtatatacaaactgtcttggttcatatttatatgttttatgaaactagaaaaattgtatatacaatataataaagctagcccatctctttcagttgtttcattccgttattgtgctattttgttttttgacttaatattgtgccattttgttatgcgacttcctgccttatcgggttctaagtgaaaaactaaatgaagtcaaatttctctcataccttaatgcaactttatcgctctctattgttcgcatttattttactttggaaaaaatctgtacatcttataaaacataatccaaagagcaattgtacaatctttagtatcttttggtacctaggtactatgagatatcaaattttgagatttactccggtccagcaaaaagtatcttgaggtaccggtacctcaaggtatcaaatagttttcgatcgttggatctagctgggcaggatgagcattgttagatccaatgatagcaaatgatttggtaccgtgagataccggtacctcgagatactttttgttggaccgaagcaaatctcccaaattttacactaatttttttggacaattgcaaatttaccactactttaaatcgttattgtaaaactgccactagaaaattgcaaaaatgccgctagaactgtcattcgaatggcatccttgcaatattgaaaaaacaggtggcaaatttgcaaatgcccctttttttacctcatggtacctcctcaagaatcgtaagattgctcttttattataaatttggtacctcttgctacctagataccaaattttacattaaatttttagtacctcatctaggaccatacaattgctctaaccaaaacatcgaggtacctaaattttacactaaaaattttgataccctcgagataccaaattttatataaaaaatgtaatacctcttctaatactttctcaagaatggtaaagattaccttttaaacataggccatgacgagatatatactggccattattgtagaagtccagacatgcatgcaactccatgctattggactaacatgaaaggtgaatggagggtacgacaacctctgccttcaccaggcaaaagcagagggtatccttctagttctagactagatacagcacacgctgtggagccataccatgaatgtaccaatgcgcgcacaacctggatccaaaataattttctactactccctccattccaaaatataaacacttttagacttcgatacagtcttcgagatgctactttgatgatatctataaaagtaaaatgctttaaataaaagagttgcatattgtgatagtttgtttaatgataaatctagtaacatcaattttacatgtttgatcttttctattttttttgctattattagtcaaagctacaaatatttaacttcattgacactatgctaaaagtgtttatattttaggacgaagggagtaactcgtaggtgatttcaactgtatcaggattcgtagacacattaccacatcagaacacagtccaaattatttgctctctgcaaagctttaggctttacctgccatagatagtcaagctcgatcatttagtgatttttatcatagttgagaaagtatcgagagataccatattttctatcgtatataaaacttggtaactttaggaactactcttaggggcatgtactattattgtggttgggaatttgagatccttggctgagaattggagctacgtagtagcagtgctcaactacatctacattatattgctctgtgtactttcatgagtttcatgttgaagcaatgagcaaatgcatgtgttctctcgtcagcactcagctaagctaggtggggcatcttctagatttgtaacgactcccttcctcatcgcttggccggcaatgtgttgaccagggcaatgtagtgattgcatccgttttgagcaaatgtctggtcctacagcttgcgaagcacatgatctcgtgagaacgctagaacgcttaaaccatcagacttcccgacacctgctactcctgaacgtggtgaggtggtcaaataggtggcctaaaccataaggtctcgtatatcaaaaatgctagtggtcggacgtccgatgcagcaaagaaaaatcggacgtgatatgcacacggcttacatgcatgtctagctgttgtcttatcttttctctcaggttactacatggctgttcattctctctctctcttacttttttccttagtacatcactctaacatataagtatatgcatgtatgtaaaaaaaaaagctatgcatgtattagttacttcaaactatttttctccaaaaataattattaaatttacattccgattacactattatatccgttgcaattaaatctttacaacaaaattttagttaattatattttgataaaaaaaaataagtagaataaaacactgttaaatcctaattgaaacatttttattccatataagaaacattgagttataagtgttgcaacactacacctatttattgaaacactcaaacaacaccagtgcaatatttacattgaactagtgaaacattagaaaatacttattgaaacatataaataatatcatgtgcaatatttataaatatctactgcaacatagtcaaattctaattgaaacatttatttctcacacgtgaaacatccaagttcaacggttaaaacatttgcattttttttcatcagaatataatgatgtgatatattgttataaagatttaattccaatgaatacaatggtgcaatcggattgtaaatcagataaatggttttcgagaaaaaatgttttgaagcttgccactaccattatacctctctcatttgatactatgcatgtgcggtcaactttttgttgctgttgctcttctctatatgtataggtaatagttttttaatcagatggacataaaaaggatgaatgtgtatccaacagtagaagaggcgtccaatgaaaacaattgtattggacgttcgatccgtagtctctcctccatatatatacacacacgtgttggaatcccacgagcagctacctgctagcagagcatgcaccatttggcgtgatgtatatatctccttgcctgattggcctcctcgcatatatggaagcagatcctcctacgtgaagtttcccctgacatggttactgacaggtgggtccacgagtggtggggccacatggcagtcaccatgttcatctgactgcagcacaatgatctcgccgatttgatccggctgcaattagtcatcagagctaacagtcaaaactctgcgttcaattttcttcgggaaaaaataactcagcctttaattttggaagagtacagatgaaagtactgcttaccaaccggggctgactctttttaacaaggcattaccccgttttagttagatgtatgtcaatttaaaattgtgcagattaaggatttgctaaaatggtatatataactggcttgcaattgttacccgttgaaaatgattgctaaatgagacatgagtatattgaaaaaaaggtatcaagtatttgagtatactgtagaacttacatttagacggggaaaaaaagagaagtatgaaacaactgctatcccacaaatcgcctctggacttcggactgattacaagtaggaggatgaccaaataaatatttctgccaattatactgtgcatgagaaactttgacacaacaaatttgcaaggtttactattttcgaatacataattataccagggttcactgaaattatgagattttcaacaaaaaaaaaaggaacctttgaacaatatttttcaaaatttggacaaattttgctaaatctaaaccaacttccgttaaataaaaagaaaagttttaggtggtagaacatcctaccgggaccccctgaagtttcttatatttcgtcccgaaattgttagccctgtaaatttggacagtcgtcagatcgtgaccgcgaggtgcggcaacagcagatggatgaatggcagtgacgttggtggagcacacaaacaaaatcttcaaggtcggcaacatcatcatgcgcaaattaagatccttgtttaaactagtaatttgggaaatttgaaatgaaagaaacagcctggtcgtcagagatgtggaggaggcggcacaacgcatctcatcggcaaacatactcgacgatcagctgataatctagagcatggcaggcgattgttgtgccggggagataggcggttctttgcttggtctaagcaggggcatgtccatctcccatgtgttgaggagttgaggctaaggcattctttgttctgttttattttttctctttctatttaaacaatctacagttacatgtaatctgacagagtaactagctacaaactaccattttttatgtcaagaaaagctatgcacgttgcatttttttcgtgttttataatttctttaatcagaaaagttattatcgttcatccgatgaacacacttcctctctacaagggaaaaaaaaagataaacacaaatgtaatactactgcctacacttagactgcgttcgttcgggtaacattgagggagataacagctcgttttccacgcgcacgctttccaaactactaaacggtgtgttttttgtaaaaatttcctatagaaaagttgctttaaaaaatcatattaatccatttttaaaatttaaaataattaatactcaattaatcatgagctaatggctcacctcgttttacgtatcttcccaatctcctcgatcaccttctccttaaattcacccttattgtggcaaatagtttggccaaatgtagccacgactcatgtgtcaatatacgtacatggaaatttaagagacaacttttatttcaacatctccccctaaaaaaaagaatatgtgcgatccaaatacttggcatgacatgacattatgcaggcaatctatataggctataccagtaatattaagactgtgtgtttatttcacagaagagggaaactcggggagacaactttagaggataacacaacatggtggacgaaacagcgggcaattgatgcacgcccatctctgttggctttccagccaaaaagatctcgtatggcgcctgctttctgctctgtgtactgcatagcacccatgatagcgtactggatgaacacatccaggagtaatctgggagataggccacagctggatttccggtgccttccactcctatgtagtcaaattgtatatggaacaggtacatcctccattcaaaatgaatccatttctaagaatatatttggataatcgtttgtccgaatttcctatcagatgttggggtttttctatgattggaaggaggatatatatgagtatgttggttagtccttgttgctgcagactgtttactctttagctagctagctgctttggaacatttttctttttctgacgtttttatatagggttgcagcgtaaacatgttacacacaactgtctcgttagatttgcttgtcaactgaacacaaatgagattagcatatattcagcagttatctcccttgactaatttatattgacaaacatcaaaggggaaaaaataaatccttctacgtacattattatcttcacattatttcagtaagctgactttctccataagatacagctaattaacggtaggctaatacgcgcgcagcgcttgaaatagtagttcgagcgccacacctgatctcctattttcctcttttttttttcttcctcacccctttcgatttttccatgccacccacttctctatttttccgttcctactaacttcacgtctcatccctttcacttttcccttctttttccgttaccatccatctcattatctcaaggaataaattccattaccacccaccttttcatctcatatttcatatttagtaaatgagttactatgtattatgagcttcaaatccgtacactcagctatcttacaaataaacaaaaatggattaaacaaaatactggcttcaatagatagatcagtcttattaagcggagtaaataaaaattgctagcctaattttacgcatggcaagagatcagtcttataaacatatatagtaaataaattactaacactaaccgagagagacggatcttataaaagattggagagtaaataaattactaaaagaattatccatcgactccatcggtaaaagaattactcacccattggttgccagaccatagtagtaataatgtttgcagttgaaactttactcccatccagtaataataccgtagtaatacttttgctactggagtttcatatccggaatgacgatcaacatatttttaccacgtattgatacactaaatatcgatctatacatgtaaaagaattaccacgaataaaatatttacaacacgctcatttgacaaaaaaaaaagaagaaaaatgccagccgacgggtgaggatgtgaggacaacgaccacgatggctgcgaagtggcgatgattggacctcccgctatcccagcaagattgccacgaggattcagaaccaggaggtggtgacgaggagcgacgaagccggtgcacatctggagggagcacgaggagatcagagcacgtggactcgcagatacgtcgtcgatgacctcgactcgacctcccctttggtcgccctcatggtagaactgtccgcacggtccgccacctgctgcacgccgggatctgctctccctgtcgctggcgagaccgcgtcgtcgcgcgctctcgatgcagagctggagctcgtcgtcacccgcgccgccaccccggaggctggccaggattgcgccctcgacgagagagaggaagacgacatacgcgttgtcgccgccgccgccatcaactagcaggaacaactacataattacctatctaacactcgacctaatttgaaagtacatccaaagaaacggatgaagtacatccaacgaagacaaacgctaccagaaaagtgattttttttacgagacctcataaattttgcaaatggaccataactagtggcgtctgtaaaaatcgagggtcatttttcccatacggctgcttaagtggcccgtatgaaaaaatccaagccacttgagaagccatatgcgaaaataaaatttgaaaattttgaaaaattggaaactagtgtatctcactcatatgaactccaaattggatgattttctttctaaatgtttctaaaatcatgctctatcatattattgtgttcttattggtattattttggctattttttcttgtgactttattttatcaattaaaaatttgaattttaaaacttcaaataatattttgaagcaggaaatgattttatctaaaaaagtcatcaataacaaagttgtataactcatcaagatctataacttctattttggacatttcttcatccgacaaagtgatttgtaagattgttcacaaaatgtgatacagcatgatttgttattgatgactttgtaaatgatagagcatgatttgttattgatgactttgttattgataactttttcagatgaaatcatttagtatttgaaaatgttgtttgaagttgtcataatttgaaaatcatattcaaactgttcaaacaaagtcatatataaaaataactaatacaaaagttgtagatcttgataagttatacaacatttttttagacaatttttttcatttcaaatcatttactacccaaaaaattatttgaatttcttatattttaaaattcaaattttatatagtctaatcaaactcggatggcgaaatgaccaaaagaaaaatggtagatctcaatgagttgtacaactttgcttttgataactttttcgcatgagttcatttagcatcttaaaattcgactcaaagttcatttaataccaaattaatatttttaataattatttttgcatgcggtcctcttaaatagccacatgcaaaaatctattttcgcatgggacggttaggtggtccgcatgtaaaaatgcccgcatttttttagtcctcctctctctctttccctcctcaccatttcaaaatttttcaaccacccatttatttttctctttctttatctcctctctctccctctctctctctcctctcctctcctctctctttcttctcgccggcagcaggcatgggtgcaaggcgatggcgtcggcaggcggcgagggcagcggatctggcggcgccgtactcgggagggccggatccatcgctctagggaggagctcggcgctcgacggcgggcggcgtgcatggcgatggcctgcggcggcggatccggcggcgccgtcctcgggagggccagatccgccgccgtagggaggagctcggagctcagtggcgggcggcgggcacggcgacggacgacgccggcggatctgggagcggcggatccggcggcgccgtccacgggagggccggatccgctgccctacggtggagctcggtgctcggcggcggatctaggggcggcggtggcaacgacggtctcgagcggcgacggtctcggctggtggcggcggtggtctcgggcggctgccgacggcggcgacgggaatggaagcggcggctgcgacgagctctggcgggtggcggcgctaggtttttttttcgtttttttaatttttggaattttatttttttctctcgattttttctctttgcttaagcgtccgcatgcgaaaatccggattttcgcatgcaggtgccctggccgcatgcaaagatttgcattttcgcagacgatttggtccgtttgcaaaaatggtttttgtagtagtgaaagtctcaacattgataattacaaatttgttttctaatcagttcaaccgatttaaatatttcaactttcaaataacagagagatatatatctctttaaggattggagaaaatattgtgctcctaatttacataaaagggggcacaccattccacagagcactatctcgttaaaaaaaaacgaaccaaaacactcggcgcaacgagacacgagagccagtagagccaaggcagcatgcatgcaccaacatatttgtagatccgcaatgtcgcccactacatcgtgaactgctctgaatccgtggtaacacatgttctatgagcaccggaaaattcgagatacgcatccacaccaacacgcagtgaccaaagcagagtgaacgggatttctagtgccacccatgcctacatacgatagaattgggcatggaacatacgtcttggttcttatttgtatgagagaatgaggaggttatggattaactgaacttagagcaagcaaattttccttgtacatgaagggtctagattttgtgtgcgttccgctgctcggccttgtatgtgaaatatatactccctccgattttttttatggagtttcattcaattttaaactaaacgatcgacgtcatatattaaaggttttagtattagttggtttattaattctctccgtccatgcagctgtttggctactctccatcactccccagtgcgcatgcgcatactaattggcaccatttggcacaggtccatcaaatagagatgattaaaaactccagttagacaaggttacatgaaacgttttgatgcatatattcgtgatagttcagatctatacgtacggaaggtcttttttcccgtgttcgatcaccaccacataaaccatcagtgcaggttaattattaaaccgatattaaatatgtattcatatgagtatatttgcgcatattgtgaatgtttatgtttgtattgtgtttcttaataatgtattgctgcgagttattgtgtttactgatggtcaggtttttgtattttcttggggtcatattcttcataaaataattaaaattttaaagctgcatatacggatgtgatactcttctattccttcctgctcacggaaataatctcagcgcgcgggagaaagctattggcggtgtttcttctcttgagaaatcattcaaatttctgaacaattatgccggtcaggtactagtgaaaacgcatacttcatcgaaggaaataatagaccgtgcaatggatcaattccaactatgcatataatctaaattggacaaagatagacctccacagatgttcttgactttttttataatgaaaacggtttacattttcggtcttttgcctaaatatttttgacgtaaaacatgtacacaagcagacaagctgttgtcgtcaccaggaaagtgagcttgcaaaatgcagcgaccaagaccaaatcgaaccatagtgtagtcgtatactgatgcccctcatgtactattctgctgctatatgatcgttgttgcactactgaataaccgatctttgctgggtgatgtaaaaactacattagttccaatttgaatagaaatcgggactaaagattatttttagttccggttaaaaagtgcaacgggactttatgatctcatagtccaagttggtgttacatatggatctttagtaccggttatttcatcggggactaaagagagccatgtttagtccctgattcggggtcccgatttgtaacccggcaatgtagagggatgcaaaccaggactatatagggttttctcagcagtgttggataggtcgcaagagaagaggtcttcattcctgatgccttccatgcccataacctggaaaagaacatactggacgacggacacaaagatattttgttgtttttatgatccacatatgtattttaacgccctcaagttgatcacgagcttttctagtttgacattttttttctccagagtttctttttcaatcgagcataacgcagagcagtttaattctggcaaaagtataaaaacagaaggggctatccatatttataatgtagtgcatattacttgtgatcaaattttaaggatgtatttatactataattacattacaatatttattggcttgttggcttgttggcttgttggctgttgctaattccttggtcggttcatccaacactcgtccaactgaattagcaacagccaacaagcagccgattacaatttacagataggaatcatagttacaaattttcatatggcaatggtgttgctgctgctgtctagatcagtgaagtgaatcagtgatcgtcgcagtgattcagcaaatcagcaacaacaagacatcaatcaggcatcagtagaagtacaaaacaatgagcgacggcaacggcaagaaacctgcgcggctcggcggctgcgcctcggcacctcggcctcgcatgggcgtcgcgtggccgcggcggaagaggaagtgcgtgaaaacggccagcggacggcggcctcggacgagatggctgcggtgttgcgacggcgttggtgccagcggccgcgatctcgcgtgaggacgtgaggcgtgagcggcggttgggcgtgaatgtgatcgcgttgatggcgtcgggattctcgggaacctaccatccgcatacatctgtttctgttgggcgagagaggggtggcgggtggagaggggcccctacgagtcgggggcccagagcggccgcaccgctcacccccctccagggccggccctgattgacagcatacacaaaccatgcccgtcgtccaaacatgccagctcacatgaatccagctcgtacttaattaccacctctcatgctcagatctgctgattcccagcacaaatttacatgggtaagaagccgtgacatcaccatgttgatcaccccatctgcaaatttcgccgcgatcgtgaaattcatggatgcccacagaaacacccaaggccggaacaaattaagcaataggcagctgttgcatactgcccatctggtgttctgcggcctctccatccatctgtacactgggcatcgacacagcaacagctgatgtatgggacggaactatagcgttgtagtgaccatgtcgctgaaggaggggtgtttattcctagtgccttccatgcccatatgatctggaaacgaacacggtgtgctagacatatctgcatagtgtaggtgctctggtttgcactctttcaatattgtgacctcgactaccctctactcgacattctgctagctcttttgacatcaatatagtttacagtgcaaatatctcatcgttactttttaactatatatttctacaaattatttagaaaatacaacaatgtgaaagcatttttcatggccaactaagacggggagaactagcgaaatccctaactggcagccgcttgcgccccccccccccctcccggcggcgcaaccgtgtggagcatacgtagagggaaagggggatcccgtgcgcatctccttcccctttttcctttttttttctttttttgttttttcccttttttttcttgatttctttcctttctaatatgtatatatacaaagtttgtatacatatgtatacaaggtttctatatgtggttttttcccctttttcaatatgcacttatacaatacaaactttatacacgtgtatatattttttatacattaaagtgtacacgtgtgtatgtaatgtttgtatatgtacatgtaaattttgcatacgtacgtatacaaactttgtataggtgtatatattttgttttataaattaaaattgtatacacataaaaaactatacttatattgtatatgtattatgtatatactttatatacatacgtataaacttcatacataaatatataggtacgtagaggagagactagatcaggagggcgactgaccgcgtgggcgcacggctgatcgcccatcagcgcccccgagaaggagacgaggcagcgaggggtgacgggaaaaggaggtggtgccaacagcgcgagaatgagaggcgatgtcggtggcgcaccagagcatctggggtaaaatgaaaattgctaactttttctccaagagacatgaaaggactaaaaacaaatagaagattctcaatgggacaaaacgatatttcgccaactatacgatttaacagcctgaaactcgcggagtagaaatcagacggtatatatttcttcaacgacgtggcacatcctccttccagaaagcttgctttcacctatacagatatctactagcaccattctttcatattaattaaatcctaattgttgaaaatacaacaatatgtgtgtgagaggcagctgcggataacttgctctctttatcaacggcacttcattattgaatgtgaaaataaaccacaaataaactgtcgtcgcggttcggcagtgcgaaatcgtgacgaaatcgcaagacaaacgcgtgatactgatgaaagggtgatgacacgggtggtctcccaaggtgaaaatgcaagatcggcctcgggtgatacatgacgaagggtgatgacatggcggtctcacaaggtgaaaatgcatgttcggcctcggtgtcgctagttcgccgagcgacagggctattgagcctcggtctcgtttgatggccgagcgagatggccacaccggcagctaataacacaactaatcatactaattagtgatactaataacattaattaatacattgctaatgatgttaattaatttattaatagcgcgagtttgtgtggtctcacgggctcgcctcacgagaccgcggtatcgcgcactcgcctcccggtctttcacttcaattctgtgataatggtatatttatgtcatccccttctaaacgtgtatattcttataaaatcatcggaaacaaggtatattttcaattttttttctttcttcaatacgtaatgcggatgtgtggtgtaggagactaggagttcaaaccatgtataaagattaactttgaaccagtctccgcttcattccaagttttattgtgaatgttacaatcgagtgtccattaggaatcgacagcattcgcgttttcttttctcagctcataatctcactatggacagcgctgcccgaacaactcttggatgccatatgcatcgctggaatgccaatttggtcgcaatctaccggtttgtcgttgtgcacccagtttagctctttgttgaaccatgaaggtcgagtgactgcccactctgtggcgcgagcaactgagcacgacgctgtcctcggctctcacattggctgcaccgaccaacacagtgttctctcctctgcccttgctctaaaatcctgatacctccccgtcctatggagcatgcatgcacatgattaatgcacacagatgtggacaacattttctggacggattctgaatttgccgcaactcgcctcggatcgatcgatgctcccaactcccatcatatcctccgaatttttagcttagtggttgcttttaaggcccattgatcctttcgttcctctattttgggttcaatttaccagctattgctgccagcacaaaatggtaaatgctcatatatatatatatatatatatatatatatcaactttagagggcacacatggactaaatatcgagcctgagctgaattttgaattccaatttatacaacattttctcgtgttgacatgaattagaacttgtagtttgcaacacacatctccgtcaagtctgtgatatgtccatcaaatgctagctaggtgctatatgcagcgccatagttataggctaattaataacggcaagcttcgctttgatttaattgccgcccaaaatactcattgtaaacatgaacttgatgatatataaatatattatatgtaaattacaattttattaataaaataaagaaatataaagagttgcatatcaactccaattcactttgacctaaccccacacaacgttgcatgggacaattctctagtttctagtgcgctatctctcatggactcatggttggcagagcaaacacgatcgatgcattagtgtggagtgtggattatacttgctggatgccctataactttgcccccactgttgctgctagctgtgggatcggtacactcccatcttggattatatccttgaaattaatttcctcaatgtactggttgcatattggtaaattgctctactttttttttagttcaatgtgtggagaagctagattgattgggaagcgttaaaccctggttagggggccgcacctttgtttatataggcaggaaaagcccctgtcgtggcttgtacagagatgatggaccgatctcaacaaccctgagatcaatccggattatagagataaggataaaaggttacacgtgataatatcaatcttatctctacaaactaacaacttatctattctaacacaatgtactagctacttaatttgaggaaacaatttacaaatgacttatcagtgctgtctcaaaactgctaaatgctcataactcaattttagagaggagagatcagggtggtggattctaacaaaaatatacaatagatacttcttctgaaaaaatgaaagatgcatgttaggaggtcccatgatgatgtcgtgttttagtcccatgaaaaagatacggacattttatgttttgccatcaatgagaaatagttccaaaaaaatactatcctatcgtacaagcaaattgtttaaaaaatgtgtcattaccattcatagattcaggttatgttagcccaatccaaattaaatgccctcagcttgaattggtcactcctgcaggaagattctcctcatttcacagtagctgggttgccgaatgctatgtgggaaatgacatccgttgagtctctgcatctcacgccaaatatccaacaactcgcacaaaccgtcatcaccaagggattcagtcttataacctaacaagctgttcttgcgcgtagaaaactccattggcatgggcaacaaaatgaaaccatacaactatagaatcaacggagcaagagtattgtccggtctgtccggacgaacgcgtatccaagaggcagccacaagtgcactgcaggtgggcacagcgttgagcggacatagcagtggccgtgagctcagcacaccgtgctcgatctgtcgtgcggcgtccgtggacatgccatacagtgtgcaaaaccacagggaagttctctgcagccattagacatgatgcacttgtacttgatagataccaggtcgatccgcattcccggcattgaacactgaagttgatatttgtattcttgttacctcctattcccacaatcaggaaaagaatgtagtggctcagggtctcatgagcagatttggtgtgtgtgtgtactactctttgttctatggctttatgcactacctcacattctcacaacccggtctttttgtgttttcttgatacatatatatttggtactggcgttttaaataaaagcaaagtaggtagactctctaccaatcgagggatcgaagtatcacatcaatgaagatgtatttgtggcaattgctagttataagtaacttgctccgcttaactcagaagtatatgcatgccccatgtaagttctaatggagagtaccaccaatgtgtatgttccatacaaaatttaaaaatgtaaagtgtacataccaatgtgaaaatcgtttaagtatccatggcccaacttttcctttcattttttttccacgaaaacagtccctgaggcactgttttgttaatccccaagaggagggtattgaagggatttatctgacacctattgtggtgtggaataattctccttaatctccataaatcccctccaaactgaacaaggcccgatgtggagaaacctaatctaaattgaaaatcataaaagtcccacctgttcttgatgtcatacaagtgtacaaaccgaaaccatgttcattgttccacctggtcagcgtgctcgaatgcagccttttcttgccactgctcatcctggagccaaccaattcctagtaaaaatctaacggacatatgcaaccatgctatagcattactgttcttctagtccccaatatttttcatggtggtagaattcacaggcatgcatggcgatgcccaaggctgagccgatcaaagcataaagcagccattcagagatgcctatatggtgttctgcaaacagtgagaacagcagcagaacaccatagaggaatgggaaaaaacatctctattgccgtgaataggtcacacgaggaggagctttcatccccggtgcctttcatgcccatgtttggctgagcatggactaattaaaattaaaaaaggaacttatcatttgccaggcatgtgtgcatatgcatgtgtggtagctgctgataatttgcgcactctacctgagcaatagtgtgacgtttgctatgttggagatttgtcaatgtaggattagagggttgcatagagatttgtcactcatgatatttttttagcgttatatttagattttagggtgacatggagaacagaggaagattttctatgtaaaataatgtacttcatgaatgatactccctccgtttcacaatgtaagtcattctagcatttctcatattcatattaatgttaatgaatctagacatatatatctatctagattcattaacatcaatatgaatgtgggaaatgctagaatgccttacattgtgaaacggaggaagtagttataaaatggccaatcaatttaggaccattgggagtagtatgagaggtacatgaattgagatggtcatggctagatagctgcctcttgataccacagttgcagtaaaaagactctgcctccagataaagttttaatatgctgatcattaactggcgaatttgtaatttggcttatggagagaaagacatatcctatttgttacggccttaaattccaatcagctttcccatatctatgttttctttttcatacgaaagcatcaagtcatcccaaccattatgttctctaatacacagaaagaggaacccgctcaatgtagaaaaactttgctagaaaagggtgaaccaaatttatcggagtaatcagagtggtagaaagtccaaataggccatatcaagaggccttttatagtaccttccactaggaggtggtagtagtgtagtaggaataaatatcgccgctgatttcgatggtcaatttagtcatttgtttaaattaggtgaaagggcaattaagtaatcattggcaggccctaagagcctgtttggttggagggagttagtgatgggaatgggagtttatgatatctgggagtttaagtctataatttggttggaagacttggaaattcgagggggtttgggatagggaattaagaggtccaattcccaccacggcttgtttggtaactcgagggaaggggattgagagtttacacgagggaattgatgatgagattaagatgggaatttgatttttaatcccaatatcttgtttggtagaggtgatggaaattcatagggagtttatttggagattaggtcattaataaaaacggatggctgagatttgcttagaaaaagtaaaggaggaattccctcccaattacctgcccctacctagatattgaaaaggagggagttccttcctcaattccccatccccgtcccaccaaaattcccatgtctcccaaccaaacagaacaattaatagcctcgtccctctaaactcctagtccctcccaaaaactcactccaactaaacgggccactaatctcttacctgggggaggcctgttaattcgtgagacttgtagggaattcgatgtgaaaccaaacaatggaagaggactaaaaatataactcctatgaccaatcccaccatcaactccctcttgaaactcccattcctctccccttctcttgccaaacaggccgtaaggaggacggctcaaacatcagtcaatcgttcccatggccaattcgtcgggcacggcgcacggcgagcacgggcacgcgccgccgcctgttcgccgttcacccctttcacttccaaccccgatgtgcgccgtcctttcactgccaacagccggtgcgcatccttgcgcaagccaacactcgacaccactcgccccgtccgcctcctgacgccgcgctgccacccgtcgacctaatgcgcccgcgcgccggcgccccctctcgctctccttgcgcccggcatgaagtgttgattttaatatatccagaattgcggcatcaagtgctgatcttgaacatacatgttttgctcgcagcttcatgatggataatcctcaaaagctatgaaattcagtcttcataatataccaattgattatcttgactagtcgcaaacaaaacctgaagattctgaaacttatttgtttcctgcgattctgctaactaatcacaagggatctaaaccttaattattttctgcaactgtgctttcagtttaattaactctttcattaacgaaagtattaatgatcccgcaaaataattaaatctgaatctttaatgtgccctcatggttgacggtagtagaatttgtgtaagccaggcgtcaaccatgcctcaaatcagaagtctgaatttctgaactctggcatgacctgaagaaagtttcatagaaaaaacaacctcaagaaaaagcagtacggccggaagggaaaagaatccgacgagcgtgctgcctccggaggtggcacagcagtgatggcctgatgggagcagcggcggtgccagtgatgggtgtagggttcaaaaatcacgatctaaagctattgattaattatttttctttttatttcataagtggactgcatttttatagacccaagaacaaatcacaccctctgccaaacctaaattttcaaaaatgtcacaacaattttttcttccagaattaccattctactacactcctgcaccctgttacactaggtgcagtagcaacgtacatcctccgttggatcccatccttgaacggcccacattgatccatgggtactttaaaaaaaaatcccaaattaagcgctgaacaagaacggtagaatagtagcctcattcttacacaagtataccatgccaacttctgccgtacatcttgtgcagtagatccaccttggtgactgatctagattcatgatatcaacagctcatgtggcatgggtaactagttttacacagatcgagtcaacaggatttctagtgccacccatgcctacaattgaattggaaatggaacattcctttgttttcttcattgcagcacacaagaatatggattatttcaacatagagcgcatgcggaattttgccttatagtagagggggctggactgtgcgtgctctagtgctcgggcaagctatatatatatatacccgataaggttgtagtatatagttgttggtatattattctttgcaaccagccaaccacacacagctactcagctcccctgctcttttctcctttgtgcaactagcatatactccgcacatgtcattaactaaagacgtactcaaaactccatcaaaggtagttatacgtacttcatgtgtttgtggaaagtggggagcttagttcagatcatcagagagttctttaattttcccgttttgtgcagttattgccaattatgagctgtctctggtaataggctatcacagtttcagcaaatcccacgcactgtaccgggagattgttttatgtcttgaggtgatatccacttattttgttatgttacctaaatagttattaaagctttttgaaaaaattgataagataggttaatatgagatatatcactatgcaaacatgtaagcttaaattcgacttctacaagttctaacaaatataactgtgaatttacatcaactaattttaattaattttcttttattataacttgtaggttctaaatttgaccttgtatgtttttttagtgatatatctaatattccactatcttgttattttttcttaatttttataactatttaaacgcatgtaagatatgaggggatgttgaatagtataggatattccttcgagggatgaaaaaaccatctcccccaatgaaaaatagttttggtctatattttttaataagcgcaattgattttactaaatcttaaatttttagatgctttcaaatcccctccaaattgggtaagaccttgttaaatttttcatgactttgataaccacaaattttgttatgcttttgatcccagcaaaatttgctaggagtattaaatttgctttgacttggatgtccaaaattttgtcattgttagagagaaaacagggatgcattagtgtgcacctcattgctcaaaaagaattttccagcacgcaacttaattgtaataggatatatatatatatatatatatatatatatatatatatatatatatatatatatgcactacacaagcagtacaaattccatccgatcgatcgagccatccaattttacatggatgtatgctagattctacagcagatcacaattaattaattgttgtgtgcacgcatccgtttcatgagattgcttcaaacgacgaggcttcccgacgtcctcatgataaagagtgtaattagctcgaggagtatatgtatatatggaggatcgaggcaagtagaaagatgcgatccaatggtattcaaaactcttctggccgtaattctggatatgtatcttcaatagatcgcaagatcagctaccacagggcacatgtgtattggtcctctcaaaccaagcaaaataacactatttttctcacctatttgtaggctgcagcagttagtcatcctcactagtctttaactcatccttcaatttgggacaatagatatttagtactgccaactaaccagcatcaccttatagttgcccgcacttattacatatttgtacatattagaaatggtgtataatatagtggtgtagtatgttgcacttttactgtccaaacaaaagaatggaagtgctctcacacaaatgcttgatcaattctagcataaaatggctagtgaaggaaacctaatggtggtggcgaaaacaaaaccgcttgtacaatgccgttttataaattaacttgtgtatagggtacacatgtaaatgatttgctctacacattttgcaccttgaagattcttggccgcactcctctgcagaaaaaagctggatgaaaaacctttcatttcacaatgctgctgctcttcccaaaccgagtttcacagcacataaagccagattcatgaaagatttgcgtagtaatttctgatagagtaaattgcactagcggttcttaaactgagctttcacttagatccacgaacttacaaaacgcgtatcgagatccctaaaattggtttaatgtatcatcccgatccaaagtctcatttgactgtaatcttgcctacatgacatgacacgtggacaatgacatgtaattttgaaaaaaaaaataatgtctcccttcttccaccctcatcccctccccaccaccttttctccccaacgccagcagagggccaaacgccaccgatgcctctcctcctactccgctcaccgcaggcggcagcgccgcctctcccatccccggtggtgtggcctctctctctctctctctctgcagatcaggtcgcctctcccttcctcgacaaacacccaggtggagggcgacggtactggtagtgtcgagctctcccctctcctcacgacggtcgggggaccacagcggcgacaaggatagcgagctcaccggatccggccgcaatcttgctggatccggtcacaacctcggcgggtaggtcggccagtagaggcgatgagttccgtacagtggaggttgacgtgattggcagtagcgagctctgtaaggcagaggaaaatgagctgaagctctctttcctctcctcacgatggttgggggaccgcaacggtgatgaggataacgagctcgccggatccagccgtaattttgttggattcggtcgcgacctcagtgggcaagtctgccggtgaagtgaagggtgatgagctccgtgcggtggagggcgatgagctccacgctgcataggtcgatgtgatcgatggcggtgagctctgtgtgatgggggatgactagattggcggtgacgagctttgcatgggggagtgtgatctcattggggagccaccacaccgctcgttgtcactgtctccgcgccattttcgttgtcacccaatgccactcattctcaacgcttgagttggaggcaaagaccgagccccgccactgccgttggtgttgtcgttgtccccccagcctctgctccgacgacgagcagacttcggcagtggcgcctctgcctccggtggtaggcacagtctctccctctcttcctttgcctgccatgaatgcatccagaggtggaggaaggagagaaaaaaagggaaagtaaaatttgtgccatgtcatcacccacgtggtatgccacataggtaagaccacagtcaaacgaggctttggaccagaatgatacattaaaccaggtttagggaccttgatgcacgctttgtaagttcgtgtacctaagtgaaacctcgttacaagtttaagaaccgctagtgcaatttactctttctaatacatacattgtacttgtattttatggatatcctgtcccttagcattctctgcatatagcccttactgcgcagttgttctgatgatgcatggcaaagatctatgcccatatcactaatgaagaaccagtcagtgaaaattgtaaatctctcggatctcttacgaaccgggactaacgtggccttccccttcagtgtatcttcacctcatgaataggtcctaggagcggacaccaggattccagttaccttccattctcacgatcaggaaaaagaatgttgttatgactcaggggctagttgacatgttgtatgcatatatgcttatactgaatatatatgtgataaagtgatctgttctttgtcctctctccttatgctagctcgcaacccattttgctatcttgatccatattttgctgctggcatttttaataggctgactcagcatgtatgtgtgaccaaaaagtgtgagacaactaatagaagatgtatatgtgtgagcatgtggcatctgccaattataagtgcatgcctccaccagaaatttaaaatttcgaagcctacatatatactattccaagtgaaagctcttgtgaaatttcttttaattgagagttaattattaagttcaaatttctaaacaatgggaccagggtaccagtaaaaaaaaacaaaaacaaaaacagactgcatgcgttcaaagtgcacgtcagcactgatcaatgtgaatgaatgcatttactcgtggtccagctcgcagtgtaggatctgcccttccacaaccaatgtgggactattcaacaatctctcccttcacaccaatttggtgtccctcagcccttcaccgtatccgggccccaccagcctacggtccatcaggtatacgggccccgcaggtacccacggtccatcgggccagagatgttaaactagccaggctctgataccaattgtaggatcgtaaagggcctttcccatcccaaaagctagctgttgaggtgggaggctcccccacttatatctttggttctttaaccttccacaaccaatgtggaactattcaacacgcatgagtttagctactctagccactgctggctaatccttgttctggtgcgtgccaattctaagtacaattttaatgggataagaaattaattatcgatgctcgtcttcccaagttcccatcaccggagttcgtcgtgatagaagaattcacggataagcacggcggcgtccaagaccaaacaccggcgtagtgcacggatgccaatcttgttctctggctgtccctccatctgtgtacagtgcgtccgccatgccacggctgatggccgcgagagaacagcaaatttgccctgaattgatcatcggaggaggggttttcattcccagtgccttccatgcccatatgatctagaagaaagttagatggtgcttgagatatgtgtgtacgtagctgtgtgctctggtttgcactctttcgctcgtgaattaatgtgcctactctctttgttctgctatctcgtaaacgccctttggttggtgcgctctctagatctctctgttccatgtttttcctgctgtccattgtgtcagcattaactaagagcaggtacaatagcaggctataagtcagctgcaaacatattttaagaagataaatcaggagagagaagagcaacgggttacagatttgtagccagctgtagcaaggactccaagacgcagtgtttctatcacaggtgggactaggtattaatagtgtagtatgtaactattgtatgaatgagctattagattggctatagatgaattggagctagcagttggctatactattgaacttgctctaatactccctccgttctataatataaggcacagctacttttttttagatgtttcataatataaggcatgcatgcatgcatataattaattatgatttttttaaatcctccaccatcaagatctctaattctattggatgcatgcattatatttattaggatgattcaaactaggagatgataataattatttcttagtctttgggttaagggtggttgtgccttatattttggaacggagggagtactccctccgtcctaaaatataagcatttttatcctgacacagcctccgagatatcactttgaccaataatatctataaaaataagatgctttaaataaaaagagttgcatattatgatagtttgtttaatgataaatctagtaacatcaattctacatgattgatttttttaatttttttgctattaatattttaagttaaaaatgtttgacttatcactatgctaaaaatgcttatattttgagatggagggagcagttaactactggaaaaacaattttgtagatgaggtacttctatttttctagggggagaaaattttttcaaccaccagcccacctgtgatgatatacgtactaaatcatcgctcttaaatcatttccaaaagagatgtgatctatgatgttcaaagaaaaaaccgcacagattttaaagaaaatgagaaacccagattaaaagttagttaacagcataaacatcatttataaaggattatttcgtgcatgagggagttttaatctctgatcctatcagtccgaatcccacatcaaagcttcggcaactgtttcctgctcgccgccgtcacaatgatgaacacctggtgcctggccatatggcatttggatctatcgcgctacaaaaacttggccgttgagcatcccaaactccaatcattctctcgcttacaatcatccagctattgttggcactgcaccatgtgatcgagaagcaagcatcaatgagttcattagcttttcatttatatggagcatggcgacggcttatgtcactgatcttggcagcaaaattgcgccatggccgctgatagcctgccactaatattcaagaaacaataaggagccacaactgatatgctaggcgcctaggcctcaatgttttaaaaagcggactaaggtatttagcggttagcttgtcaaacagctatagcgggctaaatggagctataacggctaaattatacatgagagtaaatagctagaacctttctaaaacagctatagcgggagatagcggcagctatagcgggagatttaaaaccatgctagtcctacgtgggcgggctagcatcggaggcggagaagaacgagagagaggatgaagggccgtgactgaatgaatgcatgcgggcttgagacaaaattacccttgataaaaagttttaggctgttaattaccatctaatctgggcctctcatatcatttaaaatccatgcagatttttctttaaagagcatagaagcacaaatcttttcaaaatattttaatccaaatccatccatcgcttatgcaacatttaaaatatattcattatatattctgcagcaaaccacgacgagccatgtagttaacaaatattttcatgcaaacacgtacataaattacacgagggtctttccagagatcaagaactaccacgctttttcgtgctaaattattaccctgacattaaaaagtgtccgaactacggagagacactaacgattacactagaaaagtttggtacattcttgatggaaagaaaccatcgtatacaatcaaatattttgtcgaaggctgctgcgaactgttggtttacaaaacaccatcaaagtacttgcgcattcgcacgatgaagatcacctgtttagacaccctgtggagccttcagctgatgaggatcgcagcacggaccggagagccaagaagccttggatgtcgaagcatcctagagaggtgtcgtcgatcttgttattatacgctctcgtcgttgttgtgcacggccaagaaaagttaagccccattagcttgtcctgtgtgtagaaagggatactctgaatctacgagcttgcgaacccgtcaccaattatttcccgattactctcaatcccacaatccaaaactccaaatccccagcaaagtgaagatgtgtgtgtgtgtgggttttttccctgtggacttctttctttttttgcaattgtagaatatttactttccaagtaaatcaactgcagtagttctcgtgccgaggacagcactaaaatagccatgcggtaaaactcaaagtttcactgaatttgatctcttatatatgaggactgctatatataatggcacagtaactctgccataattattaatgtatgtcttttttttgtacaatgacgtactatctccgttttttatatactatgacgccgttgacattttaaccaacgtctaactgtcttatttaattttttatgctaatataaaaatatttaagtcatgcttaaagaaaacttgataataaattaagtcatagtaaaataaatgataattatataaaatttttgaacaagacaaatggtaaaacatatctcaaaaaattaacggcgttgtgtattaaaaaaaacacagagagagtagtatataggaaaaagtacaaattaccccccaaattatcatggttgaccgaattacccccctaaccacagttgcaaacattttatacctagaacttttcaaaccagatgaataacccctagcacaatccagagcagttttgatcttacgtggcatacacgtggtggtctactcaactaaaaaataattaaaaataagtggactccaccggtcagctcctctatctcttctcccacctcctttcccttccatctccatctctctccacatgtctctcgctctctccctctcacgaaaagccagaatggcagcggcggcggcggcaggtcgttgggggagatagcggcggaggcggcatgaggggaagccgccgggctagggcggcgagcagcaacgctgctgcgtgcgttgcccgggcgccatcaccatctcgagcttggtgagggcgttggaggcagcagccggtgggacacgccaaggaggatgatggaggcagcgttgcggggagggcgtaggaaagggaaggggaagggggtggctgcagcagcgctagcgtgtccaatttcttcaactccgctgtgcccgagctctgcgccgctgcgatggtggggaaggaggatcccgccgccgtctctaccgccgtctctaccgccgcctcgctccacatcccaccgcccttgccactgccaccgctgtggccatcggagccggccgagcactgccccggcgtgtagtatgccgcgtcctcgtcgggcgaccagcctgccgccagcagctgccttcgccctctccggcatgtccgagctccgcgccgccatgatggtggggaaggaggatcccgctgccgtctccgccgccgcctcgctcctcgtcccgccgccctcgtcgctgccgttaccatcagagccggcgtgtatcgccacttctattcacagagagagagggggggcagagaaggaggagagaaaaaagcgctgataggtaggccccacctatttttatttgtttttgctgactgtatcgccacgtaggctgaaaaccgcttcgaatcgagttagggtggtaatttatcaagttttaagagtttggggtgtcaaatgtccggtattgtagtttagggggggtaaatcgtactaccacaatagtttggggagtaattcgtactttttcctagtatataagagctcaatagcttcaacttcattgtgaagacaagctaaagcgaggtgcctatttatgttgactctccaccgagtgaacatcagtcaaagttaatttctttaaacaactataattgacgatgtaggtgttggacagagaataacgccaaggtatacagattaattatccatcatgaaaaaaaataatttaaagctacaatgtgacaatcttgtataattttggatgaccctccatttccttgtcgtgaaaataatctcagcgggagaaagctagctttttggtgatatccggtctcttgagaaattaccttcaaattttgtaacaacgagacacaatctaaaagaatgagacaagtgtaaaccgccaggcgttcttgacgtgtatggcatacacaggccgtgttcgttgtcaatctgcgcagctcgcgaaaattaatgtaccttcttgcaagagttctaacaacatcatcgttccaacgtgcagcagtgaggggtggcaaaagagcggcgaacgtaatcaacatgtatgattgagctgcacgccaatgtctcaacacgacgctgcttgctgaactgctacaagtccgttgcggcaaacttcctgcctgtgcggagaaatattgaaacatagtacttctgacaagggagagcatgatagtgggattcctagggccacccatgcctagctacagtcgaattggatatgaaagacgtattggctagtcttctgtgccgcaaagagtctctctagctagctgctttcgaatttgtttgcaacgctggtcagttataaggaccgagtcaagaaactatccagaaaacaaatagagtacgaccacatttcccgaatggatatagacccagcacactaggtaacttgagtggaacggcagcctagtcatggttggttctgtttgtgatgttgtggagaagtgttgtggtaattaataacatcaaaacctaaaatgcaccctaatataacctagataccccaactggacatctcgcacagtccatagggcgactagctagctaatgaggttcaacgatattggtggattaacttctacgtccaagtcgtcgactgtcacaccctaaagtttccccttcctagcctttaattgaataactaataaattgctacaacaaattgattaatttaacctagagctaatcctcaattaaaagtcctacttaataagtggaaatggcttggtgggatttttcttgagttcccctttctaaaatacattatcaggatttgtagtggaattttcacatcaaagaaaataatttaaataaatcaaaaacgattatcggaattgaattaatttgaaatccttttctttctcttcatcggccgttgggccgcttccggcccaactccctctccccgacctacccacgcccgacaccgtgcccctacttgctaggctggttgaaggttatggcccagcaagccacccgtgccgcctccgtacttgggacgccgacaggtggggcgcacctgtcggggttgtctccaacctctagccgagaggggcagggatgatgtcagccacgccgtcgtctctggcacacctttcgcgccccaaacgccgacgtcctgcacccagccgcacgtgcgcaccccactccgtgcatcccactattgcctccttgtttttgaacccaaaatcaagctcggcgccaccatttttcctcctcccactgcgccgcctccggccactactcaccaccactaaagctgcaaccgagccacaccgtcaccgccaccagcttcgtgaggtcaaggagcccctcggccgccacatgatcgttccattccgccaccggaacccgcctctcccaagatgccggtgagcctcgcctttcctttccctctccagccgacaatgctcgctgccgcgcaaccccatttcccctctaaactcccccttcgtcttccttaggtcacactggaacccatccaccgcctccaccgtcctccccatcactagattaccgtcgtcgatgccatcccagaaccgccgctgtttccaccttgttgtcgtcgttctcgcgctgcatctcgccgtcgtgagccctcggtgagctgcaccttcccttcctcttcttccactgccgctccgcacgctcgcctcgggccgcatgtgctgccgccaccaagtcgggacggcaagccactaattgccacttcactagagtccaatttgcccctcggcacatcggggccgtccacctcgctgtccgtgtggctacctcgtcggtgccacgtggtgcacctgtccccgacccgatggactcggtccacagtgcaccgcccgccttgcatcgctaacgggttgggctcacttgctggcgcccacctccctctcgatttcatcagccatcaggttttaatgcgcattaatccattaatttttttctattattagtaaaagcacaatgaatatttgataattcatccgagctccgtttaagcccattcaaattgtagtaaattcataaaaatgcatcgaatccattaaaaatggttttgttctatgttttttagacttgtagcttatttttctttgtgtggtttgtatgtcacttagattctgttggttcaaaagttcccgtttactttgaagtggttgtaggggttgcagcagcacttgagtaaggcaagtcacgcattctcgttgaacatatcgtacctatttttcaaatgtcccgctttctattaaatttgcattgttttataatgtcacgtggggtggtttattttatctcagccatagcttgatcaccttgtatcattgataacttgttagtatgactagatgttaatttaggaaatgcttagtcatggtcagatcaaacgctcacaattggaatctctcatatatcttatatcttaggttaatgatgactttggacatggatcaccatggtattaatttaaaatattttctttttttagcaccgaaatatgctccttacgaaagattctaacacctgaaattacaaggtagattaagcaacaagaacgagaaaaaaaatcagaacccaaatttcggactatggatggaaacaagaagacctaagggagtcagcatgatgcaagggcaaggcgtgtgtgtcctgctggccgccactgctggttgcatgtcatcgagatgggagacggcgcagatgggacttgggagatgcaaatcacggtcagggaggaagtaggggagaaagtgccgatgcggaacaagatgaactgtgaaggaagagaggaaacaacgcgaacgcagcgtcgccctcgcagccccgcctgtctatccacatagaaaccataccgattggccgaggatgggagttgggtgggattagtgatggcccccctctgcggtcttaggcggtcgcacaactcacctaggcctagagccggccctgataatgaatgagttaaagttcttttctttgtatgaataaagaattattatcactagttttcagttatttgtccattaaaattattttcttcttaagagtgtggtcattgagctgaatatataaccgtagttaatacaaataatgatgacataataatacggttgttaataaaataacgatggtagaaagtctgggcgctttatgaaataacgacagcagaaaaacaccgtctttcataaaataatgaccggaagaaaattgcatgcgtggttgttaatactataaacgacgtaacctttagcgaccactgaagatcacattttatgatcgttattgacctttaacgactacattcgaacttttaacgatcacatttgctgtcattaataatcgtttcaccagttgtgcgatgtggtaggtttttattgccctgcatgttggctgtgccgcctaacacaatgccatggtttttgactcttctgtaaatttccgacgcctctcgatcctaaggagcatattcacacgatggatgccacactagtgtggactatacttgctggatgccctgtaactttgccccaactgttgtgactagctgtgggatcggtggatactcccatctcccattatatccttgtaacttgttgcatctatgtattggttgcctttaaggccattggtccaggcattgctctatttttttagttcaatttactagctagtagtttggaggaaataatttactaccgacttattagcgctgtctcaaaatgctaaatgctcataactcgactttagagagatcacgtagcgtgttctaacaaaatatacaagagatacttcttttgaagaaaaatatatatgtataagaggtcccatgatgatgtcgtatttcagtcccatggaaagatggacattaagttttgccctcagtgagaaacagttcaaaataataccatcgtatagtacaagccaattgtctaaaaaaaagcttttcgtaaatccaacttcgttagccctgtcccaattaaatgccctcagattgctcgctctgcagctggaagatcctcctcctttcacggtagccaccaccggatgctgtgcgagaaatggcatctcaatggaacctctgtatctcgggccaaacatccaacagcacgcacaaaccttcatcattaaacgggtttcagtctatctccaaacaagctcttcattgcacgtaggaaatgccaatgacatgagcgacaaaatcaaaccatacaatcgtaggatcaatcaagcaaagagtactctgtacagtttgcaagggtgaatgtgcatccaatacgcggtggtcgcgaggtgagatcagcatcaaggcgcacaaccaatcggtggatgtgagctcacctcacccagactgaacctgataggtggtggctcagcagccgcaggcgttggaagggcggcgagcgcgcacccaagaatcggtcatgagctcaccggatccagactggatctgacgggcggcggccgtggacatgccctacaacgtgtaaaaccacagggaagctctctgcatccattttgacatgctgcatttgtacttgacagatgcccggtccctcgtcagtctcagcggcgctccaagaagctgatagatgtattcctgtgaccttccattcccaacatcaggaaatgcatgtggctccgggcctcagaagcagattaatttggtgggtgtgtactactctttggtccctggctttgtgcttgctcacaacccttttgtgttttcttgatccatatatatttggtactggcgttttaaatatgaaacttttaagacaagctaggttgactatatatccaccgagtgatcacctaagatgtatatgtggtaacggctgaatattaaataacttactccacctaactttggctgtgttctacccccattttccccaggccgccacctctctcttttccgtgcgcacactttttaaactaccaaacggtgttatttatgcaaaaattttctatacgaaagttgttttaaaaaatcatattaatccatttttcaaaaaaatagttaatacttaattaatcatgcaataatacgagtttcgttttgtaccatatagtagtatatgccccaagtatattctgatggagagtacaccgcagcacctagcctttttgtaaaaataatgaaggatacgcaatgacatgcaccgtgggactttacccctaggggcgtttttttatcactatattcaaggaaagagcacaatttcatactgattcctttaaaaagaaccatcaaaaaataaaattgtaaattaatcttttaattctccatgatctcctccttttccataaaccctttctcccttttttaatcaaaataatccccggtagggagaaactcaatctaattaaatcgaaaattaaaaaaaccaccaccttttcttcatggcatacatatgtacaaccgtgctcatcatccaagctgtccagtgcgcactaatgcggccttttcttgccactccacgtttccaactcaacgaatcaattcccagtacaaatctaacgggcataggaatacatgatatagcattatatatatatggctcttctagtctccaaatttttccgtgttgcagtggtagaattcacaggcatgcatggcgacacccaaggccgaaccaatctaaggcctaaggcagcatccgttcagagatgactctatgttgttctgcttctgctttggacgtgctctctccatcaatagaatttgtgtcggtccgccagcagtagctaatggatggcaaaaatcatcgttgttgcggtgaataggtcacaagaggaggggccttcatccccggtgccttgcatgcccatgatctagaaaacaattaatgttgtgggtgacactttacaagctagcgatgtgtgtaccgtgccagtttgcacctctttgctggtgaccttgactacattctctgtggtccttaaaatgttgctactccctccagttctagatatagggcacaactactttttaaagtggttgcatgcatgtaattaattagcgcattctctcccctaaattattattattttaaattctatactcataagatttttaattctattgattgcatgtattatattaattggggtgattcatgacaaacatgagatattaattaattcttggtctttgggttaaggatggttgtgacttatattttagaatggagggagtagttcccaagagatcaggaagagaaaagcaaatgattggtatttaaacttattcggttggttgtgtcacttatgtctctgtagtatgtactctcttggaatgtaaatggttggtccttaaacttattcggttggttgtgtcatttatgtctgcgtattctggaaatatagaattagcatctcaaattttttttagcccatcactgggtcaaacagttgcagactcactctgcgcgctgacgtggagtatgcagaatttcggcacaccaattgctctaattctatgcctggaccatcggctccttcgattgcatcggtgctatgtatgggtgctcgagttcatcgactctggcacggccttttggtacatattgatagtgacatcatgttgttattgaaatatttaggagttgcatgtttatgtgttctggccaatataaattcaatagagatttctgctctaattgtttagtgacctcaggtatacaatattgtcttttgaaaaaaaagttttatcaagaaatgtcaattgaatagaaaattgaacaattgaaattatcttttacattttcttggcaaagccacactaaattcaggtcgaattgatgatgactactaaaatctttatcggcgcatggaacaaatcggtgatcgcttttagactagtgattcacaccagaaactaatataaggtgctaattctatattttaaaaactacggggacctaagtgacagaactgaagagctaactctgtgtggtctattttcccagtcacatgtaaaaaaaaaaagtagtatcccggtcattcaacgaacacatttccggaaggtgtaattaatatgtgtttctaactaagcaataaaagcttaatgaccgcaactgtaaggatgacagagaagcatcgatgttgtccacctctgcgtttcaactaggtacatctcttggggccgtacctatgatttgtggattgctcagtattcatggtagcacacatgcccactgcacacgctgcaaaatgaagatgaacacgctttaggctttcgcgtaagacaacaggattcttagtgccgcccatttctatagttaaattggacataaaacgcgtatgagcatgttggttagtcccttgtcagttgtcaccttagatttctagctagcacttcaaccttattttgctatgtttttatatagatgcaaacacaactgtttctaactttttattactacttgcccactagttttgtacgtacgtccttcaccctccagagtccagagtaagttaaatactagcagtcttctcacctgaagcctcccagctaccctaggtgggaaaataaaacaatttttcagtgggggacgcaaccctaaaatttacaaaacaaaattaatatatgtaggtcacatatatatatatatatatatttaattagatctaatacttcattctcaatatttttttctcaacaaatatatttttctagactcctggatcacatcacttagtagtcaactacctcaagtctacaaactctatcccactaagaacaactgcaacagcctctatatcccattcttcaaccaaaatttgacaagtttaggcaaatttccagctccaatagatttgtcaaccggatggccaaacactaggggggcaacgcttgtaattgttaagtgaatacttagccttgaaattttgtgtccgcgccactgctttttttacgagtgctcccatgaacttagagcatcttcaggggagacccaaaacctgcccctaaacaaaattttaggaacagtagggtacattttagtagaatttgtctgtgcagatctctaaccacttcagcttttcgtgaatctatctatagttagtttggtgaatgtgaattgtctgcttggctatgaatgcactatcaaattactatgagcaactctgaactctgaacaaagttgctgattaaatttgcattctgaactcagaacatctctgaactagttatgcacactgtgtttatttttagtttctcgtacagagattttaggtcagtgcttgtgatattgacttcttatatattgacttgaggagttactcagtaaatatatttataattcatatcaattcgtactttaattcaacaattttaaaattcaaacctttttcaactgaaccattatatcccggttccagatggtcatatttattgaaccttttctcctctttacaaaaatttattgaaagtttctaattcagtaattatgtataggagcacagattgcacgcagaaatgacttgtgcacgtgatacaccttgaagactcaaggcagcactctcttcacaaacctagatgaaaaaccattcaacaaaaccacggcttgtccttctccgtcgctttctccatcgagccggcgactttctccgacgaggatggcgccactaggcgacaagctcggcggtgtggagcacgaggacaaccacacatccctctcctctcctcccttctctctctcccttccttggtggcacggagcactagtttggaccatacctgcaaacactgactaggaacatgtggtatagtttggctatgcggtcttcgctttgctcctctaatggaggaggtggcaccgaatatttggttccgtctacccaggccaaacgtctcatgggtgcattgtgaatggcgtaagacaacaggattcctagtgccacccatttcaatagtcaaattgggcatgaaacgtgtgagcatgcatgttgcattggttagtcccttgtcaccttagattctctagctagcacttcaaccttgtcatcttacattagacataacccttccttttttttcttgcctctctgatatggattttcatctctcgaggggacataaggggatgtcccctcgtagttggcatgttatccaaatagttatcaaaaaataaaaaaaattgacaacatagattaatacgaaatatatctgtgacatcctggctcaattgggatttggcctgtgtggcccatgtgagctgtgtgtgcatgtttagtactaccttgctagtttattacgagtggtaccaacttataaggcctctaccctccaaccatatcactcccaggttaacccttttaaacgatgcgaggatgaaagtgtaagtggggtgttgtgtgtaagtgggtccgcccgtcggttgggctgggctacgtggttctggagggagggttgttacaatatcactccacaaacatataaggtcaaatttgacttctacaagttgcaaaaaaaacaaatcaactgaaaatagttactgtacattcgtagttatatttgttatttttgttacaacttgtagaagttaattttaacttgcatgtttgtggagtaatacatttcatattaatctatcttgtcaatcaatttgtttctaattttttgataactccatttcatattataagtcgtttcgactattttccttgactattatagaaaaatttaacagtatcctcaattcaaattagtttcatgatacataacattgaatatattttgataatatatttgttttgtattgaaaatattactatattttctatacacttggtcaaatttaagaaagtttgactaagaaaaaagccaaaacgaattataatatgaaacggagggagtatttagatgacatatatgaaacgtggggatatccccttgagggatgaatacactttcccttgtctttctatatatgtgcaaaagtgtcacataaatacactataataaatattgtacttcatatatattggctcgaggagttcctcagtgtaaatatatttatagcccatatcaatgcgtactttaattcaacaattttaaaaattcaaacctttttcaactgaaccattatatcccagttccacttatatacaaggtcatatttattaaaccttttctcctctttacaacaatttatagggagtttctaattcagtaattacgtttaggagtacagattgcacgcagaaatgacttgttgtgcgcgtgctaccccttgatcaactcctgggccagcactctcttcacaaacctagatgaaaaaccattcgcaatgttgctggccctcgaccgcgctttggagtgcagtggagcaaccttatatgcatgacagtgcagtaagccaaacggatgctttccgcagcatttcgggcatcctacagtactatgtatttaccctgcaattcatgaccgcgttgagatcagtatacaccttacttgagccgatgcacgacaagacgcagcggccttatcctgcaatagctgaagcaccggagatatgtgttcccgatcccttccattcccatgatctggaaaacaaatgtggtggctcacggggaaatctctggacttgtaaatgtactgtatggtaaactagtctttggtctcttcttaatgctagctagttctcagtcacaaccgctagtgttatctagttccatattttgctgctgccatattcttaaattgagaccaccgagtgatcactcaaaagtgtcgcgattgctgattataagctagtaacttgcttctctacgtaactctgaagtacaccatgcatacatattctgactgagagtacgtatatctgctggaagaaagctctcgggataaagtcgatctttgtaccctctggtttcgctctctttcttcttaatacaatttgggcgacctccttcggccgtcccggcaaaaaaaaaaaaagaaagctctcgggatagttctttcaagttttctctttacctatggagttacattacttttgacttttcaacaatgagatcaaattcaagtgtgcataatctgagctggacaagtgcaaattatatagccccgtcaatccttgatcgaatataaaaaccatgcttgtcttccaagcctgcacgaaagcaacctgttcttgccgccgctcatgcatcctccagcttctttcagggtgctactcagttcctagtacaactaactgtaacggcataagaaactaccatgtactcagtccccctcaaaataaaataatttcaaagagttaggaaaaagatctctttcaatcacctaattggtggatatatttttagttttgaattgctgacatgcatttccctcaagcatttggttggctgaaaatatatggattctcgagcatgtaaatcaggagctagaaatgcttatatcgtggaacatattttaaatcctataattgcttatattttaggatgaagagagtagtatttttgctcttgtcttcacatcttacggcttctttggaacacatcattctcaaaatacgggtataaaataatgcaggcttgaagtgccgtaacacctcaaatactacaggtagaccatttggatggagcacagaaaatacgcatgaatcgtaagagaaatagatgcaaacgatctatctttttcccaagtggttagacttcatttaaaatttcctctaaaatccttatgttttgagccaatccaaagaatttcgtaggactttttgttagggttacatatgaaaaaatttcgtatgattgaagtcttataagaacactctcttgaaggaggccgtagattcttcttcttctagaggtagaattcatgggcgtgctgttgggatacgcgtaggctatgatagcataaatcaaaattttctatcgcgtaaaccaggaaccatgcaagtattagatcatagatcgttaccactagacgcgttgagcagcggaaaaagacgttgagaagtcgaaggaactctcgcgaagtagcgcgcgtcgatgtagatgaagtagtcgatcgcaccggctcgaccttctcctcctcgtgcgttctcctcgccgtactcccacgctgatcagcaccgcaaaccagcggtgcctctaccggtatccacacgtacagggacggatcgccacgtgcagatgtgctagcacccgcgcgcggctagggttttgctcggggagaacagtgacggctagggtttcttacgtgatgcaaatgcctccgccggtcacacctctcacgaatatataggatccatcactcgggcctccaaggcccgtaggactcctattcggatccctatccgaattaagctcatattggatctctatccaatccccttattccggcccattaaccgtgcgaccctgtaggttcatatatactc

SEQ ID NO: 70427 - DNA, 684 bp, Oryza sativa
cgagctcggtaccccaaagataatactactaatattaagcaaaggctagtggtaactaaagtattaacaatgtcataagcactggagaaagcattattcaccatttggcgttcatgctgcatagagaagaaaaacaaattgctaaaaaacaccaaggcaagaagggcaggaatctcaatccaagcacaccttagcgtaagcatcatattgacggtcatctcgaccagaatactggtgatgagttagttagccatggccatagctaggttgatgcggctgtcgtttcaaactgcacagcgccacagatctcaaagcttatagcgatgtaagtatgctgtactccctccgtttcaaaatatttgacaccgttgattttttagcacatgtttgaccgttcgtcttattaaaaaaattgtgaaatatgtaaaactatatgtgtacatgaaagtatatttaacaatgaatcaaataatataaaaagaataaataattacttaaattttttgaataagacgaatggtcaaacacgtataaaaagtcaatggtgtcaaatattttaaaacggagcgagtaaaagccaacgaggacgggtggcaccactggcacggtagctacgaggaagaggaacagaaggaggatgcaatggcgctcctgggcaaaacgggtcgcctgcatgtatcaatc

SEQ ID NO: 70428 - DNA, 12661 bp, Oryza sativa
aaaaaggtgaagttggcccattgcctagtagaaatggaacagaagccaagcttaaagaatgcgctgcgcagcaaatggagacctggtgtcagtggacactggctcaggccagaaaaggcaagtattctttacgacaagaatataattctctctgacggaacgagtttcgcgcgtgtgctgctaagtcgtataggcccgaacccatataccccggatgatataaatcttaattacacaagatatcagagacttatagatatgattcctgaattgaaagacgaaagtaacaggtttgatacatcgaaaatgatgcgccttatcttcagagcatgggtgcgtcttctggtgtatgcatccgtgcgatgcacaagggattcccatgccaagcagctcgcctgtggtggtgagctcacaacaatcgtctggattcttaatgaacacgctggtatatttcgtatcgacagcgacaaggatgacgacaaggatagactgacaagtttatatactaacgaagatcgtttgtacctttgactgcaactcaccaattaatttgttttccttgttgataacctatatatatagggtatgtatctcatttcttttgtatacttacgctctgtaattacctcactacactacttaaaaaaccattttcgcttgccttcaatttaagttcacatgcggatataaattaaattgcacaatgtcttactttatgtttactaggttagatcgaggtgattaaggccattcccaacccaaaacactacatatagtttccataaactacacatcatcaagaaactagtactagacactactcttccaatgcaaacacaactattctatacataaatttaatgctacttatctcacatgatgtcttggatgttgtgtagaaactgtcacgcccggaatttctatccaaaattccaaacgcttacatgtgtgtgaaccctcgtccaggaatcagccgaggcacacaataacaaattcataatagagtacaattattactctaattaataagcgaataaaatgtcattacagaggtagatagttcctctcaatcaataaagatctaagcagcggaaaaaaaaagagataaacggcgcagacgactccactccacaggcagcttgaccagggctacacctaatcctccacactatcagcatcactgtagaactcctcctctgatgaatgattgcaaggtgagtatatgacatactcagcaagccacgcagcaaatatgcaagtgcacaaggataccaaagaatggcataatatagagctcatttgcaaaagcagcatttagcaaacatttgagaattataaaacagtagagtaattaatcatcaattttaatcaacactaaacagcacacccatgctgctcaggcccaaccatccggaacaaccatacccggctgtacagatctatctccaaaccaggaatataccattccaaaccaggagctaaacaaatttttaccagttatagcatcttttattatggtgagaagtgtgaaactaatcacgaaagacattgttagacccgcccataaccgcgggcacggctattcgaatagttttactctggccagaggtgtaccactgtacccacaagacacagccccacaacatgtcaccatgtgcctcaataccaccacggtacctcggaaaggaggtgtgacagtacccctcgcacaacacaatccaccaaagcgcacctttcctggatcataatcatccccttataaacaaggcatgaactccccagcgacccccgtggacttatctccgccacttctcagtctggtgctacgcaatgaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaaccaatatatatagcccaactagtcaagttataataacccaaggtatcaaggaataaagtaatcaagaacaaaagggctataacaaacaataggttaattccacccaatgacattcgaaaataaatgcaatagttgaatagaaaaaatagctttaaacgggatcaacatgctcaaagggttgtttgggacctgtgtgacttgccttgctggccttggaactcttcaaattcttctagtgcgaaaacgaactcttcggaaacgtcggaatctaaacagaaaagagaaaaaacaccaaaacagcacataaacaagcatgaacagtacatgtggatatttttaacatgtagatctcaattttagaaaaatttagagacttgaaccaactaaatccgagctaagatgaattagttatgaattttcaaagattaaatcggattaaatcatttatttagattttaattgaattatgacgcaataatgaattatttttgaaaaggaaaagggaattattgcgtcagtggctagggttcgcggtggaccgggtgcacggcggtggctcacggaaacgaacggccgagatcgatcctatccaaaacggacggccaagatccaacggtctacgaccaggccacggggaacgacgacgatgacgtcagcggagatgtcactaccggcggcggctcgggcgtgcatgcttgccggcgaacgacggcgcggcggcacgaacagaggacaccaacacgtagagggcgacgcggcgaactcaccggtgaccaaaacaacggcggaagatcaacggacggcgacggcggtgaggaaaaggcggcggagatgatcggcttgacgacggcgacggtgttccggtggcctacggcgacgacggaggggcggacgaggtcggcgatggcttggcgatcacgacggcggccttcccgagcgacgacgacgaccggagcggcggcggcgcacggctggacgaacggcggcgacggcggcgcacggctgcacggtgctagggcgctaccgacagcggcgggcaaaggcaagggtggcggcaggtagcggcgggcttgggggtccttttaaaggggcaaggaggcggtggcgaaggcccacggcgaccggcgacgcgatggaaagattagggtccgggagagagagacaaatccgattcgagatcgaatccgtgaatttccaaacgaaattaaccgacgattccataagagaaaagatagaggggatcccggggatcatttcccttctattaatttcatcggaaacagaaaggggcgggtggatttggaaggagacgacggcggcgcggtgctagggttcgggcggtcggaggaagacgacggccctgacaggtgggccccacctgtcagcgggtggacgcgcgcgcgagcgggcggctcggctgcgggccggattaggccaggagagagagagagagaaggttttgggccgactctccgcccaaaaccaaaagagactctaaaaacctcccccaactcaaattatccattaaatgcaattccatttattaaaaatacttccttagctcaaataaatcccagaaaaatctaggaattatagagttaagcaaagtatttaatgaaattttatctggccccattttatattggaatttattaattaaaattagatcttctcttctaggcttttaaaataaattataataattccaattaaacaacaatttatatatttaggatttttagggtgtgacagaaaccatgtctcatgtaagacatagtttcattctctttcctcatttattcacttgccacatcatttttcatcctaggtggcagtttatttaatgctatagatatcatcctagtcattgggttgagaatggcctaagaagccgcccaccgccttgaaaattgtttcaatttacccgagcaacatagttaagaagctatctgtaataacacgatgcgcaccttgagggaccggctaaaactaaatatggatttccacatgcggctgcctcttgctcacacccgcggccacgaccgtcatgctccacccagcgctcacgtgcacgagctctcgccggtggcctttgaggcttctgtcctcaatgggatgtgaagaagaagaaaagaaaacaagggggatgaggaaagaaaaggatttgacgaaaaacataacggtagtggcacaaatcaatttttctgcaaatttaaatgacatgaatttaatagacgaatagaagtggtatttatctaaacgagcatatttgtaatggcatatatccaattgtccctaactaataccagccagcaaacaaatctttttgcatgcatgtgactagcaaggctgagcttggccaagacaagagttacaagccagcctaattagtgacagcaaccaaacagatccataattactgtcgggttaattaagtttgtttttcctgatataaaaattgcgagcatcttacgccataatccacacaagcgttgcgagctcaccgccgctgctgagttgcttggcgtgggactccctgctgcatcggtggctaacgtagtggagcatctccacccacaccttgaacagaaattccacactggccccgtcgtatttgttgagctttttgactagaaggagggcaagcggcagagcattgagcgagaccttactggggtcccggtcggtgactcccagctgcttggcaaggctctgtgttttctggacggatgactagatcctaattttgttgatatctcggatggtttcactgtaaatagtgcgtagtgcaaggccaggtaccatgtagggacgttccagaactaggaacatcatgtagttggaaataagattgattgcttcaacatactcggtggtctctgccttgtcggaggtgcggaggtagatgtccgtcgcgatgtgccagataatgatttgctgctggatctcgtcgcgaactaacctcaagaacaagtcgtacatttctgccttgagcaaccccgtcgagtccaatgggatacccggttgccccgttggtgctgcatcttgatcatcttaatttatccttattatcgatctcgcaatccttattgtacgtcgacgtcgattcttattatatctagcaaatagctgaacacctgctccatgacacgatcaggaatgaccgtggtgccggagtaggtgttgtctttcttgcgccacttgacatgtatcttcttggcaaggtcgtaccagacgtccttggagccgtcgcgtgtgcagtactgcaacatgttgtgctgccagatggtgccggaccaccttctgctgtcctccgcattgacaagccagcggatccacgtgagcgcgcggccgacctggcgccatcgtccgctgcagaccgccgcgtggtacagccaaccccgcagcggcatgcggatcaagaaggcgtacgcccaggtcgacccggctgccatgagcagccaccatgtgtctacaaggacggcgccaaccagcaatgtgtaggtgatggccacgtcgactagcatagccccatgcccaagggcgccgtggaggctgagatggaacatcaccaaggcaccggcggtggccagcggcgaaaagacacggatgcagtagccatgccacgtgtggatgacgccagccttggtgtacatgatgtcgtacagcagggagagctccatctggaggacaacccacgtctctgtaaaatcaaaggtgtttttgattattattctgtgatgaacaattgggcattggagattattggttttgttatttggaatttattcacgaagtggttttggagatgattggatttacaggtgaatcgcagggttatcattttatgtggaccggtcagactgggctctggtagccggtcagaccggcgtgtaatgcgcggtcagaccggcgcagcccgcggtctgaccggccgacactgtatcggtttcggtttcgggttgtttatttggatatccaagtttatttcatgattatgacttctagatggatactatacgtatgtaatactattgtttgctgctaatgagtcaagttggagataacttagtctcggaatatagtttctttgtttgttccatgtgtaggtgactcgatgtctcaggagagtatttgcggtgatggaccgggagtcggcttggggataagacgacgtccgtggtggtcagagatcatgcgggatacttaggctatagttgatgcacgtggttgatggagattccatatggcatacaatgaagttattgtgtacgtataggatgcgtagttgaatttggaaggagttcaaatttggtacgattggttatgtaaagtttctttcttgtactagagggtttcctaaggtgtttaggactcctagtataagtttggttcgtggctttaggctgcctacctcatgtataaatagagggggagcgtgaggcttcccggtatcgctttagagagcaattgagttgagttttgagttagggtttcgagtttagtcaaaatttttgtaaggagtgctgttggtgcactttgtaaacacagagagaatcaataaagtcgtcatccactttaagagttattcgatttgtgtttaccgggtttcggcggtctaaccggcgatctaccggcggtcaggccatgtcacatcctgattttttgtttcaggatttataaattatttaataaattaataatataatttatattaaatgatctttaatttacaagtgaagttaaatgtgggaaataaaatttcctaaatataaagcatggatggatttaatttttattaaattctccatggttaattatactctctgaaattttctcagatttttcagagctcaattcttaaataatacaaagaacagttcagtaattatttgattctccatggttaattatactctctgaaattttctcggatttttcagagctcaattcttaaataatacaaagaacagttcagtaattatttgatcattaatgatctaattataattgttaagagcttttcttgtttaaaatccttaaattataaattgttgtttaaaaggaataattagaaatgattttaaaagcctaaaggagaagatctaattttaatttgctaaatctcaatataaaattgggctagataaaattttgttaaatactttgcttaattctataattcctagatttttctgggatttatttgagctaaggaagtatttttaataaatggaattgcatttaagaaataatttaaattgaaaaaggttttaaaaagtcttcttttggctttgggccgaaagccggcccaaaacctctcttctctctctcctcggcccagtccggcccagtccgccgagccgccgctctcctctctctctcgctgtcgctgacaggtggggcccgcttgtcggagccgtcttcctccttcggccgccgccgcccgcaaaccctagccgagccgcgccgccgtcgctttccaattccgtcgctcctttccatctccggccgaattgatagaggggaaatgatcctcttgattccctcttccttttctcttttggaatcgtcacctaattcggtttggaaactcgatggaatcgaggtcgaatcggattcttctctcctccgaaccctagctttccttcgccgtcgccggtcgccgtgggcctccatcgccgctcgctagcccctttaaaaggacccccgagctctcctctatccgccgccacctttgccttagcctgccgtcgcgtctagcgccgcctccgcgtagccctagtcgccgccgtcgttgccgtcggttcagccgcgtcgcgccgccgttgcagccgccgtcgtcagtcgccgtcgccgccatcgtggtcgtcaagtcgccgccgtcctcgtccgcttctccgccgccgcttcttcctcgtcgccggcgccgtccgttgcccttccgccgttgttttggtcaccggtgagttcgccgcgtcgccctctacccgttggtgccctccgttcgcgccgacgtgccgtcgttcgccggcgagcatgcgcgcccgagccgcccgagtcgccgccggtgctgacgtcatcgctgccgtcatcgctgacgtcatcgggatcgtccgccgtaagccggtcgtggaccgtttgatctcggccgtccgttttggatagggttgatctcggccgttcgtttccgtgagccgctgccgtgcacccggtccaccgcaaaccctagccgctgacgcaataatccttcttttccttttcaaaaataattcattatggcgtcataattcaattaaaatcaatataagtgttttaatccgatttaatctttaaaaattcataactaattcatttgaactcagtttaatgtggttcaagttgcaaaagttgtgtaaaataaagatctacattttaaaattgtccataaattgaattaaatttatttaattctttttaaatgggctttaaatagatttaatcttgtaaaattcataataaattcatttgaagtcagaatgaggccgttcaagtctcataaatcatctaaaattatgatctacatgtttgtttactttttatgtactgtttatttggtttttattagtctttttcttcattttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcattgggtggaattaacctattctttgttatggcccttttgttcttgattactttattccttgttaccttgggagattataatttgactagttgagctttatatattggttcagctagatattagaggtaattgctttgccatgcttagaaacattagcacacaattgggataactaatgtttcactatcacttatggttatatttaatggtagctcacgatggtcaattgtgattggttaattaattacttgtgattggttaattaattatttgccaactaaaactggataatggtgggttgtgagcacatggttttgagagtcgtgctcatgacaattaaggaccggttcgcgagctactattgtgaaacattaaccgtgccaaccacaaaccagcgtgggcaacggctttaccttttgtatagcatggttcactgcagagcaccaggttgagaagtggcggagataagcccacgggggtcgctggggagtccataccttgtttataagggggtgactatgatccgggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacacctctcacaataattatggatgttatacctggtaataatttgcttagctcctggtttggagttagatttgttcagccgggtatggttgtttagaatggttgggcctgtgcagcatgggcgtgttgttcagtgttgattaaaatttctgattaattactccactgttttacttcttttaaatgttttgctaaatgctgcttttgcaaatgagcctatattatgccatcctttggtatccttgtgcacttgcatatttgctgtgtggcttgctgagtatgtcatatgctcaccttgcaataatcaatcaacctcagttgaagaaaaaggatccagaaggagaagacgtttggattataccccagttgagctgcctgtgggagtggagctggagcttcgctagattttattttccgctgcagttttcttcttggtgaggactaagtgcctcataagtaagtatttatcgttctagttaatttgatgaatctgtatattaaattgtcagtttgtgtacctcggctgattcctggacgaggattttatgcacaaataagttcggaaattactagtgaatttccgggcgtgacaagttggtatcagagccatctcgactgtaggataagccaaatggtcaaaccttaaggactaattttccgaaaacatgatttgtgaaaatttctcctttcttccttatctagaattctttgcaaattgtttcattgtctactctcctctctcgttcaacttgagtagttctaaaactagtggttgaaactagaagatgctgatgtgggcaacttatggaggttaagtcaagtggatcgatgaataagaaggtgatggtcgatctgaagagccaagtggtcaagatggaatgaagtttggatcctatcttagaacctatgccgccaaagtgtctttgaagaatagttagtagggtagaacgtttgttgtttgcttgtgtgtaggtatggttgcattcccatcattggagtagttcaatgatgagtgtgtaactatactaggttgtttgcttaatcaacttgaacaatataatggtctacacacatcagatcagttttaacctggttaaggtcttgtctttagtgtaacccctctccttctatcttctctaatctgcaacagatggtgaacactcgcgcaagtggaagtggaaacaataacaatgaagataacccaactcttgctcaagttctggctcaacagactcagttaatgaacatgatgatacaacagatgcagaaccagctcaaccaaggaaataacaatgctccaccgccgcagaacaagttagctgattttcttcgtgtgaggccacctaccttttctagcacaaccaacccagtggaagcaggtgattggctgcacgctattgagaagaagttggaactgctccagtgcacggatcaggagaaagttgttttcgcttcacatcagttgcaaggacctgcatcagaatggtgggatcatttccggatgaacagagcagaaggacaaccaatcacttgggtggagttcacggaggcattcaagaagacacacatacctacaggagttgtttctttgaagaagcgtgagttcagggcattgaagcaaaaggatcaaaccgtggcagaatatcttcatgagttcaatcgtctggcacgttatgctccagaagatgtgcgtactgacgaggaaaggcaggagaagttcctggaaggtctgaaggatgaactatcagttacgttaatctcccatgactatgttgattttcagcagttggttgacaaagcaattcgacttgaagacaagaagaacaggatggataaccgtaaaaggaaaatgactgttttccaggaggcacaaggtagtagccagaggcagcgtatcaagccactccaaattggtgaatcctcttccgctggtcaaggacagtcgcagcagttgaacatcggtggtgagatcaaattagagactaatgaaagcaatgaacttaacatcgagcaagctaatcagtcggtgccagttcagcaggatcagtcgaataacagtagtggaagggagcagcaggtatgcttcaactgttacaagccaggccactttgctagagagtgtccgaagccgaagcatccgcagccacaaggtcaagtcaacaacattgtcgtcacaggagccaatgcagtgccagttgcgtcttcaagagttgtgtcttcaagtgttacaactcagccaccagtttcaaagcagcagtagttttctttaaagccttagaataattatcggagtgatggaataagatagactgcagtttgcctattccctttttctttctagccgttccgaatctcgggacgagattctttgtaaggggggtagtttgtcacatcctgattttttgtttcaggatttataaattatttaataaattaataatataatttatattaaatgatctttaatttacaagtgaagttaaatgtgggaaataaaatttcctaaatataaagcatggatggatttaatttttattaaattctccatggttaattatactctctgaaattttctcggatttttcagagctcaattcttaaataatacaaagaacagttcagtaattatttgattctccatggttaattatactctctgaaattttctcggatttttcagagctcaattcttaaataatacaaagaacagttcagtaattatttgatcattaatgatctaattataattgttaagagcttttctggtttaaaatccttaaattataaattgttgtttaaaaggaataattagaaatgattttaaaagcctaaaggagaagatctaatttaatttgctaaatctcaatataaaattgggctagataaaattttgttaaatactttgcttaattctataattcctagatttttctgggatttatttgagctaaaggagtatttttaataaatggaattgcattt

SEQ ID NO: 70429 - DNA, 24350 bp, Oryza sativa
tgaggtattaaacctctcagcccttgcttggtcctcaaacatgttacgtagtcccgtgattatcgtatgagcatccaatgcctcatattgcctttgaagctcaggggacatagtagcaagcatcagacagcttatatcaaggtattcattgcatcgcctttcatgctccctacgttgagcggcaggagcattgttgggaaagtcagctggaaaaggctgtgtaagcacaaactttttgtgctcttacctgagaacaattcttaggttacgataccaatccatgaagtttgttctagtcaacttctctttctcaagaatagaccacaagttaaaattggatggtgcaggagctgccatgatctacaatagaaatatatgtatgcaaaatcagcatcatatttacatttaacctttgattaaacaatttaacaaaagatactcccactatgtattgtgaaacaaaattccctctagtaacatagtgagtcaagatcctcattttattattagtgtctagtgagctttggaatcacagctagacaactatcaaaataggtaagcaacgccttgctaatcacatcatatgtgactcttgtgctgttttggtgacatctccatgtccaacccaatctatgccccaaggtccaaaagtgacgggtagggtttcttacgtgatgcaaatgcctccgccggtcacacccctcacgaatatataggatccatcactcgggcctccaaggcccgtaggactcctattcggatccctatccgaattaagctcatattggatctctatccaatccccttattccggcccattaagcgtgcgaccctgtaggttcatatgtactcttgaaatatagaattagcatctgaaacttgtattggtgcctatcactgatccaaataattgccgctccatgcactgacatggagccgttgtagattcggtacatgtaccgattgctccaattcgacgcaaagatcgatatggagcacatagaaaaaaacgcataaatcacaagagacatagacacaaaagattcttttttcaagaggttagacttcatgttaaaattagtctaaaatccttgtgctttgagctaatgtaaaggaatttttaagattgctggatagaatgaactgcatatggaaaattttcatagacctgaaatcctcctaaattcatcgaagaaccatttgttccgaaagaacacttataattttcttcatgaggagatagaatactgtgcacagcagctagcacccaaggccagcccagagcatagtgcaccaccttgtgttataagtggttatgcaccccctagttataagtgtaaaatcaaaggtgtttttgattattattctatgatgaacaattggcattggagattattggttttgttatttggaatttattcacaaagtggttttggagatgattggatttacaggtgaatcgcaggttctattattttatgtgatcggtcagaccgggctctggtagccagtcagaccggcgtgtatcacgcggttagaccagtgcagcctacggtttgaccggccgacgctgtgtcggtttcggtttcgggttattagtttggatatccgtgattatttcatgattctggcttctagatggatactatacttatgtaatactgttgtttgctactaatgagtcaagttggagatagcttggtctcggaatatggtttctttgtttattccatgtgtaggtgactcgatgccttgggagagtatttgcggtgacggaccgggagtcggcttggggataagacgacgtccgtggtggtcagagatcatgtggaatacttaggctagagttgatgcacgtggttgatggagattccatatggcatacgatggaggtattgtgtgcgtatgggatgcggagtcaaatttagaaggagtccaaatttggtacgattggttatgtaaagtttctttcttgtactagagggtttcctaaggtgtttaggactcttagtatgagtttggttcgtggctttaggctgcctacctcatgtataaatagagggggagcatgaggcttcccggtatcgcttttgagagcaattgagttgagttttgagttagggtttcgagtttagtcgaaatttttgtaaggagtgctgattgtgcactttgtaaacacagagagagaatcaataaagtcgtcatccactttaagagttcttcgatttgtgtttaccgggtttcgacggtccaaccggcgatataccggcggtcagaccggcggcaagcggcggtcagaccggcggcaagcggcggtcagaccggcggcgacgacagcgaatagcagctgatctcggcggtcagatcggagatctaatcttggtcagaccgacggcaaccatgcgatcagatcggcaagacaacttcggtcagaccgcgatccgtcgaattcgagggtaacttttatttccgctaaaagtttttcagtttttgggtataccaaccattcacccccccctctagttgacttagttattgtgattcgatcctataataagtgcttataactggttcggaacccccctagtcctggttatgcaaccgggactacgaatctgggactaagatacatctttagtcacggtaaagatggcagcgccacgtgactggtactgccatctttagtcccgattgggaccaataaccgagactaaaggtccttttttcccttttttttgttaatttgcttgcaagttatcagataattaatcacaaattcattcacaacaccagcaaattatcagatcatcacaaactcattcacagaaacattaacaaatacattcacaacttagaaaaatttgcacatatacattcacagatcaacaacatccacaacatcgccactgctggccggcctcccatcccgctgcatctcctccggccggatctagcggaggagaggataaggtcgccggccactgccggctggcctcccctcccgctggacttggcggggaggccgcggccgccaccgcttccaccgccgggccgccgccgcttcccctgccgggccaccgcctggacactgcggttgcttccgtcgagacaacaagagagagagagagagagagatagagagagccagagagagcagagggagagatagagagagcagaggacagggagatcgaaagagatcgggagagaccgagaaagccagagagagagacaggatcgaggagatcaagaaaaaggcgtgggagattaaagaggtggggggatatttctagtgccgggttggtgatcccatccgggactaaaaatctctgggggggcttgccactgcttacaactattgaaccgggaataaaaatgacctttaggttaccaaccggaactaaggattaaaaaaaattggttgggctttttaaccgggataaaaaagatgtttagtgtcggttcctattcaaaccaggactaatgtggtttttggtcaacccagtaaagatagttcctccagtagtgctggctactctctcatctcacttatgctacctcacctcccttctgtttgcgttgtttgatatacgtttaacttgcagctggccttttaaaaccatgttagcctgagtattttctaattaatcaagaaacttcttagttggcttattcatggatggggtggtaactgctgataatatatacttgctcgacttaattatccattggcatctataatattgtgatgtcacttatggcattttgtgtaggattttgattttagggtgacatggagaagagagaggagggttttctatgtaaagtaaaactgcgctctttgtcattgatagttataaaatggcatatcaatttgggaccataggagttgatatggggtgtggtcctagtcttcacaacaaaggataactagctgcaaagagaccaaaataactagctgcaagcagccaaaatacgtagtgcaacctgccaaataaaactcgaagctaaccaccgtctttaaccagcaacctgaatcaaggattcgcccaaccactacaaagaactaaccaacacaaccaacaatcaatcgataaaaacctcaaaggcagtaggagcaacaattgggagccgataaagtggtcgcttctataatcccacaggaaaaccacaagagtaaaagaggtagagatcagtatctcaatttgttagcatatagctgaactaaaggtgttcattttttttattgtcaaaagtcttcgaaatgataaaacacaggggatatttatactaagaataaccatcctagatggggatgaaacaactaatgtaattcggtgaactgggctagctcaaaggcctcctacaatcattcccgaggaggttcacgtagccttttcagcttctgtgtagctatagtaaaatagtcattactccgtcatggtaagtaaaaacgatgagccgtttgttggaactgaaagtagactcgattatcttttcgagaatatataatatccatggggaaacataactttctggatcgcatatcgcttggagattgtaccatctgcgcataatcgttctgcacatctagcagcagccactagtacagaatatagctatggcaacacatggcagtagcacattctaaactgtgttgcagggaaataaaccagtaacacatgctttgtgttcttagcagatcccgtaacacatttttagtagggtgaataaatgtgctacaaggatacagacagtaacacaaacatgtgctacaaagcacctcgtaacacataatatatgagttgcacaaatatgttacatgtagatggtttatcaatcttacaataacacactatatgattatcaaaaatagtgttggctgtgattcttgttcaatattgatagattaataatttgatcgtgttggtaaagagtaaagcatggggataaagcaaaattatcgaaatatatatccttgaaatttcactaattttgtcctagatattgaaacaaaaaattggtactatttgtggaaaaaaacaaaaagatttgaaaaattataagagtagaaaaaaaatgtggagcaccttttctatttttatgtcacaaatgtcacaaaaattacaagttgacgtagagttctagaatatattctttatacagacaatattcaggttagttcctttctatgagttcaaatcatccaacttatttagtcattatataaatatgcatcatacaagttagaaatctcctgtaaccactcacattttgtaacaagaaaataaatttaccatcagacaatataattgctcatttctcaaagtccatgttcacagtctaggaatgcacagtccaaaagacttaaatagaactagaacaaagctacagcctacaggtaaagggggaataacatgaggcattgcaacagtacaagccttgcaaaatcacagctacaactaggtaaccaatagactgcttgacgtaggccttgccacatgtgaaaacttcatttgttctctactgacttggataactattaagtttttaccattctcttccagcatcttgtattgtttattcctttccatacctgtaggagcatgtgcatgacaacgcggttttaatttcctagagaaaaacattatggtcaattcagttgcatttaaaaaggataacaaagctatagagttcaattttagtgtcagctaaaattagattaaaaaaacagtctttactttccacacatacaactcaatgcattctagttgggttttgcagtatgtaaaaaagatagattggctttatgacatttggtgatgcataaatgtattaagatatttattaaaaccaaacacggcctatacgaaatctaatacttggagttctcactgcatgtatattgtgtcattcaaaatcttaatcaaatgaaaaaggctatggtacattgaaattaatgattctgataatccaggattggttgcttatatttgttcctccatatgaaacaagaagcatggcactgcagagagaaggtaccaatgagcataagtactataatataaaaatttcagaccacaacaggaaaacaaaagaaaaggagcaactgatagattttttttagtacatcttctatatataaatttgaatttagaaccaaaagattatcttgagcagacactacaaaattatcttgaactagtacactgaaaacatataagtaccttgaatggagctaacaaagtaccaaagtacctcagtgccaagtccattattagcatcaaccattgttccttcaacatcagctctaacccagtgttgattgtttgattgatcgaataactccccgaggtgtgaaacatgaaaaggctcagcttccatctcatctatccattcctctttgccagtatcatatatgtccatgggtttcattttccttactacagaccaccctgggttcattgggtcatccacataaaacacttgatcagcttggttaggaagaataaaaggctcatgctcaattttttctcctgtatgtataagatgtgagaagttgacaagtgtataatcatatttgtcctttttaattccttttccagaaataacatccacccattcacatttaaataagaccactgaaaattttccagagtagttcagctcaataatatctattatcctcccataatatgtaacatcacctaaaattggattagcgtcacttgctttagtgtagctagatttttttgcagttagcacaaccccactattttgtgtcactccatccaagcgtttaggcctaaatctgaaaccacgagtgttaaaagcacgatatcgtttggctgcatcaagtggaccacgggctagccatctaacatcttcgttgacaatgtgcaagccattcttccgctccagatccattatctgtacagtgagaactcatttaggtgatgacttgagtattatatataaataatctgaaattctgtacttacatgtgctctaaaccattcatggaatttctcattttgtacacgctcaatagtttttggattgacaccacgtcgaggatacgtacttgcaatctgatcagcatgagctctgcaaaatatttataatcaaccttcctatcataaaaaggataactaaacatgctttaaggtgcaggtcataccgcaagtacttattaacatctgaacaattgaacaacacatatcgatgtgcttgtactttagccataccccttataacatagttgctaggctttccaagtggttttccaacatgagaaaatattgatgatccttgtttcacaataggataactatctagctcatgtgtatcatcattcctcgaaggacggttatgcttagtctcaaaaccatcaagatatcgtgaacaaaaaaccatgcacttatctgccaaatatgcttcagccattgatcccttcggatgagctctattacgcacatatgacttcagcacaccaaggtacctacaggaagtcaggcaacacaaagaaaaaattgtgttaaatatgttgctgtaaaataaagaatacatcctaatatttgaaagagagaaatacctttcaacaaagtacatagtacgaaaacacgcaggaccacctaataatgccccagttgctaataaatgactaaccaaatgcaccataatagtgaaaaacccaggtggaaatatcatctccatatggcacaatgtcaatttaattctctcatctaacttcttaagctcatctatataatgtacttttgcatttagttctctgaaatacccacatagatcaaataagacagctgtaacattatcaggaagtacacctcgcaaagcaagaggaagaagttcttgcataagaatatggcaatcatgacttttaaggccagaaatttttccttgctcaacatttacacatcttgagatgtttcctgcatagccatctggaacctttatgtcatgaagtactttacaaaattgttgtttctcattttttggacatggtgtaagaagcaggaggcaagtaatacttgtcattagcacgtctttgtggatgcaactacgatctaatgttcatatcttgcagatctagtctagcttgtaaattgtcctttgatttgccctccaatcctaaaagtgtcccacatatattatcacatacattcttttcaatatgcatgatatcaaggttgtgacggagcaaattaatgtcccagtaaggcaaagaaaatagaccactaatacccttccatgtttttgacttttcaaaatctggaacttcttgtatcttctttagagttgaagttcgagaatatgcaagatgaaaatcctttccaggataagatggaccaggaattattagagaaagcattagagaagaagctttcatgcataaccatggcggcaaattataaggtattaagacaataggccaacaactataacttgaactcatcgttccaaatggattgaaaccatcactagccattccaaacctaatattatgagaatctgatgcaaactcgggaaactcagaatcaattgccttccaagcctctgaatcagctggatgacgcaatgccccatcctttacacgtccctcatcatgccatcttaatgctgcagctgtttctttgtgcatgaaaagcctcttaagccttggtttgattggaaagtatcgcaacaccttccttggtgctgccttctttctttccttcttagttaatttagttttatcctttttgtttttccatcttgaagctccacacttagaacaaaagtcatcattagccttgtctttccggtatagttggcaattatttggacaaacatgaattttctcataactaagcccaagttttccaattatcttcctagcctcggaaaatgttctaggtatattgctaccatttgggattgcttgttgcaaaattgctagcaaatcattcaatgatttattgctccacttgttaatggattttctatggaacaaaagcacaaggaatgaaagttttgaaagttcacatcccggccaaaaaggttggtcggcctctctaattaagtcaaagaaagcttgggtttcagggttgtcacgaccggaaataacccaacgggcgttccttacgtgcgtgtattatttcttgtcccaggaggcaaggtacaccaaaagttgatacaatatagagtttaataagcgaaagtgtaaataattaatttattacatgggcggcgaaggcccagcacacaggaagacaaacgaaaaacagcggaagactagggcgatgaccacaggcgcttgacggcaggcacgagctagacaccaaagccttcatcttccaggaactcctcttctgggtttgggaaaaattgagcaagactgagtacaaccaccgtactcaacaagacacacccacaagtgcagtataaatgcaagggagtacaagggacttataatatagggggttagggtttgcagtaaacagcattaaaagacacttagttgctcaaagctattttgtaaacacgatcctagagctattcaatattattaatcaaggccgtgaacccacacgaacctgccttaacccaaggcctacgatgattcagaccgaactggcaacccgaccctgggtcccagctcgtcccaagccaacccaggccaaccattccatattttagttgttaagcaggttttaagaattaaaacactaacttgggtacattgctaggcttgcccataaccgagggcgcggctattcgaatagattatactctgatcagaggtgtacatctttacccacaagacacatcttcctcacgtgtaaccacatgccacataccaccacggtatacggacggaggacgtgacatagtttccaacccatcctagccatagacaagagtaccgacccaaccccacctacggccggaacctccgggacaggtaggcaggactgagcccttagcagcaggacaccggccctgtgccatgacatctcgactaccgggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgaatccaaatccacaataatccaaccgttccatagtgtccaggtgatgagaatattcccaaagtctagagttgtaaaaccacctaatgttgcctaattaaccagcgaagcatctacctaaatttatactagtggtaccatgaatagagtatccactagttgggggttttgtttattctagggtggacaaggtaataataacaataacaataataagatcataacaaaggtaaataggcatggctaaataaaacagtgataacgcgggaatttaaataaagcgataatgcaataatttaaatcaaaataattttataaactggaattcaatatgttcaaggatgatgtgacttgccttgctcgctttcccaaacgtcggcttcaacctccacgaagagcggatcttccgaagctgcagcgtctacacgactaacggaaaggaaaaaggcttttactctaataaactccatataacaagaaggaacaaagcacaaaaatgggttcttgacttcttaaggaaaaattagagacttgaacggtccaattccgagttcaaatggccaagttatggccatttgaagtttatatgctctttaaatgaatatttgcgaatttctttatttaaattttaatttaaaaattggtttactgcgtcagccgagggggaggggcgcgcggaccgggtccacgggagtggggcccacgcggcagcctcacggtccacggtggaccgggtgcacccgggctcacaccggctggcgccgtgggccccacgcgtcagccgcacccgagggcgcgggcggctgacggccgggccccacgcggcagccgctcgacgcgcccgaaggtggccacatcggcgtagccggcgggaggcggcgcgcccgcgcccctatggtcgccggcggcggccataggcacggcggagcggcggccgagagaggggagggaaagggggaaacgaggcggcggtccacggctcaccctaggtcgacggcgacgacgaaaaaggctgccgaagcggaggaaggcggcagcgcggctcgggtcgacggggtcggcggcgctccggcggtcggcgagctcgacgagggggtggacggggatggcggcggtgcggcgaagccggagaaggcgacgccggggcgggaaacggtcccggcgagcggggagagccggccgaaggtcgtcggcgatggaggagagagagggcgacggcgcgagctcgattccggcgaggagacggtgcggcgaggggcggaaacgggcgcgggaggtgcggggagggtttaaatagggttggaagggggagagggcggccgggagaggaaggaaaccggccgggaggtccggctgccatcaatggcgccggcgagatttgcaggagcaaatccgcccgtttgaatgcgagagagagaggggaaaatggggggaaagggagaggggatcacggggaatatttccccccactttattgcacgcggggacggcgggaggcgacgggattcgcggcggcggcggcgtttggcgcgggcgaggcaatgggagcggcgggagggaggagatgacaggtgggccccacccgtcagcgagggtggcgggcgggcccgcccgtcagcggcgcgcgcgcggggaggggccgaatgggccgcggggaagaggagagagggggagggaaatgggccggattcggcccaagagagggaaggggatttttagggtttttcttttttataaaacctttttaactttgtttatttcttaacaattattatttgtgctctaaaaattccactaaaatttatttacacattttaggcttttaggaaatatacaaaaatcctctaagccttatttggtcttttactttgcacattttaatttttggacgctttcacacggattttaattattctaggcataatttaaaggatatattttagggtcgttttgggacgtaacaagggtatggtcctgtttcaaaggaattttggcaagtagatgaattcattggatgtccattatccatatgcccaaaagcatctatgactaactggtgcatattagtttttgttttttcttgcaactgtgcctctctgttagcagagatgaatgctgcagtttcaccatgacagccccaaattgtatattcttttagcattccatcacaaactaaatgatcatacacttcattccgtttccgtaaccaccttagagcacatttgacacatgggcatcggattttctctccagaacttttcccattgtatgcaaaatcaagaaaaccatctacaccagtcaaatagtcatcacttggtctaggggaaagtagtaacttcttaatagtggctaaatcgacccattccctgtgtttaaaaaaatatagtacttattcaaatagggcaagcgtggtagaaaaaccaacaagtgcatccaaacacagatgaagaaccagtgttcttgttgactatcgaaatgcaagaatacatggggagggaaaccatacctggtggattggtgcttggatcctttagcccttgtctccataacaggaccagacaagctgcagggcagcaggcttgtctagaagctcaatccaacgggcttcagggaaatggtttacccaaagaaactaaggattcagagttggcgcctagcaaatgagatatgaatgaataaaaaatttaaagcataaaaaatcctttgtaaagtaattaagcaatgctattttcttctccattgcaatttgcaaatataccagtaaatcatatacaaatctcctcacaacctcatttgtcactatacaataaagaacagaatagagctcactcactggatgcaagcaagcctcatgccgcaagaagcaatgtggcaggcaatgagtcaagttggggcaacgagcaagctggtagcagctcttccttggctcctgcctactggtttgtccggccggcacacctgcacgcctgcacggccacgcgctgcgcgcccacgcttgcaggctgctgctgcgcagcccacttcccttggccgcctcgctccggtggtcacctgcgcagaggaccgacgaagaagagctaaactgccgttgatcttctgggttgggttgtggtgtccaccgaactaagataagacaagatttggggattttccttatacctagcaagcatatggtgtactggtaggtgggtggtgtgagaacagaggtgcttcagtgcttgtagcttttcagagatgcagtaatcgaggaggtaggagagttaagactgtttctttgttatctgtcctcagtcaaaaggacttggactgttggagggaaattttctctcccgtgagaactttttctttctctttcttgcccatacaagattaaataaaatttggaatacaaaataaaataaaatcgaaaattataaataaaaacaatataagggtttaagtaggaataaaatttaaaaactactgaaattcgaaattaaaaataagcaaatttgaaagaagagtcaatataaaaacccaatacgagattaattaaaatttaaaataaaaaataaatccaaaattagaaaataaaaaagaaagttcaagtagaaatacaattttgaaacaactgaaatttaaaataaaaataatgaatattaaaagagaccatataaaacacaatacaagattaattaaaatagatccgagaagaatgaatagataatttcgtatgggtgctaaccacacaattgagcgggccaccctactagtttagatgaaaatggataattttcagatggtaccggaaatggaaacgaatactaatataatcttttcagaaacaggaacaaatatggtaaggccattatccatcggaaataggaaatggttggaaactatccggagttctttttatggatatccgcaaatagtaactaattttctttatatgcataaccttttcatatcaagtgggatgaagacaagcttgtgttaaccgtgaaatttggtatattccattaagtaattaaggaaaacgtagagcaaagtcgacagcgtgaatttagggtctaagattgtatcagctgaggctgatgggtctatatcggatggaatgcatcggctgcgagatgatagagttagacgacgagggatggatgatggctgaaagctcactctttgtcggacttggttctggaaaagatagtggtgaatgttgaaaggagactgagtttgaagaaagtacggcaatgctatttatcgattaattttaggataagtttattattttccttttatgttttaggaaagtttatctcatgcgcgaggggatagctcccatctcaagtagccgaacacaatgtaagtcaaccatggtcagagaaacaggaaacgggatgagttggacggaaagggttcttacaggaacagagggaagatttggggtgctaataaagtaaattaggaactttcagaattataaaacaaaaaaagagaactttcgatgccatagaaccaattttgtgaatataaaaccccctcaaattgagcttcctaaatatagaacttcgaatagtttccaaccatttttgatttccgctggacaatggtcttaccgtattcgtttccatttccaaaaacaattacaaaattaattttcatatccgctactgttagaaaattatctatccgagactatctatttccgaaaatgtgtccgaatatcggaaaatatatgaatcatttttatctctaataatggctactaaaacaggccaagtctaaagttcgatgcaccaatcatcgccacgcactcgcgcggttgccttgagctacttgttttatataggaccaccgatttattttactaattcaaaaatttaaaatttatagtacgcattcaataaaacaacaatttgtaatataatacatcggtatgaaaactaaagtaaattatccacataagtctaaaaaataagaaaaaagaaaaaataatattaatatgtaccttaaactgaagaaaacaatattaatatgctacatggttggttcttgtttagataagcattatattgtagtgagtacttagagtgctgtagtaatttttagggatcaaatttaaaattttaaaaagtctaaaatgtttgaacatgccatttcaaaaatctccagaacttgaatttttgcacacaaatctccctctcaaaatacttcccgctaacgtgaaaccttagcttccctccaaaaatcccaagcaattagtgtgtcccttcaacttcccatgcaccataaataattgctgcctcttcgtatccttaacccaatcgttctcacatttcctcattccccgtcctcccacctgaacaaactcccccatctccatcaagagcactgcacacagcatggcttctcctgtcctccagaactatgcgtctcctgcacatgccctgtagcttcaccatgaagacatgttgctaggctgcttgtgacttcctgagacaatatgtaagtgtttttttcttctcttgctcggttatttgtaaattattctgaggatttgagggactatagggttctaaggatataaatcacagggtagtccgatcacttatcattttcctctccatattctgtgactatttatgggctttgcatgaaaagcactaattactataacttcattttgtagcatattttccagaaacattgcaccaatttccaggtgaaatggcaagaacgaaaaggttgaatgtagtaaaaatcagtgccaaatacaagagtggagatggcaatatcagtgaacataacccattgcatgagtcacaagcactagaagatgatgagatcgaactagagcagcaagatgatgactccttgaatatgtcaggtacgaatacaatgaagaaagctaaaactagtaggaccaactaaatgtttatattgaaaaactgggcttagccactactgttcttgtttaattttacaggtgagagtgccaaagaagacaaacgtggaaggacaactttaacacatatttggaaccttccagaaggcaatcacatagtagtgaagtgcaacaagcttggacagcccattggagcagaaggtggactgttaggaaaatttttaggcacagtggcaagaaatgggtcttactgtccatttgacttgaaggattggagattggtcaaaaagaatggtggagctgaaacaatacttcaacttgtggaggtatgtgtgactgagcaaaaatctaggcatattgctctgaattttaaatttactgctctgccttttatctctttcccacatgaatataatttacataaagcagtcataacataaaaaacataacatatttatttacttagtatatcttactgattttagacaaagttcttgtaccctcaatcgtgcaagcaatggatattgaagtcaacagggagagattggaggcgattcaaggcatcactaaagacagcttattttcagcctaaaaagaaaagatctgctttgtataagttgtgtccagaagatatcgattatgatcaatgggttgaacttgtcaaattttggaagtcaaaaaagggaaaggtgatacaactgcacattatttcgcttacaatttaatactctgccaatctaaattaatgatgtatgatatggtctcattaatagtgcactgtgtttataataggccctttgtgagaaaaataaaagcagtcgtgccatgatgaagacaacacataccgcagggacaaagagctacgctcgttgggctaaggacatggtgagtaatcttgttttattcaatgttgtcctatataagtcactcatataactggtgtatgttctattattttcagagacaagatgatcctcaaaagaagcagccgcatagagccatggtttacttagcaacccacaagaaaagggccgaagatagaaatgaacacctggtatgctatacacataatatgctactacaattaaaaacaaattattatttgatctgatccaatttttctaaactgttaggctgagttggaaagcctcatggatgaacaacctgagctggatgaagatgatcaaggaagagttgcatggaaaggtgatgccttacatcaagttttaggtgaagagaaacctggacaagtgcatggtatgggactacttccagttcccaaccatgtttatggccaaacatcacaccatctcaggaacattaatatcactaccgtagagggtacaccacatgaagtagcgatacatattattgatgatgtggagaagttaaaggagcatgcacagaagcaagatcagcttattcaacaactgcttaaagaaaagactgataggaaaaacaaacaggaaaaggtgtccttgaaaaaaaaaaagctaagaaaggtacaaattttatctgaaccttcatacaaaaattagttctaaattgatatctttttcaggtcaatcgactaaaaggatatcatagcaactctcagctacaagcagtacattctaaaagaaaggtaattgttatagcttccaaccaataatgttattttggttgtattattcttacctttgtttaaatttagagagtccaatgcgacgcagctgatcgagaagacctcctgagtcagcaaagatatccattcaaggtaatatttgttactaaattgattcttgccccataattcatagtactcatatgtacgcacgtgcggaaacacaaccattaactctaattaaaaaatattgtgtctacatttaactaaagaatcatcaaattctgatcgactaacaggacatatatgaggacgatgacttgtcattctctactgaaaaggttagcaaagggcactacaattattttatagcaacaaaaagactataacaatatgataaatgatttttatgacaattctagtatcataatgatgcaaaccaggaagaaccccattatcaagaagcaccaccatcaccatggtccgctcattcctttcgacaagaagaggtaaatgttttcagatatagtgtgatatatatgcgtcaaataaaatattttgttgtcactctctagaagtaaggatacgacatgatgaaaccctagcaattgtcttggaactagttaattgccttattttgtctagggtgtttcagattaagcatttaaatacctgaaaaaatataacaaagctgcaggcattgtaatttaatagatctatttgttcaataattttctactgtatcacttcaataaattatataatggttagtttatagtattttatctattttgaatacaagcttacttttctatatttgtctaccattacgagtttagctacatcataatgtacacaaaatttgttcctatttatgaactaatctctatgtatataaactccccaattttatttccagtatgaacaaaataaactatcttgaagatagccaaatgatggcatcataggtacatatttttgtagatataaaaaaaataccatactgtgacttttttgagtatccatactgataccatgtgacaaatactatttatttcactgtagatggctaaagaagggcagaaaatgttcgtaaagagcacggacaatgcacatgatcaagtgattcaaagccgtgtgcgttcaaagaagacgcgcccttcaccaatggaggtaataacactgtgttccttttgcattactgtgtgtgttaaatgttaaatataggttgttgactaaatgttaaatataggttggttccacagtattactcatgacagcaaaatatccaaataaagaaggcgtggcatatgctaatttgttgagctgcaacccatattcacatgtaggtggtgttgagataggcaaccatttttggaaagtacgaatcaaccatcctattcgtaaaaatgaggagcttgtaagaccattggatcattgcaagacaattaatgatgcccatgccaaaggagtggtgattgcgtggccttcaatatgtgtatgttagttgtttctaccttggttcatgtaacttaatgttttgctgtacattctagcttaacaaccaaagtaatgtttgctacgtgcaggtttggaagattaatggttgatttcgcttccatctcaccctatggattgataaaccggcaaagactttcaagaagaagaagaagaagacgaatagattatcattttgttatattttagtatgaaagactgttattctgaagacttgcttttctcaaatggattatcatttatgttttgtaatgatgggaaggatgttttaactattttgttatgcaatgcaatctttattttcactaaatgtgatgtgagtattttgtgagatatgtggtgcttttgaaagaaaataataatgtcaattaaattttgttcctttaacctgatcgtgtgtgtgtgtgaatatgtatatactaaagtttgttcccacaaaatgtattggaataaggaaacatgttgctaatcatattacatttatgttactacaactcaaattatgtattcctggggtactatgcagtatcacataatatgtgttcttataggtgatatttgtgtgttacaaggtagcaacacattcttagttatatagtaatacatgttatatgttgcaacgtattgtaccagtaacatggcctacaagaacacttatagattgtgttactgggaacgcttgtaacacctatactgatatgtagtaacacatgtacgtgttgccaaagccccttcctgctgtagtgagcaggccacaggagcgtcagatccgatagtggcgatcctcaggagtacctcagtaggtctgcagctatgggtctgtcagtggtggggcttggtgccgcagtgagtcctttggctaggcgaccgtgatgacgaccacaacaatggcgtggggtcgctatcggcaggtcagggcagttttaggcaaaattttgtggtgaatataggtgaaattttggggattttttttgtgtgaattgctgtgtgaagtacaagaattttggggattttgaatgtgaatttgaatttagggacttttttttttgctgaaaatgcatcctatagacgagcttcataatatgcctgcatgtggaaatgcatctccactgacaggtgtcctagtacgctctcgcctgtgattttgattttcaccgccggctgtttccacgccttaaaaattactccctctgtcctaaaataagtgcagttttgcattattcacaacgtttgaccgttcgtcttatttaaaaatttatatgattagtatttttattgctattagatgataaaacatgaatagtactttatatgtgactaaatatttttaaatttttcgcaaattttttaaataagacggatggtcaaatgttgggcacggatatccacggctgcacttattttgagacggaggtagtaacgatttctaagagtcgtttggttataggcagtgctcagatccttctgcgaaaactccatttgactgtctagaaaattgttttttatgggtggtgtttgaatcttctaaaagatgaagataaagattaagtggttcacgtaaaatgatgtggtaataacatatgattaattgagttttagttattataaacttgaaaaatggattaatctcatattttagaacaactttcatatagaaagtttttatatgaaatgcaccatttaataatttgaagagtgtgctatgagtatccaaattttcatccacttgttaaagaagaaacaaaggggaccatagtcttgtatctactgctgatcctgaccctctactgcgcgtgccaattctacttacaatttcaacgggacaaggaactactccctccgttttgaaatgtttgacactgttgactttttagcacatgtttgaccgttcgtcttattcaagaacttttgtgaaatatgtaaaattatatgcctacataaaaatatatttaacaatgaatcaaataatatgaaaagaattaataattactttaaattttttaaataagacgaacggtcaaacatgtgcttaaaaagtcaacggcgtcaaacatttcaaaacgagggagtaattaacgaaactcgtcttcccatcaccgaggttatagctgggtagcataattcccgcagaaaaactatagaacggtgtcccgtcggagggacaatgtagttaatcacgttcatccatcattacacctgacgcgtggtgcgccgagctgagaagatcgcacgacgcgtgcgtacctgtctagcgaaggggagagcaacgtcgccaaatgtgcttgtgccaacctcaaagctaactagagggcagcagtgtgcaggctagtgtcctagctactattctttctaagtatcacctgcaaaatagttgcaaccatcccagaccaactcttctcctattatcttcttctcgactttcattgcttgtagatattattcatatgtatctatatgatatatatctcgccctttttttggtttttcttcaatttgttttgcgaatttggtcaaattttattaaaatttaatcaaaatttgttaaaattctaaataatttcgtgcaaaaagttccaaaagtcttgaaattgctgaaatttagatttttttctacaagtgttaaccctggatacgcctacaatatgtattatacagattaaatatagacgatacccatgaaacctatatggtactatgatatctcgtggtacctccaaatatcatgggtaccagtaccatggtaccttgtgataatctatgttacccagatacggggatacggacacggatacacgacacggcgatacgacattttccaaaaattaaggatatggggatacgctaatatatataaaaaaaataaaaatacagaaaagtagtaaattgaacagggtaaaaatagattgtgaataagtgctagaccacaaatagtgcatagaccacaaattaatagttcaacggtatatccaaacatcgcaatgaccatataagttcacaaataacaagttcacatccagcccacagggcacaggcacatagctagtttataaataacaagttcacagccacaaatagaataattaggatagaccgatagacttgttcaagactataagttcaattcaataaacgaacgggaaaacagatcggcggtgacagtgctgtgccgacgtcagagtaggaggcggcgaggcacagcccagtgcgcggcgccggtgcagctcggcggcggcgacggttgacgaggcagcccggcagcagcgacggcactggagcgcgtgaggggcgttggtggtgacagtgttgggccagcgtcggaggtggagagcagtgtggcggcgccggcacagcccgtcggcggcaatggctgatggggcggcggcggcgctggagcgttgggaaagagaggcgagagtgagagttgagaggcggcgcaggctgggtggatatgatgccccccacacgcacgcgggttttgataccgacgaaatattagggttaaacgaatcgggaccgtatcggaacgtctcataaatgtatcatgaattactttatttattttaaaatcaggataaataccgatacgtcccggacacgtatccggccgtgtccgatacgtgtccgtatccgatcccgtgtcggacacagacacgcgcctgctttgccgtatcagtgcttcataggtgataattccttgaatgtaccatagtgcttacacaacgggataccgttgcaacgggatattttaagtgactgtcccttttccttttctttgtccccgtgtgctccctggtacctgatacctggtatgtccacttgtactctctggtacctgatacccggtttgtcacgccccgaactagtcccgaccggaactagcccgtgacgctccaaattaacctgttaatcgataccagtcccaggaaacagtgctggtatcacagggagacagaatatcacagcaacaaaggtctctttattatagagtagatgtacagtcatgttgggctgcggacagatcccgagctcacaactgcattacaaaaggaaagcggaagccaggacttggaccaatcaacacaggcgcgacttgggaactaggccgaaaccctaaaactcatcgtagccggcttgctcctggaagaactcctcatcagcaggatccgcttcatcttcttcagcaactgggggggaattatttatatagagcaagggtgagtacgggagtactcagcaagccatgggaaataagtgtttaatgcaggcttcaaggaaaggctggtgtttttgcaattaattttatttgaactcttttctgaaacaactaagtgagtgcttctcaaacgacacggatgagacagtgcgtctcgtccggtcggagtatgtgcaatgtatcagtctttagaatttaaacaaggttggcacccggccaacagctttttcaacggccacccaggccaacaacttttcaaacggccacccgggcctacaacttttcaaacggccacccgggcctagctgatcccatcagctgcagatttttcaaacaccgaaccccttttcacacagcaatttcacaagcagtagtcaaaccaaactacgctaggaatcacctcacatccgcccatgaccgtgggcacgactgttcgaacagtttgttaacctctgcagagggggtacactttaccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggacccggtccttaagtgcgagagcgggaaaacgtacactgatgagctactg

SEQ ID NO: 70430 - DNA, 765 bp, Oryza sativa
cgtattgggtttttatatggattcttctttcaatattgcttatttttaatttcgaatttcagctaattttaaattgtatttctacttgaactcttcttttattttcttttgctaatttcggatttatttatttttattccaaatttttattaatctcatattgagctcttatatgcactcttcttttaatattccttattaatctcatattttttattaatctcatactgtgtctatatgaattattcttctaatatttcttatttttttattcctaatttcagttgttcgtaaaatgtatttttacttgaactcttatatttgatttttctagtttctaaatctattttattttttattacggatttcaattaatctttaattgtgttctacatgaactcttctttcattttttattgtgttattatttcaaaatcaaataaaaatccgtgcacatgccatcatgcttttctggttgctgacgtgtgcatcacccaaatacggctcactgtgcagccgcacggcttgacccgctgcttcggatttccgtcgctcgccgctagcatctatcttcatatcaacaaaaacgcatccaaattacggttctacagtggttcgttgcccgctgctttatttatatatgtgtattatagcctaattcatctctaactctagttaattggtttaggaaatcggacaaaactcttttgagtctgtttgcatgtaaaggccctagctagagattgattctaattctacacgcgt

SEQ ID NO: 70431 - DNA, 2791 bp, Oryza sativa
atccttatttttttcgctcacaggttttctcttaattaccttttttttctcttttttttcgatggtgcatgaaaatactagtactatcttatactgtcgcttttcctctttctacgagtgtcagatatggtggagttcgagttcccaatgcttcagttggcccgccaaagccatccaatttgccgagacggacaccccgcgcgcgacgccacgccaccgcgcgcgaatttacgcggttgcccctcggtggagtccccttcgccgtaattagcccctacaaggaggggcagtctcggcgcgaaacgttgactcccctgcactcccccaatcccctccacgtcaacacggccctgccacgtcactggcgaactcttcccctgctccccggcgtgagcggagcaggtgcggacaaaacggcccctccaccatactaccagcaccacctgacaatttgcgttctcaccccaagttaaactcgtaattacgtgtagccccctcctaggctcaccatttataggagattttttttttcaatccggtacttgagaagggttggaattaggatttggggttcttccttggtgcctggtaatggctaaaataatccggcctagcgcacggtgcactcacgaacgaacgactgcctcggccagtgggggcgtactggtaagaaaagcccactcgttactcgttagtgctgcctccgcatcatctgcttgctacgctttcctttctcctaagagcattcccaatagaaaccacggtagcagtggtcttatatgaaccatatagcctaagagcatgtacaacagcgggctaaaagtcagctgtaaatatattttaaagagataaatgagaagaaagagggcagtgggctatagatttgtagccagctgtagcatggatttcaagacatagtgtgtgtatgacaggtgggactagatattaatagtgtagtatgtaactattgtatgaatgagctattagattggctatagataaattggagctagtagttggctatactattgaacttgctctaaaatcatgctatataagagtaggacacactacttctattgaaggttacttcttaatccccccgtttcataatataagcatttttagagttggacacggttattaagaaagttggtaggattaaatgtgtgagtatagtattggaggataagtagagataggtggaaaattaaatagtgtagggttataattggttgaaaagagaatattagtggagaagttatattttatgataaattttaaaagctataagttgttatattttaggacggagtaagtaaatattacgaaatctgaggatactttgcgaagataagcccatcccagcccacaaacacaagcgctgttttcctctcctacccttttctttattttattcggcccactccccctcctttttctcgtctcctccgccccagcgcccggcgcctccccttctcttcaccgccggtcgtcggcgctgccgactgcgccccacgcgccacgacgactcagccccaccgcgccgcctccgactccaccccatcgcgccaccgccgactccgcaccaccgcgccgccgactccgccccaccacccgtcgcctccgctcttcgccgcgccagatccggtgggccgcgccgtcgactcctccccacggcgccgccgacgactccgcccctctccctccgcccttcgccgcctctctctccctccgcacggcgagaggtgcgcgcgagccgagccggagggggaggggagggggggagggagcggcggatgccatgggcagcggcgcgtcacggctgctgaccgcgtgcacgtgctcgcggccggcgccggcgtccgtggacgcggagccgtgcctggacgacgctctcggccactccttttgctacgccgccgccgccacggccaccgcccactcctcgtcgttccgccacggcatctccggcgccgcgctctccgccaactcgtcggtgcccgtcccgctctacaacgcgtccgccgccgccggcggcgtggcgccggggtactcctcggcattccacacctcgtcgtccttttcctccgcgccgctgcagctgtccaacctctcctcgggcccgctgttcctctcgggtcccatcgaccgcgccggccagctctccggcccgctcgaccccgccgtgcccttctctggcccgctccccgcaaagcctcccaagcccgcgtcctcctcatcgagggggttctcgaggaggttccggaagccgtccttcggcagcctgcggcggagcgtgtcggagaagaaccgcccgtgcgccgtgccgctccgccgcgacgacggcgtgcagtgggcgcacggccgcgccggggaggaccgcgtccacgtggtggtctccgaggatcagcggtggctcttcgtcggcatctacgacggcttcaacggccccgaggcccccgacttcctcgtcaccaacctctaccgcttcctcctccgcgagctccgcgggatcttctacaaggaggccgacgcggacaacaagaagctctggcagtttctcgtggacggcgacgacgacgacagcgagctcgacttctcgggctctggccggttcgcgctgtcactcgacagctcaaggagagtcggtttcacatgtgggcgcacgccgcggtcgacgagagcaggagggaatggggttccaggaggttggcaccggcgcctgcggtgagggaccatgcggcggtgctagccgctctcacccgggccctggcctcgacggaagcgg

SEQ ID NO: 70432 - DNA, 522 bp, Oryza sativa
aacaggtaattgtgatactgtttgagtgggtcagccattcttttaatttgattcttatacttacgatgtttgttttgtgtggtatacatatccatcttcagagcaagtgcatttgttgtcagtactttgtacttttaactagaaactatatctgtcatgtgttctgattaatccaatgccctgattgaattaatatagacactagataattcttgatcatagaacttcgtgtatttgtgcaggcaaaattgaacaatggattgttagagatgttccgcaatgattacattggtgatacaccgtatatatcatgcacaccatcgctttgccatcacaagctcactgcaagggatcagtttttggttctttcttccgatggcttatatcagtacctgagcaacgaggaggtagttttgcatgttgagaatttcatggagaggtttccagaaggtgatcctgcacaaagtttaattgaggagcttctctctcgtgcagcaaagaaggctggtaggctctcttcta

SEQ ID NO: 70433 - DNA, 806 bp, Oryza sativa
aagatccttcttcgatcagcttcccacttatcaaatgcaaatcttctccatgatagtagttgactactttcttaattagcgtgtttacatatccgtcactaagatgttttgcacaactagccaacatatacttacatgtgcataatgcacacacatgtactagtataatatcatagaagatagactcattttacgtccttcgttataagttattatatatatatatatatatatatatatatatatatatatatatatatatccttcagtattggtagtaataatgatcgagtagcgagcattgtaaagagagtctattaactaacacaacattatctttttacgagttactcatatgtggatccattatgttatagcctctcaaagtttctcaagcattggaacagctaatcatagtttgtcgcgacttgggcatagtatagggagggcagccagctgcaggaaggatcaagagagaaggcaggccaactggaactgtgggcgattccttggtgccgctagccgccgcgccgcctgctttattttgtcgattgtcgatcagtctgcccacaaacgtcacccatgtactgtccatctactgtacgtactgtactgctacaatcaccgttactcagtggttctacgtactactagtactatacacacgcgtgacacgttcctttgcatataggagtactactgtacacaaattcttactgaaattaatagtacagtgtgtgttcctttgcatatattccctccctcccccataaaaaacatatttttgagtttatatgttcaacatt

SEQ ID NO: 70434 - DNA, 1901 bp, Oryza sativa
aatttaaattcaaactgttcaaaagaaatgttatatagaaaaatgaccaaactaaaagttgaaaatcttgataagttatacaactttattgttgacattttttccatttgaaatcatttactacccgtaaaattgttttgactcataaaatgaattattatactgcacttaattattttcctatagtcaacttacaaatataaacatttcatatgaaaaatataaaaatagtcatcggtgacgggctttagttaatgcccgatagagattaagtatatagcccgtcactaatgagtcatctgtgacgggcctgttgttatctcaaacgggcctcaagttatggcccgtcacggatgatggtcatccgtgacgtgccacaacttgaggccgagatatggaatgttatctcaatcgggcctaaactacggcccgtcattgataggtgtcattcatgacgggcttaagttttatgcccatctaacatgtctgtacgaccatatctcaatcgggcacttttcggcccgattgagatgactttcttatgacggcccgctatttctaagcagattagagcccatcacagatagaaggatctgtactagtgttaacaaatcataaattaccatcctactgtggtttgtcttaaaaaaccgacaagcacaacactaaaatccactataatatatatatgttgctttgaaagtatggtttctgttggcattaaattaactaagaatgtttatagtcaatctatgtatttatctaaccatgatcgatcaaacaggtacaaaatagccaaggacattagatcgggtctgctctacctacatcacgagtgcgacccacatatcctgcatagagacatcaaaccaggcaatgtactcttggatgaaaatttcaacgccaagctcgccgaatttggcctatcgaggatggcaaaccaagacaatgcaacgttgctgacaactgccataggctcggaagggtaccttgatccacagtgtctgaaacacggtaaggtcccgttcaagcgtagctcagacgtgtacagcttcggcatcgcccttctcgagatcgcctgcgcaaggaggcacagggagcaaatctgggacctataccgaagaggtggcaatgttgtcgaggcggcggatacaaggttaaccattggtggtggccttgatatgagagagatagagcgtgtcatcgtattggggctctggtgctctgctttggagactcaacaccgcccttctatgcggcaagctatggatgtcctggagcgtgacggaccgttgcctgcccttaacagcttgatcgtcgtcaacactactttggcatcaacgacagaggaagacgcctccagtgcgccggcggcgggcaatcgctatgactgtgatgaggcaccactgctgattgaagggtagcagggtgagccatgcatgaccttaactgctggacaatatctcgtaagcaagcacgcatgcatgcttggttcttacaagagctgctgatcgagtgctgagtgcaaattctcatgttgtcactttattatgtaattgccttctttttttaaaaaagaaaaacttgcacggggaggctctttatggcacgagggagcaacggggaggccggggagtggctgttttggggcggcaacggccggcgacgtgggcgacatcttgggcgaaatggagctccatcccggcgtgatttttgggggaaacgtgaggagagtgtggaggaggtggaggggttgcggttgctctcggtttggatgcgagcgcgcgagtgagaggttgtgaaaacggcggcgtcgtgggcggcatggcggcatggcgtggttgggcttgggatggctggggattggggatggcacgtggggcccatgggtcccacctgtc

SEQ ID NO: 70435 - DNA, 2718 bp, Oryza sativa
cgctgcactcgggaacaccaccggccgccggcgtcgttgccttccggccactggagctctggcgcccctcctctccctcctgtcagtttgctcggcagtagaaggaagaggaggaagacgacgggaggaagaagaaaaggaaaaagaaaagaaggcagacactgacaggtgggcccctgcacagtaactcttcgtattttctctatttaattcaaatcctaatctttagaagcccatatctcctaaaccgtagatccgattccattcaaacttggacctaaattcatataaattcaaaatctatattttgataccaaatttgctattttaagattctgtttgaatttccttaatttattcaaatactattagaataaatatttgattaaatcttacaattgaatttacaacttaaatttatatttgcttttcaaatattttattttattccaaattacccctttagccactaaaaagccgccggttggaactttacgccttccatggggatgttcgcggtttactatcctcgacgtcggaccgttggttgtaaagcccgacaaaaaccaaacctaaggtcgaagtgctgctcctagcaccccacgccttgatgcgtatagcggtcggagcttcactattccctcgacctccacagcacgccgcacagttagctctcgggctcttttgatcttagccgctccgccgccactcacggttgtcggagtaacacttccgccccaccaaacctacaccaacctcatattcctctagccgatatactgtcggtcgacaccggctagagaagacactaaatctagtcattatgctgccaactctagcaacgactagcaaacaaccaaaccctagccgataccttgctagtcaaatcccagttgtcatccaaattccatactgtcacgccccgaactagtaccgaccggaactagcccgcgacgctccaaattaacctgttaattgataccagtcccaggaaacagtgctggtatcacaggaagacagattatcacagcaacagaggtctctttattatagagtagaggtacagtcatgttgggccgcggacagatcccgagctcacaactgcattacaaaagggaagcggaagccaggacttggaccaaacaacacaggcgcgacttgggaactaggccgaaaccctaaaactcatcgtagccggcttgctcctggaagaactcctcatcagcaggatccgcttcatcttcttcagcaactgggggggattatttatatagagcaagggtgagtacgggagtactcagcaagccatgggaaataagtgtttaatgcaggctacaaagaaagggctgctgtttttgcaattgattttatttgaactcttttctgaaaacaactaagtgagtgcttctcaaacgacacggatgagacagtgcgtctcgtccggtcggagtatgtgcaatgtatcagtctttagaattggccaagattggtacccggccaacatctttcaaacggccaaccgggccaacaactttcaaacggccacccgggcctagctgatcccatcagctgtagatttctcaaacatcgatcccctttttcacaacggcaatttcacaaggcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttcggatgaaaatccaaggaaacggtccttaagtgcaagagcggaaaaccgtacacccggtacgttccccggtccgcggttttggaaattcatttagttcgcaagcaccgacccaggtgtcgggttttccaagtcttttgtaaaacccaagttttacccaagttgtttttcaaattttaagtttgaaggcgaccgtcgatactcgcacagagtgcacgaatatcgaggcgcaactagatggttacaagggaacatggtataacaattaacaaaggaaggatcaaatgcaacaaactaggtaggtccgccaatctgccttgtagacgggacaaacagattaagtgcgatcctatcaatgcataatatttttcaagcaacataattaacttcaaatataggctcaagatgttcaaaggtggcttgccttgctcgagatcttgggcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaaacggatttacggttgggaagatattgaatttctaagattattggatttttggtctaaaggaaaagaatttaattggctgcaggaa

SEQ ID NO: 70436 - DNA, 1557 bp, Oryza sativa
ctctctcacagattcagaaaaaaggaggaagagagcctctcgatgggattgattcccctctgtccagtttcagaacatgagtggacttcaactatctttgttggacagtctaaaaaatatcagtacatgttacactggcttgtatagaaataaaaatgtttcatcactgcacaaatgcattagttttatatatatatatatatatatatatatatatgccaacatcacagaaatgtgtgtgctatgagtaaagttatgatcattagattgatagttggacacattttatcaagaaaaaggggggacaggcaagaatattgacaagaccataacaaaatatcctatgtatgtaaccatttgatgttgcaacttgtaggactcaacatctgtacccaatctttgagagagtatttatcttttggctcttgtcaatggaatctatccagccagtgatattggggcattgataagctgaatcgcaactaaatgcagttgccctcttacacacaatggtcctactatagctatatactaactgctctttctctcctggcttgacaaacctgtctgcagaaatggaaatatcatctacctatagatgggataactaccagactatcattgcaatcttggaaggttcttcatctcttgagagattgaaaatgaaaatatgaacactaaaagtaacaacctcaggacatgtgtagtttatatttcactaaaaaaaattctaatgagacagcatacagtttccacaaattgtgttgttttgaaacttgatgatgacgtgctggtacattagtagaatagggaaaccctctttcacctatctgagatttctcatttttctatgtactgtttgaatgtttcaaacatttttttccaatcttaataaatgcagatcccttagcttttctatacaaagtgcattttcaacatagcaacaaagaaagttttgaagtgaatgggaatgaatgtgcaacttacaaaggttatcatacacaattgacttcttccgatccttcaaagcatttcgataagcatcgtctgcaaacctcttcaagaatatctcctgcagttacagatttacaggttcaagtgagcgatataacattaaccaaatcagctttggacgaggaatggaaaaaataatgaaacactggtccgtaatgaatatcacagtaatctgacagaataactaggtaaatcatgaaaatatattcttcagattctatcttaatatgccctctataatattctcattgccagtatgccataaaccagtaacatatgcctaatgcatcagagaacagcaacattttagcgagttaccaacaaatacaaacataaaacaatcgtgcataaaccctcctgccaaaagtttgatggcagcagaagcagagaaatcaagctttggacttctgagacaacctgtaacatctaccatttggaggtagaaaacaccattcgtgatctgtgatcatatcagacaattcatcaaacaccttgtgggcgatcacagcaacgccgacctaaatctcattagcttaactagat

SEQ ID NO: 70437 - DNA, 1369 bp, Oryza sativa
agtgcctgcgaccaaggtctcgaagagcggagaaagcgatgctaagactaaaaagattcccctagatccttctgatcccactaaaactgctgtaataggcgccgagttagattgtaaataggaaagcgcgctcgtcacctttcttcaaaataataaagatatctttgcgtggaaaccatctgatatgcctgatattcctagagaggtgattgagcactccttgcacgtcaaagaagacgctaaacctattaaacaacgactccgccgcttcgcacaagacaagaaggatgcgatcaaggaggtattaaccaagctgttagcagcaggcttcattaaagaagtcctttatcccgactggctggctaacccggtcctagttcggaagaaaactgggcaatgacgtatgtgtgtcgattataccgacctcaacaagtcttgccctaaagatccttttgggttgcctcgcattgaccaggtagtcgattcgaccgccggctgcgagctactcagttttttggattgctactcggggtatcatcagatccgactgaaggaatccgactgcttgaagacttcattcatcacgcccttcggggcctattgctacatcaccatgccattcggactaaaaaatgcaggagcaacttatcaacgcatgattcagagatgcttctcgacgcaaattggccgcaatgtcgaagcttacgtggatgatgtagttgtcaagactaagcagaaggatgatttaatctcggacctagaagaaaccttcgcaagcatccgcgctttcaggatgaaactaaaccctgaaaagtgcaccttcggagtaccgtcagggaagctgcttggttttatggtgtctcatagaggcatacaagccaacccggagaaagtcaacgctatcctcaacatgaaaccgccaagctcccagaaagacgtccagaagctgactggatgcatggcggcgctcagccgattcgtttcacgacttggcgagcgggggatgcccttcttcaagatattaaagaaaacagacaatttccagtggggacccgaagcacagaaggctttcgaagacttcaagaaactcctcaccgagccaccagtcttagcctcgccacacctacaggagccgttgctactatacgtatcagccacctcccaggttgtgagtacagtcttggtcgtcgaacgtgaggaagaagcccatgtccaaaaagtccagcgaccgatctactttgtcagcgaggtcctagccgactccaaaacgagatatcctcaggttcagaagctgttatacggtattctgattactaccaggaaattatcccactacttccacggtcactcggtaacggtggttacatcg

SEQ ID NO: 70438 - DNA, 2334 bp, Oryza sativa
acgcagcctgtacgaaggtgccctcaaagcactgaacgaaattaagggcaaccaattacaatcttctgttaataacagcgtggaaggaaagaagaatctcgcccaactcctaatagacaaggagaaacagcccaaacccatgaggccgatgaatatcagcaactggaggccaggatatagtacccacaagtcgaggccagaactcgcaagtgctcttttcgaccagaatataattctctctgacggaactagcttcgccttggcgctgctaagtcgggtaatgaaaatcccaggagaaaagtccaacattacgacgcccaaaaccttcagctccgaatcccctggcttcgataggtataaaagacttaagcagttgattcctgaactgaaaaaatgggacaaggaggacttctctatgtcggaaatgctggaacatatcttcatggcatgggtgcgtcttctgatgtttgcgtcggtccgatgcacaagggattcccatgccaagcagctcgcctgtggcggcgagctcacaaccatcctctggatcctcaatgaacatgctggcgtatttcgcattgatcacagggatggcaaaaagaaaaagcctgaagagttcttttcctactaacatgctggcgtatcatatttcgtatttcgtactagtgtatttttaactgcagcaaattgtttaggactccatctcgatattttgttttccagtgtaactcactttgtatttgcagcgttatcaatgtatgcacaaggaattaccgtgccgggagcccgggacaaaagtttctgtaagattaatgaaatttcgaatggatgcaaaggttagttaattaaaacaagtaattagcaaagttttaaacgtgaacaattacattacttagacttcgataatcgcaagctatagatgtgaaatatatatatctgaggaagaagaaattcaatattagcagctttaattagtatggacatttaatttttcagcgaaaagtagccatatatagttgaacgaaactacatttggtggcactctgccaaatcaacatttctttttcatgtattcttgaagttgccagctgattgggccgacttcgatctgggatccttggaaatttaacagaaaagttgccatatatagttgaacgaaactagcttttggcgcatgttattagttaacaacatttacccgctgccgtcacatgcaggcacattgagcaagtcacgaggtactatctccgtcagccgccaaagacttggtttatctgccgtcgttttctcaatttcatgcgttactatctccgtcaatatacccccgctccgccccaaaataaaacagaacattttatttttaaaaaagtggatacttgtaaattgtattatttaatattatgcctgtcaaatcatttgattcatataggaaagtattttcgtgatgctaattttgttgttgttgataatatataatgcaagaaactaaagttcactataatattacatacgttagggtcgtcgtcgtcctccgtcgacttcgctaatttgattcgcatgaatttactacaaatgaatattagtatgatattttatgtgtatggatggaaatatatatgcttgtctaggccagatcttattatttagttttagatgtactccctccgggttgataatacttttcgttgataatacttttcgttttggacaagagcacggtctccaaaaataacttttacaactattttctattataatttatattgaaatatcaataaatatgtgattttattgaagtactttttaagactaatctatacatatagttttcatatttgcaagataaatattttaaaaattatttatagttaaagattttaaagtttgactttacccttattcaaaacgactaatattatcagtccgaagggagtatatataggggtataatcacttaatcaggaaacgagggttaaagactaatattggcagcccatttttgaccgaagaaatcgtatggccgccgaaaacattatgttttcttgtagtggtttcagctggatggcaaatgctgtttaatttacacccgatgtgttatcgagttccttatcattcaatttgagctctgttctgtaggtactctcgtcttcttcctcaccttgttttggcggcatcgcgcttccaacatcacctgccgagcatcgtctggctgacaaaatattttccagctgtgggattgtctagttttcagctacatgaaaatgtacacatattgacttttaaatggctaggaatacaccaagattcgtgcactacagtaaaaatcgatgctcgaga

SEQ ID NO: 70439 - DNA, 2094 bp, Oryza sativa
aggatggagaggatgcatgcacaggatggagataagggaggagaagaaaaattgataaggatgggagatggagagagagaggggctgtgcatgcacaggatgcagagagaagcgccggagacttggtgcgcgcgtgtgggtggacgtttttcttcctggttgttaaacaaccgggacaaaaatagatctttagtcctggttggttacagaaaaaatccacaagcatacggatataccattatagcatttcacccgggagtattccagggtatcgtatttatttaattctaagggaagatattgaaagagagaaccatgctaatgattatatacatatatattacttgccttcatcaaagcctagtaggggttaattcagcatatgggtagagtgacacgaagcgaagcttttagattccctctaataatgatcctaaactaagtagtcgcttttagattccctctaataatgatcctaaactaagtagaaggagaaatagaaaagaactcaattcctatacttctaatatacactcaatctttagtctacaattgctagtatacaatcatgtggccaatatcccctaatagtgccctcctggtgtttcgagagaccaccctgggttgccgaattccttacgacaacctgtcatggccgtccaaccggggctaaatacggaggaatttgtcttaggaatatatactatcgtggaggaagacctgtactgagctatcatcatcagcggcccacctctacagatccgtagcatatatgcccagataatgatacttattaatctaagtacctcgtttacattaataaataccactctgggaagctaaccatacaattaatacgacacaaatgtaaagtaaagccgatactcagactaaacaaagtaccgaaagtatataaagaagaatatttcattaatgctggaagtcttacaaaagccgatagaaaagatactagagccatacccgaactctttcgaagactccgaggactccgaaaactattctattctactttagttagcacaaaaactactaaataaagtgtagagagaaatcttgagcttgcttgactgtgttgagaagtgaagtgagctcctccttttatagggtcggtatgacggttatggagaaggcaaaatgtcctttctgcccctgaaccgtcattggcaagtgatcctggatgaccatgtgtagggccagccggagccacagctgccaggggttcggccgaacctgggtcggcccagcaggcccccaagtacagtagagtggctgacaggtgggtcctcatgatggttatggtagttgatgcagttttcaggacggttacacctatcatgtgggcccatcttatccatatgcttgcttaggagtgagttttcctcatttcttctcattttatttgctcagtacatgcaacaaattattctccaagtacaagtggaactaaattatttcaaaacaaaatatgcattatgagcataaccaattctctattattttagttatattagcggtcgaaattggtctataacgaccgtcaacagggatcaattttagatgaattttgcaagttgaatggctcaattcgttattcatatgaactatatatgaattttagaaattttgagccatttaaatggatttctggaattattatcgatttatgacgcaattaataattattttacaaagggaaaagccgattgctgatgtcagcaaggggagaggtgtggaccacatccacaaagggcaggccccactagtcagcggagccaaaggtgctagtcgaccgtggaccgagtccacagtggcggtgcacggcggaagggtgggttggctcgctagccaacccgactgggcggtggcggcgccagcctgacgaccaccggcggcaacaccggctgtgagtggcggcacggggagcggcggaaggaaccgagaaaaaggagatgggtgctcaccgaggggcacggagatggagggaggtggctggcagagctcagggcgaaggaaggcagcagcgctccggtgatgggcggcgccctggaagaggcggacgggcttgccctcgat

SEQ ID NO: 70440 - DNA, 6590 bp, Oryza sativa
  unsure (1)..(6590): unsure at all n locations
cagctctctccacccgatatgacttttcgggtgaaaacctagtccaaggtggatagcctccatggaggcaccgcctcgaaggtcatgttccctcgcattcattgccttcttcctagtttggccttctgcgttcggttagtttcgtctctaggttggtgtaagaatgagcagatctttccccctctctctctctctcatcctcatcctcaaacctcctgtgagggtggccgggagtctgtcgtcgacattcttggtgaaattggtttgaagcgagagcgtctgcgacctccttgtagggctagcaattatcggtcacgtacaacgggtgtgtgtttggagcctgtagcatgtggtggagtagtcttttttttttccctaattatgaccttcttctgttgtaattctatacataatttttttcatgctatatcaatatgaatcttcttgtgttgtcttgtgcgggtcattcagaaaaaaacactattagtaagtgggaaactagaggccgaccggaggtttctttctatcgttgggagcctctctgccttccgacctccatcgaattgggtgcagaccagcagcagccaataattaaggtcgtcggccgtatatatgatgatggagaatagcagggagcagcagccggagtcgtcgccggcgaacaacaatagcaagaagaagaagaagaagaagacggcgtcgcggttccggcgtgtgtgcgtgttctgcggcagcagccccgggaagaaggcgtcgtaccaggtggccgccgtgcagctggggcagcagctggtggagcgcggcatcgacctggtgtacggcggcggcagcgttgggctgatggggctggtgtcccgcgccgtccacggaggcggcgggcacgtggtgggcgtggtgcccaatggcgtgctgccacgcgagctgatcggcgagacgctgggggaggtgagggcggtgggaagcatgcaccagcggaaggcggagatggcgcgggagtcggacgccttcatcgccctccccggcggctacggcacgctggaggagctcctcgaggtcatcacctgggctcagctccgcatccaccacaagcccgtcggcctcctcaacgtcgacggctactacgactccctgctcgccttcatcgacaaggccgtccacgaaggcttcgtctcgccgcccgcccgccgcatcatcgtcgccgcacccaccgcctccgacctgctctgcaagctcgaggaatacgtgccgccgccgcacgacgccaccgcctctgagagcttcaccttgggagatgnntnccaccggtatctggagcagcacgccggaagcatctactcccccaagcccgacatggcacgctagctagctagctagctactcgatccacttcattattacttatcttgtttcttctcatataatcttgctgctaattatttcttccatatattaattccctatatatatgtatatatactcgatcgtactatattgtatacatcatcaattacttgtaacttcaattaatcctagctacatcgaagaggcaggcggccctagttagttttcctgtactagaagctagttaattttcctctatggagtgttattatgagttgattgagttgggagtattaatttgttctctcatcatttactagtacacacgttgttttgttgtcatcgatctctattactcgtagaaagggtaaggacctagactaggtactagaggaagcagaccgatccaactatccaagggaggaagccctgtgattgggaagcagcaattcttttcttcttcttcttcttcttcttcttcttcttcttcttcttcttcttcttttaaaggaaaactgcaaaattaaaatagagcaatctaatactcgtttagggcaccacctcatgactaatcaagtactaggtttctgctttctccgctttaagatatattaacctagtactgaattatacaaaatctagtatcacgaatagtccaaataacctgttactaaaaatatgaatagcctggtaataagttgtgtctaatctaatactatgttgttatattttgggtcagaggatgaagagagtacttactaatactatgttgttatattttgagtaggattatacttactaatactacttttgtgtgcatacatagcaaattagcaatcaatcaacttccttcccgtgtcctctttgcaacacgacaggtcctccatcgatctcacacgtggagagatagagagagagagaggcgcaattggagtatatcggcaacttttaccaacaaggacggaaggaaggaaggaaggaagaggaggtgagacaccaaccgatcgatcgatcgaccgaccaaacgaggtgaggtcgacaaacaaagaaaagccagccgtagtgacaacactagctagtcatcgtcgtcttgtccatcgagtaacaaacaaacaacactggcattctggcaagtggcaacagcatttctcttctcttctcctctcctgtggactactagctagctaggagatgtttttccagtgagtttcccctgaattctgatcaagaccgaaaatgacaattaattaattggagtaaaatcgatgcatgtggactactctctctctctctctctctctctctctctcactcactcagagtctcagtctccttccaggaagccctctcctctcatctcctctttctggaccaaaaatgagaggacctcatctcttcacacaagagaagagccccatgctactgctagtggatggataggaatatagacagggaccatgcatgctatctttctgtttggctgtccatgtaaactaaatgttggataagaattgtctggacatgtttggactgtccagataatagccagtaattaatatagggaggtaaagtcaattgctgttgagttcaatttggaattcaggcatatgtataataatcctcctaaaataaaaactagactagtatccctttctacctaatcatcttgactagctccgtcgtttatctcataattcaattcaattctgtgtgcatacatatttatcccatgatgcaacgtgactagtcacaagtatactagtagtagacagaaacaggcgcctacacaccaagtgaaaatcttttaactatttggcagctgctttccatacgtccaagtcagatgatcaataataggcaacagacatgcatgagtgataatatatttgttcagaatgaccttaaggcctctaattaccttaaattggagtatttgatttgcctatttttgtttctacaggctatcttaattaggtgttgatatttcagtagctaccctattatcatatcatatgtacctggctacgacttgcgtcctgcagcaatcatgcatatgcatcctcatgaattaatcggcatcacatattgctcaactgaccactagaaaattaagcaatgcatactcattgttacatgtaggaatgcgattaatttgttgaatccgcggagtagcttgacgctaacttagctagctcaagctctctagatagcgaggaagcaaaagcagctgcccaattcgattttgcggcccatgcgcgcgtccttttccttgtcgggtaataatctctcaatttgtcgcggtagtgcttaatttcccagagttgaccatccgacacagcagaatggggaaagcatggcccattcaccacctgcctaaacaagctagtacatatcatactcaaaaccatacctttctttcacacatgaaaaaaaaaacacctttcagctggttgtgcttctaatgagctacgaactgatcaatacatcctcgctctaacatataagttggcagaagcgttctaacctcgttagaggccgctgtacgtgttaatatatgtttgggaaaagcccccaaagtggcgcatacaatggtgaagattggttacaaaacagaaaacaaaatctcttcctatcttatcatctcatgcgttgttatctcacgtaacaactctatgtaacaaacctctatctctaacataacacactgcgtcgtaaaacaaaagtcgcagtagctggcatcaaataacatgacacgttttcacacatttcatacaaagtgagaaacttctccaacttcccgtttgcagtgcactgttcaggaggaagaggaaaaccgcatcaaaaatctatataaccatcatccaaacgaaaaatctccatactccactagcaactaacacatagtgcttgttttgggttccttccgacaagttgtagcctctttcaaaatcaaaagttccttcaaacagtcaaaacttttcactcagattctaagtaactgtaattatagaatccagaaaatgaactagaagccgaaaaagctaggtttctcagcttcttccggttctcacggactacttttccagttctcacggactacttatcagaatttaaaactcccccaaacaagcccctatacacacttattggagcccaaacgctcctgaagaatcaggcttgaatatgaaaacataaatcaaatcgtaattcgttcagaacttgcgttaatatagaaaaaaaagtgacgccaaagattcgctccatgcatgtgggtaatacacgcgggcgatccgactttgatacagactcgacaaatcacgagcgtcaaaagaaaaccaaacagcacatatgcgggcaatgtaaaaagaacatatttcacaaaatagtacactacgaatataagtttctatcctgaatcttgtccacaatacagaatgcggccgatctataaactaaactaaaaatcatgatacaatgttgtaccgtgatcatactatatgatggccccgcacacgcagcaatgttagcaaaatacaggagcacaagagctgctgtcatcacattaacctgacagctcatactgcaaaccaatggcagtccaaaacagctcttgcgacaaaattgagttggcctttcctattgactagcagaaatctcgcaatcagcaccaagtggaggtaaccgaaaataaaattacagcaggcaccttctttcaccaccctggaagagaacttgggcaatggggtgttgagggctccagaggtttggaggccaaagcaagaaatggaactggattagcaaggctgaatcacagaattatgaatcaaccatctcatcttgtaattcgcttggggcaataagccctggaatggcaagcattcgttgacgctccctctctctttgtgcagcagcctcttcagcatacaaatccttattatcctaaccaaacgaacatgaaacaactcatcagatgagttcaacagcaagtaacatgaaaacaaataaaaaatgggcacttgtgcattgtaaaggccctaacattaacgctaaacttggcacatgattccatatctatcgttttctcaagtaggcaccatactaccacgtggcaacatccactctctggtaattagcaactgttggtttctgataaactatgttcttactatttctggtatagtgaagtattggttcctctaattcctttgaattgtgaaaaatcaggtccatgccagtgtcaaggggtaggagcaaattacctgagccgagaactcctttgattgcaccaggaaatccctaatatggtttttgaagcttggaaggtcatgttttgaactaagaagcccatcaacaaattttgtaacctgtgcgggaaaagttgttaggtctatgatggccacagaagcacaggatagctgcaaaagaaggatcatacctcagtaggtgtcatgttgggaaatgatgaacctaaaagttttattgtgtaatctcggacaaacatagcgttgtcagtatattggtatggtactgaggatgcatcccagagaggctccgtcagaccatcaacctacaaattaggaaaattaataattaagtgtatccatacaaacaaaagagaacagataaaaatgaatattgacataccacacaaaataagtgctgcagcaccaaaacatgaagcttgaaaccaggcttgtggaatgtgtctgtcagaactgcaaagatctcttgttcaatattcaaaaaataagttttgtagaattgattttggaatcctgaggcctgcaagtgaatcatgtaaaaaaaacataagcaaacagaatattatgcaatggtagcaaattgtggattgtattttctacctgaaagttctttaaaatttccagcaatagactgagaccagtctctgcgatgtttctctctgtatgtctaaatgcccagttgatagagtcaatcacaagtttcaattgctgaataagataacaatccaataatcagataaaacagaagaatagaagataatatgttgatgtatctgaactcaatagtaaatttaaatcaacaaggaagaatgatgttttaaatagttggtactaacctgacttgaaagctgaattaatgcttggaagcaatgggtgccaatcgcacgaagcaaagagaaaaatttgaggcgatgctccgggtaatcttcaaagtttttagtgatcatctgacaggacagaacaaattattaatccaatctaaaaata

SEQ ID NO: 70441 - DNA, 706 bp, Oryza sativa
acaaccttcctccgccgcctccattactcggtgccgctccaggaagctcgccgacggcggacgcttccggtgatcttttcacgttttctttttcacctttttcatcttctcttcaccgcttatcaccacctaatcccaattaccatcctttttagatttttcttctcctttcttactcgcattttgtccatccatgaaaagtctctataagattttatactcccaactccaaaccacttcgttgacatataggttactactgctcgtcagccgaccattactgtaagagctgcttgtttgtttgtacagctagttgtctaatcttgatttgcaaaattgttaattaaccttagtttcttttttttttctttgatgcttgggtttaagaatgagtggacttgttgatgtgcatggactgcacggtacaggtcgtttgtacacaggattaaatgctggatttatgagtgagagggatctgagtagagggggataggagtgtatgtggctttgtgcacagggattaaaagaaggttcttgattgttttgtgtctgaaatgaattctgaatctgatccaatggtctatgaatactccatgaaatagcatcaattcaattcatttggtcagagctttcacatggaggcaggcagcgtatttatgggcgatggctgcctctgcctccattactcccttttctggtgcaccaa

SEQ ID NO: 70442 - DNA, 12845 bp, Oryza sativa
ttaatcggagaaaaagaaaagacagagtccatatagaaatacaatttaaaaatagctgaaattcggaattaaaaaataaggaatattagaagaggagactagagtccatatagaaatacaatttagaaatagttgaaattcagaattaaaaaaaggaatattagaagaggagactagagtccgtctatatagaaatacaattaggaaataactgaaattcggaatgaaaaaaaggaatattagaagaggagactagagtccatatagaaatacaattaggaaataactgaaattcagaattaaaaaaaaagaaatatgagaagtagagtatagagttcatatagaaatacaattaggaaataactgaaattcggaattaaaaataaggaatattagaagtagagtatagagtacatatagaaatacaattaggaaataatataaattcggaattaaaaataaggaatattagaagtaaagtatagagtatatatagaaatacaatttagaaaaaaaaatagaaattcggaattaaaaaaataaggaatattagaggtagagtatagagtccatataggaatttaaaactaactaaaatttggaataaacataataaaattaaaagtagagtttagagtctgtataaaaatacaatttacaaataactaaaattcaaaattaagaaaaacattggaagaagaatttaaggtcaatataggaatacaaatattggaatataatttagaagcaactgaaattcgaaattaaaaattaaagaatattgaaagatgagtttagagtccacatagaaatacaattagaaataataaaaattcataaataaaaatgaattaaaaaaagaaatattaaaagacgagtctagagtccatataggaatatatataatttacaaataactaaaatttgatattaaaaataattaataactaacacgtatataaaatataatataaatattacacattagtagttttgtaaagttattgcaaaatttaaaattatgttgtcattttaatatatttgaataatataatgagaaaacatatatgctattatatgagagaaaatataatgatgctagccgcgcaatctgcgcgggccactatgcttgttttcctaattggaagagattaaatgaagagagagagagcaaagctatctactaacatggagatagtctatagagaaaaaagaggcaatggattagagagctatagatacccatgtagacataccattgaaatggtttactattaatctagtctattgttgaggtgtacatgttttatagatagcaccttactttaccattgcgggtgctctaagagcatgtacaataagctgactcagcatgctccaaaacattttatattatctaaatcctacgtggaagaaagagaattgaagagagaaggaagcgagcgaccattctgtcgccagcgctagctgcatgtgcctgcgcgcttccgaataaaaaatacgctttgcggaccccacaaccaaaccgtctgatcccctgtatgttcccatcttcatgcctgctttttctcttccgctccgtcgaatgctaggcgaaatctccgccgcgccaccaaactgcgtcgctcacctcatctgtgttatttttaaaccgcaccaacccaaagcttcccctttcttacatgattcgatcaacccccgtgttcgccgcccttatggacacgagcgttcctttctaacctgacctcaattgtcaacgcccgataaaaccgtgaatcgatttatactgtaagtgctaaccactagcagagcttcaagattttataactaggccgacaagtatttgtgtcgagaattatattttcaggttatataaaagggcattatagttcgtcgtgtcgttacataataatggcataatataaggtgtgtattagatgtaatatataccaagtagataacggatctagtaccaaatgtactaggttgtaacatctccgcccagggcttaataggattgataggatactcatatcaacaatttgtaacttctttttcagaagccgatctcgaaagaacataggttaagcgtgcttggttgcagaaaagacttgtgttggtctgtgagggcagtctatggcctatgaaagttgccagatgtaagcgggcccaggccggtctgcgagaggcgggacgttgcacaggcctcaggtgttgggtacataaactctccgtccctaaatatttgacgccattaacttttttaaacatgttggaccattcgtcttttttaaaaaatttaagtaattattaattatattcctatcatttgattcattgttaaatatatacttttatgtatacatatagttttacatatttcaaaagagtttttaataagacgaacgatcaaacatgtttaaaaaattcaacggtgttaaatatttagggatggagggagtatttaccaactattacaaacaacagatccacgattagaaaaggaggtgcatgcgcatgcaatatattgcatatgcactcggtgtgaaatggcctacgtgcatcagtaatgatgcagctaatgtccgatcaatcgtactaaaagaacatcaaacactcgatggatgcctgccatgcaacctaggcatattcatcaatggcaagtgcaagtgcaaagctagctgctgccgctgccgctgcacacgctccactcaaaacaaatcatagcgtgatgcagaggcctatctactgtgcgcacacgagtaattataagtgctcggattactgtctctctctccgaccatgcatgctgttcctcaatagccgctccatctcctcattagaaaatctctttttttttaatatatactactaccatttcatattgggttattgtattttatattatagacaacttgtctattatttcctccgtcctataaaaaaccaacctagtatcagatatagaccacgaatctagttatatatctatccagatttgtagtactatgatgtgtctcattcggtactatattcgtttttcatgaggcggatgggagtatctcataaaatatacgcgcaccaagataacattaatttgaatattcttctttatctggtggatatataggcctaatgggaaaaccgccaccgcccgcctaaattgttgccaaccccttcggcttggccacatgtttctgaccctctgccccgaaacggtcttacctaataattttatactataagctttttaatatagaatcattctatataaaattatttaaatccaatcagtattagagcaggtacaatagcaagctataagccagctgcaaacatattttaaggagataaataaggagagagaagagcagcgggctacagatttatagccagctgtagcatggactcaaagacacagtgtttgtatgacaggtgggaccaggtattaatagtgtagtatgtaactattgtatgaatgagctattagattggctatggatgaattgaatctataaaatcgaactttcagtgcattaacttacaagaagatcgaggaaattaatgatgtggcggaaaaagaaaaacacgagcattcgtgattcgtgtgtggcccggacaggcgaacattccggcactagcccttaatttcgatcttgtggttaaagtttgttatggagatcgtgttgacacttgacagagtggcctaattggtttcttatgctgcagtgagagcgttaacattgatgtatggctgacacatagcacctgatcattaagcaatggtgggcccttcattacagataaaacgccccctaatttctgcattgaaatgaagtgaaattgactaggtactagagtatatgatccatcatcataatagccatgcacctgtgttttgagtgtgtgtaataataacatctatggcactgccactaatacttgttcaattcatagctaatctgtagaggtttttcaagtctgaactgagattactttggagcacttacaaaactagagaatcaatcgatgctctcttttttttaatcaaggatgtttatacaaaggccaacactagaaacaacaacgttaatatagatagacaaaatgcaaattattgatggagctggatataattcagagcagaggattcttgtgcagcgagacaggggtaatccctagcgataacttatatagaaatttgatggataaagaaatatagtagtacatacatacagtctacagaagaagagaagagataagaaaagaaatgaaaagaaaaagaagaaagtagaaaagcagagtccgtggagcagagagaagagcaggacagagttaatagttatcacgcggtaaattaattaagagcgggacagagttaagagcgggacacgcggtaaattaattaagattatgataattttgaataggacgaatgggcttgcgttgcatcgctggcgaatggcgatggccggccacgcttgcagctcgagtaaccttagctatcactctgctagctactcctacgccggctcctccttccgtcgcatagtataacaatttgatattgaatgaaatattttacagtacaataaatcttaacacttttttacccagatttattgtacggtaaaattttttatttaattgtataagttgctatattataggacggaggaaatagtacagcagtgagtagctaggagtacaaacttaattactagattaagtagcgataaatgaatatccaggtccagttccaggggaggggacgacgcgcactcctttctccagctgcgcgcgcgcatgcgctgtgctttaactctctcacaagacaacctaacctaaagcaagctaagctagctcctacagggagtatatagcacgccggccttgcacttgcacctcacctcgcctcccttgtatatatacactcactagtacactagtagccggccggccggcgagcgagagaggtcgagtcgagagagatcgatcgagcgagagctacctagctagctaggctataggcctgcacacacatacagctagctagctagcgcgctcgagacgatgctggcctgcatcgcctgcgtcaagcaggaagatggcggccgccgccaggacacgccgcgcgccggcgccggcgccggggacgacacgcccacctgcagggaccccgtcaagacgctcacctcccaggttaatttcttacttaatttattactactataccttcatttttctccttcctttttgtttgctgctgctgcttcttcttcttcttgttgttgttcttgttgcaaccggccgggctaccttgcttgcattgcatcttgtttgccatcgatctgcactccagcttattttcgatcgatactatcatctgttacttaaccatctgcaccaccgtaccatccattactttcttgaggctccgatcgagctttaattaatttattaattattagctgcgcaatatataaatatatatatatatatatatatatatatatgtgcaagttttttttctatataaatatacactattaattagccacactatatgctcagtgtattactagtagcacatcgatcgatctgccgatcgaggatttgatcacggcacatagagggttgttatgacacccggcacttaactccgatcctgtaccatcgattccttcaattataatcgggtagtactgtcttaattcataattaaataaataaaataaaattactagtaaatgctaactgagtacgtacgtactcagggtcagagatgcgtactacgcacatatatgtgcagtatatacatgtacgtatatggcgttcgcgaaaaaaacttagtacgtactgtatatatatacatataaagtattcgatgatttcaccaatccaacacaacgtacaatataatagtacctgcagatgttgtactcctacgtaatgagtagtgtttagaacttattaatttactactactacgtcactagctagatcgattgatttggccttatatatgtactcctacgtgtttgaaggttctctagcactacttacatactcgagactgattaatttcaaaactttacatcgtttgtttcactgtttggacggtagagtttgctatatatatacacctagcttttcctcttgcttttttatatgatacacgcaaggcaattaatatcagagtcttatactctctccgtactcgtaaagaaactcgtttaggacaatgtttaagtcaaacctttaaaatataaatcattaataactctcaagttgttgagtttgaaaatgtaaaaattatatgaatagatttgtcttgaaaaatacttccataaaagaatacatatatcactttccaataaatatttttatagaaataagaagttaaagttgtgttttggagaccgtgaagctgttcaaaatgacttctttttttttaagtacggagggagtatatatatagaagaactaggtagatagagtccccaattaattgcattacggtagtaattaactgacaaaaagtgagtgagagagatgaagctgcagctacataaattaatggacatgatgatgaggacggaaacgataataataatacagttaagcaaagtgtgatgctgcgagcagagcagtaatgatcgagagaggatgagtggctggtcggccggccggagatcagagggcgtgcccgtgcagtcgctttcgattgagcaatatatatatatatatatatatatatatatatatatatatatatatatatatatatatatatatatatatatatatatatatatatgcgcgttgccatcctctctcttaagtttactatatgccctaattaattactagcttaataatgtttttatacaaccggaatatatacccctctattctaaaaatacttatatttttgaatggatgaagtagtgcatagtaggttaataataatgccagtgtaagaagcaaccagaggtattaccaaacaagagagaagactgacagtacagcaagactacaagagagacgactgaccattgtctcgcttggcacgtcttccgaggcgtacgtaggggcccaccaaccctacccagggcatggatgatggatgcgagcgggcgtgtacggtggatgcgtggcccacgtgtcggaatcatggcagctcaagctgatgctgctgctgataataacagcatacgctgctgcttttcgcagcttcattgctttggctgctgcatgcatgagactgtacatgatacagatgatgcagtactagcaaaacacaaaagccaggcgccaatcccgatccatcatccgatctccatcgatccatcgatcaatcgacctaccttactagtattgcattgcagctagctactaatttactgtaggatcgatcgagtaacaactgtgatccatggccggccgtgggctccattgctcccagcagctgcctccttctgctacctcagctcatcgatcgaccaacagcatgcagacatcgatcgatcagatgtctgcaagcttcaacagatgaagctgctaattaactattagcgccaaccttaattaaatagtagtagctacctaatcagtccaacgtcgtccatgtatctctatcacttttctcttttcttctttaatcgatcgatcgatcggatgaatactatagtatactaacacctggtggccggtcatctgccaaaaagaaacgcatctcacttctctccatctctttcggcgaattgaagctttagctgagcatgacactgacgctagctagctatctttgtgccaaagtcgatcaattcttctttctcttttctctttttgttattattatgcttgtctactagaaacagaatactggaagctcacctgatcaatcatccggccagtacctgcctttaacttcaaagcaagtttcgcgccttttttgccccggcctcttcacgaccgttgttgcatgatccatcgccatttcaccaatgctttcccagctctcccaatctgaaacttttcagagtagcatatcacaagttagcttgcagtagatgcctgattcaatttaaccaatcacccgtttcacccatctgatcaaactaatccatgctttggcatcaatgtgaaaccagaaaagatgtgccccatttagtcctgatcaacatttgttttcacatttggacttgctttgaatccaatgttttcacatccatactttctgtaaggataataccgctaccggtctaccatatgaaaatctgaaattagatcagataggactagatatattgtttttaattagctattcccatagatgtagcagccagatggacactgcacttcatattatttaagctaactgaacacagttactaatatttgagtgatgtggatacagttagttagatactgtatatatgttcaaactgaaactgaagcgggcaacgagatggtcaaaatgaggggacaggtagcgtagtgtaggctgtggctgccctggttggtggatgatcacctttcactttgtgtcgtttccttggggagagatcctggaacaaattaaagcaaagcacatagtatgcgtcatctacatatgtctattgtttctttctttcattcctcccccacaaagagtggccatggactattcccttgttcttttgtgacaaagaagctttgtgccccaacttcccatagctatgtgtccatgtcttttgcttctcattttctctcttttttcaacaccaaagtatatgtagtataaggtatgctcagagcttcagatgagatattgatataaggatggggctccagcatgctttctttctcaaaaggagagattgagagagtggcactagtgcactgcaatgcaaataaagagatcccctggttggatggatggatggggatgttgcactgcatctgcattgctgcttgcatgcttcagttgttatcagtagcacggcaagaatctatgtgcggggatgttcattgtactagtacatgtttttaacaataacaatacataaaagagaccagtcctaaagtgatgcttgatatcatgaaaggggaaaacaaactgtagatgaaacatacaggcgcatggacagtagtggctagtaatggagttaaatagctaggaagaaaatgtaaatatagtatatacttgtatgagataaaaacatacatatccttgtttcaggttgtgctgctttatatatttacctcatggtagaataagaatttactaccacttactgtgtgaagtgtggaacaggtcgtatttactttcttcttcagtcttgatgaggtagcaatgcaagatggcattgtgcagtctgagctgaataaagattacaaattgattggctataggtcaaatagtggatcctagagtgtaagatagtctttgaaaatgtcattccctgacccctaaaggggaagcagcttcattatctagcattcatatttgaccggagccttcaatggattcactagctgcactgccaatagtaccccaatataaaatcgcccatttgaatgctgcagacagatttgtcgacaactagtggctattagtgcagatagttgcaagatgatgcgttaagcaataacttactagtagctattagctctagacctctagtttccagaaattctggttgtagaaccaaataccttgacaataatgcagataggaacatggatgatatactaggtagtaggactagtacctggcccaaagctgcagtcgtatgaatgagtccaaatcaagagctgaacttccctggaaatcagccagttggaagagtatacaacttattcagcaaatcatgatgccttttaagttgtaaccaagagtaatgcatccagatggaagcttaatgactgacacatacccagaatgagcacaaatgcgtcctgaattatgattcaatatattcagcaaaccatgatccaggtataatcttaacggaaggaaataacatccagaatcagcacaaatgtatgattcattatagttcttttcaggactataatgtgatcgaatagcacaagttcgatttgcattgcttggagaaagcgtttacaatttcttttactacttgttttacctgcagtgtagctatctgctgaatgcagaggcaaccatcaagggctaaatatctcatttcaatgcacctaatgaaccctgatgaagttgacgcaatgtcattttcgtcatcataggacaaaatcttgcatctgatcacattgatatttaagtatcatcctagtgttgatcatcgatgatcccatgaatccaattaggagatgatggatgatggatcatcaaaaattaaatgtgttattaattgttggtgtatgcagctcaaggacatggtgatgaagctgtccggcacgagccgtcatcacggtcagcagaggcgtggcgggtcgccgccgccgaggggccggacgacgtcggtgtaccggagcgggtactaccggccgggcatggtccaggacgacatggcggtgccgccggcgacgtacctgggcggcggcgggacgtcgatgagctcggcgagctcgacgccggcgtgggacttcgcgcggccggcggagggcgaggctcgggagtgggtggcgcaggtggagcccggggtgcagatcacgttcgtgtccctcgccggcggcggcggcaacgacctgaaacgcatcaggttcagccgggagatgtacgacaagtggcaggcgcagaagtggtggggcgagaacaacgagcggatcatggagctctacaacgtccgccgcttcagccgccaggtcctccccacgccgccgcgctccgacgacggcgaggtcacttcacttgttctttcctgactactactagtacaaatgtcatggtccccatgcatgatgtggccggcgaggcggcgacaaggcaacagcacacggccacgacggcgacgttgcctagcctagcctgtcccgttcttggcttggcatcatgcagtgatagatgctgatacgttcttgcctgcatctgcaactctgcatatggcgatgcttttacagaatattgctttcgtcgttgctagctagtagcttgcatcaaaagatgcaacgacgatttgctagctgctgctagtgctgcagagtgcagagcatgcatgcaacgattaaagctggtgatctatggatatcatattcatatatggccatttctctctctctctctctgcatttgcatgaattaaaattaattatttgagcagagggaatcgttctactctcaagtggggtcgacgagggggagccccgccgccacgccgtcgccggcgccgctcaccccggaccgcgtcaccagctggagcgccttcgtccggccgccgtcggcctcgcgccagcagcagcagcacagcttccggccgctgtcgccgccgccgccgtcgtcgtccaacccgtcggagcgggcctggcagcagcagcagcagccgcagcgcgctggcaagagccccgcggcggcgtcggacgccatggacgcggcgagaacgaccagctgctcgtcgagggacgaggtgtccatcagcaacgccagcgagctggaggtgacggagtgggtcatacaggacgagcccggcgtctacatcaccgtcagggagctcgccgacggcaccagggagctccgccgcgtccgtttcaggtcacaaccttcatttttctactactctagctacctatccctgatgtagtatctattaattacttcctgaatgatcagatgatctgctaattactatagatgattgattaaatgcgtttttgagtattgctgatgattttgttcttgcagccgggagaggtttgcagagctgaatgctaagctatggtgggaggagaacaaggagaggatacaggcgcagtacctctagatgatcactttgcattattggtaaatctgggaattactactagctaagctacaagttggatgcttccattttgcaaggaggaattaaactacataaagtttattttacaagtaaatagagtttgtgttccaagttggagctgggaaagattaagataggaggtgggaggtgaggggaaaagaaagggaaaagtttagggcattagtacctgccccaggtaatctgtgactggtgtaccataagttccacacatcaacatccttcagctttgttcaatccaatttctcttgagtatgcctagcaacttatttcacagcagaaaaaaatgtgtgcattttcctttcttaatttaccacctgtaaatgcaatatagatatagtgaagctacgaatcacacatgatagtttcatacaacagccaaagtgatccagcatttacaccgcatgttggcccaacgatcaaaaaaattacaatgtacataaatcggtaaatgtaagctagcaagattaatacagactagagcatttatcagaggcataagcataaacctgtacaattactaaccaaatgaactgcggtaatgcacattgacaccgccaactgatcgatgtctatgtgcaaactaatgtagggcatctgtagtacacactgtgaatgctccacttcatgcaagttcgcgcacacccttgtccagtggaatcctcaacagcaatttggataaatgtgaagaaaagtgatctaggacacgaccaatttgtgtcaaaacatgtaaccggcaaggagaggagaaaaattctggataggaagttaaaatagacatcttaaacccatcttttgtttctcctttggttcaaaagaaatcagtgaaaatatcagtatggtctaagatcacttctcttc

SEQ ID NO: 70443 - DNA, 1140 bp, Oryza sativa
ttttgctggttggtttccaccatggtgtgaccgtcctttgtgcgattgtggggatggatgcatactcaagtcttccctcatgatacaaactcggggcaggagattcttccaatgcgcgaactttgatcaggtatgcttcatctattcgaagttcaaatggataaaaaaactaacttcttcgtacacaattgtaacatcttacgcagacatatcgtccaatgtgcaacttcatcgagtgggtagacatggagaacccacaaaacgacggaacccgtgcttacccacgtagtgaaacaagatcggactacctaaggtggaaggatgagcatgaacgtcgaattgctgctgaggctttagaatggcacgtaaatcccctaggactccccacgtggcgtgagcgtccggagtgtcgttgtggtgaccgttgtcaggtcataaggtccgtaaggcaccgaactcgaggacaaaggtgtttcgtgtgtccaaatattgtcgacgatgatttcgtggtaattacaactattcttttcatcactcctcagtactatcattaacttaactatcccaaaatggatgtacatagaggatgtaaggaaatgtcaattcgtacaatggattgacacagtcagagttacttcaagtggcgggccgataacgcaacctgaaccgaccatacagttcattcatgcttggatggagtacgatcgggtggaaattgcaagcttagactggaggaacaatccattagggttacctaaatggtccgagcgtccaaagtgtgggtgcagagatcgctggcaggtggctacatcctttgctgaacaaacatttcgaaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactctatcatatcatggccagaagataacagagtcagaaacacaagtagagtatcaacgattgaaggaccacgagaatgcaatgcattctgaccgacctagaagatgccgataggttaccgcatgcttgattcgtcggg

SEQ ID NO: 70444 - DNA, 615 bp, Oryza sativa
aattttggctagtgaaaaaacatgacaataatctgatcttagttcggttcagtttttttttggggcctcggtcttttttgccatttctacctgacgaagtgacgatgcactagccagctactagtagagacgaggctcgtgttccgtacagcctcgtaaataatcatcgtgcggttgtgttcacacaggcaagtggcaacatattcaggggcaaacaatccagagttccagtctcggccttcatttactcaagcagatgtgattatatgaaggaatggttggttgaccacgactaagcgtagcagtctaatgtagaatgccactccatttctggatttccaagagaaagcgtgaggggcatctttggcgtgcacccatttccagggtcgactagcagcttgcaattaccctgcataaatagactggcgagtgaaaaagatgcggcgggctatatatgctgtcatgtagtattcctgtgcagataaaccctgattaaaaccagacaaattgctggactcggcactaagtttttcgtcgtttgccaattatctaaccaggtaaagtcacataagttactgaaacagaacacgagcagccacaccaaccgaccacaaa

SEQ ID NO: 70445 - DNA, 749 bp, Oryza sativa
cgtttcaattttacaccttataagttgctagaatcacagtcatctttaaaaaaaaatcattccgaaatgatgtattaatctgaaaataagttgtttcatagcaattccgtgcatctctattatgaaagactagattggctctacaataaagaatgacaattcaatgagtcaatgaaatatttgaagctttgataatataattctgcaagaagctctgtatgctactccattggtaaaaacaagtagataactagtgtcaacaaactaagaacaactaggtcagtatccaataaagcatattctgcaaggagggacacaaaactgtaggtcctcaactatagtgctcacctgaattactcactgcctctgtgagctcaagtgacttcaagtttctgttgcgtgctatttggagtctacgaccagttgctcggataagcatggcagctataaaatctacggccacaaaaatcaaactgtcttgcattcatgagtgtaatataaattacaagatctccaacatagttcaaaaagataatggagtacattggaggcttcattttttttatttggtctgaatcattacatggtaacataaaaataataagaacataatttaaaaaatcatcatagaaaatccttttcatccatggaaatcaagtggctaatactgttagagaatagagacacagatcctaggtgtaatggaaaaaattacataacaacttatttacctgcaatatatatgatca

SEQ ID NO: 70446 - DNA, 2778 bp, Oryza sativa
gcatgcagcagtgttggtcgtggttccatatatttcttggcatgcaacgatcgaatccgatccgagaaaaagctactactgtcctgtgctgtctgcagctttgttcacttgtcacatcgattgatcgtcccagctgccgacctcgcgatctgcaatttacacagtacagcgagggatcgatgcattcatcgatcgatcaaaccgttaattacctacagaaccaacgtaccagaaggcttgctagctagctgcagcttaattaattcactgtattactacatgtgtgttactttctcgatcagcttcttgcttcgtacgtgcttccatctccaccacaaatttctctgctatatatagcttgctttctgcggctgcatccaccggagaaaacgacgtatatatacagccagccgacttaattagttttcggtcaatagttctataagctagtaatatataatatctcatttaatcctaatactatacatatgttgatgtactacatatatactgcctccatctcgtataatagctacttctaacatttaaattttgcctcaaaatatatacattacctagctacttctccaactatattatctcaaccaataatcacagcatctctcatcatctaattattccacctactttctttattatctcaaccgatcatgatcattaatttcacggtgttccttaacctctctaaaaaaaattcaaaagtattactgtagtgctatactctctttttttttagtaatataattgtttttgttacatcaaggcttgactaataactattttgcagtttctaaaaacaacaatcgttttacatttatttcacgttttcatatccattggttatttgtaaaattttcttaataggaataaaattcatcctttcatttaatatatcacttgccctttcaaactcagtcacattagatagaaattacgaataataaatttggcaccctaccttatttattgatatgaatatgagcacaccaaccttattcttaaatttgtaccatgtgtgaaatcaaacttaaacatattttaaacattggtacttcacaaaaaaaaatgtgctgtagatttaaataaaagattgcacatttacttttcggggtgtgcgtgtgtgcgcgatcagatttgaacctctgtatttatggcttggtatgtgatttgacaatttgaatttagagtattaaatataattggcatgttatattttaaatttgtatggcataaatatgtgatatcattttaggaattacgacgcttaccttattaaacgttatgaattttaatgacactttaaagaatattaattctttccttattatgagatcctacccagaacaaggtaatataccattggattctagtctaatggacagtgaaaacatttggagcaccttaaaaaaaattccattgtttttttatataaaaacaattattgtaagtaagcaattttaacatgtatctttaattttgtgttaaatatatatatcttgctagagtaattattgtcaaagtcttgccctaacaaaacaaaataatacacaatatattttttaacgaaaggagcatatagaatggctaacgcatgccacactgggaatatggaagaattaatccgatttgggatgaattgattattctcgatcgtccctaagaaattccagtaccggcatatatatagtggcattcgttcttgtataccaaacaagtaattattaacttgcaattcaatcaacaaaagattctggtacataattaattgacacatttaactaaagaaaaataacagcccccaagtccaacttttgaatgatgtgtaattgccctcgagaacatttttatatcgataaattagttatagctaggtctcgatgaaatgctagcttaattcagcttgcatatatagaagcataaccacacttacttaaattatcttgcttggaccaaccaacaaaacaataagagggttgagggttgaaagtttttttttcagaaaaaaatattacatacatgaattatctacccaatccatgtatatatatatatatatatatatatatatatatatatatatatatatattctcaaagatggggggctgtacaatatctatatatatgtctatatgagcatattaaagcattaaagcattttctttttggggtaaacctcgagaaggaggacagggagttcatgttttatattaggaagaaaaaggagttggcctagtttatcatgggccaaaaaaccaaacaaccatacgattaattgatgaaaaatcggcaaataaaaacccaactctatcagcacataatactggtggaaaaaccatttttggtcggtcggccaaaatacacaatattcccggttgcaataaaaaccgggactaaagatatctttagtcccggttcaaaaggttagagttttttttttatctttagtcccggttggtattaccaaccggaacaaaagatctatttttagtcccggttggtaacaccaaccggaacaaaagatccctattatctttagtcaccaacaccaaccgggactaaagatctatttacagtcccggttggtgttaccaaccggaataaaagatcggcatgcgcaacatgggcggcggagagtacgaggccagatcgaggaggaggaggagcagttaatatattctatctcctcactggccttatctcttcctccatatctcttcctccatatctcttcctcttcctcctcctctccttttaa

SEQ ID NO: 70447 - DNA, 5647 bp, Oryza sativa
tgtgtggacgggaaaagaggatcggtactatggattatatagtgtgttttgatttttattcccggttagtaataccaaccgggactaaaaataggtttttagtcccggttggtgttactaaccgggactaaagatcatagagccctgacacagcctgacatggaatcaaccgggactaaaaatcatctttagtcccggttggagttaccaaccgggactaaagatgatctttagtcccggttggtaacaacaaccgggactaaagatcttcctcttattaaccgggactaaaaatcatttttagtcccggtttttaatggaaccgggactattgtggatatgggtcgaccgactaaagatggtttctctaccagtatatggcatttgaattagggttgattaatttctccgtgctagctcctaacccgatcctgacacttaagcttagtctaaggagctctctacttcccaaacttaattagccaattatacaatactatatattatcctgacacttaagcttaatctaaggattttctacttatggcccctttgatttagaggaaaaacataagaattttagaggatttcaatcctataggaaaatttcctatgaagccctttaaaacaaaggattgaatcctatctaatcctttgaaattcctatggaatggacaattctatagagattttggaggaaatttagcaagaccttcaacctcttgctaactttcctttgagtctatctctctcatccaattcatgtgtttttcctatggttcaattaaacggtcattcctgtgttttgcaatcctctattttatacttacattcctatcaaaatcctacgtttttcctattcctacgttttctcaatcctgcgattcaaaggggccttagcaaacttaattatctaattagaaaggtgactaaaatgagagaccatgattttatctttgcacttaagcttagtctaaggagttctctacttatcaaacttacttagccgattagagttagaaaggtgaataaaatgaaagaccataacatttttcaaacgaccaaatagattgattaacgttatattaatagaagggagtttagctgggatttgggttgggaagacttttccgctaatcgattgatcatcgcatttatactgttggccaacagtggcgactgcctggtatggtcattatcgactcatactccaatatgtttataccaactattatatttaaatggccagcagtggagtaataagtaacaatctattatttaaattatgataagattcactcatatatgtttatacaaacttgttactagtaagcattagatcagctgcagattggttgcatcaggtgtacgtacagaaatccttccaacaaaaagcatatgtaccatatgacaatatgtacttatgttgttaacttgttctagaattaactttccatcgagagatttaatcggttaatgacactcacgttcccctggtagccgttgtatatcattttcaggtcaagaataaactaagatatgaacatcacatccatacccatccgacgattaagttaggtggccaatcactcttaccatccatatatgcatatgctccattagttagtacggagtacttctttccaaaatagtataaacattgtcaagtaaatagccaggaatgcttattcgtctagttgcacaatcagaaatatttatattttcaaatggagggattactcaacttttacttacaggcaggggaagtcagtactgagtagctagctaattaccccgttgatcatgcaactatgcagtgacagattctgccagaatttggttcatggccgctagctgcagggcatgtgtgatgtccccagtttgaacagtagagagcagccggcagtatgcacatatgctgcatttaaggaggagttaggaccggagtaggagtactagtacttgtttattaatcactcatctattagcataatggtccatggtgaaagtacagcaaaattaggtgaaggtaacgtcgatattagttgtatagaatcatagaccatcttcccaacagtggtactttcagatcatctgtccttgtttccgtccctgttggagagcgacaatcggaatggtcactgacaagggacctctctgttgcccggaaacgacgaaacatccagttcagagttgcagacttcagacagttgccaaggatcaatggaaaattgcaactgaaaatgctggagactgcattgagattgaatattaattcctccaactataattgaatttcatccatatttttggaactagatgaatatgatatccataattgtttttaccctgggtaatctttagacctatgttatttgtttgtttttatgtgatgttcacatccatgttccatcaaaccatgtattcaacctgtattagaggttgttatttggttcaatgcttcaacttgccacacctctttagacttgtgtttggttcattgctatagttgtggcttacctatacttttttatcttgtctcgcatatcatagacttaatctttatctaattttaccatacttgtctagaatgagttatggcaatattagtaaagatccaaacaaccctgatcttcttattgggcttctcttaagtttatatgcaactggtcccttttaggcccgaaagcttgttcagtatgtgtgctgggccgtatggaaccatgacttatagaaacttctggcctgctcgggccctgagcccctgagcctattctttgtcgagactaattgggatgtggccttttgggttttcaggcaatagaacagtgtgagaatgctaccctcttatcctggcccatttattccacgaagctgaaatttattttagccttttgggttttcagaaataaaaaagattatgcaagtgtttgaaccctttattttcggtctctggacctattcagattgtagtcaaaataaaccttaccaatttttggcaatgccattctaaaattttggcaggatttcttatgtattgatcaaattttgcaacaaactaaatgtagatatgtttttggtaactttgccaaaaaaaaatgatgtgattgaaaatggcatcaaagtgaacagaccctcaataacggagtaccggcccatttattttatcattttgttccggcccatttattcctcaaagcagcagcctttaacgatgtatggcccgtatgaactttacggccttaatcagaggcacagtgttaagaccgtaaagttaggcccactacatatggttgagtaattcagtgttgccaccagcgccgcataaatatcttgggataaactaacttttgaatccagaaatagaagaaaaaaatagtctggacacatgcttgatggttgatgcaagctgatgcactcttttatctttacagagggagctccaggatacaagcatatgctagaattaatttttatacatacgtacgtaggtataaatatatggtgtaataacttaatatatagattttcctaacttgacaaaaagaatcggcgcaactaataattgaggagaaagaatttggcagctcgagaaattaaccggcctgcagacgagcgatcgcctagctaaccaagcaaccaaggcaatccgatccagcaatgctgatcaacgcccgtccgccgcctactttttataccgtgattctaaaaatcgaacataactattgttgcaattcattttttattttctagaagtcccgtcaaccgtcagcggctctgcaactatactcttacacaccccgcccgctgcttctcctttttattgtcattgagattttaaaattcgaatatgattatcaatgttgttttttttttaactttctagaagtcccggcaaccgcctttcatgtttgcttcacggcctgcctaacgtccttctttttaatcgtcattaggattctatttggtgttttattaacaatttttatatggcgtatcaaccgccaccaactctactcatttataggcatgttatttaatttatctcgtcatgtgttttagatggtcttttctttcaatagtctttatttttatcaaaaattttagttatttataaattttattcataattgaaatcttttttttttctaatttcagaatttactttttttaaaaaaaatagttgatatcgtattgtgttcttttaatgtttttatttttaattttcaatttcagttgtttcataattgtatttctacttgaactctcttttaattttttctaattttagatattattatattttttattcgaaattttaattaatctcgtatcgggttcttatatggattcttctttcaatattgcttatttttaattctgagtttcagttaattttaaattgtattcctacttggactcttctttattttcttttgctaatttcggatttatttttatttttattctgaattttaattaatctcgtattaggttcttatatggattcttcttttaatatttcttatttttaattccgaatttcagctatttttaaattgtattcctacttggactctcattttcttttctaattttgaattttattttatttttatttcgaattttgattaatctcgtattgggttcttatatggaaacttctcctttccttttctaattttggattttattttattttatttcgaattttgattaacctcttattgggtttattgggttcttatatgaaaacttctttcaatattgtttatttttaatttcaaattttaactatttttaaattgtacttttacttggactctccttttcttctttttctttttattcaattaacgtgagaatttctagtctcaacagcgaacgtggtgcctcctttcaaagctgtctttatataatataatataatagatataatagataggtagataatagcctggacacatgcttgatgattgatgcaaagctgatgcattcttttatctttacagaggagctccgggatacaagcatgctagaattaatctgtatacatacgtacgtacgtacgtacgtataaatatatgatgtaataacttaatatatagattttcctaacttgacaaaaagaatcggcgcaactaataattgaggagaaagaatttggcagctcgagaaattaaccggcctgcagtcgagcgatcgcctagctaaattaaccaagcagccaaggcaatccagcaatgctgaacgctgcgtgtatatgcatatgaacatatgatcgatcgatcgatcagtggatgcagatgccggggagcttccactggaacttgcccgagcgccgctcgtcgggcggcgccgccgtgtagttcctccagacgtcgaggacgcctcggaggtcgtgcatcttggcgccgaggccaacacagcagttggcatggagcgtgcagatcttgttcagatccttgctgagctgacagaagccactgatgtaggtggtgtcgaggaactggatggcgatgcccagcttcgcctgctgctcgtgcttgatcaggttgaacacgtcctgctcgtgctttccgaagaatcgccacctcccttgctgccaactccggtagaaatcgagggtcttgtcgttggatcgcac

SEQ ID NO: 70448 - DNA, 630 bp, Oryza sativa
ttacaatttattgcaaattggaactaattgatacattagccacttgatgagctcctctccatgtcctcaaacgtactgaaactcacttcttccagatccacgcttacgcttccacactcatcaccactaatgagctcgtgagcaagctatgtccctcctaatgctattaacctataatgaacgaaggatggacctaggcctgctcatcgtcgaccataaaccgtagagatggccgcctccaatcgacgcaagcgcagagctgctctagcttggggactatgtggtgtaggagcaaattgacgagatgcgagcagtgcgacggagggcggtactccataggctctatgttactgtctgtttgagctttcacaccaacccaacaagctcaagaagacagagagcaaggaagagagggaaagatagggaagaagcaaattgcccaaagtaaaacttatatgtaatctttttgggttcaaatttaaagtgttgggctgctcggctgttcctacttcctagtcttttactcttaccacattggtaaaaagaagtggccctatatgccatttactcttaaaagaattggtgtaagtacaggataaggcgacctcgtctaaacccccacgctcccat

SEQ ID NO: 70449 - DNA, 11981 bp, Oryza sativa
gccctccccctccgcgtccggctgcagcagcgcgatcgtgcccgaccgccccagcaccgccaccacccatccccgcgtggtgggcggcgccgacagcaccaccttcgccaccgggaacacggggggccgagggatgcccacggattcgccggacgtgacgctgcacagggcgatctcgcggtcgtcgtccaaggccatggcgagccaaccgcccatgtggccgcagcagcgggcggcgctgaggcgggcggggagggcgaaggggaggatctcggcgcggcggaggctgaagaaggcgagaggtccccgggggggcccagggcggcggaggaggaggcgcggggcctcgaaggcgaggtcggaggggaaggaggcacgggcgcaggtgcgccaggaggagcagacgaggcggacggtgacacgctccagggggctcatcagcttcatgattccttccaggagctccggcgggagatccgcccaccccacggacaaatccgcccgccgccggggatccatgtccgccccgccccctgcttctctctcttcccccctcccccttttcttcctctttcttcttcttcttttttaattatttttctgtcaatggccagtttatatttgtccttacacttcctccctaaaataactttgagtacctgtttgaaaaaaaaaacctaaatattttgcggggttcttgaccgttggatcactttgagattcgtgaagtgcccaaccctaaccactcattttctcgctcctcactccgaacgccgccacctctccgcccgatacccctcctccccaacaactaacatacaaatattgttatatgcctcaccaattatagaatacgccaacagtaccagcggggttcatcagacctcaccctccctccctatcctatttctcaagctgatgatggtgaggtgtccccatcccgttgtctttgacgactcctcaccatcaaagacaccactgcctcctagctcgttgtgctctgagctatcaacattggtcgttccaccgcccataaattactatcaagttcttgtattttacaaccatccttctaaaacttgaggaactctctcctctttcttctaccccgcctcaaccttaaccctatatcttaactggactgggcctcctaagatcaaagagctcaccggaatgtgaagaaaatgtcatggtgtacaaatctcagattgaattggatggtccaaaatatgtaagatgggactttgagtttctattgtagggagattaataattttggaaaactattgaccttattactttctctcttttatgttgtccccacggcacacaggacaagatctctctttgggttgtttaatttgattcatggttaaaatttgtcaatccaactacaatagcaaaagtacgagtaataacaaaaagcttgacgcaaatttaattggcatatgaatacgttagctccacgccttgagaaaaatattttctttttttaaaaaaaaatttctgcaacatcatcaagatcactgtttatttcttaaaatatttaatttgtaaataatctataacaataatttgttcaataatctaaatcaaattattgcctaaaaagtatgagtaagcacgatcatggaattcaatcatgcagacacggaaatacatttacatataacatgagacgtggccatattaggcatcaaaccaaacatcctcttatttttggcagccagggaagagacaaggtcatattaaggattaacaaacaatttggttttgtggattcataatgtaatttgatatttgatgagtagcaacgattatgagttgttggaggaagaaaccatgggagaatatatatgtttttattgggaataggatgaaaaggaatgatcggtcatctttggaatatagagagatgtttgatgaaatcaatgggaaattgcttttcctagaaagagtgagatgttcctcgctagggatttcatcttgggaataagttcactttgattcccttaactagtgatcgaatctgattcatatccctgaaccacaattacggatatctcgaccccccaactattaaaaccggtgcaatttaactcccttggcggttttagagggcggttttgctgacgtggtgtctacgtggcaatattgacctggtcttcgtccccattcggcgctgacgtgtcgattaggtggcattagaattaaaaaatatgtttgggggcccatttgtcattaaaaaaatatgtgtgggacccatagacatgtggccccacatctcatgctctctcttcttccttcttcctcccccctctctttctcttccccatcggcgagcgtgggacaggggccgtcggcaggcagtggtggtggcgggcgggagggtgggcgagcgagggtcgggtcccctttgcgagctcgcgacttcgattagacctctttcagtccccgatcaaccaagccaccaccacagtcgagcttctctcctcccagaaatcccaatccacacctcgctggcgcccaatcaccaccactgccgaaaccccccaaatccggtctctgccgatcaccattgcggagctcgagctgtgacttgccgctgcaatccatcccctccgtttcttcccatttctcccctccctctccttcttttccctcttcctcttccacggcagagaggccaggactcggggagggcggcagtggcggatgaggtccgcgcggccctcgcacgctgtgtccagggcgggctcagggtgggagcaccgaaaggcagtgacgaggagtgacctcccccatctcttttgtggtcggggcggctaggctatcagaggcagcgagggagcggaaggcacagaaggacgaaggcggtggctgccgctcttccaaacgacgttctaccactgctgttgccgccgttttgcttctccgactcgatgcttcttcgtcttctccaacgaaggcggctacacgaagccgggaaggttgtgacggcgacaagaggttgggagggcggtgacggcaaagtgggaacaacgccagccgactcctcttttcctcaaggagtcagctccttgttcccgccatggcatcctcgatggcgaccaccctctacgtcaattcggtcgtcgacgatgacgtttagtcgcacagctccgccgccaagctgtgccgctcgtcgccggctaccgccatgaccccatccatccatctgacgccgcgaacacagccgtgtcgttcggcccgaccaccgcgggtgccacacattgagctcatctggggcgggagcggcgacagctggggaatcgagccgctgccatttccgcatctccgtcgcgccttccgtcgtctccgccgctcaccgtcgtctctagccctcgcctcccaccgcgggaaagagagagagtgagaggaaagagagagaagggagcgacgaggagagggaggaggaagatcagagagcatgagatgtggggcccacatgttagtgggtcccacacatatttttgtgaatgacaaataggccccacacataaattttaattctaatgccacctacgcgccgcgttagcaccatgtggaacgaagaacaggtcaataccgccacgtaggcgccatgtcagcgaaaccgccctccaaaaccaccgagggagtcaaattacactgattttaatagttgggggttcgagatatccggtattgtggttgaggggtacgaattagattcggtcactagttaagggagtcaaaatgaactttctcctttcatcttgtggaggaaagcaatatatatggcctagtggatgaaaagatggctcattggcccattgggaagggaaggcaggagcccatacatattccaatttttctgggctgtcagtgcataaggttagtccaataaggaataagtctatttgacccccttagctcttgctcctgattggatcacctccctcaagcgtaataaaccaggtataatgcctcccctttaattaacgtattatagtcatctttggagttatactagcaaatatgcccgtgcgttgcaacgggtgaaaaaacgtaatgataatatacgtttttcatgcataaccacgtcgataacaatcagaaaattagaactacgaaactttattttctagcgcgttttcttttgtgcttttttctgacatttttccctcacgtgtttttttaaaccgtttttattttctcgcgcattttttccttttttaatatactgtagaaacttctctttttatagttagattagattagattagagataaagaagatatataaatggactaaaaacgacgaatataaatttgacttttttcctccgcgcttttttccgtccttttaattttttttctcgtgcatttcttttacgaagggtttttttcaccactttcacatagtgtcaaacctttctagatataataggattcgattttttttaccgcatcgcgtataattcctttttctttagaaacagacaattttttcgcccttttttatcgcgtcaacggagtcggaatcgttttgattttttccctttttttggatcggacagatttttttttgcccggtttatttcgcccgatcgattttttttaccgcgtcacatataattccttttactttggatttttttcgccctttttttaccgcgtcgacggagtcagattcgttttgattttttttctccctttactttggaattttttcgccctgttttcaccacgtcgacggagtcggattcgttttgatttttcccctttttggctttttttggataggacagatttgtttttttttcgccccgtttttttatcggacttttatcttttttttcgcctggtttttttattttttttaccgcgtcacatataattcctttttctttatcggaaagttttttttcgcctttttttaccgcgtcgatggagtcagattcttttcagctttttccttttcttttatcggacaattttttttttcgcccatttttttttctcctgtttttttcggatcggactatttttttcttttttcgcccggtcgatttttttaccacgatatatataattcctttttctttggaataggacagttttctttttatttttttaaactctttttaccgcgtcgatgtagtcggattcgtttcgatttttttcctttttttgctttcttttttgtcggacagatttgttttttttccacccggtttttttccgcccaggtttttttatcggacttttctttttttttttgctccacgatacatataattcatttttctttggaataggatagttttctttttatttttttaaactctttttaccgcgtcgatgtagtcggattcgtttcggtattttttccttttttttcctttttttttgtcggacatatttgttttttttccgcccggttttttttcactaggtttttttatcggacttttcttttttttttcgctcggtttttttctcccgttttttgacggacgacagaagcacctagagaagtgttttttttcttttctccaatccaatacagatcggatctcttccagggaaatcagattttttttctccagggaatcggactcttttttttcgctttttttattcattaaacggtttgtctctcggacttttttttcccttttaagggatcgggtgtttttttgccagggacaggtgtttttttcgcccggtttttttttcacttttttttggatcggacttttttttcgtccggtttttatgatcggacaaacttggttttttctgcccggtttttttttcacccggtttttttgacggacgatggaagcacctcttattttttaagtagtatatagtagagtagtagataataaccacaacatcatgcgttcttatatatgggcttgtttgattgcatccatttaaaaatactccctagcaagccaaaattttagcaaagtaagagttttgacaatgttacttcaaagcttttagttagctttgccaacatattggaattatgttcttcttcttcttcttcttcttcttcttcttcttcttcttcttcttcttcttttgttttttgcaacaaaccaaaatgaacaccgaagtcagtcgccattagcatttttttttggtatggtttcatacttttattgagtgttaaatcaaacacacgatatgatatatctcatcactagtctcatttgttttttcgagtataaataattataaatgtttacatggtaaacaaggttttttttcatgaaataatgaatcgtaagagaaataatcaagtgaatgaaagagatgatgaaggagcatgcatgcaggaatcctatgtataggaaggtaggaggacatgcatgcatctttttggttggcagcaggcagaggcaggcatggcattggcatcggcatctagagccgcatggatgatccagatccagtccagagaaagaaaaaaccaaaaggaaaaaggaaggtcaatgccatcctcagctgtgttcaatccgtacctccccggccaccaccggccaaaccaaaacataggccagccacccgcacccacagacccagaccaagcttttgcgtgcgtggtacgggtaaacgacggttactactaaatactattatctttaatttaagaaaactattttgtgtaactaatgggtaattaactgcacaacatatagaaggtatgataatttgtgtgattaactagttttagatgggtacccaacgcgttgtttgcgggagaagtgtgtgataaaatagtatatatgagttgtaaaattttatttcttggttactatatatttttttaccttaatcaattatccaaaggttataaatgattaggttgtatggtgtgacttttggagagaaaatatacaatttgcatttttgatgaatcattcaaaggctaaaaacaattaaggtgatgcatatcataactacacttagggtgagtttgagagataggggattgagaagattggaaagatacgcaaaacgagatgagccattagcgcatgattaattgagtataaactattttaaatttcaaaaatggattaatatgattttttaaaacaactttcctatagaaaatttttgcaaaaaacgcatcgtttagtagtttgggaagcgtgcgcgcggaaaacgagttgttttctcaccctatctcacacaaacgaacacagccttagtgaagatcaactttatagatatatagatttcttacatactatacgattttctattgtgtgcttatatattataccttgatcaaatatccaaaaggttataaatgattgggttgtatagtgtggcttttggggaaaaaagatgcaatttgtacccttgatgaatggtccaaagactaaaaatagttgaagtgatatggcttcatgaaagaggagggaattagaattagcattttctttacagagggaaaaatagtaaccttatctcctcctcctccctcctcattcacgatgtgcttgggatgagaaagcttgtgctgatgccgcgtgctccgcttcccacacaacaccttggccttgccggtgttggtgatgcctactagaccggcctcctcccgcccttccccctttgtccgatgttcttcttctccaaatacaatgatgtgaagcccctaccctgtcggtccttcctcatcgccggtggctcctatcataaccagtctcatttgctgtcgtctttcgatgccaaccctgcctgccaccacctctagccccatggctccgacagtgccaccgctgtcctccattgctcgctggccactacccaccactgctctgaccgtcgccactactgcccctctaagcctagggaaaacccccttcccctctttcttaaccccccctcccaccttaaccaccctcttgaaacctaatccaatccatggcaatcatcaaaagggcatcagagaagaagaagagctcacaattaatcactgaaagaatattgctatcatttttttcaaacgtgcaaaagccttgcacatcgatatattaatagggggaaaggagattttacaaccacgactagctgatgcaggtcatggggggttacaggagagatggcgggcacactagattaactaggaaagacaaccaaattcctgaaaacaaaaaaagagaaagagcttgtatctaaacgccaagaagaacttttaggggactagataacgccacaacccaaagctttccttattgaacgatacgatgaacaccaccatctccaccatgaaaagtatctccttgaaaacacgagcatttcttttcaaccacaagtgccatgtaacaaggaggacaagggagtcgaaccctttcctgttgtaatcccctgcagctgcgggcaagaatactcccaccaaacctggttgctattgcaattatcatcgttgttgattagttaccccttcttccttacccctccctttattcatagcaggtatcggagaagaggaagagcttccaatcactgaaagaactacccctggctgttggatgcccagacaagcgatttcaatcacctaaaggctagcaaaaatacccttagttgcttcctctcatgcatcccaatggccatgcatgggcacaatcacacggctattaaacaatgtggtgcttgctaatgcagtaaagccagctgctggtgcttgttgcacagggccagaaaagcaaagctacagaggccatggatctccgggccatatggtctccactggcagttgctctgaccaaaagccactgttgcatgcatgccaaacacagctaccgcagtactccactgcactgctctgcaggacgacctgacccagatctgaccatgcattgccttgcatatagcagcacatagatccatcatatccagagatgagaccacacgatgagactacacgacgacgctgcctatttcccatccaaaacaaacaaatctagtagatgaaatataatattctctctatttataaaaaatccaattctaaaaattaatctaaaattagaccaataaagtatatatgctagcattatgaatctgaacccatactagttttgattatttttccgcaaacttaaccatctcaagcgtaaccccatactccctccatcttagaatgggtccaattttttatcgtcttctttttatcctaaaattattttgaagtattcactgcatcagaatttgtaaaatagaggataaatatattgataatagaaaaagagagcaataactacattgggattaataaagtgggattcccagactttttaattttatattgatatgcagggcagaagaaaaattaacttattttgagattgagaaagcagggtaagtattttaaaagttatacttgtctctatcagttactcctatctcttaattagtatttaaatttctctgtctattatcgatctgaaccacactgccctcaacaatctctcgatacaataaaacacattatgacttctttttttacattcttgatccaaccatctctcaatggataaaacacattatactttttttacatccttaatctctccaatacaatctagaaatacttacttccatcattttaaaatatacgaattttaattttatgtgttttagaaatatatttgtgaaaagagggagcagtatatatatgaatatatatactgtgttactactactctactcctaattatatcagatccatctatccattacgacggtttaacaattttcagccttaattagacgatcgatgatttggtactgccttccaccattaattccatattgttgagacctttcaaagggattgaaaccaaattaggtgcggaataaattcacatctattttggtgtaaaatgaattaatgttctcaatccaatctaatttctttctctaccggattaactgaaaatagcatagtttcagctcaaattaaccagctatatatatacgtaccattgtgttgttatatttaggtggtgttattttttaaggaagatgaagataagttaggatacgtaaaacaagaaaaatattagcgcctgactaattgagctttaattattataaagcaacttctttgggatccgtacgggaagtacatacgtatcaatttaattataatacgctatacatccgtaaagaaaacttcattctttacaggaatctgcacaagtgataacacgtgtagataaatgtgaaaactttgaggtagtagccagtagactactccatgcggtcgtcaatgcatgcatggatgatctttttgttcaggtgtcacttggtacagtgcacctagcttacctagcacctcgaagctagctaggctttctgttcagttactactacatttagcctcgaaagaaaaatcaacttttatacgctaatttagtgatgtatatgttcaaatttatatacctaaattgatctattttgagacggagggagtaaccattacacctagctaatcttctgttcaatgcgcgtattcctaaccattcattttaatttggtcaaaactattaatcatctttgtgcatcattaattcactgtaaaatacttcatgcaaaatgcaatatatattggagtatttaataaataaccaagctaggaacttaatcaaatttactatatacggctatgtatatactttatatagatatgtacttgtctttcattctagactaaaacgaaataattacgaaaatgaagcctactggtggagattaattgagtgcataattatggagaataatgtgatggtctgaaggagggcaacaatattcttcgttgagagcctgagaatgacattttgacaagtataggtacaactcacctcaccggtcaattatattgcaaccatgcattatactatatggcaccatgcgttgaataattaagctacatgttccacgaaagtgctacacatttgtctgtgaaaagtgaaaacaaccaaatattgacttttagcttagtgctatatatatactatgtgatgttcacattatttcctgatagatagttaaaagtgtgatatatatatatatatatatatatatatatatatatatatatatatatatatatatatatatatatatatatatatatatatatatattgacttttagcttagtgctatatatatactatgtgatgttcacattatttcctgatatatatatataaatatatatatatatatatatatatggttaacagcacgctgtatttgctttcagaattgcaaataacaataaaaaacaactacaattaattataagtaattttcttagtgtacgtaatttattattttcaacataaaaatgttttgtttcctttgatacgctttaggttttgtcatatattgatgctacctatttcaactttgtgcccccaagcatttttagaatcctacgtccaccactaacattactttggtcacagtgcgctttctattggattttattgtgactatgaatttgcagatggttgacactggtgcgcgagtgtggtgtgcgtacggttaaatgtagactatttgaaagaacataaatccatttttcaaaataaaccaagcacctgtttgtagtgctacagtaaactcataaaagggacaaaattgaattttaatgaatgcatggactggcctgctatatattccctccatctacttttgatagtcatatttccaaatctgaaaaatttatttttgataggcatatttcaatccaacaacctatcatcttaatgactttctcagaattaatgtgtgactctctattcttccacacaagattggctgtgtcagggttacgggttaggcataccctttacctttcgatatacgttacatatcggcatggcatacccacgcgcatacggatacttcccgcgtacactaaggaaatccttcacgaagt

SEQ ID NO: 70450 - DNA, 2157 bp, Oryza sativa
gctgtcgacgtacgtgggccgcgcgcgggccagtgctcgcgagccgcgcgttgctgtgcatgtatgcgcgcgtgtcgtttcgcgcacggtttcggagagggaggatcgattggatcaggggttgtctcttttggcctaaccacatgtcacgaagggttagttgatgtattatcatcggcacggcagtgaatatagtgattctggcatgcatgcagcatgcatgtggttagtagcagtaagctagcgtgcgtgcacttacgttgcattggttgatcgttcatagtatagctataagaacaggcacgttttggtttttatatttttttaagcgtgataaaggcagtgacgggtaggattgttcagctagtaacctttggttatcttgagccgtcgaccatgcatgccctttaggattccaaacggtcgctgggtttaatcgatctgccgtactgccaatgcgctgcaaagcttggaccatagctatctcagctcagatgttagtagtatcgatctatcaggacgtacgtggaattcgtcagaggcgtctgcctgattcagcctgaagacatatatatgtagctttctggggggaaataattagcggaggtttatttttctcgaaatatcattacaaaggacggtttgtgtaattgtattcattccagaaccagtgaaccaggacactagaaaatacagagtccaaacgtatggcgcccatctgattgacagcatgtccaatgtgatatctctccatgttttttgcatttagtttaacggtcaaagacgggcaatctgaattaagcagcatgcaatgatattttgagagcaggactgtcaggaaaatgttattatcagcatgaaggtacacgagttcattgcctcaccccgcacagcggcgtgccgtcaggttaatcaccacgcgaacggcgcccatcagctgcctgagagtcattatcagcagcgataattagtcccatctacaatgatcgatcgattggtcatctcaccgaaccctgcaaccgtggatgtgatcaattcttacttctcaggcacagacctaagttaggactggccttggacaatgatcgcatgacattagttaccagtagtccgaatcgagcaccagctagcacatcttgcatctactgttacgagtgtacagtagaaccgattaggtcatgtgcaatgcgagggcggaagacctcttttctttctcacactacagtctacccattgcatgcgtcaaatttactctgtaccaggtccaggtttggaccttgaaacaaatgaaaatcattactattgttttccaagcgttggctcaagactagtgaggatgacatgattttttaagtatatatattgttccacattcagtgttaaccactgtgttagggataaaccccactcttagggttagagcaagtttaataggatagccaacttctagctacgaatcatctataaccaatgtaataggcaattcatacaatagttgcttactatactattaatacctagtcctacacctagctatagctggctacaaatctgtagcccgctgctcttctctctcttcctttatctcattaaaatatgtttatacctggcttatagtctactattgtacctgctcttatcgtgttaactaataacataactacactattgatggcccatgcaaattgcgcgaaaagtatcttttttttcttatataatagtgtgtgtgtgtgtgtgtgtgtgtgtgtgtgtgtgtgtgtgtgtatatatatatatatatatatatatatatatatatatatatatatttcacattttattattaaaatagcaacatagttttaaattatttactaaattgatcatacgtgatagttattaattactttcaattttgatcttagttatttctaaattgtattactacatgtactctaacctctacttccacttgtcgacgtttgatgtcacgactacggtatttggacagtatggggatcgttggtgctaggatatatgtgagactgaggtaaagagatggagacatggatttttatacaggttcgggcccctgagtagttaggtaataaccttacatcctgttggccgaagccggtattgctcttattcacataatcacaccagtagggctgcagg

SEQ ID NO: 70451 - DNA, 21019 bp, Oryza sativa
tacactaaacttttgataatatgaattaattagacttaaaaaaatcttctcgcggattagctcttatttatgaaattagtttttttattaatctatgtttaatactctaaattagggtccaaacatccgatgtgacatgggctaaaaagtttttagtcccgtctaaacacccctaagctaaacaacagatcagatcaccaaacaaagaaagagcagatgagtagactcgtgcagtcgtgctaagctgaaaccaaattactgttgctgcctgtgctactacagatagacaaacacagccaacggctcttgatgacgctttgtcctttgcatattacgctgcctgcccgctctgtagtctgtagtctgtaccctccactggctgcggctggcccccctgcatcgccaccatgaccagcccacagctagcacacacacaccagccttacatgatgcacaaacgaaaaggaagagctataatgtgcaaaatctgaattgatcagggacatgaatgaccctattcaacattataagatgcagaaaatccagacatatgctaataacatgcacaatggcagctgtatcaaaatcactttgcattcacaagttttcatagttgctatcattcatgcacgaggcattgtacctttgattggaagatcctgctggtctcatatgtcagtgaagtcagcaagggtcatttatcacctacagtgccatgttcaatgtagcaagatcacagtacctcatttatcactacatgagcaccatccaagccaactagtagtaggtaagtattttgcagatacagatcgggaaccaacatgaagatctagtggaataatgttgaagccttcagaaagaaaaaacaagaacccacattactggaagttcctctcagaatcacacaattcaagagcacctggacttcatacgcagcaagggtttgcaggaatcatgtttctgcatcagtgcttggtgaatctgagactgaaccaacaccaacaaggattctacataattcccagcgtagggttgtggcaagtcatatattatgtgatataaacagcagcatctgaatacacagaatggaatctgcaccaaatgtgactggctccaactacatgttacctgatccaactgcaaacattatttacagtataatagttgaggtaaggcagtcatccgtgcaaaacaaacatcagacatgcttgcaggttgtactaaaaaaaaaaactccctatttatttgaaatgccaacagtaccttccaaaccacaaaacacatatccttattcattgccttcaggaatctcaatggttttggagttcgcttatggggcacaaaatattggcagtcatatatttggagcacaaactctcggctaaaactgaaacattatgtattgatattcaacatgtttcgaaatcctcagcaggcgacagataatctctgagacaatatgtatattctaagggcattcgtttagcatattaatggttgacaaaaaaaaacttgcttcctatcaatactgtttgtgacaaagtgtttcttaggaacaaaaaagataattaacaatgaacactaatctaaacagagaagaggacataatgtagctgtagaatcttggtgcaacacagaacagatgctcagattcagagtttttctttttatacacagaggctgcagatttgcattgttttcttggtaatttactttttcatcactatttagaactaagctattcactttcttccctgctccaggtaatatacagtacgctaggacagtcaatgtgtgcatcagctataaaagcctaacatcatgaataatagaaacaactagcaaaaaagtgctggattatgggattgattgatggaaactggcatgaaaagtttcaggtcggtcaaacagaaacattttgcattggaagaatggtccacaagacatacgtaagaaaggcctaagatgtttacaatttccattggacataaatccaggacagaatgacagaaagacaatattatattttgtataattccatagacctggatgtactggtatcacttaaaaaaatacaataatcccagttattcaattatgttgtcacccttcgtgaagaataatggaaggaagaatagggaaagcgcacatgaagaaaacagagtagacacgaatacaaacaaagctgagaagcttaactggtagtgtaagttatagatatcaaacataatcttaaatagaagcgttcatgcaatatttagacaccttgcatctttcaaaaaatacattgtcagttagctaaatgtaaaaaatggtttgctgatgcaaacagcaaagacattctgctcaaggcctcaaaatatagtaaaattaaccatacagacacgctcaaactgtcatacaatatgtctataacacagaaaagtgctagaaagatatatatttgcagacagttaattagcattggtaaatggtaattaaaaatgaccataatttctgaattgagaagcccccataaaatttgtatggataacatcatgcaggattgaacgaggaactcatgatcatttaatgtacagaaaacctgatgaagttacaacatttcctaaagcagaaggattaagaacctgtatcacagtcaaaactggaattcttgtggtatgccgaataagagctaaagggcttctctgatctgaaaagtcttcaaaatagctctagctttatcatattcattcagttctaccaatatgtctttcaaacgacgagccagcccacgtgtctcttcctcacttatgcctgacatgtgtcgcctctccaacttgtttcctagttctaccacgagatctatgaaaggctgcaacttttggcttggtgaagaccacactcctttaagtaatgcagatatccgctcagccctagcaattgcatcatgggcatccaaaatgatactcttcatatgaggaagaattttccccttcaacaattcttccagagcaagcttctctaaaacaggttttgcaaaaatatccttccacaaacacacatttttaagaagacgtatcgcaactccaaatctatgagcagcatactgcgaagcacctggaacagtccttgtcaccattgatccccaagctggcactgaaatgtcagcaatggcctcagtcagacgactattgacagcggccaatagttgatgcaatgccttgcttgaggttggtaaatagctaatgaccatattaattgcatccacagcgtttttggttctttgggtgcttaaaatatcccaacagtgcataatacggtggtgcaaaataggaagagccaccttctctactaatactggaatgaggtccttgtccacattgttagggtcagtgccactttcactgttttgctcaccataatcaaaaagaatcttgtgccactccatgccaaagaaatcagttgtttcatggagaggatcccacttcaaaagctccagtctgacataaggggtgaacacagatggcgcactcagagctacatgagcatctcggtaagccagaggatactgagttttccatccttcaaacttgtccttaacaattctaaggcttgagtattcctcggcagcatcactgaatacaagatcagcagtcttgagcaactcatcacggctggacagataggcactgctctcactatcactctcatcagtgcttagttccccttcgatatgttcattatttgcactcctcccttcagatgacaaccttttagattctgatcgaatttttcttcgcctcctgtcttcttccctacgcttaagatccattcgcttctgcatattgatatctctgccgaattcatccagctcaggtggtaggtttgaactttccctagcagcagctgccgccgcttgtgcagcattagatgcagcagatagataagctgagcttgatcctttgctaaggacagatactgctgcattgacggcagcttcgataacacttgattcatcagctagatcagctgccctcctctctgagacagcagtcactcgattctcatgcagcttctgcatgtgctcctccaattcctctatatagaatgccttatcattcaagaaatcacacatgacagaaatgtaatttcggagctcctgcatgtacacaaacttcctttctgcatcttgtaaaccactctcaaggctagatatctctgaaagagcttcagtaagatgtgtgtcagtcttgactaaagcatccactgttgtcttatgggtctccttaagcttcctgatgttctcctgcagggctttgcttgctacatcagcttgttgagcgattgacaggaactctgcactcccagatgcaaaaatagaagtcccaggcaaaaccccgctaaaggaaggctggtaacggggatcgattgagtatccggatggttgcggctggacctgcacaggagctggtccaccattcgctgctctctgagcagaagcatcatccaccctcctaccaagccccttcctgaactgctcctcctcccatttcctctcttcctcatcctcatcgtcatccttttcatcctcaacctccctgaaaccatcattgataacccccaaactggcagcaggacctctattattgatcacgccaaatacacctttcgtgctcctctggctatctgacttctcagcgtacattgcaatacggccgcgtgtctcatcatcatcctcgtcgctggatccaccagcagcttcacgactgctaagcacaccacctccatcaagggagatgtaatccggtgctgcatgcctcggctgttgaagctgctgccgctttgctcggatagcttcaattgttgcgcggtcaggtatgactggtccttcttcctcctcctcctcttcctctgactcatcttcgtctttgtcctcgttctgcgatggattccttggtccaatgctagcttgtgacataggttttaccagacctttgagaatcaccacgggctctacagcagcagcagtggtgtttgtagcaggagcaggactggcggcagctccaggcaaacgctgtcgtggggcttcagcggttggagggggagggggcggcggtgcacgcatgaggctcccagggagtgggcgggcgttcttctggagctcacggaggcgctccggcgtgtactctccagcatgcgactggaagttggacggcttcggcgcgggaaccgccgctgccacggccgtagagctcttgaggcggtccctggcgggcgtgagccggtggagagtcgccgcagctggcgatgccgtgcgggcctgccggaccgtagcagccgggcggcggcgctgcgacaaaggtccctcctcggcgtcatcgtcgtcctcgtcctcgacgaagctgaggcggctcgcgccctgacgtctcggcgacctgggcttgggaacgggaggggtttgggtcttggtggctgtgggcttggagttgctcgagtcgtccccgtaggcgtcctcggcgtcgtccgtgcggcggcggaagttcttccggtggctgctcatcccgcccgctcgccacgacggagcggcgaccaggggtaaaaaaaatctgcctagtttggggaactctattagggtttgtgcctagaaaaaaccttgggttcgagtagtgaggtaataatcaggtaagagaagaagggaatctcaccggcggcgacgggcggcggctagggttccggcggtgcggagtgtggagatccgcgtgcaaagagagagaaagatgggaggaaggcgaagaggtttctggatccggatccaataagaaaccgcctcccagctaaggcctggcccatatcggcccatgtggtgtaagtttaggcccgctccgcttcgtctcctcttggcctctcctccatcccttcggaaaaaccctagcaaatccccgcctcgatcggaaggagaccatggcgacggcgaggctccgatccgcctcctccctccgcggggtcctcctccgccactgctccgtgggaaccacctcgccgccgcaagttttctcccgcgtctcaggttcgcctcatgcttcgaatctctccccccgtggttctctccatagttaaatctgatccgcgtggtagtgcccagctatgagctgcgaaattgttgtgagaacgggcatacgattccatggtgcacaagttcggttctagtttgattaggtcctgggctcctggaggtgctgtgccctctatgtagtgctaatgttatctgactgactagctatatgttcttctatgttgtgagtaatctcggaatttccaagttagattgtagttggtggttagacttcggtgagagtgcatgtgtcaatgaaaaggtagtttaaatgacagtcctccacatctatttcagggatgattttttctaactccacccacaatccaacataatctgtggattcaagcttctaccttgaatttcatgatttattatctgctattctctacatattactctcgtgagcccccaatacctctttcggtttcacatgatttagttttgccagttacatgtgtctaattgtactgtattgaggtgcatttgttaggaagatgtgttatagtaattcaacagggcgcatggttgaagtccaatttaccactgtatgttacctcaaaatgcttaatagcgtaatgatcttcctttctgaaagcaacatgctcctttgctaacttaatggtttctgaaccattatcttggatagccgaagtatatagatttgcattcttattttttttataggtgtcaaaaatccgattaaagtcagctaactgtcctttacattatcagatcttcaggctcctggatgtattgcatggaagcatttctcaacattcaagcctaatcctcttccaaaacttgatggccttggttcagtcacttgtttgtacagtcaggcaagatgggcttctcaagctgctgctgttaaagaaactgaaaatagtggcagcaagataagcattgggccaaaatccaagcagatcaaggaagatgacaaagatgacaggctagtttaccagggacctatatcatcgaccataagaaaagtgaagcttctttctctgtccacctgctgtctctctgtgtcgcttggccctgtgataacattcatgacatccccagatatgaatgtaatcctcaagggcgctgttgcatccactgtcattttcctcagtgctaccacaacggcagccttacactggtttgtgagcccgtacattcacaagctcaggtggcgaccaggttcagatagctttgaagcagagattatgtcatggctggctacacccctcacaaggacaatcaagtttgctgatgtcaggcctccagagaccaacagaccttttgtcacttttagggctgaagggaacttctattttgttgatgccgagcacttcccgaacaaggctttgttggcgaggcttactcccaagcaccctaatgagtctgcattcaagaacttgtgattgaaggttgcccaatgacctcatggctgcactcgcgttcatgatcatttgttggcagtttacatttttattgtgatacctccctgctaatacttccagaagaagtagtatactatgttattagcgttcctttaaatccatgtggaaatcagtaaatgctggtgtcatactacgattttagttaagacactgagatggcgtgctgactgttcttaataagtagcggggacttttgcttaggacacctcccaacattctgttgtttatgatgttgcaatgctacacgcccgtgtgtgcttggcagtttaattacgtgatgctcttgttttggcttagagatatgatatatttgcaaccattgttcaaatttcatctggaacaccgagcgattggtcgctggttgtttttgttcagctatccatgttttcagagactttgcaaggcatgactaatgtcctctgaccttaaggacgcagatgcctatgccttcagaagagatgcggttgttatgcacagggcacagtttcgtcacacgtttctacctcatggcaaaaacaatcatagacagttgactttgaccacagtgtgatgtatatcgatcaaacaaactcccagctaaaatgtggtgcgtatgggctgagaaagaccatgtcttcgagcaaccaaaaaagtccttcaaaatctcttgatatcagtataagggaagttcataattgatttcctcttacacatgaatttctcttctactatggcaatgctagcaattcaattagggctttgcactcacaaacttagcgtccgcgcttactagggacactaacaagcaatagcaagagaagatatggaggttccaatatcatgtggacagcagcaaaattccacacgacctacaatgcgtggagagaactattcagatagtagatcctccaacttctttcggaacttcggaattgcttcagctttgacggccatcactaagcccatctccttgtaattcttcatctgaaagggtagacagggagtccattcaatttaggtgtacacaacatcaaacttagaatgatgcatgttcagattctgcttgaaatggtgagctaatgatcatcagaagaagaaagatataacgaaagcataacacaaaggaacgaatgttcctacttcacatgattgggatttggtcatttggctactactacctctgttcctaaatatacagcgtttgttgattttttggacatatgtttgactatttgttttatcaaaaaaattatgcaaatatgtaaaaactcgtgcttaaagtatttttaattataaaacaaaataaatgatacttacatatttattaaaacgaatagtcaaacagatgtccaaaagataacaatatcaatccaggtaccaaaggaaatttgtagtgccagtgccacaagtgaaccagttccagatgctgaaagtaactatgaaaatatgaataaaagaacagcataataaagcctgaagtacttatacacaactaacctcttgctgagccgattgttcagaacgtattgggaaagtgaacgaccatgaagaaagctgaggaagaaagttttgttaccacatcaaacagaactgcacaaagaaaaattaatctcagattgtcagtagcatgtcctgcttgatacctcgcgaaaaatttcgtcttctaacttaggatagataataggctcatcctcttctgtactgttctttgccttttgctttgctggagttttcctctacaccagatggcaaagacgtgttattcatacagctgaagcagttacaacaagacaggaactttcatatacagagcacaattacacttgaaaaatgatctatacaacatcttacacggaaatactgagcaacaaaacaagtcgctttgaatatcaatgggcaaaacaaacatggaaacaaattgcattgctcacctcaagtactctgacaaccattaggtactgcttgaaccggaaggagtcccggagttcttgtgttggcttcagatatgcgaggacagttgaaaacacgttataagaaagtagagaaaagaatgtgtttcacactatctgagctcgacgttcataaaagaaggtgcttgacaaacctcgtcttctgtggcccatgaaacttcgtcaaataacgattcatacatcttgggcacaagttcatatgggaaattcacaaaacggcggcacacaagcagacccacatcaggtgctttgtcccccagcatttgcttgagcttcttcttggtatccttgtcaccacaaacagcaagcaggtaatccttaagatccttcatacagcggtgctcctacaagacaacaccagcaagttgattaatcagaagccaccagtgcagcaagacctatgtatcttgtggatgaagcagtgagtaggttgaacatacactgtatcttccaagattaagcacgctaatgagaccaaacagatcgtcattgccaccagtgctgcttccatcagcaccatttccttcaccatcctcttcatcgtcagcaatcttgacaaccgtacccaccgtggtctgctcaaggatgaggtcgacgaagccagtgagatcccacggcttggagtcgaggtaggtcttgagcagcagcttgacgccatggaagtcgccgggcttggggtcgtagaaggcgaagtccgcttgcaccgtatcgagctaggagcaccaatccgaagagcaactcgcatcaatcgatgagtaggaactccagagaggctagaaccaaggtagaggtaggcactcacctcctccgacgcgtcgtcgctgtcgtcggagtcgctgctgtagctctcgtcgtcactgctgtagcgctcctcgtcgctggaaggctcggcccgcttggcgcgcttgggcggcggcatatcgcgactggagccggcgattcctggagagcggcgaggcgtgagaaggaggtagcgaggccccggcgacggcgttgccaattaagtgtaagcacgcgtacctgaagggatttcgtcggcggcggcggcgggtggatcctcggggggaggtagtggtttagaggaggaggcggagaagaggagggagcgagcgaacggggagaatccggcgaagggagccgggcgctttcggtcgccgaccatgatcgccgagcagtcggcggcggcggcggcggcggctggttcggagagggaggagaggcttgccttctccaatggaagtagaacgaggcccatgcatcaaggccctgtttgttgggccgcaaggtgagtcgagctccgtgcagcccatattgttaatgggctggaaggctaatgcgacaaatgtgagaggctgggcccacgcgacatcgacgaagcgggcccccctctctcgataaataagccgacccaagcctcaaaacaccaaccaaccaaccaaagaaagaaaagctcgactcgagctcgccgcgattgaatcgcgcatgggcacggcggcgggcgacgcggcggagcagccaccggcggcgccggaggcgaaaagggcggcggctccacggacgctggtgttcacgtacggcacgctgaagaggggcttctccaaccacggcctcctccaggacctggcccgggacggcgacgcctccttcgtgggcgccgccaccaccgcgccgggcctcccgctggtttgcgggccctaccgcgtccccttcctcctcaacctccccggcgccggacaccgcgtctccggcgagctctacgccgtcacgccgcgcgggctcgaccgcctcgacgagctggagggcgtttcccgcgcgcactacgagcgcctccccatttccgtcctcctcgccgagggcgcccaggtcgacgccgtcgcctactacgcgcaccgcggctacgccgacgacctgtgggcgcgcagcggcaagaaggggtacccggagtactcgccggccgtcgccgacggctacatccgccgcaaggatcggccgcagcagctcaccttcctggagcagattcgggtgttcgtctcatcgcagtcatcgtagaacccatcaattaatctcttttcttttcttaatctatttttcttctctttgcaatcactcctcctatttgtgcgatagcgtgcatgggccatgtgacaatctcttgtgatgaatggatgatcacgcgtgctacctaacctaccagatcgccatatcaggctatcgctgatcgcgtgatctgtagtatcacatccgtttgtgtgggggtaaaatcagccatcttcctgtaataaaatagaatgattttccattagactcactgatcattggctgtgaaatttgccggccgcctgttcatcagttatctcgatcaaggcttcaacttttactgtggtatgccggctcctagctggaaaatgttgaggacaaaaactcttcttcaacccaaagataacacaaccatcctgaatttggttgtaggggacgcaaattcaaaaccataattttctggtcacaataattgatgtgttcaagataacctgctctgctctgaattttctgtcatcttaattaattacagctgccttgaatcgttcagacaatacacgatatcttagttgactcggaaataaaatgaacgaatgaatctaaagacgagccttgcgtggattgcaaattggcaaaggcagcacagatgctcccgtcactcgcttagaataacaagccacaaacacaacacaagaacaaagagaatttgctttgtgcaagattcttctaatgcgattacatcaagaatctgttactgtcagtgtcactgtcaaccatttgcacaacgggcgggccttgacgttccagcatttttgacgacgaaaaagtggagaaaagagaggagacaaaataacagtcttgcgtggcaccgcctggagtccacgtcactttgaacggctctgctacaacgatacacccggcaagacagcaacttgcattgtgtttatcattggtggctcaaaatcacagcaaaacaagccattgcaatatataatatgatgtcgacagacggctgttcgcaaagtaccatttttcccacgataagctgaatctatcatactcgactgccagtatttggtcagtttccatacacggttagctgaatcttgccttcacaaattaacagtttttttccaccctgcaagattgcattataataaacctgtaacatttaagctatcgacagagacgtcagtaaaaggaacaaccagccagtttgcaatagcttatctgcttataataggaagatgaactctaactggcagtggcacagatcactgtgagaaataagaaataacatgactggttccatttagcacaggcacatcaaagtataccttttcttcccagctataccactaactggaatgaataccatcgtatgtttcaatcttgtcaagaaacgaataaaaatatcttcatgcggacagggttccaacaatagtaaaaaaggaaaaaagaatacagacgcataattgccaatcctctactttcatctacatagctgtgcaacaaatgcttctctgagctgcaccacattttaaactcaatacggtattctgtgcaggtttgccaaaacaaaaaatgctaatgatctcgccccatcaaccactcaaaggattctgtcgaggtcgctgataaaattggaggctatagatgtcagcttctttccagtttctccagccatattcttgagggaagacagatcttgagatgcctgcacaacaatcccagcaggtaagatatttgtgcgtttcaaggatcaatctttgtactgaataattcagtagtaactcagtgtagtaatgatttgcatgctcggttgcttaaaaactaaatatgcaagaggtgacaaaaggctggcaattatttacagaataactacctggaatgatattctgttgatgagatccgcagcacttaaatccagattcgagtcatccatgtcgcggcggccaaaaagatcagcacttgaaatggacgaagaaccctgaattaaagggggaaaaaaaaggagaaccgtaagggaaaaaaaagatgcaaacttctacagaatattcaaatgaagtactagcacaaacataaacaatagacaagaaatttcaagtctggaatgaagttaagaatgcttcgacaagttcgaaggagatgcaatgtaatggtcctcggacaaagagatgctaaactaatacgcaccgcaaacttttgaagggacatttgagcgtctttctcttctctgctttgattgccaaaaaactgagatgatgaaattgcctttgcattagagaattttttccttgcttcgtcagtctcctgaatctgaaaggtattcacgtccagtgtcagtacttattaacataacaaaaatctacaagcggaaaactatttgatataataagaacatgctagcaataacaacagcttgcatagagagaactgacttttccaaagttcaaaaggtaattattctgtgaaatttgtagatgttcactgatgattaaacagcagaatgcaagcatgcagcaaataaaggaaggggaaatgacatcatgaaatcaaaacaagtcaagctagtggatgcagcaaaatctagtgcagtgtttacattatcatagaaagtaaactttgcaaacttatgtattgatcagaaaagtcaatctatttattatttacttattgacatagcacaaacattggttcaatatttacctgggtctttgtggcagctgtgcttgttttcttttggaacccattatccattccgtactcttgaaagaagtttgatgattttggtggtgctacgtggccagtcatttgagttcctccatttcttgaatcaactgctggctcattctccacatattcaaaacgtgaatgcaaggacgggccactttttgtggtggaagtagtcattactggggcagcaggttttggctcttcaggtttctgatcatacaggctttcacttggctgcaacataaaggcaaaggtcagtccttaatgttcacatcatatagatagaagagaggaggtatattaaatattaactgtgggaaggaaccaaacacatgcatacatagcgctaatgatccacagtgttacctttgtggtgagctttttaacaccaagccctccagtcttgcctccaatcttcttcgcaccaatggacttctttacagaagtggcaaaagtgggatgagtaggggcttttggtgtctgcgtaggtgctttttgcgaattggtgacatcaggttcctgcttcccattggtattctctgctggtgcctctggtagcttgaactcagggaagtcatcggatggattttgtggttgagacgctgcaactggcgacgatggcaagacgttatcagcagaactcttggcaacttccttttgcagtatctgcctgtacagctcagcagcccttgacgtgtactttgcgtcgaccttgccaccatctgtccacccgtgctgtttaaagaaagcatgggcacgattgttgcctccaaaagccatcatcttcagttgatctggagtccatgaatctaggtttgttgacctatagaaaatacatacggattgtataagagaaagtgaaaataaaatgggtacagttttgacatttggcaggcacaatactagtacttttgcggagtatcaaagcaaggcattttatgatttttttttttgtgtggtagaaacaacacaataagacaaacgtgcagcatcatgagatgggtagcaatgtagcatagccatagtagtgatcatagatatagcagccagcaatgaagttcaatatgttcattgcagaaaaatataacgaagtagtaggtgatttactgtgaatgcgcatatggatctgttagaccaaaatgtgtaacttgtgaatgcaaatgccgatgggatgaaggtgtaaagcaggtattgacgttgatggcccaagaacctagatctccggctgcattccccaccagatgggctgtaccaaaaataggaccttttttttttctttttgatgaaaggctcggccagatccaccaaacccagcaaccacaggcacctatgcgctgtaccatatcccttttttggggggtaaagaagaaaaagggaagtattattgagatcgttgagctggtctgcgctagttcctaggagtcgtgatgggcttagagttggttggtgatggaaagatgaggaaaggaatcggatgtgatggcgtgggcggattgcaaatcttgtgaggggagggggcgtggatcgggatgggaagggggggtagaaagaaacctgacgaaggtgatgtggacgccgaggctgcggtggacggcggagcagtcgaggcagaggaagatgccgtaggtgacggaggcccaggtggggttcttggcgctgcagtcgaagcacatctgggaaattaacaagcacacgacaatactagtacatgagatctgactcttgaggcgaagaagaagaagaagaagatctgagaggaggaagttaccttgttaatttcccagatgtgcttcgactaattggattcatatttcgatcactcctcttcttccttaatgtatacacatcttggtccttccttcaattgatgatttgcatccctctgatcgatcccggctttgtgttaccgcttctttttatcactttgatctttttattagttcatgcatgtgtgtgtgtgcagatatctttggctctcattttcagcattcctttcgatccattacatatactgacagattatatatatatgagtcgtcattaattctgacttcatcacctttaagcaagctagcaggatttcatggattggcatttgatgcttgcaccccctacccatatcgccaaattaatattaactcgatcttactcttctcagagttttactcctcgcatatggccgttttcagtattaatgctcatatctagcaactgtacatgtacacataactctttgacaggtttggaactaaatcatacttgacttcagttcctcctaatttgcttttcacgtttctctaatgagcgaggaatacttacatcaatcgatttccaattaatcaaaagtcttaactatttagtgttagtttattttcaagcaattaattaattacttgcttgcatcctttggcatatatactacaggaagaatgaggtgaagaaagtggtgtgcatcccggcgccgccagcgacgagtagccgtggaggtggaggagaggtgatcccgtctgatctatgggcatggaggaagtacggccagaaacccatcaaaggctctccttatccacggtaaaccggccacattttcatctgtttcttcccctctttttttttttaacacgcgctcacttaatcgatctgttcatatatatcttgtacctaatgacccgattcatacatgaagtttatttgcatcaagatctcatcaaatatctttcaatcattcctattcctcccattcttgataaacaattaatcactttctgcataaatatttttatacttaatgaccgatccaatttatacgaagtttattggaatcaagagatatctcatcagatatatatgtttcgttcattcctattgtgtgcttactgcttagttatattatgttccctctaggtattaattatattcattttatattatgtaagttcattaatatttattgctcatatctctgcaggtactgtatctctgggcaaaagcatcaaaatcatggccatccttttttataagctaattaactaaaaaacaagcagcttccatatttcttgtttagacaatttcaattggtttgtcataattaaacaacttttgaaatatatatatactgatcccctatgagtccaagtgtaagccatcttagccttttttaaactctaaaagtatgttgtttcaaaatttgcaggcatcttttaatttcaacttatatttatggtttcggtgtaaaaaaacttatatttatggtttctcttgccaaataaattatatttttctcataaataaactaccaatattttccaaaacaatataaataaagggtaacaaaagtcgcttgagctatttttttttaattcttgcacataagttttaaatggcttacatatggaataaggaagtacatatatatctgtacaccccccccccccccccaattttcaattcaaacaacattttttgttagtaagccacaactttgggtttattacttagctagattacatgaagttccccattatttgcttgttggcttataagtcattgacacaatttaaattgagttaattgcactttggtccatcttttattaccaaagtttcactttttgggctaccctctagctaatattttcactttagactaggtaagattatctttgttgcagtttggaccaccccaagtcacttttctagtgcatctaccctctaatcttgtgaataatagtctacatgtgagccaggaagttagcggtttatgggtgttgatgtggttaaagtcatttatgtgctcgagaaaagtttttgggatggttcaaagtgaaacaaaggcaaactaatctagtccaaagagaaaagatgttttaaagggtagttcaaagtgaaactttggtgataaaaggtcatttactcatttattttaaagttaattttaaattatcctccttttttattttaaacttatttccaaccttggctttttaccactaatggtataaatagtatataaaaggcctaacctaaaattattttcggttgcttcgtttacttttgtataacttatcagccaaagccaaccaacgtgaatagaacccaaaattaatttactgcacaatacacatttaatataccaaatctccaatgatccaaatcaagtatacaaaacatttcttttagaaaaataattcgacagcatcataatagacaatatgcttgtctattattgattaattatttgtgtagtgttgggtttcaaacttccaatggcacttgaacgacctaataagggtttggatggatatgtatggattaatcaaacgtatataatcacttcagattgtgtcggagtttcaacattgtaccgtctgaaggttatatatacacctatgcccaagcaatccctaaaatgtaaatctatcatcaatgaattcttccatatatacatggggatctaataagtgattcatcacaattatgacccaatgtagtgtcatttgtgagaaactaatactcccaattgcaaattgcgtaaatcaaacattattaattgttgaaatagtagatattgcaagactgccacaaattaagttgcttttacttttgaggcaaaaattggaacaaaatagctatgtttgccgttttcaaattaatttaaaaggtaaaaatgaaacttcaagtacagggatcgataagcttaatttactcacaattaattaaatttctcgatgaattaacaattattctggcttagtggactcagtttgacattactgtgccatcttcaaatttgatcaaaccattcatacactgcattctaagggtatatatatatctaggcacaataattttatatatatgcggttgatcaggaaattaattaaaaaataataattcactgatgagttgattttgtgggcggtgatgatgcaggggttactacagatgcagcagctcaaagggatgtatggcgaggaagcaggtggagcgcagccgcagcgaccccaacatgctggtgatcacctacgcggcggagcacaaccacccatggccgatgcaacgtaatgtgctcgccggatatgcccgttctcatcacagtactcatgctactgcctccagcagccgccacaagcaacagcagcagcagcagaccaaccagctgcagcctgcactgatcacaagctcatggtcttcttcctcctccccattcaatctctacgccgacgtcgtgctcggtggccaacaggccaacatgatgatgacgacggagggcgccggcgctggacttggcatccaaccttcagcagctgataggtctttgcagagctggaggagttggagcctgataatcctactatgatcaatgcaaacatgcaggtgtactccaccaccagcaggccaggggtaagcagctatgatcatcagtggcacaagttctaataattaaaccatgcagtacctatatatatatatatcagaacttcaatattcgagagaggagatcagaggaaattgaattctagcacgtacaattaatacatcatgactatgcaaaatttacatatatatgatatgatggtcgcctgtgcgattattagtgaccaaattaaagattgtcagagatataggcgtgtacttacgcttatatgtatcacgctgaggtatactgtatttacaagaagataaataaaatatccatatccctctagatgcttttgattggtatcctgtatcgactgatccatatatatgtgcaatatattagctaatttatgtcattagtacatgcgtgctatattaagaagagatagatggcaaaaaggagtcacgtaccacatctttttctggatggcttaaaaattatcacattgataggataaaaggatctatattaatttgcatcatttggttgtcatgctaagtgggctggaaacactaaaaaatctatgttggagggggcaatagtgttagtttttttcttcaaaatttcctcgagctagctataaaattcaatgtaaaatttgaagacaaggggaggccgagttggccccttcgccgtctccgtctccgtctctaggtctagattagattataacgggatagatcgatcaagatagttatagatgtatacatgtaaacagatagagatgtatattaaatacagtacgttctacttttaaatctagttctttctgcacaaaatctcgcatgggaggttaattagttaaaaaaaaacgtgtacatatatttgtgctttcatgttcggatatttgaaatacctataccactttaaaagaaggcaatggtgcatggtggcaaccaccgcccctatcaatgacatgcaggttctcaaatgtactctacaataagaagactactagaaacagcttgattcaactagatagagaagtggatatattattgtatatcgtctatatatttttcccacgtgaatatgtaataccgtaccatatgattctctttttaatccgtaacaaaatacgggcatattctagctactaatatgtacatatatgaactgcatgcagtccccattagtagtacttaatttgggaggtagttatattccatctgctgcaagttttcatactttgcacatgagaaaaatgaatgaattagtctggtgaaaaataagatgaagaaaatgctttaatgtggtggtttaattttttgctttgcttggttttatggtggtttgtagtttctagggttggctcacactggtggagaacgggg

SEQ ID NO: 70452 - DNA, 692 bp, Oryza sativa
ttgcaaactgggtatactgtttttcagcactatgtgtcctaaggtgcaagctggttaagcaaaacaaattttgcattgttggtgtaaagaacaccatggttcagttggtaattttggctctactgtaggatatttttgtattgattgttatgaacaacttgcagtcatcatcattggtacacgtttgtgttgaatatttgaatttcaatagatgaatgtcttgtcgaaacggtttccagttgtctttaatgtcaaatacatgtacctttttttttctcctttctccctcagtaataccatgatttaacttttacttttgtttctttaggtatggatttttatgagttactagatatacctcaaggggaccgaagaaaataccatgatgatgtcactgtcatggttatttctctggaagggagaatctggaagtcgtccggaacatatgtgtgatgatcagttggaacaatgtcgatgtcaatatttatggtgacgcatcaagtgatctcagctggtcagagcctctgagcaactgcatttatgctcatcaggggagaaacacccacagatggctgacagatgatgcactccatacatttgtcaaagcgattggagttggagccagcgttggtctagatcttagcttcagcacaaaacacagtccatgaatgtgctagagagttaattctcgg

SEQ ID NO: 70453 - DNA, 578 bp, Oryza sativa
tgcaacgtccccccactctgcattttccttttctcttgaagctacaggagagactagagaagttaaaatattccatttaatacgggtagcaaggtccaatcctatttattaacttatttgcaaacattagttggagtatgcaacaaaactaagggatcggcagtaagttgccaataaaatcctttcttccccaccccaataccattcagaaaacttggtccaacaacaattgtctgttcgtactttccaatatttgaaagatttcattatcttgttactaggcagtggacagctggtagcggtgggcataaaaaccgaggacggaagaccggacccaaaaaaacgaacccaaaaagaccgaaagctcggtcattggtcactaattcgggtgtacaaccagaaagaccgaacttaattcggtgagttcggtcgttactttggattaaccgaaagaaccgatggaccgaagcagccaactacctccctgtatccctcctgtacaaggcccacaagtccacaagctcattcgcatgaacacatcagccacaaccttatccctttcgtccatcacgcaaagg

SEQ ID NO: 70454 - DNA, 1225 bp, Oryza sativa
caccaacatcagtcggacttgatgcatttatgttctcttgtgctagttcctgctgggatctttgattagtctgtaaagagtcattttcttgattttgaaggcgcacatcaacaagattttctgccagcattgttgaatatctagaaaaagtttgcacaaaacaacagagagtgagcatgcagcgatgaacttactaaaaagtaagatagttccaaaacaaaaccaactgataatagatggtagtacctttcagtctgtcctaagaggaaatcaagttgcttgtctagggccttttttttcctttcctcaagctccagttggttcttataaaaaacctgcatcaaacccaaatataaatagcataaggtttagtatattggaaaatgtggtgttctaaatatacactgagccacaatgaacttgccagcttctctattttggtccagaacttcttcacgtccttagaaatatttagggcaacttttctcaggcgaacttcttcctcctatgaaaatcgcagccaacattaagataaaacccatgaatactgatttgctatccacataatctacggtcattgagtatgtcgctcaatgtgctggttatatatttacttgcagttgaaagaacaaattaggggaaggaacactgcttggttctcaacttatcttcatcaaagttcaattcaatgtgctgttataaataatgtcttatgtactaatgaaatatatttcctagactgaccatagtttatgccaaaacatgcagtacttgtgaatttaacctattctaggctttatttgtcaacctgatcttattgatcaaagtctccaccaaatttaggtttagcaagcagttaagcaatcagttagctatggttcttcattctttattctcggcaggttaaagtcagatcatggtaataaataaagggtactcagttaaggtccctgtgtactgcagtgaggataaactaagatgcacatcactcagttcagcaaacggcaagcatgcagatgtggccatgtgggtcattgccagcaataaattacagtccagcttccttgtcgccttcccagcctccaacctttcccattactacagtttattattctatgtatataaatgataaagctgctgatagccttcaatatgggacagaattgtaataagacaactctcatggagtcatgttaatctgcctaattaataaaaaaaagacaag

SEQ ID NO: 70455 - DNA, 2078 bp, Oryza sativa
tcaattctacatgaccccaaatcaaagttgaattggtggcaaggtacagtgaattcgagacaagtggtggggggaaaaaacgagctgctacagttgtttctccacgacgcatgaacgcatttttaaccgtcaaaatccttcagatgttcactgctcatgctcagtatacataacaacaaacgaccatgtcattttccgggcacaggaggaagccattaattagatcagggggagaaaaataaagtagcaagcagacctaccacagcacatatacatgagtcactctcaactccctacttatctcgagaaggcttatctcactctctctgcatcgcatggaagccactaaagccaggcttcatccaaagatcatggccataggccggggaggcagtgttagttggctgtagccatcagaatttcagaggtttatgcatgccagtgtggcactttagccccggctgcaaccttcaagacgtgcatttctcagccagcaagcaagctgcccgccggacagcagcggtggtcagttcacggccgtgctggctgaaaattcggtggcttcgtagcatcgcatctcttcttcgtcggactcgctgcagcgacagctcggggagctgccacacagtcccctgcagtcgtttcgccgtcgtcgactcttcgtcgtcatccccgcgcgaacgcgtggtggacaaaggcgacggggatcgagagggtagctagctgcgctagtgggggcgcaatcggagcgcgacgtcctgctaaaggaggccctctgcaaatgcaatgataggaacgtcacgttggtttttcagagcatatatgagaatgagaccgagaggtaaactctgtaatatagccaaccacgtaaagtggcgggagtatgagaagaattaggtatgtcggtgtcataccgtttacatcaagaatcaggtatgcctagctgagctagccgtgtagctgatgataattagaagatcgaaggcgaattctatggttagtttcagtgacagactggagtaggtctagaagatttttttagcgttgtttatttcattaatcacgaaagtatggtaaagcgaaagtcgatttgaaataaatcagtcgtcgtttcgaattataaagtaggctgcagccgctgtcaggcgatccatctagaatgcacttaaccagcgtgagcttggttacctgaaaaacgtagctgcgtgtcacgcatgcctttatgctaaaatatggaggcgtgcagtgattgcagttcatcaacgaaagggaaatcggaaggaaagcaatgattggaaagtcctaatccccattagttaaaccgatctgtaatcactgtcgagcaattttattcacccactgcttgctactcatctggtcgcaacgcacaggaaagattgattggattagcttacctgaaaaatttgcacgcctagagtcctggacgtatgcctggtaaggcttctacgtccagccctcctagtgcacgcatctatgtctttttaaaaagacaaaaaaaaagagagagataacatttctgcatttttcttaaaaggaaaaaagtgcgcaaatgcattggaaagcacaatgcaattgctttctttagcaaatatcatagtcactcgtactactacgttttaatctggatacacagtatatggacctgtcgacacactttcatggtagtcatgcaaaatgcagctcatgtagcgctgcagacacgtaggagtaaatcactagtacagtgcagacaaaagtgataacgactcacaatatacacacacctgacaatatgtcgtcgtatggatggcctatattcccccgatcatcatatctggcttaccgacaagaacatttgggtacattcaactgtaaacccccccccccccccccacacacacacacaagaaaagctcggccatatgacagggaacacactgtcacacactaaactctgctaaaaggtagctagcctaaagggacgacctgtgcagaggaaacggtaggtcaggatcgcttgaactatgcgagcgtctacccgtgcaggaccagaaaggggatgcgccgatagatcgatc

SEQ ID NO: 70456 - DNA, 1434 bp, Oryza sativa
  unsure (1)..(1434): unsure at all n locations
tcatcctaactctcaagacttgaaacatcaacagtaaggaaatagataatatgtactgaacatagtaatgaatgagataaccaagaaacacgagcaagttttgactagtgattctcccagagctctagtgccaagctaacacatcaattgctgatttggcagatcaaagaatgaagatgcacagtgcacctttatcaaacattttaagtctttgatgaaattatcagtacgcatttacttaatacagcaccaacaaccaagagatcagtcccaaggcatcatattcatacattgtgtctttttttagataatggaattcatacatagtgactgatcgcgtaaatagaacttaagaagacccacaggtagttgtcagattctcagtgagatcatgcatatgacttgatagaatttgaccttctgattttatttcatacatatatgacccagttgctccaacttttgttgccatctatggtcaattgaggtaaatataggtttcgggaataacaaagattcctttagaaatcaagttttgagagaactgagcctgccacaatagcccaaactgtagtcatgcatgcatcngcccagcatggttcgttcttgcgccgctttttgaaaacacataaaagctttgcacattactgtaccaaggagaaaatgctttgtttttgtactgtgttaaggagaacatacagaaactctgcattatgatgcaagaatacgtaggcaacacaacaaagctttttaaactgctgttgaagaatgaacacatgaaactttctagctctatatttcatttcacctctaccactgaaaaggactgtagaagcgagaatggtgaaaacatctaaatatgcattagttgtgctgattattttagcagtaagcacaaaattaaattaatacgccttgacaactgatattagctttactgagcaaatctctgtctaagctatatattcagaatcaaatgttcctttattgaggatttgaggtccgtcaaacaaaccaccttcttaacactggacattagtaaaagaacttacctggaaagcggtccaaactgtagaaacgactgtgatggaaggacaagaatgaacaaaggattctatattttactagtaccaacctatcaccttacaagaaacaacctctagcctcattagagttagctccttgaaggaactctaacgaaggtaggggctggctcttccaccaacctccaatgtaaggaagtcagtttagctttatagatgccagcaaatgatcaaaacttggtttgataacctattcgcaaaaaaagattgtacaattctgcgtttcaacgctaaccattcgcagaaacagcggtaggaaagcctaagaatagtacccgtgaccaaacttagaccaacagtaaagctatgactatgaatagccttctacagc

SEQ ID NO: 70457 - DNA, 18198 bp, Oryza sativa
ttgctaattgccatcacaaatcattgcataaactaagtttcattaaccaaatgcgagttaagtgaaagaatgtgggaaggaaggaaagaacccttccggggccttgttgatgaggaagacagcctcattggaggggcggatggtggcttcttcggccccattatttgccgcacccgaaccatcgggaagctgccggcgccgtggtcggcaaccgcctccgccgccgccgccttgtccttccgcttcttggcgggcgtgggagagcttgcctggccttcaccggacggtcgctcctgtgggggatccacgtcgccgagcttcctcttggtgggcgtgggcttccccgctcctcctgtgtcgcgtttggcttccttgttcttcttcgagggagtcgacataggcgcggacgcttgctgcttctcgcgcttgggctccttgctgctctccttcttcttcttcttcttcgtgggcgtgggcttctccccttcgccggaaacccggtgcggcttctcgctcttggcccccttgtgcttccgaggtttgggctccggcggctggcgcttcggcttcttggagggcgtccccgcatcggccttcttcttacggttggatcccccttgggggttgaggcgcttgttgttggcgggcggcggcggtggtgcctcctccttggggttggggtttttgcggggtttcggcgtggagcggtccttggaggtggcggtggatttcttaggggtggaagcggaggcggaggcggagggagaggcgggatttgttagggccttcttcttcccggccatgtcttctccggcaccggcaccggcagccgcgaggttcctctggaaggcggcggccggagtccggagagttcaaaattatttggtttgggggcgctgatgctgaaactcaactgattccagtctctgttgggtttttgactcatccggttcacgtatttgcaaatgtcatcctcctggatcatttccatctttttatcattgaagagaaggcttttcccaaatattggggttattgctcgtgtgtcattttttaaatctacggaagccacgtcaccgcagtatgtgtggataatggatcatgagaagcctgattgagaaatgtaaatgaatgaaaaactgagatgaaatgaggtactatctccgtcttaaaaatataagtatttttagctaggaaattatttccctaacccattagtcatgtcttgagtgtaaaattactcatttatcttttttctttctccctgccatacaaagaagaacccaactctcattggaataattaactatttaccactcttacgagtggtgataataaatttgtcaataaaatcgcatgtcatatcattaggttactattttattgatttgtatcatcgagcttgttttattctgtttcaattaaaatgtattgtagtagtaattatttacgtctccacgataaagataagaacgtgcattgcaggtattaaagattctaaccttttctcattaaagaacaaatcactgtatcacgacataattctttttctaacgttcgatcttctttcaacaacttcacttgagtctcaaatttttccagtgcgtactacccttttttttaataactaaacattattgcaatccagattattaagctggattataataagttataataaaataagttattagctgtttgtttctttggattattagagacatatattattggtttcgaaaggctgatgtctctaataccctaagctattgtggagtgggagaaggatgaaatggcggcgatgacgatacggcttggggaagggttcgcgcgcgactagggagagaggaagcggatgcatgcgcggctgggggaggcgccggattcgcctgcactgtggagagaggaagcggatgtactcaatctattgggttcgatggaagtggtgggtaatttgcatacaaattttaagattagtgggtctttagccacctactaatttgaaagaagcacgtttagaggagattatcatattatactaatctagcttatagattattataatgatctacatgattgtttcagattattgctaataattcagattataataattctaagctgaaataaatagggcctaaacaatgtcatataaataaaaaatgtagggagtagttaagttgttaagctagtaagaaaatacaggagtagattgtaagtgttactttagtttttccatatactccgtataaccaattgcatacttacaccaaaacaatacaatatgattcctccgtttcataatgtaagtcattttaacattgcccatattcatatactccctccgtttcatattataagactttctagcattgtccatattcatatagatgttaatgaatctaggcacatatatatatatgtcaataaatctagacatatgctaaaaagtcttactagtataatatgaaacggaggaagtagatgttattgaatccagacatatatatatatatcattaacatctatatgaatatgggcaatactagaatgatttatattatgaaacggagggagtatctattatagagaaggaacaaccacatataattaacatccacgttttatttttttctatatgaccacttgtaatccctggcttgaccaacaacatactacaacaacataggagtacataccaggtcagatttgaattgtcaacgaaacatggcgcgttgcaacgtgtgcgctgacgtgtcgctatcctactggaacacaccacgtcaatgcgaccgactcgtggcccccacatgtcagtgacacgcaggcaggcaggaaggcacgcagccaccggagacaccaatgcacgcagctttccgttgcgagtttgcgacccatctccatctccatccatccccttcccccttccgctgccaacatctcatcggcgattcgattcgggtcaattagggtttactcgagactcgagagaggagagctcgcccgctagggtttcgcgggagatggcgcaggcggtggaggagtggtaccggcagatgcccatcatcacgcgctcctacctcaccgccgccgtcgtcaccaccgtcggctgcaccctcgaggtctctctctctctctctctctctccgcccgcccctctttacatgattctactctctcctcgatctggtgcttgtttgagtgcctgcgctgatggcctaatgccctccttgcctcgcagatcatttcgccctaccacctgtatctgaaccccaagctggtggtgcagcactacgagatctggcgcctcgtcaccaacttcctctacttccgtaagatgggtatgcgcctcttacctttctcttacacttgcaagattgtcagtttacaaacagtatctacttatatttactatttgtgcggatcccaatcgtaatttcaccacgtttgcatagtagtaataagagttctcaatgataattctattattgtattctgagggtatcatttcagaggtgtgaagcatagggatgtgaagttagaacggaagtattgttctgcccatgactcattgatgaaggcttatgcgcctacgtgctacttagagaatgtacagtaaggtataaagcgctagtgccaagagtgctcatgatgaggtggaggagagaaggagctgcccctcatgcaagaggcggcctgtacatgtgctccatcaccaagagagggaataggaagataaccaatagattgatatcaaacaaataaaataaaattggtattgtcctaatcgatgagtagataatgtgggcaaaaatagaggcatcagttacctctactattaaactcgctctttagcgtccttgttggacagcttcaacctgtggtattgattagggataagtgcctttgggctgcattaggagtttaggtgggacctcgtcaaagaacttatcaagtggtatacaatttgcaactctttaattatgatcacaatgtatttcaaactcataatgtgtgaaagctccttatacccacccactcaaggtccttgtttgttttcattgaattaattgtgtctaccctgtattttgttcccctaattgtatgatcctgatgtatagcgcatttagaaaattatatctaacatcttaccacgtctccagttaccattataagttaacagcggatatagatttatgttatcgtgctaatttatgtgtcctcatgtgacaccatggaagtgcttgtatattattagttcgctacacgtgtgttgcgtatgtattgcattataagtagaacatgtaagcgctgttattctagcattattgaataatttttatgcataatttaatccctttactcttattcctgaatccatcttttgttgtttccagatttggactttctgttccacatgttttttcttgcacgatactgcaagcttcttgaggagaactcattcagaggaagaactgctgactttttctacatgctcttgtttggcgctactgtcctgactggcattgttctgattggtgggatgataccttatatttctgagacatttgccagaatcctgttcttgagcaattcattgacatttatgatggtacgagattagtacaagcattatacttggtttttggttttctacaccatcgttaggggtgcaggacaaatcttagggattttctgggctctgaaaatagtcttcttgggtgcatacttagaagttgagttttagtaattcctctcgtatggacctgcaggtttatgtatggagcaagcacaatcccttcattcatatgagcttcttgggtttgttcacctttactgctgcttatttaccttgggtaagtatttttagtttcctttccatgtaccacaacatgactacatgactaatgcacacttgattctcatcttaagttaacttcctagagcctcttcatataatcatttttttcatgcctgaatgttaaatcacacgatttgaaatctgtaattgatttcatatgttttatgcaatagaattatttaaaacctcttcaatttcaatatttttctttgtttgtagagcaaaatatatgtttgattttttcccctattagccaagagcccaaaagcaaaccattttttttcccaacagttgtccatttgtcctaagcattacccaacaaatgcttttctgttggtttgttttgtgatgaatgctctcactatttcacaacatgaagtagtagtaactttatgttttggtgcaagaatggtctatttagtgtgtaaaaacgtcacaggaacttggtgtaaaatgctagacctttcctttaccatggagccaatttgttgttccagtaggtctaggttcatcttaaaaatgaatgctccctccatttcaaattacttgtcgttctagctttgccactagtcaaacatttctatttttcaccatccatttttggaaattcgtgtaggttaacatgcaatatatattatggaagtatttctcatggtgaatctaaaaacataaaccttatgatgttaaactatatgaatttctacaagttgatgttcatataaacatttgatttaggacaaagctagaacggcaagcaatttgaaatgaggggagtacctcactagagtgggaataaatttctgtattcagtactgtgtgataaagtaaaatggggaattagcaaatgtaaatgtgctctctttacagaatgccttttggatttgctaagccttcaacataaactggctgtgacaatgtacgctgaaaaggttttgtcaaccaactcctggacatccttttgcatcgcgcacatatttcattgtcagaatgtattattacaaagtagagaaacagaaactctagtggctctgatcttgtttttgctttgtagtgatccttgattttactttttcacctgatatcacacagatgaaatttcactgaaattgttcaaagtttattcaactttatatcagagatgagaaacagctgcgtgaattgttctcttttaaattgcaggtccttctggggttctctattcttgtgggaagcagtacatgggttgatttgctggtatgtttcttatcgttatgatgaatatcataatagcactgtgattttttagtgtctgtgctgccaatgctgcagttaaagaatgccttgtagaattgcaagctcagtatggtcaacggttatttcttctatcatggttttgtatgaatattgtttgtttcgttttccatgagctacaagcctgtgactggtttttattggtcatcttgctgtccaacttttatttggcattgcttatttgcaagtgtgacataagcctgtgttaaaagcttgttccattgtttttgaatgcctgaacctgggctctattttgcattttctacccagcttgccaatagatgtttctgggttagtgagctataacctgatgtaggtttaactagctacattgagatggtactagctattttcaatggttaaccttggtgttgaagtatggaagctgaaaactttattttcaacatgttagcatatttttaacagaaataagctattggtctttttgctgtctatgtgtgacgatgctggtagacatagcagcatgtattaatggtaacttggtaatggagtgctggctggctcgtgtcttctctgactggtttgtatttgccaatatcatgaacttaaaatggatcttatttgcttgtttgtattaacagagactttttcctcagagataatttatgcctgtgtactctcctgaccatcattttcatgcatctgtatttttttaatgaattattagccatgtccttattcggtatgaatgcctgatgtattgactgaattaaaattgtcaatatgctgttttcttcttggaccatatctgtaattgacaaatattgtttctttcagggtatgattgctgggcatgtgtactacttcctggaagatgtatacccgcggatgactgggaggcgtcccctgaagactccttcgttcatcaaggcgctatttgctgatgacaatgttgttgtggcaaggccacccaatgctgggcttggcgctggagcaaggtttggtgctatgggtgcagacccccaggcccaatgatcaattgccattcgaaggcagttactgattcgagagttcttttttttttttcatctgttcaaattgcgaaattgtacaagcaatgttcccgtgtatttatacaggctatagatcagagaattattgtgcataagaaagcatttagtagtatctggggcagctaaatttcttaactggacacgaagggtgaaggaaatggtttacgagtttcaaccggctggacaatgccgccatccttggttgcagaaactgatcctttttgcgacgattgacatctgaccgggatacttttcaatgtggtagtctattggtaacgataactgtatcaatcgttgtgatgtttgtccttgcgatttatggtatcagaaatgttagaatgttttatatactgtttgggtttgaagaatattggtcgaagatgaccctcgaaatgtacagctatccgtcaaagtatttttttttaaaaaaaaaacatgagtggataaaataagttacgtgcaatgatattcataacaaaatattgcaagtacatgcgagtaatgattcttgcaaattacatagaaagctattaatgtaaaatatcacgtgtacatgataatattgattgctaggagatattagctgttggatatatattacaaaagacaaccactagttaccaaatcgtccccaaatacatttcaccgatttgacttgaatacaacagatcaattttacttgaatgcaacagatcaattcataagcgtgccacagagctgaagtacgataagcagcgcgggttacgcggcgcagtctcgcactgaaagaagtgtttgtgggtatatcatcaactaccccatttgatcaaatcctgtcttaaaacataaatcttgttctaaatataaaatgtttatagccagatggaataataaagagtgaattttacaaaactacatatacatgtacattgatcaaaatatataaaaaaaatacagatttaaaatattatattttaaaattatcacaaaactatatatgtagggcctcatatatttagatgcagtatcaggagatcggtcccttgtgcatcttccccgtcttgacttgctccggttcaattcaaatcacctcgctcgccgtccgtcttcgtggagctttcgaatacgaggcggcgatcgatgcattcccgccaccaacgcctcgcgtcgctgacgaagttgctcacttcccacgtcaacgtcggccgtcaccgggatgctctcgccttcttctcccgcatggtctccgacccctccctcccgccgctctccgacccctccttcgcctacgccttcccgctcgccctcaagtcctcctccgccctccgcctcccctccgccgccgccgccgccgactccctccacgccctcgccgccaagtgtggcttcctctccagtccattcttcgcctccgcgctcgtcgcctcctacggcgcctgcgcctcccccgccctcgcccgccgcctgttcgacgaattgccccaccgcaacgccatcgtctgtagcgccatgatctccgtccacatccgatcgggcgacctcgccggggcgctgcgtgagctcgatctcatggatgtggcgccgaccgcctcctgcttcaactctgtgatcgccgcggttgctgagtccggggaacatccggcccgggccatcgatctctaccgacggatgcagagaatgggcgttctcccgagcctcattactctgctggcgctcgtcccctcgtgcacggcgctgggtgcgttgagctcaatcaaggaggttcacggttttgctacgcggcacggcatgtttgcgagctgccacctaggaagctccctcattgaagcatacgggcgatgtggttctctggctggcgcacggaacgtgtttgaccaggtgcaggagcgcgatgtggttgtctggagctctattgtatcagcatatgcattccatggccacgcagatgttgcaatgtcgcttttcaggcatatggagctggacaatgtccggcctgatggcataatgttccttggcgtattaaaggcttgcggccatgctggtcacgcagatgatgcattgaagtatttcgatgttctaaccaaaatatttggggtcgaggcctgtggagatcactattcatgcttggttgatgtcttgggccgggcaggaagactacgccaagcttatgatgttatacagacaatgccagttaaggttactgcgaaagcctggggtgctcttcttgctgcttgcaggaaatatggggaggtggggttggcagaggttgcagggagagcattgtttgagattgaaccggagaatgcaggtaactttgtttcacttgcgaacatctattcaggcatgggtatgcatgacaaggcagaacaggtgagaagggagatggagcagcgaggtgtgcggagattgcctggaagcagttggatgatacattgcaagtcaaggtgctagcatcatttccaatgaattccttttgcaatgcccagttgcctatatgaccattacagctttattatcacccaaagcatgaattaactgactgttctgtttgctgcagtgaactgttctgaaaggggaaacacactttgagaactgcatcacagactcacaagaaaattttatcaagatattcaaatcgtttcgtatccatgaaaggtatctgagacatgccactatgtagaacacattttacttgggtcaggttcctaactctatttatcacaattgtgtcatatttaaatcaaaactaactgcaaaatagcaaaagtaacagaaacatagtgttgggtgaatgttaactgtacatccagcagaacatcaaatttccccatggtaatgttgggaagtcaggaatttgtgctgacagctatggttttgtttggaaaatatcatttgcattaacaaaggaaaaatcacacgccctttcctgtggccctgttctttaatttcacttgctttaagattgcgttacaattagtttacatgttctttacatttcagttaagccactcattaaaagatcactaaggttactgcttctatttttcctctaaattttttgtgcttgtttattgtgaagttagattgatatgatttggccagtttctggacttctgaactacctttttagccttttaagggcccttcccctagttatttcttttcctggttcatatgatgcttactttaatgcacctttacaaaaagcatgtctcattagaaaattgcactaagcaagatccttaatatctttcatgtattctttttctccatctcatctagtgatcaaaaaatattattttataaaggtgtcagcccctgttatgcttccattagatcagtcggtacagtgccttgggcttgaaaatatcaagtccttattttgcacgagtagtgtgagttcattaatactatgcattagagatgttattcctcagctaaacttcgtgcaaatctaaatatccattttcagtatgtctgtaataaacaatttcaccatatattattaccgcattttgttttggcggagggaaatcagttgtttccagtctctaccctgaaagcttgacaagagttagtatgatcaatcacttatagcaaaatgttttttgtctttttacataatcagacaaagtgaatacaaatattgaagagcatctagataaattgcaaagttccaatagttggaactgattaccgtcaggttacttcagttgaggcgtacaaatgatggatgagtacagctaagttttgcagttacattataaatatgaagtttatccatgattgtaattttgtagaatggattatgtactactcactgtgtcgtgtaacatttgggatctgacgcctgatttaccagaccatgactgatggtgagcagtacagttttcttgtgtgttctgtaataatatggaagagcacttacctaaagtcttaccggagaggtccctctcaaatagcttcgttgtagccttgtaggtgggttaggagcctagggtgcatcactattgctagtggtgctaggtcccagtacagtggcatattggctggatgatgtggaagtaattctataaacctaatttatccaacatgtattgttcaacttctgcactagagagcctaaaattgtgatgctgctaactgctaagggtatttagctacccacacgattatattatgtttccttcatgaattggagcagaatctgtaaatcatatatgtatctgctatagctacccacacaattttcttccaccgtacacattttctgtctgatactaatttcatagacctctcgatacatcgtgcttgttttgatcactaaatttgcttgttcccatcagtatctttttctgtaccaaattcctcgatctgcttctacaaacatgtggtgagtgtatgttccagattcgatatactaggccacgaaccattgaagaaaaaccaggaagcgagcccaccaatgtgcataacaatttttccgacaggatgtagtgcgatcattaaagttgtttatctctgttattatttatgcatgtgggaacctccaagtgggaaacaggtgaattggattgctcatgcagctcaactgatgccaaagttgaacctagctagctaacatattagtaactattggttgaattgaaaacatgcttgacacaccgttttggataggaaagactggacctaagaactagttgccttgtgctgatctatttgctaactacggatttatttatgattacaattcttttgctcccggcggtttgcttcttgtgtagaattgtaaagctgttgggtcattctaatgtgttgcagtgtcctattatgactgaaaaaaacttgttcatggcacttggtacaccatagagtgaagtttcccttatttaggctagcttccaggcttaatacagttatggtcagcagtcacattttttttgacatcacaagagcagccacattttcctgataagttgacatgtgtggcatccgtacacaagtgtggatttcgtccaggatactcaatctgttggcactttatctattgaaaagcatatagtattcaaaaggtgaatgatgaagaacacttagataaagtgatgcatgttcatctcctatgtgctcttgcatagtaggttcatgttgtatgtcaatctttttgagcccactttctgattcctctttactcggttaaagctgtaaactctgagtctcagtaattttttttccttagaaaatccgcatggagtgtttcattgccaacctgctgccctgctaggctgatatgtttttgtccttctgaagctgaaacatttcagtacatcagtaaatcatttcatcatcctttgcctaataaacatttgcttgtgaacatacctgtagtttttgtccgaagtgaaattcattaccttttctcccaccctataaagctatgtgttcatataatttaaacagcttctttttcttggaaaagacaggcagtgagatcagcatcaagcactaccagcgggcaccagcagatgcatgtgggccacagcactagccagtaccacggatggttccgtcttcctggccgtgcaagccagtccacttctcatcatcctctgtccgtgcaaggtgccctggctgcaagtataaatacccagtctccttaccttgcaagtctgggctcttaaccaaatgagcaggagccaactgatgcatatgtataagcttggagatctgacgcctgctccatccatgacgattccaatggcacattcctcaaggccaactctgggttttcccctagggacggcgctcctgatctttgttatcttctccctcagtggcatcttctcatgttgctaccactgggacaagctccgtgccttcctctggtctcggcatcctgatgtgatactccaagaaggccagcacaccgtcatctccattgcgtctccgagcaagacaacatctgatcacaaggtactacagtactaacgatccctattcatatcttactttgatcttaacctgaaatgatcgtttcttgtagacttacagaaatctaagaatgatccccatgtattgttgtttgcagaacgagaaagcagagaaagagtgtggtttgcccgttattatgcctggggacaggatccccaaattcttcgccaggccgtgcccgcatgagaagtgtttgcctgcagcagaggaggaggaagctgaggtgcaagtcaaatgttctgttccacaatctagttagtagctgtaaatgaagccatacagagtgggtgtatataagcttttattagaacctctaaaaaaaattccatttcctctttggtcctatgaaaatattcaatttcttcattgggtatctttatctttggagttagaaaagtaaggattatttcattctcgcaaactttatgaattcatggcatatattctgaccagacccaaatctatgagctcaagactaaaccagaaaaggtcgataaaataatggatggagaccatattctttctgggtcttatgaaaactgttgtcgatcttcaagcccatcccaggtgtggcactgatgcataccagctactggtggcatttggctattctgaagtatgaaccaggtaaacaaaaaaggctattatcactccattgttcaacgatgagaattggtgaaaacataagaggtctgaattataccatttactactagtatacataatttcagaattctgacgaacgtaacaggacattttcatatatattttttgcctggtcggccgatgagacgatcaatttcattaaagacattttcattttacgttctgatttttcttcccccatggaccatggtcgtcgttgtattatgtccggagaacgatttactttggtgtgattgatcataggaaattaagctgctgctattactcatgagctagagatgagttaacatgtaattaggtgatcttttgtttgtgtaattaacgcgtacgatgtgggccatattagcgatcgatggtgcgtatcgtgggtggaggcaatttggatggggttttgctgttgcaatgcgtgctgatggttgcccactttgctggactgcaatccgtgtgcagaccgtgtacgatgcatatggtattttgccgtgggttttgcatgcactttcttttgctagagccagtgccgtgcacataattaagtgggatatatataagtatgattgtatgcatggcacataattatggatgttgctggaaatctgaaacgagatcgcgatggcaaattggcagtgtcatacagtaaattaaacaatccaattaagactgtatctgtatatatgtgtagtatggtagctgattaattattttctcatcgtccatgaaaatgaaatagggcccaccctgaaattttaaattaacctgaaactaattcggctgcaagtttaatcacacgatcgaattttgcgtttagtgttgagaaacatccacgagtcttccggctagctccacgagatggtggactagatgacctggattcgaagcttcaccccttctacttatttgatattatatcattctctaatattcgtgtcttttttattttgcgtttagtgctaaaaaatcaatcagttgcaattggacggtatagacggggagggggacagcgacctaacattcttggttatctgcgcatgatcgattaatcgatcgatgttcgatggatatctatgtgcgcttgcttttcggctttgagggcatgaagatagaagtaggtaaagtgcaagtactacgtagtaggccaggccagcaaggtcgtgcgtgtatatatactcctatacatgacagccattgattaattcagcggcagtatgcatgcttgatggtgaaacgtacgctaatgcatcgtacgtacatgtacggcggcttagcagctggctatcgtcatttgcaagactctaattagcgatcgatcgggacgtgatcctttaacttactattctctgattttgagaggttaatatacggatccaatagttaatggattcacatatatcagagattcacgtcaaaaggcagtacacgagaggagctctttccgtatcgatctaggtggacatatgatcccataagctgataggcatgccaattaacgtttacgtataggcttggcattaatagccttggctatgcctatgctttgcataatagagtgagtacttactattacttgctacaggaacaccacggcacagtattatttttgggcctccagccctccaccgtgccaccgtggccgacggatgaaactccaattaggcccacaaacataggcccatttataataggctaatcagcccattaaaagtactttttcttacatgggccgaacctaacggcaaggaaggcccaggcccatctgagggcgagcggtgaggagagatgccgcgtcacctcccctcccgcccccgtcaccggcgacattattactactccggtcgaggccaacggcggcggcgccactgtccctctccctctagctccgccctccaatcccccgccacccaccgatgataccccgtctacaccgtgccattgcccgccgatcactgctaacctccaccgccctcctccccgccgtcgcccgccaccgcgatgcgccgctgccctccgcccccggcctcccccgtctgctccaccacgcgccgggggcgtccgatcaagcccggaaatcaggtaatcgccctcccgcgtgatccgatcccctaccgctccgcctcttcctgatcactctcactggcaaaagtgcctgtacagccgtagcatcttaagattttttcctcttttttttccccgtaagcaagctgccgatcattttatctgatggatgtaattccacatcacgctaccgttcgcgatccataatttcgttttttcgtctgaaatccaaccgcatatgtgacttttcttcttaattttggttttctcataccctttgtgttctatctgaaggtcctcttacgctctacagggatctggtgagccaagggaaactccaacatgacatctaccaggaaaatgtagcaactcagctggacaacttacttagacgacttgagcaatacgagatggaaatggaggattaccatgtaagctgcatgtgccttgtgttcactactactagttactagtagtacctttttcacatttttttcaataatattatttctgcataaagtgcaggcaagactctctatgtgggaaaatacccgggagaaacaaaggcgaaggcttcttgttcaagaagctgaggataaacagcgtgatggggtgtggatagatgagaaaagggggtttcttgacaagttagtgtcaaggtgatattttttcttctaactgaaatctacccattgttccccatgtggtattttcactaagtcattcttgaaattagatgaagttccactatcccttttatttatctatagacttctcttctgacttctgactaccaactccttcaataacagtagcactaaaatgacgataaacaagtatcatgtacaatacatgcactgaacttctgacttctgactaccaactccttcaataacactagcactaaaatgacgataaaacaagtatcatgtacaatacatgcactgaactttgcttgcgaaaccaagaacaatgtaactaaacagattgttcaacttgttgcatggtgttatttgacttttcgtttggtgattaattccaggaaaagaagaggaaatatagaacctggagttgggaaatgggtctcatatttgaaccgagaaaagaaactggataccttggttggccagaagcctgttgcacccattgctccgaaaggaatatatctttacggcaatgttggaagtggtaaactaatcaataacttcattataatagttttttgatcccatcattcttctaatatcctaacatggcctgcatatgaataactaattctttctcctggttcatatttttaatcaaacactcattatttatcatttatcgtgttaatgttgtccttttggcaacataggaaagacaatgctgatggacatgttctatggggccacagaaggtcttatcaagcacaggaggagattccactttcacgaggtaattagtttagaactatgcatggtagtgcctgttcattcattggaatgaacgcgcaactattatatttgaagaacaattgttaagaagaaaaatctgatctgttgttcatcgagcagtgtgcatgtccaactgaactcaagttcctagctgcactttgtgtgctaggtggctaggaatagcagaattctgtgaactaacttgttgaatggttaccaacatattcagttggtgttctgttgtttagcatttttctgaatagtgttgagttcctttttatgcaggctatgcttgaaatacatgatcatatgcatgatgtatggaagagacgtgatgaggacaagtctattgagtcgagtgctttcagttggatatcaagcctcccttttgatgggaaaattaaggagtggctaattggggaagagaagtacaaacaaaatacacaacaaaaccatatccttttagctgtcgctgacaaatttcttgttgatagacaagcaaataagagtggagcaagcattctatgctttgacgagatacaggtacatgaactttgatattttgaatattcaagtcattttcctgtatgttattatttctaaaaacgagaattggcattcctgccacagataggatcttgtttaccagattactcctaggttagcaatctgttgcaattacataaaaggagtaaagaataatcttgttgaatatttcttgtgaaatctaattttgcttatcttggctgtctcttcactaaatcttttactttacatagtgtatgttatatagcacgtgtgctatatagcatctacataatcacaagtatatggaaaaataattgatcgagtgtcagttattgttaatggtggtaaataagattgtctagtaaag

SEQ ID NO: 70458 - DNA, 1223 bp, Oryza sativa
cgacacgcaggtcgtcgatggcgctggccacgagatcgtccatgtcctggtagtacttgatgcagagcttgagctcctctaccagctcggtgaggacgcgtaccgtggacgtcacgttgcgcatcgtgatgttggccgcggcgatggcgaggccacgcttgtccgtggcggaggcgcctgccggatcagccgagagcacgcccaagcagtagccatagttggaagttgcggtgcatgtctcgttgatgagagatggggaacccaccgtgagaccgggggctattgcggcggcgaggaggagtgtagcgatgatgggatgcatcgggaattctcaggccggggagaagctaatgatgcttttttgtggtttggctcctccaggtacactgagatttatagaagagaaaggaccttcaaaaggaaactgatcaatgtaataaattctaaattcaatgcgattgatcatgaaaatcgactctttaatgtacttccggctatattccaattctttcctcaataaattgccacctcctttaaatgggtgtacattgtgaataatcacaaatgtgtttgtgccgcgtgcaaacgtccgcacgtgaaacagaacatcccctcgtgcgacccttcgctctagtacgtgcctacgtgctctcctgcctgctccccacgcatcgtgcaagagtgacatttataagttcagggggagaaaacccatatagcattattgaaaaatcagacttagtactcatttacagcaaacatgaaattatagatttgaatcatatttaacgcaggagtatagtattttactaatttccttgtgaagcagatttcataaaaaaaaactcatgaaggccacttgaaccgggggaggctaatgggcgatcgatcgccagggcgattgcccagtgatcggtttcccccctccccctatactcctccctcttgttcccttcctcctccccttcttctctttccactgcagtgcaccacacaatttttttaaaaaaacaaaagttagaaaaatttatatatagaaatactatataaaaaaatttgaattcaaattcaaatttgaatcgggtatgtaaacttttaacttataaactttgggtctataaactttaggtgtataaactttagatgtatagaaatactatatatagaaaatatttgaattcaaattcaaatttgaatcggatataattcaaattcaaatttga

SEQ ID NO: 70459 - DNA, 695 bp, Oryza sativa
agaaatggttagtacgtgctcatgatttgatcgttcttggcatatatgttagcaaagctacacggtttcagcttgtttctgtagcttgttggtctgtagccaagattcagttttgtctccatgttcagtgatgaaacaccatgcgtatacatggcagcacatgaaactggaaactaactgacagcatgtaacttgatggttgcagtctggcaacgacggagacatgaagatgagggtgatcgtcgtggaaggcgatgagacgagtaacgccccgaaggatgtatgctgcgagtacaccctcgatggctccgtggatatcaagggctcaccggcggtgaagggcaagtccggcggatggctcgccggcggccttattcttcgtaagtactttgtgctgaactctgctgatttcaccatctccttcccggctgagacgggccagcaaaaaatggagacaaagtcgatgactgggctttccagtgaagtgttttcgcaacagtgcaagtcggtctgaggtgactcgacgttgaggcttaaagtggcggtaggcgccgggtctttacgcggaatgctgcatgacgaggtgacatcggccatgcaacgcccacaactggagggttcctcgccacgggggattcgggcgcacgcattactagcgccacattaggatctccgtaggagacatcggacatggt

SEQ ID NO: 70460 - DNA, 3647 bp, Oryza sativa
cggtcgtgttcacgcagatggcgtcgctgttcgtcgtgcagggcgccgcgatgcgccgcaccacccggttcccgggcttctccgtcccgccctccagcatgtcggccttcgacatcctcaccgtcgccaccaccatcttcctgtaccgccgggccgtctgcccgctcgtgtcgcggctcacgggccgccacaccggcccaaccgagctgcagaggatgggcctcggcctggtgctcggcgcgatggccatggccaccgccggcacggtcgagcacttcaggaaggccggcgccaccacggcgatgagcagcgacctgcacatcatgtggcaggtgccgcagtacgcgctgatcggcgtgtcggaggtgatgatgtacgtcggccagctcgagttcttcaacggggagatgcccgacgcgctcaagagcttcgggagcgcgctctgcatgatgtccatgtcgctcggcaactacttcagcgacgtcatcgtgagcgcggtgaccaaggccaccgccgtgcgcggccgccccggctggatccccgccgaccttaacgagggccacctcgacaagttcttcttcctgctcgccgtgctggccgtcgcggacttcgccgtgtacctcgtgtgcgcgagccggtacaggagtggcacggtggacgtcgaccggagcgacggggaggaggaggatggcgtggccggcaggcagatggcggcaacggtgtaagcgtcaggatgaatcggccgtctgctcgcgctcgatagatgcatggcaggctgtcgtggttcttgagacggagactgcagactcttcgaggggatgagttgcattgggacgagttggtttagcacgacaagtctccgttgatgataggacatgcacggggggatagtgacacgatactaaagaataagaggtcgcctacagatgcagtattgttctatcatgtacgcctgtgtttcatcgtttcacatttttctggccaatgtaacaagagaacgcgactgttactgaccactcatgttttttcttctgcaagagtgactgatcaatgcttctgtgcattgccgactgttgattgatacgcatactagtgctaataatacttcattttccctgcctagtactgttttgtttctactatttacaattcactgctgttccttcacggtggcactgttactttgggcctgtttggcacagctccagctctaactccacccctcctagagctggagttcagccaaacagtttcagctccaccaaaattgagagtggagttgggtgaagctctctcacaaaatgtactagagttgtggagctgggtttaggccccgtttggcatagctctagctcccactccaacttatcaggagccggagttgtgccaaacgatccagatccacctttttttggagtggagttggcagagctactcctaaaaaatgaactacggggtggagctgggtttttgctgctccacagctccactctatcccaaaagacccactaccctctaattttttagagtatctacacgaaaatgccactcaactacccctacaatcctcctttcctcccgttctctctcctcccctcccaatcccgagcgggcgccggcggcggtggcgggctgcggcagcggcgggatgacgacaggcggcgacaggcggcgcagcgtgacgatgacgagcgggtggaggccggcggcggcgggctacggtagcgtcggcggtagggggccacggcgacggggcgtgacgacgacgcgcgggcggaggccggcggcggcgaagggctgcggcggccgggggctgcgggacgaggacgggcggcgcgcgtggccggcggccggcggcgcggctggggccgattggtttcgttttttttcattttttcattttttttttcagatctagaactgaaagtatagccaaacacttttaacgagttttcaacttcaaccggagctagctctcactggagttggagtttagagttaggagttggagtttggagccctaccaaacggggccttagacagctacacaactccactctagactcaactcctggagttatatttaggagttggaactgtacgaaataggccctttgttagcagcaaggcggtgaacagctgaaataaagttaagtggtagaaaaataaggtgtgtgcgcccacttgggtttgtgggggcgtaaatgtggtatgtggattcacatccaacttgtagccgaaaaccatgaaatcgttatttttcagtagcagacgagttatctatttggctgcctagcactcaccatatttggattgctgggccaaatttgagttgaagtttattatttctgtgaagagtacactttaagggtgtgttcagcacccctttttcccaacccatctctctcgttttctgcgcgcacgcttttcaaactattaaatggtgtattttttgcaaaaagtttctatacaaaagttgcttaaaaagtcatattaatccattttttaaaaaaaacaaatacttaattaatcacgtgctaattgactgctcagttttccgtgttactgttccgggttggaaaccagcctatgcaaacacaccctaattatcttggctatgcattgagcttcattcgtgtccattagcgcaaaaccggctatagagcgttaccgattatcaaaactaatgtaaatcaagtccctcggtagtttacacggcgctttcatcctacggctacatgacagattaacttagtccttatccgacgtaatgcttacatgtaattacagccaaggaaaaaatatataataggactcgtatccacatgtaagtggtaattgtatagatgttttttttattttgagtaaattatcacagtactgcaggtttaacatgatatatcacaaaactatagatttagcactaaatttatcacataactacatgtttaagactaagtatcacaaaactatagatttgatatcaatttaataacagaagttggacttatataactcaaacatagcattagtgctgaggatttaaaccccaaaatctgtagtttacgataatttcatcagcaaatctatatcttttttatacttagccttaaaccagtaggtttgtcataaatttattgttagatctgtagttttgtgatacatcactttaaatatgtagttttatgataatttaatcaaagtatttatagctttgtgaaatttactcttatattttttttccatgtgaaacatatgagtcctacatctttcattagaaaaattatggcacaactacgactcacattgggtctccttatttttaaaattttttaaatttttttctagtttcgtgattaccacaagtgccatgttagattaagactatgccaacgtgccaagtagaggttacataggtcaaaaaccactttcaaattagtcgagggactcgatttgcagtgattttaaaagttagaggatactcttacctaattttatagttgagtgatgcaaactcaaattagggatgcgaaatggaccgtttccttcattagttgggtttgatgattgaaggtccgatctaatttgtatctcttaactactatatcagatatcttgacccataactattaaaaccaatgcaaggg

SEQ ID NO: 70461 - DNA, 5705 bp, Oryza sativa
tgtgacaggtacttgaataagtaactggaaactaaacagcccccttagcttcgcagatggtggagacaatgacagcaaagaaggagggggcagccttaccttaattaattcagcgagatttgacagcgatggtcacgggaagtaacgcccggggcccacatgtcattgtccgcatcgcacggtaaccaccttttcatttggctgattgattggcatttcgctttgttgtgtcagatgagatgagataagcagggaaaagtagttgcctcatcggaccacacagccccgccccgcgtaatgcatgtacgcatgcatcgtcgctcgccggccacactctactactctaccacagctcaaactactacccttattaatcaccctctattatagtaactgttttgacactttgttgtgagttttttcttacccagtgataacaatatttttacccccaagatcgaaacgccagtgggctccttcgagagaccatattggcaaaagttgaggttgacgaattagaagcttggacggggcgtgtattgagattaacgtaaccactatatatagcctataggcaaatcatcttgttatcgacgggtatcaaatacatgtacctttaaaagaactactccctccgtttcaaaatgtttgacaccattaactttttatacgtgtttgaccattcgtcttattaaaaaaaattaagtaattgtttattcttttcatatcatttgattcactgttaaatatactttcatatacacatatagttttacatattttattttttttaataagacgaacggtcaaacatgtgctaaaaagtcaacggtgtcaaacattttgaaacggagggagtattaaattttaaaagaattattaaatgtaaatacgagtaatcttcacttttaactctaatgtggtgggtagatttcaatacaagaaccttaccggttgaattagacttcaccaatagattacaatctcggtagatgtcaccacttacattgctccttaataacgaatgtagctacccctttgaatcgtagtaacaaaaaaaaacagaagaatagaaaaaacatataattctaacaggaatgtaagtgtaaaatagcgaattgctaagtacaggaaaaacacaacaatgatcgtttgattggatcacaggaaaaatacaataatcggatgagagagatagactcaaaggattttttttgctaagtttcctccaaaacctatcctatgcaataagccatcccataagaattttgtaggatttgaaaaaacttcaatcctttaaaccaagggctaaatagaaaaatttttgatagatttcaatcctataaaattccttcatagttcctttaattcaaagagatcctatactttcttcattctagaatatgagaatcttctatgaaatctagaagtaatcactttatctcaaaatacaccatataaggtctggtttagttggggaaaatttttggatttgatcgtcacatcagatatatagacacacatttgaagtattaaacgtagactaataataaaacaaattacagatttcgccagaaaattgtgagacgagtttattaagcctaattaatctatcattagcaagtgtttatggtagcaccatattgttaaatcatgacataattagacttaaaaagattcatctcgcaatttacacgttaactgtgtaattgtaaagaaggcctaagatcttattgggagaaaagtgattattactactactccttataatcacgacagataatcttgttcccaagccgacccatttaaagccgtgcacatggcccgaggttctccactcttctcagcccgcacgcacccaccactctctctctttctctagctagctcctcctcctcctcctagtagtcgagcacacactactacactacactagtaggagtagaacctagagaaaatggcggcggctgctccgccaccgccgacgccaccgccagcgtccagccccgcgccaccgcaggaccccgctaccggcggcgacgccctcgcctcctatctcggcctcagcttcgccttcttcctcgcctccctcccgggcggcacccccgccgcgcgccacctcgcctcgctccagtcccgcggccgcgtcctcgccacgcgcctcctcgccgccgaggaccagctccgccagctgcgcgcgcgccgccgcgacgacgcccgcgccaatgcccgcgccgccgagatcttcgccggccaccgcgcctcctggatggacaacgagcgccgcctcctcgcccgcgccaccgccgccaccgacgaggccgcctccctccgcgcgcgcctcgccgaggccgaggccgacgccgccgcgctgcgcgcccgcgtcgaccgcctcgagcgcgaggccgccgagcgcgacgatctcatcaacgcgctcctcgcggccacgcgcgccgccgatgccgacctacgctccaccgacgacgacccggagccgcgggacgcggagcagcaccaccaccaccagccggcggctgcggcgttggatttggatccggccgaaccgcgcggcgctgacgccgacgcggaagccctggctgcagccgcggctctctacgctcagcagcgccagcagcaggagggtttcggcagcgacgacttctacacggcggcggcggcggcggcggcctcgggaatgcagcagccatggatggagcgatcaaaagggtggcaggtgagacgacaaaaagctggaatccatcccctttctctcccattgaccccttccttgtttcttctcttctctactaacacgttgccttcccttactactactcctacactaccacttacttccaatgatcttactccatcgagcacttatattctactatcttcccaggaagtagtaaatctattggtggattgcttaatgcttatccttttaatggctgctactgctaatggatgattagctagggcgcatactacatttgggaaattttaatgttactgttagacttaaaatttttgtatgacttaaaattttcacggcacaagtttttggtgtgtctgtttttgccagaaaacagataacagtgcctatcaaattgattgcaagaaaagttcgcattcaactgcatacttaatcacacataactttgtacttgtctcagaaatgtccaaaccgcctcgatttactacattttcttgttccccttgtccaaaccgcctctgttagtttgggtttagtagcagtaggcttatgccctttatccattatctgtgaactgtaataaacaatcaaattttgatgtagttaatgctaagtcttaggtgtaacatcctgtaattgctctccgtgcacgatttcccagttgtgatagtgataccaccatgaaccttcatacaccatgtcatattgcagaacatagaacagacaaacgaccactttgatagctttctgcatccactggaatcctgatacaaaacctgtggggtaaaccatgcaagaaagctacctgtaccgtatctggctcatttggaacctgtgatgcgatcacaggattcctgttgttgctcatgctaacagtgccatagaagactagtactgcactgcaccgaaataatcagatagccttaagttactctgtaaaaaaccatcatcattttattattctaaacatctcgccttgttataatgtcatgtagtctcgtagccctgatggattgtgcttatttttcatgatgcatcatttgatatttattatagagcacacatttttctcgaactcacaggagagatgcacataattacactaagaagattttatagatcacacttgataatcagcaaagcttttgtgctttataactgaacaaatatgtacctctcgttagcataattgagtggttcacataaatccatctcacactagtaaaactaatccctaacctaacataccgcacatgcccactcagtttcttttgttcatattcgttaccacattgagtacacatttttcttttttgattcatatgattgcaacctgtattttctctcctttctttgattttctgtcttcagatctgtgttgcaggataatcaaagttaaagatgatagtttattgttaacctttatggcctgaaaaagcacaagaatttaaagaaaaaaaatcaagttttgcattaagtaggaatcagtttgaaggtcaggaaggttgatttcatgggttctatatgtacttcattctgtgtattctaaaatggaaacagttttaattaaaccattagaaactgttcggtttcaactaacaccattgtttagttgctcttttctaaaatgtataaatagcaaattcttggaagggtagggccctgttgggagcatcgcttattacttacagtgaagggaagcttagctgggtgggttagtggaagctacagccttgttcattagcccatggccatatgctcatcttctagtgagtagcaatataggattgatatgtgggagtccataataggtgatgttggtgctgattactgctcctgggtgtctggttactggcatctggcagcattgttatacgcagtaatttaagatctattagggttgctggagcctgcacgtccaacaagactgctgcatacaaacactcagacatgacgctcatatgttaattgtaatgatactatgaagtgcagttttcatgccttggtcgacttgaaacagctgtctttttggctcagtacagtgatacttaaaagacacattttgatttaagcaagaatctatgcttttgttattggcacttaagcgaccactaatttgcatatatgtattttttttctagatacacagtgttacataaattgaaatgttgtaatggtgttgccacttaatgcaatgattgatttgcattaatatatatttttttcaataccagtggtacgtaaatggtatatataatcttattatcattgttctacgtaattatgttcatgttatatatggacacaaatcctaggtatcaatgtttgattgttggtgtcagtctgagcattgttagactagtaccctttttaaatttttatgtttgtggttcaatttttaatgttcatcttgtaggacctgaagtatgaaacggctgagccgatgtataacacaaaacatgctgtaccacggtaggttggcacttttcaattgaggcacatggtttcctgaacttgcaaatgaataaacgctagttaatgtttactctctaaacatcttccattaacaggagagaatcaccttggaaggtggatgtggaatcgtcaggagttcctgcaaagcttcaactgcttgagcaggaattaattaacctggaaaagattggaaatggagacttatccaagataccattggtgatgagaaagcaagtgaaaagataccaaactcttgctgggaagattgatgatctttgcaaaagaatggtaagcatcatcttttgatactgtatctagtcttttacttggatttgctgatactactgcataacttattcatagtgtataactgaagatgtgatgaatacattaatgtagcatatggctgttatgctaataaatacatgcttgggaagatctgggaatttgggtgttttaaagatagcggcgactcctgtctgttaaactagtcattctcggttaatttgtaggg

SEQ ID NO: 70462 - DNA, 13936 bp, Oryza sativa
  unsure (1)..(13936): unsure at all n locations
atgcaacctcgagctaccatcagcaacattctaaggtagaatggctccccagcacttggatgaatatgccttaacctccctattttggttcctcttttacgttttgtccagacttttttgtcggagtcccagttaaacttggagggaaactcacagtatgtgagatccctggcaaagatgtgtcgttgattagcaacaaaccattcagtaagcatagttctggaagaatcagggtcttctataacctcttcaaggtcaacctcttcatggtatatcacaaactgcatattgggcatgtgcacaacaagccgctcaacagaaggagttcttccatgtatctcaaacccatataatctccagtatgattcacaagttgatagatatctagacttgatgtactgcataacctcatctatcccaccattgttggcgctgctagtgtctgcctcctctaaatccttctgcttgaaagcaaacgcagtacaatcacttcctttatttacatacttaaaaaggtacttgataaggtacgttttattgcaccattccacattgatatgaccttgaaatttcttgagaagagctagattataagggacaacccaccgattatccagcttaactccattctttaccacatagcgaccattgttgcgtcatcgatagataggatagccatcatcatctatggaagtcacatcacagaattgttttggatacccctttgagcacctaccatctttcatgcaaggagaatgtggattgtgctcaccacatgggccatgtatcatgaattcatcaacaagaccaaacccaaatttatcagtgcctatatctggtatctcagcacttataaggctatcaatgaatgcaggtgaaggatctccagattgacccatgagccatgttaatgtatgagaatgcggcaatccccttttttggaactcgacagtgtatacaactggaaaataaaacagcaagaaaaaagatatgaacagctagcagaagcaatacatgtggtggtaaagagatgtgtataaagactggatagctataatcaatgagatatggaacttaccagcttgtattggaccgaatgcctgtccattcttaatatatgtaatgtactcatctagcttcatatggtaaacacgtgtgaccatatcacttctatcatttggtttctggcctagctcaaaacgaatcgcctgagcaatttctggccatttaggattacatgtgaaagttgaaaatatgtgaggaggaccgtaggcaccgcacaacgccattgaatcatggtaattttgcaccatgtatcgccttcctccaatgaaacttgatggcagaattacctttataccaacatcttttccattagtgtctcccctaccaacagcatcagatataccttaatgtgtttcagagcgaaggttcttctggctcagagtatggaagttgaggcgagatgtctcgatacatgagaaagcattaacagcgagctgatcagaaagtctaccacaacaagtaaataggttgggctcatcctttcggtagtggcactcataccgataatattcaagcatggacgcctcatcacgactcgcaggcggctgatcatctacctctctaagcttaatgccagcacgaaaaccaacatcaccatatgggaagagaagtgggtactgcagtgacataagagctggatgaatgggagaaagctgactcaattcacctgaatgcttctgcacaacgacatcaaacttcgatatctcagaagatgtaccaggaacaatgagcgcagccaacttagaagcagtgggaaggcagtaacgatcaccctgagaatgacctgacccaatgagtttgatagcaatttcaggagcacttggagagagcagcttgtctcgagcaatccggaactgttgcacaagaggattgcattggtcaagcatagagataagctcttgtacaatagcagggtcagggacatctgcagcactgtcagcatggtcaaaaatattaagtctgttttgcagctcattggtggtgtcatatatgtatagctgtgcgtactccgggcgccgtccaggagcaggaagcaaagaacctattctatgatgcacgacaccattgatacggaagacataagggccatgaccagtgtttatgctcatgtcaatgttagctccaagttatgtgaatgcaaataatgaattatactgcctgatgagtcgcatgaaagagctggaacgggcgccgccatcaaaacgaagcaatgattgtaggataggagggaaaggcctatgcacaggtaaggagatcttcccaccacggcaacacaaattgtatgcaatcctcttagccctatgcgaactctggctaacgactctttcttggtaccaaaaaagcgcaccacaatgattgcattgataatcaggaccaccatagtaagaacgttctgggtacgtagctgcaagaatggggcaactcataagcaagggagcatggatatatttgtccaacggtagatatagagtccaaaaacagtgagaaaagtagagcgaaggaaggttggcactaagttatcacctttaagaatctccatgtagtcctttggtatagaatatgagaacctcactgacggtgaatacatgatagcctctgtgcaaacagaacaagaacggggcaacggaaatagcaaataagaaacaaagagaaaggaaagcaataagaggatccacctagttgaccgcaaagaagggtttagataagcaggtgaacaacctttgcgtacaatgacacatgctttcctagctgcccgccgtttttccnnnnnnnnnnnnnnnnnnnnnnntggtactattggacagaaatggtctcctatggacaacataaataggcatggcaatcaatagcaagaaagaaaaaggttataggtagccgaacaacaaaacaaatagcaacatggaactaactggcagagtgggtaggatgaatgagggaaggcccatgactccctgtggaacactcagatgaggaggcagaatgagaaaatggaaacaaaataaatttgtgctggcacgaatgaatgagcaaacacatgaacataagcatatgaatatatgctccgagcatacaacgtcgcaacgagagaacaattgtagtgaaatatgagagaacaaatatgcaatgggtgaggaatggaactatacaatgagatagcgatgatcacttcgagcgtacatacctattgagaacgatgaaccacctgtgaacattgggcgttcatcacaagcacaggatgaggatggttcatctatcgccgaacaaaattgtgaatcagcaaaaaagaacaatcaataaacatggtgatgagctcgctaactctgaggataccgagcatatgtacctatgggacatgatgagcttgccgcgagcactgatcgctcattggcagcataacatgaggacgactcatctattgacgttcaaaactatgaattagtgaacaacagggaaaatgtgcgctaatagcctcgctggctatgagaacaccacatgcaactataataagatcagcaagtaccatatgcacgcttccgcgggcagatgcatagggatctcgaccactccatgcggcagctgtacagcaagaaaagaagccaacaaaacacagacacattgcagatacatatgaatgggcatgcaatgtaaaaacaaatcataaacgagagaggcatgaaccaccacagaaacatggaacaaaacacagatacagataagtaatgtctaaatactggcatagagcacgatatatcccatggacacagggtgggaaaccatgaagaacaaatccaggaggcaggttcaaacatagatacacctaaagatgtgttaaaaacaaacacaaaagacgaaagacataatgacatcgagagtttgcccgaaacacaccatggcataaggtctgacagaggaagaagaccatggccgcaaaaccaaagaaccacggggcaacataagtgagcaaaaaacatcctaaatacagaagagcagcttatcaccaatggatgtgtattaagcaggcataaaaatttttatccgatttatgtacctaagaagtggttacaatacaaacaaactacattcccaagaaagctttggctcaagctgcaatataactggtcggtttttggccattcagctttcagtaacaggacaggcccaaatctttacaactaagcgtttcacatttttttctctaaactttggatggcataagtaaatgttatttgaccctcccaagggccaaggcttcttcctactttgtaggacctttactctacaggaatactgaaccatgctctaaaaaaggaaaacaaaggaggggggctatcacactccttcttcacgagtgcaagaacatctcttgtgattcctagtgcacaaagctaacttcttggcatgctttaccacaccattttccttggggattaattttcttttctcctagccacctttcaaatttattctcggtgctatgtatatgtgctaatgaattcagaatttgtcatacagaggtgggatgcaaagaagcacttcgcatgatctctctattgtcgaatctaaaggggaaaaaaagaaaccccacatatatggaatcaaccgaacaggcatcccagcgactgaacaaactgatctatagagatcagaaacgaaaggaaacagaggcaacctatgaaagaatgtaacttagcaggatgaaaaaaaacgaattaacacaaatatatgaaggaatcagcgaattaacataaatatgtgaaggaactgtttcctgttaattgaagggggcaaaataaggatcagaaatcaacaaagcagatatctcgccgataaaatcacctcatcgcatacacaccgaataaaaggtggtaaccagtgcacgagagagcacaaaatacctttgcgagcagtagacgagggaggcaactccctcccccaagtgaaaacgccaacagagaatccccaatccagcagtgcagcctagaaagcagaaaacccaaaaatcagtgggcacacgcatgatcgaaagaaccctcgaaccacaacggcgcaatctagagcaaggcgtaggaggaaaacaacatagcacaagggaggatacgatcaacgacgataccgtgcggagaaaaaaagatgagctgaggaagagcaagaaagaatagaactagcgctctctgtagaagaaagggagggaaatggacaaaccatcgcctggccatggtcatggggctctccgcgtagtggagcagtgagcagcagccaatcccgtcaccgctgtacgccatagcagtccaccatcatagctcgagagtcgagacaggggcggatagagagaggagcggcccagcgactctgagcgctagagcctcgccgatggccgacacgcggtggcaccgattcacgaccaaagcggaggagctgaggaagatagcggctcggccaatgctaaccgggcccagcatacaggaagcacacgcgtcgcgagctgaatggcagacccaccgacagatgagcgcacagggaaacgacgagcgcacaaggccggcaaaccggactggcgatgggcaggaacaggccgtgttgggctagagaggcatttgggccatacaaccactaacctgcctaaccaccagatcacctattaaaaatcaacgtgtgcacaccgtattggctgccgtctgtccaaatcgctgggaagccggcaaatctagcacctttaagaaatttagtatttagtatactgaaaaaaaaagattattagcaaatcacgtacgaatttggcatggcctatgacgtatgtacacggccggccaggatccatttcatctgagcaaaatacatatatattgtggctaaacttcgtcaaaccttcctttatgcctaacaatatatctatatttgtaaggtatatctaaaggaacgatattaaacagcaactatctccagcttttggctcaaagatgggcataaacgaacattcgatcgataaagatgaattaatccgtcgttagctagctagcttaattcatttgaacatataagtgaagcatgcattcgccagaatttgcagctagtgatatgtagattcctcttcctttatgatattatatatgcatatagtgattgtgagattgagcctatcaaatgaagtgtttgtgtgtatgcttgattcgcaagatgatatgctatctccaccaacccttaattttacaccgttcgtacatcttttatttgaccggtttcagataatatctataaattagagagaaaaattcatatatatcaaccaccacaacggaccgacagagttagtttgtggaccaaaatgcctttaggataagccatgttttttctggtcgagtattcttttagagtgtagaggttaacggagacaaataagtttgtacgagattgagtaacaacaacgtccattgcagtttcaacgagatttttgaaagaatctcatgcggtactattatctggcactgatcgatgatgaaatccttgtgattcgatttgtcttttttccctcctgcctcagtttttactccgatttgacatgaggagttaggagtgccactggtatgagtgatgaaatacagagcggctgaaaggctaagaaactttcctggcatgttcatgtgtcatcaagagaatagccgaacaaatacatgcagtcacacaagatgcaaatatacatacagttactttagttactctagttggaagctgacgagagatagtaacgatgatgcctttcgaaagaccataactagtggctatatattctcctgaggatcctgtggcacaaatgtactcctgtagtagtattagtttttttttctttttctaagtgggtagtagtattcgattagttttaggtcttgtttgggggagttctcctagctgcagcttgctagaagctcccccaaacagtccacagcttctgagaatctgtagttacagattctgaaaaatgaactaaggagccagaagctggagaagctgggtttcagagcttttccagattctcagaagctggctaccaaacagctgtttcttagaatctaaagctccctcaaacatgcccttattagtgtagcagcagctagctccatgagtcagtcagtcagtaccttaataattttctcaagaacccgatgagtcccaaattgagataccggccggcacagccctgcaattcttctggattttgtgaattttcatcagatttatagttatccaaccaggcgctgttttagtgggttccagggtgtagagaaacaaacttttatggacagtttggcttgatggtcttcgctttatggtcatgttattgccaatttcatattcaccgccagaatgaaatggatgccatttttttgtaatacaagtggtgaagaatcacatagtcacctgctgatgcaatagctttgatctttcaagtttcaactcttgcatgccccaggaccaggttcaattctgacggtcaagtgggactgtggaggatacgggcgaccaaaggatttctaaccagtgctcaatttcatatacacaattttacaatcatatcaattgatttataccattataatctagtaaaatatatagtgcaaacctgaaaattactcttggatctaaaaataaacatactgagaggaaaagttttactcagggtgatatggacaaatatcgttttcaaattcaacgataatttttaggtttacacaacattatgaggtttgcactatatattttctcatatatttccccttataatttaggtccaccatgatttagtggtcaaaatttctatcttttttcattaatgtatgtataagtttacaggtctctccttttctcatatactgatagatattcagtcatccaatccacggtaactacacggcatatgtaccacccaccaaagctagctgatgcttctaccttatgcccaccttgttttgtccacacaaatataacaaaagtgatagttccttttcaaccactctttaataatataagtacgataaggaagaagtatagaacatcatcaacaaccactctttagcttcttccttcttttgccttctgcccaccttgtcttgtccaaacaaatgtaacaaaaatgtggcaagctaattcaacgttttacaagctcccagaaggaaggaaagaacatcaaccgtatatctgaacaaggagcaaacaccaatgctcgaattctcgccaccaaaggcattttgttcaatcatatcatgtgcattagagaatatagtaaaagataatcggtgttcattgtcaatgccgtagcatcgccatgacaactccaatcatagggcagccaaaaatgaacaaagggcagtaggtattgaaattgttgcacccagaaagaatagttcccaagtacaagacaaccagtatgacaagggtgcttcttaagcaggagttgcctgcctcctagaagaggcaatcagatctcgtaattccacgtgctctccgctattagctttggcgctttgctttggtcagacagatcaaatgacgctgcgacctgaagagagaagcataacatggtcaagatgaaaaacatggtcggtagctataagagtacaacctctacaaacatctatagtgaaaatagcatagcaagttgctttcaatgttcggaaggagctagtcagacagcacaccagtgccttgttgcggatttaagcagggttgcatgggtacctttttgaacaaaaagtactattgacattctttgttaaatgaactcaaacaagcaggcaacaaatcaatataactagccaaatatttgttctttgccatcaatagcacaatatggtcacagaattacgatattgcattgtggcacatatcatggtctctctgtgtgagactgagatataggaagatagtcttctttagataagttagaataaagtcagcacccttctgtaccagtatcagttaaggcatgtcatgaaggctgactcttaagccggcccaaaacccatccatatcattaagggttgttgatgcatgagctaacacatacaatgcatttatctgttaaactctccaatatttagtagtatatttagtgggatccatccctaatcaccgtttattggctatacaatacagttcaatctccctctaattcgcgtgaagagtcgactctgcatgtaacaacggctcaaagaataaagctttgttgggtgcattaactctcttccacctcagctggagtccaatgtggctgaggccatgagtcagctgagctggagaattgtagatgcccttacgaaccaatctacttcagctctttcccagggtttaatatgagggtctaaaacttggaccagaactgacaaatgtgaatacaaaatgacctttcaataaaaaatggtatgtaatatctaagtcacttttctgcaatggaactgacaagactataaagctaaccattttaaagttatattcgcctatgaaaagccaaaaggccatcttgacaacacatttatattggaggacctaggagatgttagaataatatacgttgtataaagtgaaaacagacggtctagatatttagatctctattcacttgatgcataaataagcacatagtatagagagctaccacagttttatggccaaaaatcttccacatacatccctgtgagatcaacaactcaatgttctttcaagtcaactcacccattttgcttcctcatgtttcttcaggctctatccccatccttccaatctagatcctactagaattatccatcctaaagtgaccctatgatatttgagaactattgctcacaaggaactctaaagaacaacattggcagcttaataaacagacaggcacttgttctctatgcaacaaaagaaggttttcataaactgatcatagcaaatccttcagaaccaccaagataaatcagacagccattgcaaaaccatagaaagtactgtgtgaaacatatagtgaagtagcatactgaaatataagaaaagagtcacgatggaaagaaaagaaaacatatacaaacatactgaaacatctttccaatgaatttcttcactaaaagttatatttttatacactaacattttcctctcaagttcctcacacgaaaagaatcacgatttgtttggatgagtacagaaaggttttaaaaagaaataatcgtgatcatgccccaactttcaaccctaattgtgattttaccctcactttttagggtttgcatatttacccctgtttcttcaaaacgaaatcaccgtttgacccaactatggatggcagttaggtgggtcccacaatattggattaaaaaatagaaatgaaaaagaaaaattaattaagaaaatattagattaccaatctgcccctagtaatagtatcataacattacatgttctcctcacccccactgctcccatccccaaatcgtagatagatcacgtggcggtggcaccgatggcagctccggcgagccggcttggcgcgcgacggagacgaaggctcctcgatgcggtgacgcgagcagcagcaggcggcggtggctcctcggcgtggcgaggcgagcagtaggcggagaggatggctcctcgacgcagtgatgcaagcaccaggcggtggcggtggctcttggcgtggtgaggcgagcagcaggcggagacggcggctcctcacacaacgacgcgagcagcaggcgacggcggcggcgactacccctcaacgcgagcaccaggcggcggctcctcagcgtgctggcaagcaacaggcgatggtggttgtctagttttccaggtagcaatgatattgagtttagatggccatgatggagtgatttcacacacaaagaagttgaagttgcaagcacgggctgacgggctgttttcagtgctataggtaattctgatatgctatcagccatgttggcacactgatattcagtgctataggtaattcagtaattctgtattcagtgctatagatagcaacgatattgagtttagatggccgctatgttgacacactggatgctgtatcattactctatctgcagtttaacacttcgcgtgcaactcccattgtcgattgttccttcatgagttcatgcatgcttgatgtttgcacagttttgctatgaattaaacagcgtgataatggttgaggcgtgctgctcccagatttgtttgtaatataaatgttgtgatcctgttagtgatgaaactggtgtgcaaaattttgtttgatttcggtaaaagtttgtaaaaatcagttcagatttgaatcatttcatgaaatgtcagttcaaaacagttacaagtttcatacacaaactaggggtaacttcacaagtgttgtccaaaggtagagggaaatatacaataggaagcaagggcaaaaatgtagttttacactcaacttaacaccgttaaattgatcatccaaactaggggtaaagctttgcttcgtttcaataaaacaggggcaaaaacgcaaaccctaaaagtgagggcaaaatcacaattggacttcaaaatgagggtaagaatgcaatagccccaaaaaagaaaactagatttggcttccaaagggaagtgagcatgagatgcatacatttctagcaatgatagaggaggatgtattcaaactatctttctgcattccccaagtccccagtccccaacaatttcgcaccacccatggtccatggatagatacgcacagccacttcactagttgatgatgttcgtacttgtgcagttgcacatcatcgagtggggagcaaaatggttacagtagtaaaatgggaataagcctgtacttagcgcagatttggattagtcctagactgacaacaagatgttcagttccatacctagcagcgatcctttcaatttttgtaattctgattcaaaactaaggtattgaaattgaacattggcaatcgaaacagagataattgaagatggcatggataggcaagggaagtaaggataaaagggaggtgaccttgaaggaggcaccgatcttggagtccctggtccagtcgagggcgaggagcttggtggaggcttggtaggtggccttgatggcatcccctccttgaaacttgcgggtgacggcgaagtcccaggcgttgttagcggtgtcgaagcagggctcgatggtggtgaggcggtcttggccgtgcgcgtaggagtacttgacgcggcatccggaggagccgagcgtgtgggagaggctgagcttgttggccggatcgaaggtgagggagccgtcgagggcggtgcgggcgggcagcttggcggggcccggggagagggtggtggagtgcgtgtaggtgaggctgacgcggcggtcgagcagcagcgcggagttcatgaattggaagcgcacatcctgcaggaagaggaggaggaggaaatggggatcgattgattgattgatagcgcgcggcgagaggaagaagaagaagaaatagtagtagaaccgtaccttggagtggggcttgaggtcgaggaggaaggagccgggcttctcgagggtgaggatgaggccctcgagggagggcccgcgggcgaaggcggcatcggtggcggaggccttgaagcggaggtcggcggcggagggggtgaaggcgagggtggcggcggccgtggccttgtcgccctcgtacctgcccttcaccgtcgccttcatcctcgcgagctctgatcactttcgcccagtcgccgccgccgcctatcctccttgcgcttctcctctcgttggaatcgtcgccgccgccgtcgtcctcgtattttcttgggtttcccatccacctccaccaaccaaccctcgcccgctgcggctaggctgctagaggaatgtccatgggccaccgttacggcccagaaaaaaaaaacttcatcggccccatatcaaacacaaagcccattaggccccaaacatcaacatatcgcgctctcactttttctcgctcctttttccacggtggcagtagctgagctgtgcctcgtttcctttgccatggaatgcaaggaagaagatgagagcagaagcaatcggagaacagaagaggaagaagacaacataaatcgaaccaacaacaataagaaatatgaagcatcagcagcagctataagcaaaattagatagtcccatcgatacactctctattgcattgcaaacagctactagtacaaatttagactgacgacaacagcagcaaattgctgcatccatcagatcaacacacttgttcacagcaaagcctagcacggttgtgaactcaagtagtactactagctagtggagtagtaattattgttgggtttgcaagcgaggcggcacgaacacacgatcgaacacgatctcatcgattcctgattcatgattgataaattgctgttgcagctggagtaatctggatcaggcgagcgagggggcgatccagacaggctccgcggcgagcgagtggccgccggagatggccaacccatccgcctccccgtcggccagggagtagacgccgatggcgtgcggcgcgatcaactccacctccctccgcgccatgtacacgcagttccccctgatcccggacccctccgtggcccgcgccgccaccgacaccaccgaccccacgaacagcgcctcccccgccgccagctcctccaccgcctcccacttgcgctcctccgccgcgaaccgggacacctccacctccacctccaccgcgtcccgccgcacgctgtactccctctgcaccaccaccagcgaccccgacatgtccaccaccaggtacatacacacccgcccccgcacccgctgctgccc

SEQ ID NO: 70463 - DNA, 884 bp, Oryza sativa
gcggcgagagggacgcagcgacggcgagggcgatggtcgccagcttcgcgaactcggcgtcctccggggccagcggcgacgcgtcgtcggctcgccgaacgcgtcctcgcacgtccctggcgcgtccagcgccgcgctgagctgcgtcaccgcgtcctgggtggcctcgtccccgcccctggcgatgtcctcggcggtctccccgagctggtccacggcgtccgagtacacctccgcgcacacgccgaggcggtccttcctcctcgcgtccttctccgcggctctcagcgcggcgatgcgcgcggacgtggcgttggcggccttctccgcgatcctggccgcgatggcggcgaggccgcgcgcgtcggccgcggtggcgctggcgctgtcggcctggaaggccttgatgcagtcgttgtaggtgacgtacttgtggccggcggcgacggacttgcatgtgtcctgcaacacggaggactcgcaggtagacaatccgagcatgaggaggagcaccgggacgagcagacgcctcatggtcgctgggattgggtcgacggccggcgatggtgagcttgcgtaggttgggagcttgggattgtgttgtggcggcggcgtacgttctcgcggcttgtcgcgtagacgtcgactgcgtgtagacggtttcgatcagaagctagcgtgcgagacctgggcattttaatacgcgggcaagatttgataataccataatagttgtcttaataatttataagtttgctaaaataaaataatgttgtaccagaccctacttgtcatcgtcaagacattatggtattttgagaagtttgattcgatcttgtctacctttttatgatctgtgcttcctttttttgggacacaaatgt

SEQ ID NO: 70464 - DNA, 781 bp, Oryza sativa
gcaattcctctctgtctcaaaatgcaacggaggaagagcacgtgaagatgacaacgattgtgccattgccgcggattggtgaaaggaggcgaagagggatcatcagcgcacggtgcgggatgaggaatctcgcgaatcgtgactgccgctgccacaggagagaggggagcgatcgggaaagtagccactggatcaaccactgttgttgaccatgaaccctaggccgcctaatcgccggcgtccaccgatccggaaatgaagaggatggagaggagagggagagaggggcggtaccgggcgtagagggcggctgtcggcttcccctcgccttagagtggccagatctgccagcgaagaggccgaagtcaccggatccggcggtcccggcctcctcgttggcggatgcggcggcggaagcgagaggatggtgacggcaatggcccgcgtgctgggcggcggcaggcacggcagcagagagtgcgcgggggaggtcatcacttgcgggaagaagagaatgagggaggcggcacgcggtggcggccattgcttgggcaggagatagagcggagcgagagaaggagaggaggcaaatgaatggtggcggctagggttcgaggaagggggttagggttgtttttgttttgcaaaaacactcttaatcttctagttttcagagcacggttcgattttccaatttttcgcttcttcgtatataatattgttttctacagaggacctgtaagtaagcacgcaaaagttagaactaaggacctataacaaa

SEQ ID NO: 70465 - DNA, 37709 bp, Oryza sativa
agtaatagtaacaaattggcacggtcgacactcgacaagggcagcacgaacggagggatcggatctgatatcggaaagagagagctaaatactactactactagtatgatatgataatgttatacactaatagttttgagtttgattgagataagggcatgaggaatgaccttatcgacggcgtggtgagatcgctggtgtcccttcttaggctggttctggttggatggtcgaacttgcttgggctggtccggggcggcagcggtggcggaaggggggagatgggcgatggcggcgcgcttgcggcggaggtatccggagaggaagaggagggcgatggcggcgcctaagatggccgagaggaggggcagggacaccagactcgtcgccgccgccgccatgaactctctctctctctctctctctctctctctctcgggtttagggtaaaattgggtttggtttgtgtgctactctactgatgacgaaactctcagcggatgagtccgtactgctttacccttttgcttttgtactcactgccgccccggccccaccaacgcgtatgtaacatttagattaaatgtttcatgcaaaatgagatagaaataacatgtgattaattgagttttaattattacaaactcaaaaaatggattgatatgatattttagaacaagtttcatatagaaagtttttgcatgaaacacaccgtttagcagtttgaaaagcgtgtcatgagtatccaaaagtttatccaacttttgctggagaaaagaacagggccatgcatgtattagtgtactactctagaggagaaaaaaaataagaagaagaagaagaaaggagtaagttcatctcctgtctctcaatttcacatcgagtttgtataacatcctcgatttttaataccagaaatctccaccccttataactattttaaaccatgtaaagtaggtccaatgacattatagagagttattttttcttacgtggcaagttgatcgggcccactcactgggtcagtcaccattgatcagacccacatgtcatgggatacctctcttccttttacaatcctcatctcccctctactccaatcactcatcacctctccccactttcctatttctctccatgtcagcgccctacgtgggggaggggcggcagcggcgcctcaccttggtgcggctgacatagagaggagacgaccaacagtggtggtgaacggttgggacaaccttgtcacctggctgcacacaaaagtttgcaaccaccagtaccatcgacctcagcctcatcgacggcgacacttccacaggcccaattcactggttgctgttgtcgtgggcgagtgtgcgcagtgcagggattcttgtcgtgcatggagagtgcaccatgttggcggcaaatttgtgcacagcgaagggcgtgccaccctcacacaagctccaactcccaccgcccctactacatgccatactctccctgctcccctgcctcatctccccgcgccacatcctgtagccccccgcgctcctcctcgtgtccctctgtctcctactccatgaccacacggtcacactcatctcccgtgtctaccccttcgcgtccctcagggccgagatctcctcaaggccgccgcatggatggggaagatgatgatgggggcacagcaatggcgtcgaagacaacgagcactccatcatgggaggggtgaaaacgtgtgctaggggctatgggacgcgtcgatggtgatgtccgtcgagccaacgccagtgtctgccggtcaaacaagaagaagaggaaaatggttgatgctaccatcttgatgttgcattgatggtcggcagagaccacacggatgtggtgccaacgaggagaagataaggagtatttatttatttttactaactaggatgtcacatcagctaaaacaaccctctatactattatgtgatctagtttgtacgattttgaatatttaagggtaaaaatttctagtattggggattgaggatgttttgtaggccgtcgtaaagttcaggggcgttacctatttcaagaaaaagcacgggcagaaactaacttgttgttatgggccgcgtcgcgtcctcttgtgttaggcctgtcgctcgcttttcctttccttgtcaattcccgttgatcgaaaggtcttcaaattaaagcccagcccaaacgcatatgcagcactctctttcacaaatcttttatcgctccatccttctgtataaaaaagaatcaaggaataaacaaggtataaataagctatggattaaaaaaatagaacgcgaagaaatgaaaagaacgtaaactcaaatttaaaattaaattaagtttcggaattcaaacttttgctacggtcatggttgcatctctagcaaattttcctcggtataaacaaaagagaggaagattgatccgcgaacaagtgcaatggagaagagattggtctgcgagcaagtatggtagaagagattggtctttttcgacgctggattgaaaggcttaggccgcgtttgaatatcccattattaacttatactccatcattttttacgtgcacgcttcttaaactgctaaatgatatgtttctttttttaaaatgtttttatataaaagttgctttaaaaagtcatattggccgtttttttaagttctttcgctaatgctcaattaattatgtgctaatgagttaccttgtttttcatgcaggataaatgggttacaaaccaacacgttcgaacacaaccttaatggttttgctatgtttatttaggttctttgtgaaattgcacctctttttatacactttacaacaccaaagctaggcaaagccctagtagttttccaggtaaaaaacacacaccaaagattgttgctccaacccgattatgattttgacataggactttcacaaagaacccaaataaacatgagttcacataggacttttttacatttttttttcacttgagattaattaatttgactcctagagaaacaaacacctcctttgtttccaatatctgtcgttagtactaagtttagaaagcatgcatgcaaatttgatgagcatgattgtgcaataccatgtatgggtgccttttttgtattatggaaattaaaatatacaaatttgatgagtatgagagggtaataccattttacagcatttttttggggattggacaacaaagaggattcatgcatgatgggagcaatgaagatggggaaaatatctagaacaaactacatgtatatggtgtaaacttgaaaattaacgtcaaatagaaatggaacgtggaaaaatcttaggttttcctttttttttaaaaaaaaaagaaactatggtactttttaggtttgcactatatatttttccataaagataaatgttgtgactttctacttgcaatgcgtgatgaactcatttctagtactcataagtgatgaactacaaacaaatatcgggccatcgactggtttatgagttctacatttaacatatccatcgttgtcttattggctcgtgagagtaaaagaaaatttaagttttaaagctaaattttatagttgattttgatgttttctcgtcatggtttttgcagcattgtttttaaatcgcaaagaacaaaaacatatgtaaaagttatatccgtaaattagtttctgtatattgctttgttcaattttctggacttatcaggcgtggagaaaacgatggatggatgtgttagtttcctggctcacactgcaaggatgggacaaaggtttggttaaattaaattgattaatcatgctttgcatttctgcgcaagctaattaacaagcctcactgaatggaattgatccagcaggaggcagacatactgtagtgattgaaaagcagcaagcttattccagcaggagcaggtgataggctgctaagctagctagcaagcatatattcgattcgattcgaccgcccccgccccgcccattaatttcttcattctcatcagcatctcgatcgatccatcggcagctggccggcatcaagctcttaacttaattagctagctagtctctccctccctccaccgcatatccatcccccaccagttgtagcagtagctagctccaagagcttcttgtccatgaattgttgatctcgatcgatcgatctctgctgcctgctagctaatgaataaacaatagctaggctatatatatatatatatatatatatatatatatatatatatcgatcgaccatgtcgtcgtggatgcagcacaggcggcggtcgtggacggcgcggttgctgtcctccgcgtcgctcccgccggtgcgcctgctcgtcttcttcgccatcgtcatcttcttcctctccgtctcctcctacgtcgactacaaggccatcgagcgccgtgcggagatcggcctccgcgttttcgccgccccgctcgccgccgtcaccatcttcctcctctttctcgtcctccagcatcgacgccgctactggacgctgcgccgccaagtacaccaccaccatgcatatgctgatcaggccgaggctgcagggagcgggtcgccgtgggttgtggcgctgctgctgctgctgttgctgctcatgctctccttccaatcctctgtccattccatctggttcaggcctctctgggattctgctgattactagtagtaactagctacctacttctacggttctactccaccttgcagctataatttactcatctacctacctagcatatactatatattatctatctatacatacaggaattaatccatccatatgtaatacgctgtctcttatttgatctctagctcgtatatactccatctgttacacaatgtatgcatgtatgatacaacttatgttcccgtcttgatacaatagcaatatattactactagaaggattaattgcatctgtatactaccacgcgtcttcagttctgctctatttactggttcaaaagaaattgcactgcaaaactgttcatgagagacaatgtgctaaaaaagaacactttacacgtgtagcctaaatatgaatatgttatagtaaatgagaattcatttttacgtctttaatttatacagttatgaggtagtacactagttataacaagagtttactgtagttcgacttgaataattaatgtcaacggactatgtagccatgtccatattgttgtctttttcctagctcttacatgtttctaaattcgccaatcttctttttcgataccttggcgttagctagaaacctcttgggttttatttttcctttacacatggttcttggctacaatatcgggcaatatctgatataccgttacaaccaagtctgacaaacactactgctatggcttctttttataacaataatcattcaatgtacgcctaactagaacatataaataatattttaatctaaagttataacgactagaatagttagcattaacacgtatcattgtcctattgtagctgcttttcaattgacgtcatagaatctatggcattagacacatctttagtgtgcccgctaatatgtttaaactgtttttatttgtaaaatgagatttatatcatttttgtgaagaagtatacatcaattataaatactctcataataattgttctttttaaatttctatacataatatttggggatttgtcccacaccgtatatatttgagtatttagcagcaaaagcggctgttggctgtgtgctgcacaactctagataggggatgtaaataatttccgtaattgaaaaaatgctctcataatataaattcatgagagtagtataacacatgtaaaacaaacaggtaataactcaagtaagtagtacttagaagtaaacaacacggggagtatatatatatcatgaaaatgagaaaggaaacaaataaacaactagtggtattggaatgtattgatgtaaaataagaatacggagttgtagaggggggcagagtgaaaaagggggggcagcaagccgagcatcgcgtactttccccgcaaccccaaacaacaaggaaggaagacgctcctcccctcccatctcttaaaccccaaaaaaaccaaaataaaaatccttctcctccttcggctccgctttccttccctttcccgatagaaatacataccttccgccgccgccgccgccgccgttcctagggttccggcacctccccgaatccccccctcacttcgacccctgttcgcttcacccgccgccgccatggcggagaagctgagggatctgagccagcccatagacgtcccgctgctggacgccactgtcgccgcttctacggcaccggatctaaggaagaggtattctacttctccgcccgctcgctcgcccgcgccttgcgtgcttcttccccgccaccgccgccggacagcttccgagacttagggtttacgcgctttcttctcctatgcgttcccaaccctatccgctctcaccgcccgccaatgccctctcaaccttactctttttcatccttagggtttcgtatttactggagtatgcgtcaagctgggcgttgctgctgctattatagcaccgtttatgaccccccccttcacgctctgtgtttgctgttgctgccctgctgcatattcgtttatccttttattttaacctcctgccaatatacaatgtcattatcacctttaatgtgtttcttcctaccatttttttgattaagcaatgtcatgcatgcatccatattatccttatgtgccttttttcttctttcagaggaatgccgctgatcagatactacgggatctacagaataatccagatatgtggctgcaggtggtccacattctgcagaattctcacaacttgaacaccaagttctttgccctccaagtaagtttccgcacctcactagttagccatgttaggtttctttgcaactcaataaagatggctgccatttctcttaatgattagcattgtagtaagatattttttcatcccgtaatacctgcactttacattacacgtttgcttatatgattgtagtgtaactgtgttaggagaggttctcatagtcaccatatcctatatttgagcattcagattgttcaacagtgttgagtgttttatcacttatgtactaccacattatagagacgaatcaaccctaggagaaacacatgttgcttatttgccttcgcaggcctagcgcataggctagattgaatacatacataggccatgcttaaaaaatttaaatgcaggatggtagcatgaagtttgtacagaaccctgtttacagtaaaagtggatgcttccttttttacagaaatagatggagacctaagtttctaaatatcagtttgcagtttttgtgctatgcttattttttaacatgctggagaaacatggtttataatggcctctatttagagcagtgaaaggtgacatgttggttctattgtttcaccaacagaataaaaagagcttctcttttgccacttcagaatctctaatctctttcactattcaaataaggctcatctctttttttgccatgactccatcatcacccttctctttttggcagaaccacagaaattgtttaggggccatatggtatgatcatgcaacccatagttatgtgcatcagccataaataaaacctgggttttctgcatctacaagctagtttcaacatgatgctgatgcttgctccatgttcattttaaattaggagatcccaacctgggatgtctctgtgcatgcatgctagtgctacatcttcacttgtagctgcgaagttcattctgtgtcatttcctgattttgctacacattttaggtacttgaaagtgttataaagtataggtggaatgcattgccaactgaacaacgtgatggcatcaagaattacatatctgatgttattgtccaggtaaggaccaatacatttgacaaatcttttatttcatctggcccatgaaaacaaatctcattcgtgtatgccttttatgttctctttcgtcactctatcagctctccagtaatgaggcttcttttcggcaagagagactttatgttaataaactcaacattatactggtgcaggtaagctgtactgtttcagtcaccttttaagtcatagcactgcttgttattatctatttgttcatctggcaagtcaactgacttgtattattaattgttgcaatataataggttctgaagcatgagtggccagctaggtggtcatctttcgttcctgaccttgttgctgctgcaaagagtagtgaaaccatatgcgaaaattgcatggctatattgaaggcaagttgagttatcacctgtttctgtttaacaacatggaaccaactactgactctgcgatttgcagcttttaagcgaagaaatttttgatttttcaagaggtgaaatgacacaacagaagattaaagaactgaagtcatcacttaacaggttggttcttgttaccatctttgtccttttagggtgttctgtatctatatatattagaccacagtcaattattttgacatatactttattgcgactgccttttgaactgatgcaacattattttccttattgttgaacagtgaatttcgtcttattcatgagctatgtttatatgtcctatctgcaacacaaagacctgagctcatccgtgctacactggctacacttcatgctttcttatcatggataccagtgggcttcatatttgagtcacctttggtatgtagcttatttctaaacttatcaggaaagatcctacatagaatttatcaaatcatgtcttatttttcttcatatatgtttgttagctggagacattactgaagttctttcctatggctgcttatcggaaccttacactccagtgccttacagaggtaaattggtgatgtatttcctgctgtgtctaattagcaatgtttctaactgcgtatgttcctaatggagtaataaaaaatggaccatatccattagtttggttcagttttttttttctatatatcctttttgaatgggggcagtaaaccagccctattgcatttgagaaacatgtaaccttgttggtttaataccctatttatcttttgtatatatggatcttgcaggtcgctgctcttcagtttggtgatttttataatgtgcagtatgtgaagatgtatacgattttcatgatgcagttgcaggtaaagaatgtcttcaggaatctgttgcttccttctttctaaagtatcctcgccctttccccctccttttaaatatgtacttatgaacgacccttccataacatgtataggctattcttcctcctggaacaattcctgatgcttatgctaatggctccagtgaagaacaggtatggcagtgattacttcaataacagtcagtcataggagtctggttgatttctcattttttaaataccattgaggtactgtattaataaaatgtattttccttggtgcaggcattcatacaaaatctagctctttttttcacttctttcttcaaggtaggatttctcacattctctgtatgcctaactatcttattttttgagataataaaattgcacacttaaaatatatgaaactttctttgagatgctgtaactaattaacctactcttttgatgtcatattcccagttgtgacaaaaaaagctgatttgttcttgtattggccttgtcaatttatacactgaaaaaataacataaatgttagttacgccgtacgaaatcatgatttagtttcaatatgctctgatctctttatttggtgatacatttagaatcacatgcgcatattggaggcatctccagaaaatagagctgcattacttctgggccttgagtacctcattggaatttcatatgttgatgacacagaggtttttaaggtaagtaatttatagctagattcggtacatatatgaatggttcaagagagatgcatatcttataattttggccgatttgcaggtgtgtttggattactggaatgtgtttgttttagagctatttgaagcacacaatcaaatggagcctgcagcatctgtaaacatgatgggacttcaggtgttcctctatgaattttttacatgaattcaatggctttgatatattcacctttgcaattcatgcactttttgcaaacttttccttctatttcacttgttatttcttgttttgaagtgctgcactcttctacatcgtcgactcatcgcacatatgaataatctgtaggctcagatgctccctggagttgatggcaccatcacagctgttcagcagaggcgtcagctttactcaggcccactatcaaaattacgaatgttgatgatttgtcggatggcaaaaccagaggaggtactgattgtggaagatgaaaatgggaatattgtacgtgaaacaatgaaagacaacgatgttcttgtccagtataaggttagtaacagaatgtgtagctattttccacccctgtacacaaattgtgtcacatactctgtgcttcacctgtttaatttaattgtcaaacttatgtgttgcctcctttctttaattaattgttttggcagattatgagggaaacactgatctacttgtctcatcttgatcatgaggatacagagcagcaagtatgtcctgtctacagatattttcattaaaaaaacacatgctataaatattatgctttgttcatgctatgtgatatccattgaatttgttccatttctatgttgagatagcgcaagttgtggcttaaacctgacttcaaatgatgacaacacatggctttagtttgaaagtgcctactgtaatattagtagttagtaagctacttgttggtcaaagctcaattctgtgtaacctaggaaagttatgtgagcaagctcactatgtgtagcccaagagcaattaaaaatgtctactttttcgatataattgttgcacaatttctccatctggtttagtgctttgtacgaagttaaaccagaaaactacaaatttgttttgggatcccagatgctgaagaaattgagtaagcaattaaatggagaagactggagttggaataacctcaatactctctgctgggcaatcggatcaatatctggttctatggtggaggaacaggtttgaataatcatacactgttccattctttttgtctttggcaaacgttaaggaggactaatatttagctttgtgataattttgaccatttcatgcagtgctgaaattcttaatggtttctgtggatctttttcaggaaaataggttcttggtaatggttattcgcgatttattaaatctctgtgaaatcacaaaggggaaggataataaagctgtgattgccagtaacatcatgtaagcattcatctcaactacccatgtttatactaacaaaattaaggtttgactgatctgatgattgctttgttaggtatgttgttggtcagtacccaagatttctcagggctcattggaagttcttgaaaacggtggttaacaaactatttgagttcatgcatgagatgcatcctggagttcaggtcagtgtgcattcacatgtagtctgttgtgttggtgcagaatcactgttttgcagcccttgtagtgtggaacttagattggaactgcttgcagccatctttccttccatgatcttaataacaagttactcatgtatctgttgtttgatcatcacacacgctgtttgctgctatctccagtttgtgcaaatagtttaatgcctcaacacttctgttagtgttgtatgtaatgtatgccttgctctgctgattgcaggatatggcgtgtgatacttttctgaaaattgttcagaaatgcaagcgcaaatttgtcacacaacaggtaaattcaatcacattgcttgatatctcaaactcttatgtggatactttgctgctatttcattacaaattatgttttacttaaagcatgtgctgaatttaatttaagcacatgcatctaatttatgctaatatgcaccggtgacacaccaacttcatgtttctttgttatctaggtgggcgagaacgaaccatttgtttctgaactgttgtccagccttgccacgacaattggtgatcttgagccgcaccagattcatacgttttatgaatcggtatgcttaaaaaccaaataagtaaaacacaatttcaatcagaatagtttatcattaatattattttgtgctatctgattttgctgctcaggttggccacatgattcaagctgaatctgataacactaagagagatgaatacctcaaaagactgatgagcctccctaatcaggttccttattctacattcttagtatgcctttatactttttctggaaaatgtagttttgacaggttttcctatcattgaacagaaatgggccgagataattggacaggcaagccaaagcattgatatcctgaagaaccaggatgttattagatctgttcttaacatcctgcaggtaatttaatggagcctgagaatttcatttgtctattgttttgaaattcgctgtgtgaactgcggtattatttcctttctttcgttgtttttgttttttcttgatgttctttttatttatttattttataatttgtaaagcttcaaagttagatcgtccacctagtaggaactgaactgcgtagccaggtatatgctaagtcacgaactggtagggacatttttgttcattatagctcactgaaccaatttatagagcatgctttttcttgtgagattgtgcttgggaactttgaaaatatttagggtcaatttgctgtgtaaaactgtagatatcatacattctagaaaatatattgcaattgttgtttgtgtgttacctctaggtagttagccagcaattgcacttgcttgcttttggttcctctgtgtgcttcgctgtctgttgaattaaaacattttctttgtgtacaatgtgctgtttttagtgtaattttcagtttcatttacctttgcacaaccctccttggtcttagatactgttggttttttgttatttctcctggtgtaataaatgttgttatatgtgcttgcagacaaacacaagtgttgctagctcacttggaccacactttttcccgcaaatttccctaatctttcttgacatgttgacagtttacaggtattttgttcaccgcttactgtattttattgctgtattatgttaactcttagataatggtacagcattttcttggaagtacaaagctaatcaagtattacaaatctggggcactcggcggggtaaataaattgaagcaactgactaaaacaattgatggaaatcaaatctcgatacactatattgctaaatctcagtattgtactacataacaccttccgaagttagatcaaggtctcagatgaactgttctttgggattgtcctgcctggtgcctgcccatgtaaaacttggtctcttttgtatggcaatatgcaaacaaccacaactttctggggcctgcagaatttggcccagaaagcaagcgatcatgctaaatttgctccaatctactagttagaatttttttttttgccaatgggcctgccatggtctgattattcttgtggtcaaggttgatttcatcttgtaatgcctttaatacttcattagctaataccatcttttttgttcgtgcattgttttcacatcagaatgtacagtgagcttgtatcaagcaccattgctgaagggggaccttttgcctcaaggacctcctttgtaaatctccttaggtatgaattgttggtttactaaattatgctctatatgtgacagatctgtcaagagggaaacattgaaattgattgagacttttgtggacaaagctgaagatctaccacacattgggaaacagtttgttcctcctatgatggatcctattcttgctgactatgctagaaatgttcccgatgctagggaatctgaagttctgtccctgtttgcgacgatcataaacaagtatatgcctccaacctgataatgtctttgtttttgtagatgtaaattaaaatgtgtttttattatttcagttcgtaggaaatttcttccaactgtacatcttgttgcactgtctgttctgatattcctttccagtaatcatcattttaatgtttattgtagatacaaaggtgaaatgcttgaagacgtgcctcgcatatttgaggctgttttccagtgcactcttgaggtaggaatacctattaagcttcctttttcattctatccataggtaatatttttagattggattaataatttgttctgtcctgtcagatgatcactaaaaactttgaagattacccggagcatcgcctcaaatttttctctttgcttcgtgcgattggcacccattgcttccaagcattaattcagctttcaagtcaggttagtaccaactatttaaaacatcattcttccttgttgatttaaatttactattgagttcagatacatcaacatattatcttctattcttctgttttatctgattattggattgttatcttattcagcaattgaaacttgtgattgactctatcaactgggcatttagacatacagagagaaacatcgcagagactggtctcagtctattgctggaaattttaaagaactttcaggtagaaaatacaatccacaatttgctaccattgcataatattctgtttgcttatgttttttttacatgattcacttgcaggcctcaggattccaaaatcaattctacaaaacttattttttgaatattgaacaagagatctttgcagttctgacagacacattccacaagcctggtttcaagcttcatgttttggtgctgcagcacttattttgtgtggtatgtcaatattcatttttatctgttctcttttgtttgtatggatacacttaattattaattttcctaatttgtaggttgatggtctgacggagcctctctgggatgcatcctcagtaccataccaatatactgacaacgctatgtttgtccgagattacacaataaaacttttaggttcatcatttcccaacatgacacctactgaggtatgatccttcttttgcagctatcctgtgcttctgtggccatcatagacctaacaacttttcccgcacaggttacaaaatttgttgatgggcttcttagttcaaaacatgaccttccaagcttcaaaaaccatattagggatttcctggtgcaatcaaaggagttctcggctcaggtaatttgctcctaccccttgacactggcatggacctgatttttcacaattcaaaggaattagaggaaccaatacttcactataccagaaatagtaagaacatagtttatcagaaaccaacagttgctaattaccagagagtggatgttgccacgtggtagtatggtgccaacttgagaaaacgatagatatggaatcatgtgccaagtatagcgttaatgttagggcctttacaatgcataagtgcccattttttatttgttttcatgttacttgctattgaactcatctgatgagttgtttcatgttcatttgcttaggataataaggatttgcgattattttagggcctttacaatgcacaagtgcccattttttatttgttttcatgttacttgctgttgaactcgtctgatgagttgtttcatgttcgtttggttaggataataaggatttgtatgctgaagaggctgctgcacaaagagagagggagcgtcaacgaatgcttgccattccagggcttattgccccaagcgaattacaagatgagatggttgattcataattctgtgattcagccttgctaatccagttccatttcttgctttggcctccaaacctctggagccctcaacaccccattgcccaagttctcttccagggtggtgaaagaaggtgcctgctgtaattttattttcggtaacctccacttggtgctgattgcgagatttctgctagtcaataggaaaggccaactcaattttgtcgcaagagctgttttggactgccattggtttgcagtatgagctgtcaggttaatgtgatgacagcagctcttgtgctcctgtattttgctaacattgctgcgtgtgcggggccatcatatagtatgatcacggtacaacattgtatcatgatttttagtttagtttatagatcggccgcattctgtattgtggacaagattcaggatagaaacttatattcgtagtgtactattttgtgaaatatgttctttttacattgcccgcatatgtgctgtttggtttctttttgacgctcgtgatttgtcgagtctgtatcaaagtcggatcgcccgcgtgtattccgcacatgcatggagcgaatctttggcgtcgctttttttttctatattaccgcaagttctgagcgaattacgatttcatttatgttttcatattcaagcttgattcttcaggagcgtttgggctcaaataagtgtgtataggggcttgtttggggaagttttaaattgtaataagtagtccgtaagaactggaaaagtagtccgtgagaaccgaaagaagctgagaaacctagctttttcggcttgtagttcattttctggattctataattacagttacttagaatctgagtgaaaagttttgactgtttgaaggaacttttgattttgaaagaggctacaacttgtcggaaggaacccaaaacaagcactatgtgttagttgctagtggagtatggagatttttcgtttggatgatggttatatagatttttgatgcggttttcctcttcctcctgaacagtgcactgcaaacgggaagttggagaagtttctcactttgtatgaaatgtgtgaaaacgtgtcatgttatttgatgccagctactgcgacttttgttttacgacgcagtgtgttatgttagagatagaggtttgttacatagagttgttacgtgagataacaacgcatgagatgataagataggaagagattttgttttctgttttgtaaccaatcttcaccattgtatgcgccactttgggggcttttcccaaacatatattaacacgtacagcggcctctaacgaggttagaacgcttctgccaacttatatggtatcagagccaatcatccacgcgagagatcgcatctaccaaaaatggcgagttcctccaattccgccaccaatccactctccggccaagttgtcccagagaagctcacaaggaataatttccttctatggaagacacagatccttcccatcattcgcggtgcccgcatggaggggtacctcaccggcgcgactcgcgctccgtcggcagcgatcgacgtcaaggaaggcgacaaggtcgtcaccaagatcaatccagcctatgaggaatgggttgtcgtcgatcaacaggtgcttggatttctccttgcatctgtatcaaagacatactcacccaagtcgtcaatcttgaaacggcggctgcgacatggagagtgatcacaacgatgctctcctcgcaatcccgtgcgcgtgctctgaacacgcggcttgcactgtcgacgacccgcaagggcgatctcagtgtcacggagtacatcggcaagatgaagacgctggctgacgagatgtcatccgccggcaagcccctcgatgacgaggagatgatgtcgtacatcctccccggactcgacgacgattatgagcccgtcgtctccactcttgtcggcaaggcggaggctgtaccagtcgccgaaatctacacccagctcctgagttttgagagccgagccaagctgcgacagcaggctaatggttcctccgtcaacagcgcacgacgaggaggcaagggaggcggcggcggcttcagcaacaacgtcaacaccggcaacaccggcgcgtttcgcggccgtggcggtggtcgcggcgatcgcggaggccgggggcgaggaaacggtggcggcgcgcgcttctccaacaaaccgcgctccacctgtcagctatgtggcaagattggacatgtggtggcagactgctggtataggtatgatgaaaatttcattccagattcaaaaacagcagctgcggcttcctatggtgtagatacaaattggtacatggacaccggagccaccgaccacatcacaggagaactggacaagctgacaacccatgagaagtacaacggcaaagaacagattcacacggcaagcggtgcaggtatggacattaagcatgttggtcattctattattcatacccccatatgcaatattcagttgaaaaatatccttcatgttcttaaagctgaaaagaaccttatctctgctcatcgtttagccgttgataatcatgcctttgttgaagttcatcctcgtttctttgccattaaggatcaggtcacgaagaatcttcttcttagaggaccgtgccgcaatggactgtacccgttgccaacatcttcattggccacatccaagcaagttcttggtgccatcaagcccacaatgtcaaggtggcatagccgtctaggtcatccttctctagctattgttcagaaagttgttagtagcaataatctcccatgtttaggagatgtcaatgagtcaggagtctgtaatgcctgccaacaggccaagagtcaccagctaccctatccaaaatcctttagtgtgtcaaataatcctctagaacttgtgttttcagatgtgtggggacctgctcctacttctgttgggggcagaaagtactatgtcagttttatagatgatttcagtaaatttacttggatctatttgcttaagagtaaagctgaagtttttcttaagtttcaagaatttcaacaacgagttgagcgccttttcaatcgcaaaatcatctctatgcaaactgactgggggggagagtatgaaaaattgcactctttcttcactaagattggtatctcacatcatgtttcatgtccctatgcacatcaacagaatggttctgcagaacgcaaacatagacacatagtagaggttgggttggctctcctttctcatgcttcaatgcctctgaaattttgggatgaggcgttcctagctgctgcctatctcataaatcgcacacctagtaaggtcattcagtatactactcctttagagcgcctccttgatcaaaagcctaactattctgctcttagaacctttggttgcgcttgttggcccaatctccgtccttacaacaaacacaaacttcagtttcgctccaaacaatgcgcttttcttgggtatagcaatatccacaaaggttttaagtgtcttgatatatcaactggcagagtttacatctctagagatgttgtatttgatgaaaatatttttccctttgaaaggttacatgcaaacgctggagcaaggctgagatccgaaattcttttgcttccttcctccttatatcaaaatattgcaactaatggggttgaatataatgaccgcatgcctaatgttcctgagcaatctaatgtgcctgttgagcatgtgacagatcaggagatacaattcggagaaggttcagaaaatacagcacaaaatgatcacagttctgcagcaaatattgaaggagatgcaccggatctagatgccgcagcgatcccgagggaggatttcagccctcacctgtgcacacgcctgcactgtcttttcccgacgatgaagaaatcggcgaaaccggtggcttgacgtctctgcagcagggggagcagtcgcatgcagccacgtcgccaagcagccatcatgatggggggagcgacagccctctgaccggcggatcgtctgcacccgacacagccgtggtcgagcccgcacggccggtcactcatctccagcgaggtataagaaaacagaaggtttatactgatggtactgtaaggtatggcatgctgacaactacaggagaacctcaaaacctagatgaagctttgactgataaaaactggaaagatgctatggatgctgagtttactgctttattagaaaataaaacttggcacctaattccacctagtcatggtaaaaatgttatagactgcaagtgggtctacaaaattaagagaaagtctgatggtagtctggatagatataaagctcgtctagtagccaaggggtttaaacaacgctatggtattgattatgaggacactttcagtcctgtggttaaagcagctactatcagaactgtcttgtctattgctgtttccaggggatggtgccttcgccaactagatgtgcaaaatgcttttctgcatggataccttgaagaagaggtatatatgaggcaacctcttggttatgaaaataagagtaagcccaattacatttgcaagttagacaaagcactttatgggttgaagcaagctcctcgagcttggtattcaaggttaagtactaagttgattagccttggcttccaagcttccaaagctgatacatcattgttcttttataacaaaggaggtgttacaattttcgtacttatctatgttgatgatataattgtggctagttctagatagaaggcagtatctgctttgctggcagatttgagtcaagaatttgcactcaaagatttgggggatctgcattacttccttggaatagaggtcagtacggcaggtgatggtattttactgaaacaagaaaaatatgcctctgatttgttgaaaagagcaagtatgctagattgtaaacctgttagtactcctctgtctgtatcagaaaaactgtcagctcatagtggaactgctctaggagaaacagatgcaactagatacagaagtatagttggagctcttcagtatctgactttgactaggcctgatatttcatttgcagtaaataaggtctgtcagtttttacatagtccaactatagatcattggatggcagtgaagaggatattaagatatgtgaaattctcagttgatcttggtcttaagataagtcgttcatcatccactcttgttagtgcttttttagatgctgattgggcaggatcaattgatgacagaagatcaactggaggttttgctgtgtttctggggtctaatttggtttcctggagtgcaagaaaacaggctacagtatcaagatcaagtacagaagctgaatacaaagctgttgcaaatgcaacggcagaggtaatgtgggttcaggctctacttaaagagctaggaataaattcacctgaaactgcatgtatgtggtgtgataatctgggagctacttacttggctgttaatcctgtgtttcatgcacgaactaaacatattgagatagactatcattttgtcagagagagggttgccagaaagcaattagaaatcaagtttatatcttcaggtgatcaagttgcagatgggtttactaaacctctcggtgctccacaacttaggaatttcagatacaatcttaacttaaataagttatgattgagggggagtgttagagatagaggtttgttacatagagttgttatgtgagataccaacgcatgagatgataagataggaagagattttgttttctgttttgtaaccaatcttcaccattgtatgcgccactttgggggcttttcccaaacatatattaacacgtacagcggcctctaacgaggttagaacgcttctgccaacttatatgttagagcgaggatgtattgatcagttcgtagctcattagaagcacaaccagctgaaaggtgttttttttttcatgtgtgaaagaaaggtatggttttgagtatgatatgtactagcttgtttaggcaggtggtgaatgggccatgctttccccattctgctgtgtcggatggtcaactctgggaaattaagcactaccgcgacaaattgagagattattacccgacaaggaaaaggacgcgcgcatgggccgcaaaatcgaattgggcagctgcttttgcttcctcgctatctagagagcttgagctagctaagttagcgtcaagctactccgcggattcaacaaattaatcgcattcctacatgtaacaatgagtatgcattgcttaattttctagtggtcagttgagcaatatgtgatgccgattaattcatgaggatgcatatgcatgattgctgcaggacgcaagtcgtagccaggtacatatgatatgataatagggtagctactgaaatatcaacacctaattaagatagcctgtagaaacaaaaataggcaaatcaaatactccaatttaaggtaattagaggccttaaggtcattctgaacaaatatattatcactcatgcatgtctgttgcctattattgatcatctgacttggacgtatggaaagcagctgccaaatagttaaaagattttcacttggtgtgtaggcgcctgtttctgtctactactagtatacttgtgactagtcacgttgcatcatgggataaatatgtatgcacacagaattgaattgaattatgagataaacgacggagctagtcaagatgattaggtagaaagggatactagtctagtttttattttaggaggattattatacatatgcctgaattccaaattgaactcaacagcaattgactttacctccctatattaattactggctattatctggacagtccaaacatgtccagacaattcttatccaacatttagtttacatggacagccaaacagaaagatagcatgcatggtccctgtctatattcctatccatccactagcagtagcatggggctcttctcttgtgtgaagagatgaggtcctctcatttttggtccagaaagaggagatgagaggagagggcttcctggaaggagactgagactctgagtgagtgagagagagagagagagagagagagagagagtagtccacatgcatcgattttactccaattaattaattgtcattttcggtcttgatcagaattcaggggaaactcactggaaaaacatctcctagctagctagtagtccacaggagaggagaagagaagagaaatgctgttgccacttgccagaatgccagtgttgtttgtttgttactcgatggacaaaacgacgatgactagctagtgttgtcactacggttggcttttttttgtttgtcacctcacctcgtttggtcggtcgatcgatcgatcggttggtgtctcacctcctcttccttccttccttccttccgtccttgttggtaaaagttgccgatatactccaattgcgcctctctctctctctatctctccacgtgtgagatcgatggaggacctgtcgtgttgcaaagaggacacgggaaggaagttgattgattggtaatttgctatgtatgcaccccaaagtagtattagtaagtataatcctactcaaaatattacaacatagtattagtaagtactcttttcatcctctgacccaaaatataccaacatagtattagattagacacaatttattaccaggctattcatatttttagtaacaggttatttggactattcgtgatactagattttgtataattcagtactaggttaatatatcttaaagcggagaaagcagaaacctagtacttgattagtcatgaggtggtgccctaaacgagtattagattgctctattttaattttgcagttttcctttaaaagaagaagaagaagaagaagaagaagaagaagaagaagaagaagaagaaaagaattgctgcttcccaatcacagggcttcctcccttggatagttggatcggtctgcttcctctagtacctagtctaggtccttaccctttctacgagtaatagagatcgatgacaacaaaacaacgtgtgtactagtaaatgatgagagaacaaattaatactcccaactcaatcaactcataataacactccatagaggaaaattaactagcttctagtacaggaaaactaactagggccgcctgcctcttcgatgtagctaggattaattgaagttacaagtaattgatgatgtatacaatatagtacgatcgagtatatatacatatatatagggaattaatatatggaagaaataattagcagcaagattatatgagaagaaacaagataagtaataatgaagtggatcgagtagctagctagctagctagcgtgccatgtcgggcttgggggagtagatgcttccggcgtgctgctccgatacggtggacatctcccaggtgagcttcagggcggtggcgtcgtgcggcggcggcacgtattcctcgagcttgcagagcacgtcggaagcggtgggtgcggcgacaatgatgcggcgggcgggcggcgagacgaagccttcgtggacggccttgtcgatgaaggcgagcagggagtcgtagtagccgtcgacgttgaggaggccgacgggcttgtggtggatgcggagctgagcccaggtgatgacctcgaggagctcctccagcgtgccgtagccgccggggagggcgatgaaggcgtccgactcccgcgccatctccgccttccgctggtgcatgcttcccaccgccctcacctcccccagggtctcgccgatcagctcgcgtggcagcacgccattgggcaccacgcccaccacgtgcccgccgcctccgtggacggcgcgggacaccagccccatcagcccaacgctgccgccgccgtacaccaggtcgatgccgcgctccaccagctgctgccccagctgcacggcggccacctggtacgacgccttcttcccggggctgctgccgcagaacacgcacacacgccggaaccgcgacgccgtcttcttcttcttcttcttcttgctattgttgttcgccggcgacgactccggctgctgctccctgctattctccatcatcatatatacggccgacgaccttaattattggctgctgctggtctgcacccaattcgatggaggtcggaaggcagagaggctcccaacgatagaaagaaacctccggtcggcctctagtttcccacttactaatagtgtttttttctgaatgacccgcacaagacaacacaagaagattcatattgatatagcatgaaaaaaattatgtatagaattacaacagaagaaggtcataattagggaaaaaaaaaagactactccaccacatgctacaggctccaaacacacacccgttgtacgtgaccgataattgctagccctacaaggaggtcgcagacgctctcgcttcaaaccaatttcaccaagaatgtcgacgacagactcccggccaccctcacaggaggtttgaggatgaggatgagagagagagagagggggaaagatctgctcattcttacaccaacctagagacgaaactaaccgaacgcagaaggccaaactaggaagaaggcaatgaatgcgagggaacatgaccttcgaggcggtgcctccatggaggctatccaccttggactaggttttcacccgaaaagtcatatcgggtggagagagctgacaactcagcaacattctcaagagcaagtacaacaccgaggcgtcatcgttgtcaacccgaaaacatcgagctaggatttcgcccacagcaccagctcccacccaaccattgccattccaaagctgtagcgcccgttccgtcgtggcgcctagcgggaaaattatctcttaaaaaccctaattgcgaaatttgtttctttgcttgttgtctagtgtccgtgccatctcagatctcaaattcctccgcaaaagtctattttgcctccccctgggttcgatgggccgaatctctctcgggccatctccccctccctccccggctatctctctctctctctctctctctccccctccgctccgctccgcccgcgcgccgcgcgcgcgtgcgcgtgagccgctcgcgccgaacgcccctcctccgctccctccgctctgcccgcgcgtgcgtgagccgcccgcgccgagccgagccctcctcttcgctccctcgctgccgctccccgcgcgtcgttcgcgcgcgcgcgcccgcgtggtcgtcgctcgcatcatgcctgcgctgtctgcgctgtctgcgccgcccggccccgctgccctgccacgcctgcagccgctcggccccgcagccagcgcgcgtgcccgagccgcgccactccatccgccgcgcctcccgttgcaagccgcgcgcgagtgccgagtggccgaccgcctggtcgccgccgtcgtcagcgcctgctcgcgcctgtcgcccgtgtcgccgctccgctccacaccgccccgccgtcatcatcgcctcggccccgccactccgcgcgctagcctccaaggggcggaggcagagtccctcctccctctgccgcgtcgccccgctcccccctccttttcccgaagaggcaagggacaagccccctttctctccccccttttcttcctttttccctctcgccggcgtcacctcctgtcgccgttttggccgctagccggagcgccagctcgtcggcttgaccgtccaatgtcggttcccctctcccaaactgacattgccgcccctataaacctaagcttccccctttcctttcctctcccgttcgcctccacgccattgccgccgcctcccgtgctctgttcgccgtcgcctttcgtcgttgcgcgtgtcggaggagccggcacgagcaaggacgcggaaggggactccgggcgcgccctctccttcctcttccccggcccgaggccggagagattactcccgcgccgtcggcctctcgtcactgcgccccgcccgcacggtagtgcatccctccgttctccctcctcgctccatctcctccccttagactcgggtagtagcacgagtagcctccccgtagctagccggcgccgccccgaccgttgccgccgctcgccatgtgctcgccgctgtcgctgcccgagctcggaagcgcctctcgtcgccggcctccctcgatgcgtttcctcctaatccaacgctagcatcggattcccgtagccgcgtagatgctctcgccgccaggaatcggccccttgtgacctcgtcgccgttttcccctcctcccgccgccggttgccgccgccgcgattcgccgccgtcaagctccctccggcgaatccgagccgttggctcgtctcccctcgtctcgtgcaaccacccggtgtgctcgctttcgcctatatcgccgtggttcgctccgccgctcgccgctgtcgtccgccgttcgttccggccggcgtcgtcgtctacctcccgccggcccgcgtggcagccacgtaggcgccacgtcggcgcaagctcggccaaggccgggtcgaattgaccccggtcagcccctccccgtgcgcgcgttccaccgcgagccgtgaggctgcgcgtgggcccgccgcatccgttccaccgcgaaccgcgcgcgtgcaccgcatccctcccccgcccacgcgcgtgcgccgcgtgctccctccgcacggtgagccgagccgctgacaagcgggtcccactcgggaccacgcgaggtgagcccggtccaccggcgccccctccctcccctcccccgcgcgcgctttgggccgcctttcgggccggccggcccagttagctcggccgagccgcctcctttctctcgggccgcgccctcgccgcccgagggaagtctaattttccccctccttcttttcttttcttttccaaaaaggatttaattaaatcatttttcctttagaccaaaaatccaataatattagaaattcaatatcttcccaaccgtaaatccgtttgactccgttcaacttccaaaattcctcaaatctcgagatctatctaatggcacgcttagaggtcattaatagggctttattttcgccgtttgttgagttgtcccgttttgcgtgtagtttcggagcccgaagacccgcagtgcgaggatttcgaggatcaagctctagatctcgagcaaggcaagccacctttgaacatcttgagcctataattgaaatttaattatgttgcttgaaaaatattatgtattgataggatcgcacttaatctgttgtcccgtctgcaaggcagattggcggacctacctaatttgttgcatttgatccttcctttgataattgttatatcgtgtccccttgtaaccatctagttgcgtctcgatattcgtgcaccctgtgcgagtatcgacggacgccttcaaacttaaaattctgaaaaacttcttgggtaaaacttgggttttacaaaagacttggaaaacccgacacctgggtcggtgcttgcgaactaaatgaatttccaaaaccgcggaccggggaacgtaccgggtgtacggtttcccgctcttgcacctaaggaccgtttccttggaatttcatccgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaaccagttgttggtctgggacccctctcgtcggcatatggtaaacctgtgtcggctttggaaatgccttgtcatgaaagcttggaggtctcccgacgtggcggatccccatgggctgggagatccgggttagtaatgtcgtgtgggtaaagtgtaccccctctgcagaggttaacaagctgttcgaatagccgtgcccacggtcatgggcggatgtgaggtgattcctagcgtagttttgtttgactactgcttgtgaaattgctgttgtggaaaggggttcgatgattgaaaaatctgcagctgatgggatcagctaggcccgggtggccgtttgaaagttgttggcccgggtggccgtttgaaaagctgttggccgggtgccaaccttgaatcaattctaaagactgatacattacacatactccgaccggacgagacgcactgtctcatccgtgtcgtttgagaagcactcacttagttgtttttagaaaagagttcaaataaaatcaactgcaaaaacaacagccttccttgaagcctgcattaaacacttatttcccatggcttgctgagtacccccgtactcacccttgctctatataaataatccccccagttgctgaagaagatgaagcggatcctgctgatgaggagttcttccaggagcaagccggcttcgatgagttttagggtttcggcctagttcccaagtcgcgcctgtgttgtttggtccaagtcctggcttccgtttcccccttttgtaatgcagttgtgagctcgggatctgtccgcagcccaacatgactgtacctctactctataataaagagacctctgttgctgtgataatccgtcttcctgcgataccagcactgtttcctgggactggtatcgattaacaggttaatttggagcgtcacgggctagttccggtcggtactagttcggggcgtgacaaaagccctgccacccgaacgacctcgtccagcatgtaggctcgccgcaccggcacccctccaccggccagcacccctgcaccagctcgatggcactcaaccatcctccatgcaccacaacaccatggaggtccggtcatgtgtggtcatcaccgcctctccccaagccaaggagcagctgccgcatccccgcaggcgaccgtccggacccacgcctcagcctccacggccatatccaccgccgcctcgcgctgctgacccgtagtttcgcctcctccgctttcccgtggcctcgccgccgtggctagacccctacctccacggcagcaggcaatcgtctctgagctatagtgcctcctcgcaccgttctcctgccacgagcctagacaggaggcgccgaattcggccgcgggggtgacggatccgactgtagagacgttggatttagccaccgatgccccacaccctatgggagaggcctaactgccgtcttcattgccaacgctccattccgcagcattgctcctcgccggatccggcctggatttgaggggtggtgcctctatctccttgggtcgccacggctccctagccactgtggtgtccttgtgagagaggagagccctatctactcctttctccgtttcatattataaaagacgtttttatctttttactaaattaaagttgtttaagataaaaaattgtagaaaaacatagcaatatttttaacaccaaacaacacatgctatcaaaatatattcaatattagatttaatgaaactaatttgatatcgtaaaagttgctgcatttttataaaattaatcaaacttatagaaatttaacttaaaaaaattcaaaagtgttttgtaactttgaacggagggaatagtagtatctagctattgaggagaagagcagagcagtagtaacattcagtggatacaggaagcaggagtatataggctatgttcggaagtagccgttcccaacaagcacagtgcccatgaaaaacggagtgatctattagcatgcaattaattagtattagccatttttttaaaaatagattaatatgattttgtataattttttttaaaattacttttatatagaagctttttgtaaaaaaaacataccgtttcgcagtttgaaaagcgtgcgcgtggaacgagaagggagaggggttggaaacctgagcaaataacacagccaccatacaccacgagaggcagtaggttgggtgattatttctactgtacatatggcgagcgcgcgacaggggatcggaggtcacgctctgttcttggatctccattctccaacctctctaactcagccttgccactttgccagtagtatacaactacaagacactgcagatcgacactcttgctagtaataagcagtgcagcgcgcggccaattaaccccaagatatatatttttcctttacctcttctttcttaaatcggtacacggtacatatatagtcccagtgtaggcgatgttacgtttgtgccgaatcctgacctgtttgctactccctccgtcccaaaatataagcatttttagctataaatctaaacacaatatttttagctataaatctagatacatatgtaagctaaaaatacttacattttaggacggagggagtatacaccttgtcccatcaccatctactcctccgtttactatgcatatatacgtacacaaggatctatacaaatacatagctaaagatagggatagtatctattttgagatagggatagtatctatttttgaaatttgacaatgtcaaaatttggtaaggttttttttggcatcaaagtgaataggccctttatgccattttcaaccttaccaaattttggtaaaattacttaaaaaaaagtggctacatttagtttgctgccaaattttggtaactatataaaaaatcctaccaaaattttagcaagttgccaaaattttaataatatgccaaaattttaataactatgccaaaattttgatcatgctaaaatttggtaaggttttttttgtcaacaaagtgaacaggccctaaaccccaaaattccattccatctgtgatgatctataggtagatagtcggatagagcgacacgtggcgaccactattacgtacgtaagctgtgaggtcactcgatcagtttgactactggattaattatcggctgggccgcagactaaactctggcaacgcggttttgctagctcccaatacgagtatattattactccatgacgatcatcttaattaatctgtcctacttaatcggatgcatatactccctattactcgtaaagaaaatcgtttaggacatcaacacgatctccaaaacacaacttttagttcttgtttctataaaaatatttattgaaaagtgatatatatatatatatatatatacacttttatgaaagtatttttcaagacaaatctattcatataattttttacattttcaaactcaacaacttaagtgttattcatgatttatattcctaagatttgacttaaatattatcctaaacgacttcctttacgagtacagaggaactacgtatatatatgtagtctgttggatatttgtcgacacacattattctccatgcaggttaagcgaccgtgtgaatcacatcgttgcttaattatatttagggctctttaaagcaaacaaattataaggaattttaaagcattaaattcctatggaaagaactcaattgcaaatttgcggtatgatccatttgatgaagacatcagtcctttagatacacaaagtactcttacttctcaagttgttaagtaaggtccaataactaaaactcgcgtctgataattgaatttacatgtgagcttgttattgagtacttctttatgtaattttgaggatagattactacctattaatttaattacgattagtaactatggagagaatgatgtagcacttggagagaggctagaagatggaaaaggtcgtcatggacgttcaagccaagatgaaggtccgccttatatcgaatttgagtccacctcgtgctccaggagcaatcgacactaaaatcattactcagattgcattcggactccgattttgacgttctatatgtatggaaagctaacgagactatctttccaatgggtgtggtcacacgtcaaaattccttccgagttaatggaaatcatcgaaagaagaaggcgttcagaatctgaccaggtgttgtgtcaccatctttgggcccgttgggccttgtatcatgtcggagtccgatgaggacgcgtccaggggttcgaggtcgatcctagaacctatatattcagtagctatcattgaattagggttgggtttttcttagattatttctgccatcgcagtttcgtcgctagttcggtttgtggaatcccaactttcagttcgtgattaatcattcatctgcaattgagttgttgtctttcttgttcttgattttgttctccggttcgcacgtagggattagccttctcggcgaggttaaacgggttttgacacggttaataactagagaagacgtggtgctacgacggattgtgttgattgaaagcatgatcgtgtgtgtcaagtttccaccatcaagagtaatcgatcttcacctgacggaagatcagacatcccgtttccatcaccattagaactaataaatggctctcctgaatttcgttgaaattcgttaggattgtcttaaactataggaatttgaaagatttttaacatgaggttcatccaaacagcaactccttattgattttaaaccgttgaaaatttactttgtgcctgcgcatgcaaaagcataagaaaataaaggaacgactagcttagtgtggtccttgttggtagatgggagacgatcgatcgagctgtaacttaattaatttcccttaattttgttttctggatgtatgcatgcataatccttgattgatcttttatatgcacgctagctacctagtagcagtactgttttgtctttgctaatacatgccaaatatatagctagctctcgtcaaagattctctagctagcttgtccttaatttgttaatcgtcataattagtagttgggaattcgttagcttcggttgtgacctatgcaatccaacaatgttgctcgcggaaaaaaaatcgtatacagtacacccatcatttttaatataagcaattgaacattttgaattttgacgagcgagaaaataaaaaatattagtcatgtaagatgatattgctatatttatcattaaacaaaactatcatgatgtgaaactcttctatttaaaacaactcattttatataaatattattagtaaaagtaaaatctcatagactcttgtcaaaatccgaaaatgcgtatattttaggaaggggagtataatagttgttcaattaccatgaaattctggtgttgtggattaacaatgcatatatattggttaggatttcgctattcaataattgttttgttcgggagttagcttagtcctattgacttaaaaatcaaaaagcttattttagtatgaacatttatgttttatgctggtctctttggcttatccggaatgatattgtgtttgacaaagctccaataaatcttatatgcaagtactttaattttggtccaattcattagttgtggttttaaatcaaggtacaaaggtgtaacgaggaaaaagaaatcatacttgcatgccaaggtttggagacgatggtttggtatatcgttgtcaactttggatagagattttacatccaaccgttgaatgaagagaactaatggctgaagggtgttttgtgcaagttttggcgggcatatccttaagaaaaaatatgaagtcttccttagtgtgtgtgtatatctctctctctctctctcacacacacccctagatgaacattgcttgaagttgccatgtagcgaagatagcttgtaatgtactccctccgtttcaaaatgtttgacaccgttgactttttagtacgtatttgatcattcgtcttattcaaaaaatttaagtaattatttatttttttcatatcgtttgatttattgttaaatatactttcatgtacacatatagttttacatatttcataaaattttttgaataagacgaatggtcaaacatgtgctaaaaagtcaacggtgtcaaacatttcgaaacggatggagtatttattgtaactttataaagaaaagggaaaaaaatatactgcggtcgtagaaactgttaatcgggcgaaagcctttgaaaatgtttattatccatacaccccataggtggtgcatgtgtcggagagcaattaaacgtcataggtatgtttaggtcacttggttgaaactaaaaaagtggggttaagaaagggaccaaagacccataaaataaataagcgattgtaaaaataaacggaaaaacgaaggtacggggttgaattgatgaagcaagaaaagaatgaagtagcccacagacaggaggcgaggcgaataagaggcaggcccacaggaaaacaagaaagatgggccccggcccaactaattaacgcaaagaagaaattaagatccccaccccaatgaggggaggtgatgagatccccatcatcggagaaggagaagatggagtccaccaccggcggcaaggaggaggagaaggagaagctgtgccggcggtgcaaggcgacgtacgcgccgtcgggcaacacgcggctctcctgcaggttccacccgtcgtatttcgtgtgccggcgccacgacgaccagaagaggtactaccagcttcgcgacggcgacccaccctacgccgccaagttctacgactgctgcggcgccgaggaccccgacgccgccggctgcaccaccgatttccacctctcctacgacgacgccgatgcctagccgctcacccctacctacctaccttgtacgtataccgtataccaccaccgcctgtattcctctttctttctcatgtatgctactactccagttcactaataacgccacgcctacaaacaaattactgtaatactaatcaccaatcatttcaataaattcagtcatatgagatgagatggctccttaatttctactgctatgtagtaatacttaatttccgatatgaatgaatgacatggatctgaatcccaaatactactccagttcaagttaaaggatcaggataattgcgaacaacagtaatgatgatgcattatcaactcatcaacatcaagcacatgcatgtatgtatgtttgtatgtactccacttccatttgaattcaatgattgcgactcacacaaactagaagtaattcacacagctgcatcactagcttagctagctagtagtggactactactccgcaattccgcatgcgcacccgcatggccaccaatgctctttcttgtgtcaaaacaagattcatactcctaggctagtggggatgatcttcacgttgatgattgggaaaaagaaaagggcaatatataatactccatatgtagtgggcggactggccctcattgatccatttgtatttttatcactactattttctttctcttccccttttcaaatgaatgagcagcagcctgagttttgtttttatttgaacgcaggatttccttttaaaaaaatagaattcgattgctttgtcatctcaaatcctatggatgaaaaaacacaagaaaactccaggaattacagtttgaatgtaacacaacaaaaacacatgaatcgaaagagagaaagatagacacaaaggaattttttctagcggtagaatctcatgttgacaatccttcaaaattcctatgatttgagacagtcctaaagactttcaaaggaatttggagaagccattcctttgttccaaatgcctgtaatggaattttttttcatagtaatccaatcctctaaaattactttgttccaaaggagccctgaaattatttcagtactctggccggcaagcaaggttgaattggtgggatgatgaaagcaaaggtccctgaatcaatgaatctggctatcttggccacacaagggaatcgtctgcactagtgcagtgtcacaagttgctgtatgataggatgagcacgtgataggtccccagatcctgaccttcaacagttatttgctactactgttgtcttcatcctaaaatgtaaagaattttacctacatatacttgatccatttcatacaacttattttagtatttaaattttatatcaaaatacttatcacttttattacaaagtagttttaatttaaaaagatcttccttccctatcttttattgatgcagtcatacattaatacaatctcaagtcttattgactcatttgcttttttaaaaaaataggatgtattgaatgagggtaaccatgtaatctaccacatcttttggtttgtactactataatgtttgttagaacaagtaatttgaaatagagagatttaaaacagaggaagtagtaggttactcccttcatcattttaaaatatagcaatacagtatgagatgagatttaacttagtactccctccatcccatattacatattagagggcgtcaattttttatgacagaaggcgtgatgtgttttctggttcaaatcttccaagagtgcgcttctgtgtttggtcttcatgtatgcgtgtgacgcttttggcatacagatccacccaatgactgcttgagcatgcagatgcagtcagagcaacgggattaattctacattgatgctctttattagagcaagttcaatagtatagccaactactggctctaatttatttatagctaatctaatagctcattcatacaatagttacatactacactattaatatctagtcccacctgtcatagacacactgcgtcttggagtccgtgctacagcgggctacaaatctgtagctcgctactcttctctctcctgatttatcttcttaaaatatatttgcagttggcttatagcctgctattgtacctgctcttaggggcctgtttg

SEQ ID NO: 70466 - DNA, 657 bp, Oryza sativa
ccgttgtcaatctgaattgtagccttgtcatcggcgcaattgagctcgtacgacagaactccgcactcagatgggtcacctcgccggcggaaaggagacgacacgctgctaagattaccacaggtgaacggagggcagccatgccgatgatgccgcccacctgcatctgggacaagaactgcaagcaaacacaggacagaaattacccgcaggatagcagtagtagagcaatgaaacacaccatgaatcgccatgccaggtgggcttgtgcagagccggatctagatggccaaatgacatgaacaataatacaaagaattttttttttagctacctgtccttgactgtgatgctgttgacttggaaacactcgacagaagcggtagagtccaagctcagcattcagttccagcattagtcagtcatgcatggttatttattgctgaaaaagactggactagtagaaatacggctgtgtttagttcagtgcaaagtttggattttggttgaaattagagatgatgtgcactgaagagttgtgtgtgtatgataggttgatgtgatgaaaaaggaccgaagtttggatccaaactttggatctaaacacagccgtataatcatatagactcacaaagtcacaaatacagccactggaag

SEQ ID NO: 70467 - DNA, 717 bp, Oryza sativa
aggtgcccgaccccttgtggggtttgcactatgtacataggtggggtgaacacggtagggctcacctaaccgcattattgcggtctggtcaagcgtgtcacgctgcatgcagcgcaatgcagcgcgctcttttatccggtctgtgaccagtcacagaccggtcagatcaacggttaggtggcgactggcggtctgacgcacgcctcgccccgtcccgtcaagacgagagcctctaggcactcgtccccagctggagctagcgtgatacatcccagagatggcacgttagccccgatcgatatatgccaggcttcatcctaaccattacaggcaagatgttgtgtgaagaagggcaaacatgcacgttgctaagctgacacgcggtggacaagaatgaccgattggtgaccggtctgacactgctcatgtcgtcagcgcacagccacgttcccacgacgcgcctgcccccggcagaagtggaggtaggtatgtgccgtcccatcagaaggacgttcggagggcaaccgtgcaaatctccgtccatttattgtcgcgaccgggaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaataaaca

SEQ ID NO: 70468 - DNA, 1539 bp, Oryza sativa
acgttcgatagaaaacaaaatgcgggacggctgcgtatggtgggacccagtcatttaactattcaaccaatccatttcccattcgccattccccatccttatctcttatgtcttatcttcttctccccattttcttctcgccatcccggtgaccggagggcaccgcaggggttcgtcgcggccgcgtggctcgggggacggcgtgtactccgccgcggcgaccacgctgccctacgaggacgcggatgggctcatcaagtacttcgccgtcgacgactcccgcggccgcgtgttcgtgttctctgtcgccgtggacgcgctgctcgagctggagcctagggtgtgcaacgagccgccgatcactgccctgcttgtgtacctctctccgcgccacacctcttcttcctcttcaccggccatgccgacggctccatcgctgcccaccgcctcgtcgagtcgtctcattatttgttttcgttgcacctttgtcgtgaaatgatgtttcattgtatttttattggatgttgcatatattattgtctttttgttgcaatcagtagttttcaactgttgcattcacccaccgcctgatcgagtcgtcccattatttgctttttgttgcatcttgtcgtggaatgatgtttcattgtgtttttaatcgatgttgcacatattgttgtctttatgttgcaggtagtagttttcaagtgttgcatctagttacaactttttaacccggtgataaaatattttctcaagactgatgaaacatttctctccaaaatacaaacaactgaaacatttatattaaaacaattttttattgtcaatgacacatttctctgcggcactgaaacattcctcttgaaacaatttttattggtcagtgaaacatttctccgtatgcgctgcaacaccgtccgatattttaaaaaatatcagactttcgatttgtagcactctccgtaaactctataggtcccgaccacatcgcacatgaccttaggaatgacaccttggcatgcatattgattcagttcaatatatatagcgacacatacagtgaccgagatatgtgggatctctcttagcctcctcctctagttgcaagttgcaaccaccagtggctagagaaaaacagaagcaaagatttgacaacgcttgacgacagtaataccacagcgaactaggcgccaccacacgcccacccctcaaccggcgtgatgacgcccgtgcgtgcgtgtgatatatgatccgatcgatggcaaccggccgatgatgtatcgtcacactaccctgcatgccatcagtggaagagagcccacgttgagctgtaaagcacagcggccactgtgaagaaccctggacgtcaatccgcgcactgttaactgttccctgaaaccggcgagagccagccggcggcaggcggcagcccgaaacaacggctttccgatcgatcgatcgatcgctgctgcgcaaacccgcgaaaatgacaaatgcatgcacgagataagggagtgtggcaactggtggcgcatt

SEQ ID NO: 70469 - DNA, 537 bp, Oryza sativa
atcccaaaagcgcccgaatccactaaagcccacgcgaaatccccagactgcctccacgcgcgccgcccgcacctcgcaacccccaggggcgtttccgtccattcgcagccgcgcgagttttagctcccgaggcgtcgaggcggaggggaaggagtcccccaacccccgcaacccccgtgccctagactcccccgatctcgccgccgccccgcctccggcgccgctcgccggtgacgacctgctccgccggcgcccgaggccctcgcccgagatcccctccgacggctggccctgacggggccattcgccgccgcgaggccgcaccgccggtcgccgccggtggggcgcttggggtgggtgggcccctctctgatttgaaccccggggccacgcttgggtgcctctctggttcagagggtttgtgccgaggtgaggaaactatcgagtcgattcgactctatgtcgctgtagtttagggctcctacttgtgctttgggtctgggctgcacttttgtggggtttagcatttctgcaggg

SEQ ID NO: 70470 - DNA, 26986 bp, Oryza sativa
tgtcaccaaagaatggaatccggagtaactagtctccaataagtattgaaggtagcaaatgaaagcagtaagtatcgtgatggtggattgtgcgaagtaagaaataacttcccaaagcagctaaagcaatagtggagggatccttgtgtattttgagtagagtaggaagaaagaggaatgggggggggggggggggggacctacgtaggtgttgagctgcctgacgaaggaggagaagttgctgtgcttgaagtacttggggaggaggtcgcgcgcgaactcgggggtgttccacacaacgaagctgttgttcccggggccccatgagacgacggcatcggtggccgggtcgtccaccatctcgtacgtcttcatcaggaacggcggcggcgcggtcgccaccccgttgctgaccgccgcgccgggcggaggcgcgaccgccgtcgtcaccgccccggcggccgcagccgcagcagcaacggcggcctccatgaggcgatccgtatggggaggcgtggtgagggtcaggggcgcgacagcgtgagcatgggtagggttagggggaggcgtgggatcggggcccgtgggtagggggggatttgagggtggggaatttgggatttgggttgcgggcggcgctaggttttttgggggctcgtcgtcggctgctagtgggaaggagacgagacgagagagagagacggcaggccgcagagaagaaaccaacccatccacaagaacaacaggggatgggccttttcttttcttttttctccgacgagggtgtttctgtaattttgctcttctttgctttgccgctgccgctgcggctgcgactgcgacctacctaacggcgctgccccgtcgccgtcctccactccgccgtaaacatatctgtatcaatccttccgtttgtttgttcgcacgcccatgaaaattatccctccaaataatctgatttttatcttaagaataactttttattgttttccttgcggtcaccttttcttaataaaaaaaaactttttttataacaaacaactattgtagaaaccaacctataatacaaacatgtatgacacctacacctagctagacatatgtcatacgattgatacattgcatatacgcatgaaagcgaacttcaggcaggcaggggtcatctcgccactatcctacttactcatagccttatcctacgtattctctccgttcccaaaaaaaataaataaatcttaacacaaacatgttcgtttcgttgtaaattgtaatatgatatatcaagggcatttttagatccatttgaaatagcaaatagcaaatagcaaaagttttggtggcaaaagttttggcattgcaaaagtactagttggtgtttagatgcatcctaaacttttgccattctagcactttttagtggagagagagaggtcccaaagcactttttggcacaatttgctactatggcctagcaaatggtaaatggcaaatcgccaacttttgctactagtgtttagatccaaaatagcaaaaagtgctccaaaatggcaaaaggatctgaacagggcctcacatttatgcgtaggtttgtttttgaaattgatgaagtacttactccctttatcaaaataaactaacctcgtccaagacatgaaacattctaatacaacgaatctggacagtatgtctagatgtgttcagattcgctatagtagagtgtgttacatcatgtacgacattattttttttatagagagaggacaaccttagcttaactatacagagagataggactagacatgtgatgtgtctgtcccgagaagatatgtcagtggacttcatctaccaaaagcatcctccttttgagattgtgaatttggattcgtctttctttaatcgaaacacgtttagattcatccaaccctatctgatcccactcaaaaaaattgctattgtgctatcttcaaacatgggttttgccacatatgccattctgcattttagcttcgttaaattgccactttcaaatagatgttacatgctatagtgtccttgccatatgaatggacggaaatgccccttgtcctctttttctctttcaaggcttggaccgttgtcatcgcgtgctgctggagagggacatagacatgtgcattgtatctagccagcccgctgttggcaccccattgtcgagccgcgcgtcgcccggctacacagccatggttcttctaatctttatcgctcctcctgcatcagcgcgacggcgaaggccgttgaagaaggacacggacgaggacgaatgtacgacaacggtggttgtagttaggtggcatgacagaggtttggcgggggaggggggatgaaagtggcggtacattaagttggtgacagtggagcgtaggccgacgtcggtgagccgggatggtgagcatgacgtttggtggccgctggcaagcacctccaacatatgttaaagggaagggagaagaagtctaagatcatgttcttttctccaataagagctggatgaagattaagattttcatggcaaacttttcaaactgctaaacggtgcgttttgtacgaaaactttctatatgaaagttgctctaaaatatcatattaatcaatctcttaagtttgtaataattaaaactcaataaatcatacgttaataccacatcgttttgcgtaaaaaaacttaatctccatgtttatctttgagagaaaagaaaaacacctaagggcattatcgtctgcgatgatattctagcgcaacacctaaggagtagtagatatcaattgacagtggcaatttagcaatttactcgatcgccaacttcatcatcgtcttccttggccgccgccacattctcttcttcactttaccaatttccttgggatcaatcaagggtcagtgagcagatagatgggcatggctcacgtcctcagcctcctcgtcgtcatcctcgtcgcaatcccctcttctcgctcgcacgccttgccgtcctcctcatcccccttcgacgccgcgctcgccacgctccagaaccagatcgcctaccgcttccatgccccggacctcctgcgccgcgccatgacgcacgcctcctactcccgcgagaacggacgcgcgctcgccgtcctcggcctcgccgcctcgcagtccgccgccgcgctccgcgccctcgcggccgaccacgacgcctccgcctccgccgtctcccgccgcgcccgcgacgcgtccggggaggccgcctgcgtcgcggccgcggcccgcgtcggcatcccctcgatcgtgcgcgtcgccgccgggaccaaaccgaccgccccacccgtcgtttgcggcgccctccgcgccctcatcggcgccgtcgccgtcgacgccaacagcacccacgccgccgaggaggtcttctggaagctgcacgtgctcaccgccgcatcagccaaagccgcaatgtgattcacaaatcagactgatcgttaatttaaattagtgctaatgctgctgcctgctgcaatatcatcacactagatcgttaaatgtactcctactacttagtactatcaactagtagtatgaactgtatcagttgcttctaatttccagtttgaactggagtatattagattatgtaagttggtattatgcatcctaatatccagtccacgaatgtgcatctgcttacatactcgagttattatctggaatatatgagatgaatcatggaacaagacttcatttttatcagcacctgtaagcgcttcagcatcggttttacagtggatgttccaagtttgcatttagcagcacttatacacaaaatggtacgtacctaacatcaaataatttgacaatttaactggaatgctgtagaaagctcatgtccaagcatattgatgctctcacaggggacaactggacaaggttggcacatatgcagcaaccaaagctaaaatgcaaatatttcaatcaaaagcagaatgaatgatatcagtgcacgatgttacagggaaaaaacaacattaatgtcagtatacatgagcgcaaactttaatttaagtaatacagtactacgaatttgtatcagccttgcatttcaagatcactcttgcatggggtttaacaatgtcaggagctcattttgtccaaaatctgactcaacccccttgtacaaagacaggatgacaatcttcaagttaaggatggttacttctttgcttttttgctccgatgtgtattttcaggagtttgagcatccaacttgcgtttcttggctagttgctttgccttccttgctgcaacagcagggcgcttggctttttgagaactagcatcatgtcctgtctcactagtcctgccttgctgcttcccctggtaacttggacgctggctcaccttcgccttcttcaccacaccagatttgcttgccctaaggccttggtatgacaaagttgacgccttccgtttggtcttgtcactgccttcatgggatttgctgcttggtgttaaagctgtcttgtgtttcgatccaccctttgttttgccagcatccgtcgtcttctttggtgttgcatcagctgattttgcatgtgcaagcctcagaaggcgatctctaatcttgaaatcctgttttcttacgacagtgtttgcagcctcctgcatggcagatattaaaatggtcagcataaaagtgtatgattgagtcgtcaactggctatcttggttctgaatacataattcagcaaggaagtctttctgttatcgtcttcctccagtactagcatttaattgtatggcatggttaatgctaccatcttcaataaatgatgttcaaaatcacgtagtacatagtaaagccatttatcgacaaacatattatacatcaaatggacttctgggttttgacttatttagtgggtcacactgcaccagatgaaataggaaggtaaaagattgtacccttgtcttgaacaaaacataggcgataccctttcctagacttgtatctggatctcgaacaacacgtatagcttcaacatcaccttctgaaccactggaaccacagaacttttggtacacctcttcatcctgacatgccagtaaaaaaaataaatctgaccttttcttcaaaagaattacacagaccatatacaatactgaccacatgatactcacctttatatcaaacggaagattaccaacaaaaactgtccgctttctgtcataaagaggtccttcgcctttaagtttcttacgaggtggacatgccatatcgacacggacatgattgccatcaaactagaaagtatcaaaatcaagaaaaactatcttatcaggcacaacatagaagtttttgaattatataccagatatataaactaatcatgttttcagttctaagaaagccaactcaccagggccatattatgagataaagcagcacgtgcaccctgctcatctttgaacacaatataggcatgtacactgcaaagggtgaaaaggtacagacaaaatgagtctgagaaacattaggcaaacaatacatttgacatatgcagctgctcagcacaatcaattacattttacaatcaatatatagtccttgtgcattgatgggcgtctaataactgggatatatattgaatatcagagttgatggcatcagatcatgaaaaatacgaaatatcaacaaaatgctcttaaaggaactatacgaagcacgcgcctttttggtcttagtacaccattatatatttgggtaatcatgtcacttatctcctcctttgcttcaaacagcacagaaggtagaaaccaaaatgacaaagtaaagggctgtggtgattttagttgatcgaggaaagtattccatgcacgcagaaataattacataggcacatcagtaaaaaaacaaagcacgcgctattagaaacaaactgcagaatattgactcctaagctacaccaaagttgtttgttatatcactaaataaaagttgtgccacaatcaacactgttgagattcagaagtttcctatactacattcaactagcaatccaaataggacagataacttgtatatatcaagacagtagttaaaggaaaacactttaaggtgaaatgtggtaaaaaaagagagtgaaaaaacagggcatttaaccatgtataacaaatggtagagaacttaataaatgttcagggcatagaagcgaattgtaaagctataactaatggggaggagataggataggaaaagaaagaagtgtgagcaagcccatttcaatcggtgtttcaatgctaatgtcctaattgcaaccagctgtaatctgttcatatgtaatccatttgaaattgcaagcataaaggataggggaaaaaatgcatttcgtagctatctctgccatctatttaagcaatggcataaacaatcgtagttgatactagacaggcaagaatgcactcacttgtcgacagaatcattgatttttccttttatgacggctcctttccttggaatcttggtctgcagcaaagcacaaatcagcacagataagcatgaggaggacgaagatgaagacgaagcacagggcaatggtgctcacgtcggtgagtggcacggagcgtatcctgacggactcgatctcgccgaacgccgcaaactccttggtgagcgccttcctcttggtcttgagcggcaggttccccacgaagaccgtcctcagcagcttgctctcgtcgtcgaacgcctcctcctcctcttgccctgcccccgccgccgcagccacctcttcgggcaccttcctcttctccccgacgaccggaagaggaggcgcgggtgcgccgccgagcctccgccgctcgtggccggcctcgacctcgtcccgcttcctcttgcgccggggctcatccctgcgcgacttcgcggacggctcagcgacctcgggttcggggtgcttgcctcggggcgccgcggcggtgggcgccggtggagcgggctggtcgtcggagggcttgcggcggaaggggttgtctgcggagaagagggtgcggatggccgcggcgtcgtcggacgcgggctccttgttcttcttcgccattctcgccgccggtgcgaggcgacggcgagacggtttgcggcggcggcggtggggttgggattcggaggcggagggggaaactcttttgttgcggggtttcgcctagttggaactcgccccagaataggggacaggctggggcgatctcgaccgttggattcagatcgaacggctaggatttgtctgtatccttggcacgagccgcggtggcatggtagaacaaggggaggacaggaggaggagggggttttctagggtttctggagttcgacgaccgccgccgccgtcacgctggttcccatcgccgaaggagagaggatggaggagagccgcgcggacgggcggaacccgaaccagctccgccccttctcctgcacacgcaaccctctcgaccgcgcccatggctccgcgcggtgggctcagggggacaccatcgtgctcgccgccgtgtacgggccaaagccgggaaccaggaagggggagaatcccgagaaggcatccattgaggtcgtctggaagcccatgaccggccagattggtaactactctcctctccacgcttgctatcgctgctcgcccaattgaatcgctcaaatggtgtgctatttttattttttattttttatttgcagggaagcaagagaaggagtatgagatgacgctcaagaggacattgcagagcatttgcctgctcactgttcatccaaacaccaccacctctgtcattcttcaggtataagatctactcccttcccatgctgctatggctattgctttgcatttgttttgttctacctatacttattgacaaattgtgttagaatcattgctcttgtgttgtgccacgcaagttgactgtctgtactctcttgtccctgctttaaggacgctgattgctacaaaatcttcattgagtttgcttactgattcaagcttgctatattattgctgacttattgtcaaacttcattttcttagcgtgccatatcaagcgtactttaggtttagtgcatcatgccactgccttatatcgttttgcctttaatttagttatccttttgtttgcaggttgtgggcaatgatggttctgtatccttttgccgtaatgtactacttagtattgtttctgggtgccttttggattatgaacattgtacttgatataggaatgatttcagatttttggctactagctgcagtagattggcatttgaatttaatttcctgtatctctgtgaatctcataagctaactgctaatttcagctggttgtctacagttaggataagtggttcgttgttttattcctgaattctttgcctcgcaaaatgtttgttttggccggctaatataactgacttgtgatgagaaaatgccaagtattgatggaagtccctggttccatgctttttctgagtagtcttccaatcaacatactgtatacagcgtgctttatatgaatgggcatggcctgctatagcagatatcaacatgtagtatgttctttgtaatattcacagattcttagtatttcggtcttcaagatttcaatcaagcacaatccttgactaagtctagcttcttccatgtgcaattaatgcttgctgcgcagcccttgtttttgctggcatccccttgaaacatcttgcaggtaagttagtaatctttgtatgctcattgatgaaatatatctcataagcttttgtgatgcagttgcaattggttgtggagtactggaggatggtgaagtgattttggacacaaacaaagcagaagagcaggtagaaatttctcgttttgattaagtcctctgcactaggaaaggaaagaacgaatttttatctcgtttcttccctaaaaaacatcttagaactattggttcataattcgctctttaaacttgtggacaacaagtacatttttaatccctctactctgtggaaagttatcatattggtttctaggtgggtctagttgtcaggtatcatcttctgaaatgttatgttgattgtgtatagtcttaactgttgaaaatctaaataagttaatgctgagaacatctttaggagtgcatatgcattaatgttactgtttgctgtcatctgcagcaattgaaatcatttgctcatttggtgttccccaattcacgcaagtctgctagttcaaaagaaccaaaccagaaagaggaggattctgagagaggattgataacttccattacccatggagtgatgtccggtatggttatatcttgtgcctcagcttgatgtgttcttctggacattatagatatagggatgcatatattgtggctctaaacatgtcccctttctgtctcatgtaaagaggaagattatttcagctgcatagagaggggccttgctgcatcgtcacggatctcggattttatgaggacaacattgcagaagcaggcacctggagatgtctgagaggaggcaatcatgcgatagaaaacgcctcaacattgcagaagcacaaggttgtagcagctcatgttttgaatatgaaacgcgtggggactcttggtgcattattgatgtttgaaattggctcatagatgtgcatggatggtggagcgatccggcaggaaatatgtagcgccttgttcgcattttttgtgaatgttgagctgctttggtagtgactagtgagttcgtttgtagtactagtagcgagggaactgtcgtttgtttagatgagcaaggaagaaatgcctttttgtaactcaggaagaagtcaaagcagttgtgtaacaaaccactttgccatgttgctgcacatttttggtcgccctgtttatgatgaaggtgagcaatacatgagaggaagaattcatcgcttttagttgattcaaatcacagttttataatggaatatgtttaggattaggaaagaaacaagtgtgtgagaatatgattattattccacggtattcacagtgctgaatcctagtactactacatctgtcctaaaatgttgctacacacatcctaggataacgaatctggatagacctcccatcctctgtccagattcgttgttttaagatgggtaggtagcaacattttgggacggaaggagtagctggtaggagcagtgatagtagtgatgagttggaaggtgcatggttgatgagagagagacgggtagagaggcaaaggacgaaagcagaagagtgaagtttggtagcgggtcttggaatcgcaccgactgggatctatgatgaggcggcacggcaggtcatccatccattcatccaggttagttgttgatgcctcgtccaaggcagctagcaggagtacgacattatcatgaatgaatacctaaaaatagcgtgaggctgtgtgttgcacagtgcatatgtgctggctggcttgtttttactgtgcttcatttttagcgaggggcggtgaatggaggcaaataataattaaggtggtggtggtcaaaaaaagtaaagggggaaacgctcgcgaggagggtcagggagggagactaggagtcagcctggcgttgctagtgttgaaggccagccagggaagaagaaaccattgataatttgacattcacaaagaagggaaggaaggaaggttccttcggcttggttgcctttgcctgacggtgaattgggttgggttgcgtcgcgttgcgcgcacggtcgtcggctcgcgctccgcctaattggttgacgttgctctcctcgctggtggtattgtatatagcgagccctacctactccacaaaaagagtcctctcctctcctctcctctcccttgccaccaccaaactgcaattaattgtttgtttcgcaaaacaagcatcctcgcctcggcgtcccagatctctgctgctgggctgggctgcctgcctgacaagagaggcagcagccatggcgttcgacgccttcaccgacaagaacgccgtcttccgccgcctcaaggccaagcccgagaacaaggtaacttcctcctctcagatcttcttcttcttcttcttcgcctcaagagtcagatctcatgtactagtattgtcgtgtgcttgttaatttcccagatgtgcttcgactgcagcgccaagaaccccacctgggcctccgtcacctacggcatcttcctctgcctcgactgctccgccgtccaccgcagcctcggcgtccacatcaccttcgtcaggtttctttctacccccccttcccatcccgatccacgccccctcccctcacaagatctgcaatccgcccacgccatcacatccgattcctttcctcatctttccatcaccaaccaactctaagcccatcacgactcctaggaactagcgcagaccagctcaacgatctcaataatacttccctttttcttctttaccccccaaaaaagggatatggtacagcgcataggtgcctgtggttgctgggtttggtggatctggccgagcctttcatcaaaaagaaaaaaaaaaggtcctatttttggtacagcccatctggtggggaatgcagccggagatctaggttcttgggccatcaacgtcaatacctgctttacaccttcatcccatcggcatttgcattcacaagttacacattttggtctaacagatccatatgcgcattcacagtaaatcacctactacttcgttatatttttctgcaatgaacatattgaacttcattgctggctgctatatctatgatcactactatggctatgctacattgctacccatctcatgatgctgcacgtttgtcttattgtgttgtttctaccacacaaaaaaaaaaatcataaaatgccttgctttgatactccgcaaaagtactagtattgtgcctgccaaatgtcaaaactgtacccattttattttcactttctcttatacaatccgtatgtattttctataggtcaacaaacctagattcatggactccagatcaactgaagatgatggcttttggaggcaacaatcgtgcccatgctttctttaaacagcacgggtggacagatggtggcaaggtcgacgcaaagtacacgtcaagggctgctgagctgtacaggcagatactgcaaaaggaagttgccaagagttctgctgataacgtcttgccatcgtcgccagttgcagcgtctcaaccacaaaatccatccgatgacttccctgagttcaagctaccagaggcaccagcagagaataccaatgggaagcaggaacctgatgtcaccaattcgcaaaaagcacctacgcagacaccaaaagcccctactcatcccacttttgccacttctgtaaagaagtccattggtgcgaagaagattggaggcaagactggagggcttggtgttaaaaagctcaccacaaaggtaacactgtggatcattagcgctatgtatgcatgtgtttggttccttcccacagttaatatttaatatacctcctctcttctatctatatgatgtgaacattaaggactgacctttgcctttatgttgcagccaagtgaaagcctgtatgatcagaaacctgaagagccaaaacctgctgccccagtaatgactacttccaccacaaaaagtggcccgtccttgcattcacgttttgaatatgtggagaatgagccagcagttgattcaagaaatggaggaactcaaatgactggccacgtagcaccaccaaaatcatcaaacttctttcaagagtacggaatggataatgggttccaaaagaaaacaagcacagctgccacaaagacccaggtaaatattgaaccaatgtttgtgctatgtcaataagtaaataataaatagattgacttttctgatcaatacataagtttgcaaagtttactttctatgataatgtaaacactgcactagattttgctgcatccactagcttgacttgttttgatttcatgatgtcatttccccttcctttatttgctgcatgcttgcattctgctgtttaatcatcagtgaacatctacaaatttcacagaataattaccttttgaactttggaaaagtcagttctctctatgcaagctgttgttattgctagcatgttcttattatatcaaatagttttccgcttgtagatttttgttatgttaataagtactgacactggacgtgaatacctttcagattcaggagactgacgaagcaaggaaaaaattctctaatgcaaaggcaatttcatcatctcagttttttggcaatcaaagcagagaagagaaagacgctcaaatgtcccttcaaaagtttgcggtgcgtattagtttagcatctctttgtccgaggaccattacattgcatctccttcgaacttgtcgaagcattcttaacttcattccagacttgaaatttcttgtctattgtttatgtttgtgctagtacttcatttgaatattctgtagaagtttgcatcttttttttcccttacggttctccttttttttccccctttaattcagggttcttcgtccatttcaagtgctgatctttttggccgccgcgacatggatgactcgaatctggatttaagtgctgcggatctcatcaacagaatatcattccaggtagttattctgtaaataattgccagccttttgtcacctcttgcatatttagtttttaagcaaccgagcatgcaaatcattactacactgagttactactgaattattcagtacaaagattgatccttgaaacgcacaaatatcttacctgctgggattgttgtgcaggcatctcaagatctgtcttccctcaagaatatggctggagaaactggaaagaagctgacatctatagcctccaattttatcagcgacctcgacagaatcctttgagtggttgatggggcgagatcattagcattttttgttttggcaaacctgcacagaataccgtattgagtttaaaatgtggtgcagctcagagaagcatttgttgcacagctatgtagatgaaagtagaggattggcaattatgcgtctgtattcttttttccttttttactattgttggaaccctgtccgcatgaagatatttttattcgtttcttgacaagattgaaacatacgatggtattcattccagttagtggtatagctgggaagaaaaggtatactttgatgtgcctgtgctaaatggaaccagtcatgttatttcttatttctcacagtgatctgtgccactgccagttagagttcatcttcctattataagcagataagctattgcaaactggctggttgttccttttactgacgtctctgtcgatagcttaaatgttacaggtttattataatgcaatcttgcagggtggaaaaaaactgttaatttgtgaaggcaagattcagctaaccgtgtatggaaactgaccaaatactggcagtcgagtatgatagattcagcttatcgtgggaaaaatggtactttgcgaacagccgtctgtcgacatcatattatatattgcaatggcttgttttgctgtgattttgagccaccaatgataaacacaatgcaagttgctgtcttgccgggtgtatcgttgtagcagagccgttcaaagtgacgtggactccaggcggtgccacgcaagactgttattttgtctcctctcttttctccactttttcgtcgtcaaaaatgctggaacgtcaaggcccgcccgttgtgcaaatggttgacagtgacactgacagtaacagattcttgatgtaatcgcattagaagaatcttgcacaaagcaaattctctttgttcttgtgttgtgtttgtggcttgttattctaagcgagtgacgggagcatctgtgctgcctttgccaatttgcaatccacgcaaggctcgtctttagattcattcgttcattttatttccgagtcaactaagatatcgtgtattgtctgaacgattcaaggcagctgtaattaattaagatgacagaaaattcagagcagagcaggttatcttgaacacatcaattattgtgaccagaaaattatggttttgaatttgcgtcccctacaaccaaattcaggatggttgtgttatctttgggttgaagaagagtttttgtcctcaacattttccagctaggagccggcataccacagtaaaagttgaagccttgatcgagataactgatgaacaggcggccggcaaatttcacagccaatgatcagtgagtctaatggaaaatcattctattttattacaggaagatggctgattttacccccacacaaacggatgtgatactacagatcacgcgatcagcgatagcctgatatggcgatctggtaggttaggtagcacgcgtgatcatccattcatcacaagagattgtcacatggcccatgcacgctatcgcacaaataggaggagtgattgcaaagagaagaaaaatagattaagaaaagaaaagagattaattgatgggttctacgatgactgcgatgagacgaacacccgaatctgctccaggaaggtgagctgctgcggccgatccttgcggcggatgtagccgtcggcgacggccggcgagtactccgggtaccccttcttgccgctgcgcgcccacaggtcgtcggcgtagccgcggtgcgcgtagtaggcgacggcgtcgacctgggcgccctcggcgaggaggacggagatggggaggcgctcgtagtgcgcgcgggagacgccctccagctcgtcgaggcggtcgagcccgcgcggcgtgacggcgtagagctcgccggagacgcggtgtccggcgccggggaggttgaggaggaaggggacgcggtagggcccgcagacgagcgggaggcgcggcgcggtggtggcggcgcccacgaaggaggcgtcgccgtcccgggccaggtcctggaggaggccgtggttggagaagcccctcttcagcgtgccgtacgtgaacaccagcgtccgtggagccgccgccctcttcgcctccggcgccgccggtggctgctccgccgcgtcgcccgccgccgtgcccatgcgcgattcaatcgcggcgagctcgagtcgagcttttctttctttggttggttggttggtgttttgaggcttgggtcggcttatttatcgagagaggtgggcccgcttcgtcgatgtcgcgtgggcccagcctctcacatttgtcgcattagccttccagcccattaacaatatgggctgcacggagctcgactcaccttgcggcccaacaaacagggccttgatgcatgggcctcgttctacttccattggagaaggcaagcctctcctccctctccgaaccagccgccgccgccgccgccgccgactgctcggcgatcatggtcggcgaccgaaagcgcccggctcccttcgccggattctccccgttcgctcgctccctcctcttctccgcctcctcctctaaaccactacctccccccgaggatccacccgccgccgccgccgacgaaatcccttcaggtacgcgtgcttacacttaattggcaacgccgtcgccggggcctcgctacctccttctcacgcctcgccgctctccaggaatcgccggctccagtcgcgatatgccgccgcccaagcgcgccaagcgggccgagccttccagcgacgaggagcgctacagcagtgacgacgagagctacagcagcgactccgacgacagcgacgacgcgtcggaggaggtgagtgcctacctctaccttggttctagcctctctggagttcctactcatcgattgatgcgagttgctcttcggattggtgctcctagctcgatacggtgcaagcggacttcgccttctacgaccccaagcccggcgacttccatggcgtcaagctgctgctcaagacctacctcgactccaagccgtgggatctcactggcttcgtcgacctcatccttgagcagaccacggtgggtacggttgtcaagattgctgacgatgaagaggatggtgaaggaaatggtgctgatggaagcagcactggtggcaatgacgatctgtttggtctcattagcgtgcttaatcttggaagatacagtgtatgttcaacctactcactgcttcatccacaagatacataggtcttgctgcactggtggcttctgattaatcaacttgctggtgttgtcttgtaggagcaccgctgtatgaaggatcttaaggattacctgcttgctgtttgtggtgacaaggataccaagaagaagctcaagcaaatgctgggggacaaagcacctgatgtgggtctgcttgtgtgccgccgttttgtgaatttcccatatgaacttgtgcccaagatgtatgaatcgttatttgacgaagtttcatgggccacagaagacgaggtttgtcaagcaccttcttttatgaacgtcgagctcagatagtgtgaaacacattcttttctctactttcttataacgtgttttcaactgtcctcgcatatctgaagccaacacaagaactccgggactccttccggttcaagcagtacctaatggttgtcagagtacttgaggtgagcaatgcaatttgtttccatgtttgttttgcccattgatattcaaagcgacttgttttgttgctcagtatttccgtgtaagatgttgtatagatcatttttcaagtgtaattgtgctctgtatatgaaagttcctgtcttgttgtaactgcttcagctgtatgaataacacgtctttgccatctggtgtagaggaaaactccagcaaagcaaaaggcaaagaacagtacagaagaggatgagcctattatctatcctaagttagaagacgaaatttttcgcgaggtatcaagcaggacatgctactgacaatctgagattaatttttctttgtgcagttctgtttgatgtggtaacaaaactttcttcctcagctttcttcatggtcgttcactttcccaatacgttctgaacaatcggctcagcaagaggttagttgtgtataagtacttcaggctttattatgctgttcttttattcatattttcatagttactttcagcatctggaactggttcacttgtggcactggcactacaaatttcctttggtacctggattgatattgttatcttttggacatctgtttgactattcgttttaataaatatgtaagtatcatttattttgttttataattaaaaatactttaagcacgagtttttacatatttgcataatttttttgataaaacaaatagtcaaacatatgtccaaaaaatcaacaaacgctgtatatttaggaacagaggtagtagtagccaaatgaccaaatcccaatcatgtgaagtaggaacattcgttcctttgtgttatgctttcgttatatctttcttcttctgatgatcattagctcaccatttcaagcagaatctgaacatgcatcattctaagtttgatgttgtgtacacctaaattgaatggactccctgtctaccctttcagatgaagaattacaaggagatgggcttagtgatggccgtcaaagctgaagcaattccgaagttccgaaagaagttggaggatctactatctgaatagttctctccacgcattgtaggtcgtgtggaattttgctgctgtccacatgatattggaacctccatatcttctcttgctattgcttgttagtgtccctagtaagcgcggacgctaagtttgtgagtgcaaagccctaattgaattgctagcattgccatagtagaagagaaattcatgtgtaagaggaaatcaattatgaacttcccttatactgatatcaagagattttgaaggacttttttggttgctcgaagacatggtctttctcagcccatacgcaccacattttagctgggagtttgtttgatcgatatacatcacactgtggtcaaagtcaactgtctatgattgtttttgccatgaggtagaaacgtgtgacgaaactgtgccctgtgcataacaaccgcatctcttctgaaggcataggcatctgcgtccttaaggtcagaggacattagtcatgccttgcaaagtctctgaaaacatggatagctgaacaaaaacaaccagcgaccaatcgctcggtgttccagatgaaatttgaacaatggttgcaaatatatcatatctctaagccaaaacaagagcatcacgtaattaaactgccaagcacacacgggcgtgtagcattgcaacatcataaacaacagaatgttgggaggtgtcctaagcaaaagtcaccgctacttattaagaacagtcagcacgccatctcagtgtcttaactaaaatcgtagtatgacaccagcatttactgatttccacatggatttaaaggaacgctaataacatagtatactacttcttctggaagtattagcagggaggtatcacaataaaaatgtaaactgccaacaaatgatcatgaacgcgagtgcagccatgaggtcattgggcaaccttcaatcacaagttcttgaatgcagactcattagggtgcttgggagtaagcctcgccaacaaagccttgttcgggaagtgctcggcatcaacaaaatagaagttcccttcagccctaaaagtgacaaaaggtctgttggtctctggaggcctgacatcagcaaacttgattgtccttgtgaggggtgtagccagccatgacataatctctgcttcaaagctatctgaacctggtcgccacctgagcttgtgaatgtacgggctcacaaaccagtgtaaggctgccgttgtggtagcactgaggaaaatgacagtggatgcaacagcgcccttgaggattacattcatatctggggatgtcatgaatgttatcacagggccaagcgacacagagagacagcaggtggacagagaaagaagcttcacttttcttatggtcgatgatataggtccctggtaaactagcctgtcatctttgtcatcttccttgatctgcttggattttggcccaatgcttatcttgctgccactattttcagtttctttaacagcagcagcttgagaagcccatcttgcctgactgtacaaacaagtgactgaaccaaggccatcaagttttggaagaggattaggcttgaatgttgagaaatgcttccatgcaatacatccaggagcctgaagatctgataatgtaaaggacagttagctgactttaatcggatttttgacacctataaaaaaaataagaatgcaaatctatatacttcggctatccaagataatggttcagaaaccattaagttagcaaaggagcatgttgctttcagaaaggaagatcattacgctattaagcattttgaggtaacatacagtggtaaattggacttcaaccatgcgccctgttgaattactataacacatcttcctaacaaatgcacctcaatacagtacaattagacacatgtaactggcaaaactaaatcatgtgaaaccgaaagaggtattgggggctcacgagagtaatatgtagagaatagcagataataaatcatgaaattcaaggtagaagcttgaatccacagattatgttggattgtgggtggagttagaaaaaatcatccctgaaatagatgtggaggactgtcatttaaactaccttttcattgacacatgcactctcaccgaagtctaaccaccaactacaatctaacttggaaattccgagattactcacaacatagaagaacatatagctagtcagtcagataacattagcactacatagagggcacagcacctccaggagcccaggacctaatcaaactagaaccgaacttgtgcaccatggaatcgtatgcccgttctcacaacaatttcgcagctcatagctgggcactaccacgcggatcagatttaactatggagagaaccacggggggagagattcgaagcatgaggcgaacctgagacgcgggagaaaacttgcggcggcgaggtggttcccacggagcagtggcggaggaggaccccgcggagggaggaggcggatcggagcctcgccgtcgccatggtctccttccgatcgaggcggggatttgctagggtttttccgaagggatggaggagaggccaagaggagacgaagcggagcgggcctaaacttacaccacatgggccgatatgggccaggccttagctgggaggcggtttcttattggatccggatccagaaacctcttcgccttcctcccatctttctctctctttgcacgcggatctccacactccgcaccgccggaaccctagccgccgcccgtcgccgccggtgagattcccttcttctcttacctgattattacctcactactcgaacccaaggttttttctaggcacaaaccctaatagagttccccaaactaggcagattttttttacccctggtcgccgctccgtcgtggcgagcgggcgggatgagcagccaccggaagaacttccgccgccgcacggacgacgccgaggacgcctacggggacgactcgagcaactccaagcccacagccaccaagacccaaacccctcccgttcccaagcccaggtcgccgagacgtcagggcgcgagccgcctcagcttcgtcgaggacgaggacgacgatgacgccgaggagggacctttgtcgcagcgccgccgcccggctgctacggtccggcaggcccgcacggcatcgccagctgcggcgactctccaccgcctcacgcccgccagggaccgcctcaagagctctacggccgtggcagcggcggttcccgcgccgaagccgtccaacttccagtcgcatgctggagagtacacgccggagcgcctccgtgagctccagaagaacgcccgcccactccctgggagcctcatgcgtgcaccgccgccccctccccctccaaccgctgaagccccacgacagcgtttgcctggagctgccgccagtcctgctcctgctacaaacaccactgctgctgctgtagagcccgtggtgattctcaaaggtctggtaaaacctatgtcacaagctagcattggaccaaggaatccatcgcagaacgaggacaaagacgaagatgagtcagaggaagaggaggaggaggaagaaggaccagtcatacctgaccgcgcaacaattgaagctatccgagcaaagcggcagcagcttcaacagccgaggcatgcagcaccggattacatctcccttgatggaggtggtgtgcttagcagtcgtgaagctgctggtggatccagcgacgaggatgatgatgagacacgcggccgtattgcaatgtacgctgagaagtcagatagccagaggagcacgaaaggtgtatttggcgtgatcaataatagaggtcctgctgccagtttgggggttatcaatgatggtttcagggaggttgaggatgaaaaggatgacgatgaggatgaggaagagaggaaatgggaggaggagcagttcaggaaggggcttggtaggagggtggatgatgcttctgctcagagagcagcgaatggtggaccagctcctgtgcaggtccagccgcaaccatccggatactcaatcgatccccgttaccagccttcctttagcggggttttgcctgggacttctatttttgcatctgggagtgcagagttcctgtcaatcgctcaacaagctgatgtagcaagcaaagccctgcaggagaacatcaggaagcttaaggagacccataagacaacagtggatgctttagtcaagactgacacacatcttactgaagctctttcagagatatctagccttgagagtggtttacaagatgcagaaaggaagtttgtgtacatgcaggagctccgaaattacatttctgtcatgtgtgatttcttgaatgataaggcattctatatagaggaattggaggagcacatgcagaagctgcatgagaatcgagtgactgctgtctcagagaggagggcagctgatctagctgatgaatcaagtgttatcgaagctgccgtcaatgcagcagtatctgtccttagcaaaggatcaagctcagcttatctatctgctgcatctaatgctgcacaagcggcggcagctgctgctagggaaagttcaaacctaccacctgagctggatgaattcggcagagatatcaatatgcagaagcgaatggatcttaagcgtagggaagaagacaggaggcgaagaaaaattcgatcagaatctaaaaggttgtcatctgaagggaggagtgcaaataatgaacatatcgaaggggaactaagcactgatgagagtgatagtgagagcagtgcctatctgtccagccgtgatgagttgctcaagactgctgatcttgtattcagtgatgctgccgaggaatactcaagccttagaattgttaaggacaagtttgaaggatggaaaactcagtatcctctggcttaccgagatgctcatgtagctctgagtgcgccatctgtgttcaccccttatgtcagactggagcttttgaagtgggatcctctccatgaaacaactgatttctttggcatggagtggcacaagattctttttgattatggtgagcaaaacagtgaaagtggcactgaccctaacaatgtggacaaggacctcattccagtattagtagagaaggtggctcttcctattttgcaccaccgtattatgcactgttgggatattttaagcacccaaagaaccaaaaacgctgtggatgcaattaatatggtcattagctatttaccaacctcaagcaaggcattgcatcaactattggccgctgtcaatagtcgtctgactgaggccattgctgacatttcagtgccagcttggggatcaatggtgacaaggactgttccaggtgcttcgcagtatgctgctcatagatttggagttgcgatacgtcttcttaaaaatgtgtgtttgtggaaggatatttttgcaaaacctgttttagagaagcttgctctggaagaattgttgaaggggaaaattcttcctcatatgaagagtatcattttggatgcccatgatgcaattgctagggctgagcggatatctgcattacttaaaggagtgtggtcttcaccaagccaaaagttgcagcctttcatagatctcgtggtagaactaggaaacaagttggagaggcgacacatgtcaggcataagtgaggaagagacacgtgggctggctcgtcgtttgaaagacatattggtagaactgaatgaatatgataaagctagagctattttgaagacttttcagatcagagaagccctttagctcttattcggcataccacaagaattccagttttgactgtgatacaggttcttaatccttctgctttaggaaatgttgtaacttcatcaggttttctgtacattaaatgatcatgagttcctcgttcaatcctgcatgatgttatccatacaaattttatgggggcttctcaattcagaaattatggtcatttttaattaccatttaccaatgctaattaactgtctgcaaatatatatctttctagcacttttctgtgttatagacatattgtatgacagtttgagcgtgtctgtatggttaattttactatattttgaggccttgagcagaatgtctttgctgtttgcatcagcaaaccattttttacatttagctaactgacaatgtattttttgaaagatgcaaggtgtctaaatattgcatgaacgcttctatttaagattatgtttgatatctataacttacactaccagttaagcttctcagctttgtttgtattcgtgtctactctgttttcttcatgtgcgctttccctattcttccttccattattcttcacgaagggtgacaacataattgaataactgggattattgtatttttttaagtgataccagtacatccaggtctatggaattatacaaaatataatattgtctttctgtcattctgtcctggatttatgtccaatggaaattgtaaacatcttaggcctttcttacgtatgtcttgtggaccattcttccaatgcaaaatgtttctgtttgaccgacctgaaacttttcatgccagtttccatcaatcaatcccataatccagcacttttttgctagttgtttctattattcatgatgttaggcttttatagctgatgcacacattgactgtcctagcgtactgtatattacctggagcagggaagaaagtgaatagcttagttctaaatagtgatgaaaaagtaaattaccaagaaaacaatgcaaatctgcagcctctgtgtataaaaagaaaaactctgaatctgagcatctgttctgtgttgcaccaagattctacagctacattatgtcctcttctctgtttagattagtgttcattgttaattatcttttttgttcctaagaaacactttgtcacaaacagtattgataggaagcaagtttttttttgtcaaccattaatatgctaaacgaatgcccttagaatatacatattgtctcagagattatctgtcgcctgctgaggatttcgaaacatgttgaatatcaatacataatgtttcagttttagccgagagtttgtgctccaaatatatgactgccaatattttgtgccccataagcgaactccaaaaccattgagattcctgaaggcaatgaataaggatatgtgttttgtggtttggaaggtactgttggcatttcaaataaatagggagtttttttttttagtacaacctgcaagcatgtctgatgtttgttttgcacggatgactgccttacctcaactattatactgtaaataatgtttgcagttggatcaggtaacatgtagttggagccagtcacatttggtgcagattccattctgtgtattcagatgctgctgtttatatcacataatatatgacttgccacaaccctacgctgggaattatgtagaatccttgttggtgttggttcagtctcagattcaccaagcactgatgcagaaacatgattcctgcaaacccttgctgcgtatgaagtccaggtgctcttgaattgtgtgattctgagaggaacttccagtaatgtgggttcttgttttttctttctgaaggcttcaacattattccactagatcttcatgttggttcccgatctgtatctgcaaaatacttacctactactagttggcttggatggtgctcatgtagtgataaatgaggtactgtgatcttgctacattgaacatggcactgtaggtgataaatgacccttgctgacttcactgacatatgagaccagcaggatcttccaatcaaaggtacaatgcctcgtgcatgaatgatagcaactatgaaaacttgtgaatgcaaagtgattttgatacagctgccattgtgcatgttattagcatatgtctggattttctgcatcttataatgttgaatagggtcattcatgtccctgatcaattcagattttgcacattatagctcttccttttcgtttgtgcatcatgtaaggctggtgtgtgtgtgctagctgtgggctggtcatggtggcgatgcaggggggccagccgcagccagtggagggtacagactacagactacagagcgggcaggcagcgtaatatgcaaaggacaaagcgtcatcaagagccgttggctgtgtttgtctatctgtagtagcacaggcagcaacagtaatttggtttcagcttagcacgactgcacgagtctactcatctgctctttctttgtttggtgatctgatctgttgtttagcttaaggggtgtttagacgggactaaaaactttttagcccatgtcaca

SEQ ID NO: 70471 - DNA, 760 bp, Oryza sativa
tctgtatgatacgattataaaaatctttcgaaagatgtataggtactcccgaattgcagatgatttgggccatccaaccggtgctggctgctgaagcccaactcaattacgcaaaggcgacatccatgacgacttggcgtagaaggcccaatcgccaggccgcggctccggttacagccgtgacgacgaagcggtggctgtgcgcagatcggagttgcggcagcggcggcggcgatggcgatccggaacttctggtcgatggccgcggcggccgtcgggttccggctcgttctcgtgctcttcggcggggacctccacctcgcctcccgccccgaggtctccacccccctcacctccatccgccgccgtaagcgctcccttgctcccctgcctcctcgtcccagacttgagctgtgctgtgttgtcgccgtaattggactaatagcttgttttcctgtgtgttttgcagtggcggaagggtactggctgaagcaggcttccatgtcgccctactccggttcgttccacacatcttaatcttgcttgattacttttttttgggggggacaactgaagtcgtgaattgttgagctcagtatagggatggaattactagctacatgagagcacttttaaaagtaaagtaaattgattgggtgctacttcttctagtaagctccattaagcatgaactgctgcaagcccgcactaatggggtgtgttaaaaaaaataagcgcaaaattgccatacctttactta

SEQ ID NO: 70472 - DNA, 1585 bp, Oryza sativa
cgcccatgcgaaggtggtggggtaaaggtccgcggctccggcgacgggcaggcgccagatccggtcgccccgcttggccgaggcgaccggcgacgggctcggtcgatgccggcgccgctccacggacctggcaggggggtggctggcggcggcgatggtggcggatgtagcggcgacgaagttggcgacgaaggcggcggactacggcgcgtgccgcgacgccggccctcgtcaagaaccttgccgccatgagggaggcgcggcgcccgtcaattgtacgccgtgcccgtgacgccttcctccatggcgccggcgacccgcactgtgcgctgcaccttcaggtccgcgccacccaggccggtctggacggttggcggctggcgatggtggaggctgacggtggcgactggacggtggtggctgatggtggcggctggacgggggtggcggtggcggtggtggtggcggtggcgatggtggctggcgatggcggctggcgacggtggtggctgtggcgctggcagtggcggctgtcgacggtggtgcaaggccatcatccgaggctgacggtgcgtcatcgtcggcagcggcatgtggagacggggaaggaggagtccgggtgcgggcgcgctgtcaagaactgtgggcggtggccttggccgaatttctaaagggacaatgttgttgatcgatgaagatccttcttgtgcggattagtggtgtgggtttggacagggaatcgcgggcgaaagccttgccgagccgtttggccggctgacgacggcgacgccgtttggcatcgttcccctccttggaggcgtcattttagattacccctctccttttctaaccatattctccgggtgaaaaccttgcttccttccgaacgagcggtggcggcgatccacgtcgcgtcctccttgggggcaccgctttggagaaacctcttcgtgcaaggattgtcaatggtctatgcattggcttcgaacttcagtcctaggctttgacgaggccttctagctccactttttgttttgcttttcttagtttgtgtcctctcttttcctgtttggtgtgttcaacttgtcttgaactacactctcttctggagtggaattttgtaataattggctgtagctctttttgagcaaaggccgagatattatattccattatctaaaaagctacgccgaataagaaacccaccagaagttttgataggggtcgacgccaaagcagataatccaaagaagccagccccatccataccaccggcaaggatagcaagagtaacaccactaactgcaaaagaaactgaggggcatccccgattagggcctccacgcatgggaggttgagaccatctcagcaaaacttgaaaccttcagccgtgtaattgatcttcactggaggtcaagaagaagaccacctcctttgtatagaactcgtcggagaaatcgagaaaggttggcgcaacctttttttcccagatctaaaagtatctcatccaacggctgggagaagaaacccggcaaagaggtgaccaatcactggctaaaaaaccggtgatgctcaccacaccacc

SEQ ID NO: 70473 - DNA, 590 bp, Oryza sativa
ccggtcacccaaccacctcgtgtcgtggccgttgaccgatcattgcaccgccatagcagcctcgctcactttgccttgctctacgccatccattgctcgcggcttgctgctatgccgaccgcatctcctatgcgagaaaacgacgctaccatcatggctcgccgtgcggttggtcggtggctcactctgacggcggtgaggtgaaggtggggggctgggggaggtactttggtggctagggtttccaccccgagccgcccgcctggcgggacgacgtgggggttagactcactctatatcatattatcatattataagctgttttaattttttttctcagtcaactttgtttttttaggtttgatcaaatttattaaaacttaataataattataacattaaatcagcttcattaaatctaacattaaatatctttatatattatgtttgttttgtattgaaaataatgtcattttttaaaatttaatcaaatttaaaagtttaaccaagaaaaaaaaaatcaaagtcacttataatatgagaaacggagagagtattccgtttatcctcgaataattgttatcatctca

SEQ ID NO: 70474 - DNA, 1093 bp, Oryza sativa
tagacttaaaagattcgtctcgcgagttagtccaagctcatgaaatgaattttgtaattagtgtatatttaatactctaaattaatgttcaaatatccgatatgacagggatttaaaataagtctccggaaaccaaacagccctaaagttacgaattttctgaagtctcatcaccgaaccacccgaaacgcaacccctctctggagatcaccagatctactcgtccccaatggcggccgccgccgccacctccccggcgcgggcggcggcctggaccttcgccgccgccacatgcgtcaagctcctgctcgtccccacctaccgctccaccgacttcgacgtgcaccgctactggctcgccctcacccacgccctccccgcgcggcggtggtacaccgacgcctcgtcgcagtggacgctcgactacccgcccttcttcgcctacttctcccgcctcctcgccctcccggcgcccctcgtcgacgcctccctcgtctccctccccgtccccgacgcgccgccctccttcgcctacctcctctacctccgcctcaccgtcgccttctccgacctcctcctcctcctctcctccgtcctcctgctggccacggacgcgctcacgcggcggcggcggcggccgttcctctccctcgcgctcgtcctctggtcgccggcgctgctcgccgtggaccacgtacacttccagtacaacgggttcctgatggggctgctgctgctgtcgctgcacttccttgagcaggggagggatctcgccggcggagtcgtttttgctgctctgctgtgctcgaagcacctgttcctagtggcggcgccggtctacttcgtgtatcttttccggcattattgctgtggccggggtgtggtgaggggattgggaaggttggtgctgatgggggctggtgtggctgctgtgtttgctgctgcatttgtcccttcctgtactatgggcaggtgagttttgctcggttaatttacctttggaatggacgaattggtatgttttttttttgtttagatactgtaatccatctgtaatcatcagttcacttaaaagtaggaaattatttcttga

SEQ ID NO: 70475 - DNA, 3630 bp, Oryza sativa
cagcgaaacattgagttatacgtggtcgaaacataaaattcagttattgaaacatttaaatttttttatgaaagacaatgaagacacatattgaaacatattgctatcacgtctgaaacattaaatttaacagattgaaacatatgtttttctttgatcggaatgtaatgatgtgatatcttgttgtaaagatttaattataacaaatataatggtgtgatcatatcatagattggataagtagttcagaagaaaacatattttgaaaatcatacagtgtgtatggatgtgtggtagacagggatgtaagtagtagttttcttgtctgatttttcatgttacggcagacgtccgacactaagcattttcgctaaactcttgatattttttttctctcaagctcccaatctagcttggcatgacgctgtcatatcgcgggttcgtcacgcttggatagtttgggcttagggttttgtgtttcgccttcccggcccctccgagtcccacacacgggaggcaacgtggggggtctctcacggtgcctatcaagtatctgatttgtctgtttcttttttcttttaaaaaagttggacctatgtaataagaattcaaatcctttagggaggaagaacaaacacgtgaatgtttgttataatgtgtcactgaatcagaccgttcatttttttaaactgatatggcaacgcaaatcatgcagaatgttaggtagacatgcggtcccatgcatgctttaattttgtgcctatatatccacaccaaaaatggatattagctacataaatgaatgatgaattaatgcaagaacacctaattagagtagtatatatgaaaactagctagtcgtatatatatctcacttgaaaattaagttcatagtatataataagtacaccatacaccatgcatgttgtaattaaacaaaataattaattcacataattcaatccatacagaggaatagcaggcatgcactgctagctatgtacaacacaaatcaagctgggctcacgcacaaatacacacatatatctatcacgcatgcatgtatacctatatatatcttgtatgtatatacctgtaactataccttgctatacggtgcacgctcacacacatacgtattgctggcagacacatattattagtagtacaatatagctagccatgcaatctataataactaataataataatctctcagcaaatctcactcacatcgatctcacacaagaagccaaaattaaaggcaatgcaaaagccatatgatggatgcataaaatggagtatactagctaattaacccaccaccctctgtcatcacactaattaagctcgcgcatgcatatgtatatatgtatgtatggtatgtatttcagtacttccagatggcagcgtccatgttgcatgccatcgacgagatgtcggcggcgttgttgttctggtcggcagcatcctgcggcgacaccaccagcgacgacggctcgctcaccacgaaccctccgccggccatgtccatctgctgctgctggtggtagtacatggacgggttcccaacaaactgctggggatgggcgccgctgttgatctgaagcgggaagcctgcaggcagagtggagtaggaaggcggcgccatgagtgagagtgaagcggtggtggagaagtcgtccaacatctgcagctggtcagacatggatggcatctgcatctgcatggggacttggatgatgccggcggaggccatggccatctgctgctgctgctggtagttggcggcggcgggcacctgatgaggagcaaccggcaccggcttcttgatgccggagctcttgtggaagatcctgcagacggcccagtcgtcctgcctcgggggctctgcggaggatggcggcggcggcggagaggcgtcggcgagcctgtactcgtgcatgacccagttggtcttgtcgcccttgggagccctgcccttgtagaagacgagcgtcttcttcatgccgatgagcatgtggtggtcgcggaagatctccttgtccttccccgtcgccttccagtatccagcctccgtcgccctgttcgtcctcatccccgtcgggtacttccgatccttctggcagtagaaataccactccttctccccattcatcttcgccttccctacatttatttatttttacttttcacatgcatcatatcatatcatataaatttccctaattatatatataatttctctcaattcaaaataatactagaatgtttacctggcaaatcccatggctcgcacttgttgagatccacctctccaatggcagcaacgcaaaagcccctgctgtccacaaccttgggtgcaaggtaaaaggtgataatctcctcgtccgttgggtgaaacctaaagcccggaggcaggtccggctgccgctccacctgctgttgctgctctcccatgctcaccacctactactgctctcaacgatcgctagcttcaacctgacatatatagccaataatacatatatctatctatataagcaaatcattaaccaaattaatttagcaaatcgatgtagtatgtaaatgccaaaaatctcaacttctagatagtgcaaacataattaagctatagtactcttcatatattgaacatatatacctcaacaagctcgcatgcaaattaacaagcaccccaatgtagaagcgaattaagattgatggatggtgttgtgatgaatgcaggaagatgtaggccggagggttgggttaaataggggggacgcgtgtgcacacaagccacttgtcagggaagactccatctctactttaactcctaccgttgtttgtttccgatggtctgtttcatctttccaattgtgaatgcttatgccccgcgtgccatctatggatacatcttctgacgggctcatttctctatgggtgccacagctggaatcgatcgatataccgaggctttactgtcctggctcgtcatattcttgcatcgagatacatctatcgttatgatgtatcgcgtgtttggctactttaagtcctttagctatagctgcattgctttaccatttgtcttgatcgtttttgcatgcttccctaattgtctcgctgcatccaaagtgtatcgctttattgttggcttaatgctcacaagcaacaccgatcctcatgttgatcacgcatatacagtcaggttgttgctaaatcttgtaggataaaaagatatatcaatccagacaatataattaaactcgcgtgcaaagctagtgctagcatagtcataatcttgtgatctgcatatagaaacacatggctagagtaaagaagaggaaaaagaacatgagaaatcgagatgattctattctacctcagtacaaatttcatatatatgtagtagattcaaacattcatatgtgtcacactgttttaataaaatggctcgaataatatatatacttgtgtgacgtggatcccctcacattccagcaatcccagagggattcattcttatagatagatgtataaaaaatgtttcgtatccttcactaaaacagaacacgggtagcctgtccataaatagtaggcatgtatatcatatatattaaattt

SEQ ID NO: 70476 - DNA, 38150 bp, Oryza sativa
cctgcagcccagttcgtatcttcgatctccactctgcactctttcttgataacagcaattagtgcatgtgcggcactttcttccgcatcacatggccttatagctgggatgccatgtgcacgaacaagaaatggctcttcacctcctcttacaccataaacagatgcctcagcagagccaacatacccatcagtgacagcatgacaattataacgtgcctcattagcgcctatgcttctaaggatctcagacaacaacattttcgacctgatgtgcacaaggtggcgttgttctgttataccataacaaaaacagagtcaataagaatagcagcatcataggtccatcccctttcctttccccttattcctaaaatttccctacacaggtacatataaatataaccatctctttttaccagatcaccaaatgaaataacaggcattcaaatccctaccacatcaatcatctgtatttttttaaaagagacatgacctattctagagagctcaaatagattgaggtcatcgttcaattaacagcctacacagccaccttgcaaactgtaaaatactattggccattctataggcttccaagccaagacagattaacttaaaaataatcgtgccactaaaaaaacacccatccccatttccattatatcgagcagattaaagaccgagccaaactatcaccacaaattagtaaagagcacacctcaatccacagggttaatcgctgtatatgcatacataccttgcacaggttcgtccatgctagctaaatgtcctttggctaaaccgctaagatcagcagcgccgccgccgcatcgattcagcgttaaaaaaacagccagcactcctacatatataccagccccaacaaaacatatgcaatgacagcacaacacgttgccctaggacatccatccttagctaaaaaaggccttgcatcctgaagcccaccagcagcccactatttatactcttgcacacctttaagagcccaacgtcaaacataagcacaaaagcctatagctccttgatatgttagcccgatcagcccacgataacaacagagagatccaatgcttactgctgcacgacctaaatagccaactaaatacgacctaaacagccaacttaaaaagccgttttccatcaattgttacatcggtactgatcaaataacacgaatcggttataaaccgcgcggcgcagcgcgcgaacccgctctagtatatatagcaatgcaacatataatagcactgacatcgagttggagatgaagatgaacatttttataaaaaaaactcaacacatgacgattgatttagctagttagcactctaattttaatgcctctgcattgcaagttttgttggaaccatttcttttcatgtgtaaacagtgtactatcaagaagggatgaattggcgtggtgaaaaataaagaaattaacttcaatccggctcgttatttactgatgagagttttgcggacaaatatgcgcgctcttctcttaagtctgaacgtttctgtttaaaaggagaggcgaaaattacaaacaaacgaatggattattaacactttatagggtccctttgaaatgaaggattgccatagaaattttggaggattcagttttctatgaaatttttaagtatggaatcatttaattcataggaaatggtaagaaatgtttcggaggatggtgtgtgtgtgtatcttaattaatttcatatatataaataagaagacgtcatatctgttggaaacttttctcttcttccttttgttttctgtgatgctatcggaaggctccccttctctctcttatctttttcgtttatgtaggattaggataagagaaacatgccgttccaattaatttctatgtttttttttatttttgtgttttcatatacaacatttcaaagagcgttaagtttatcaaaacatgcttcggtagagatcgaatgctacataattcacataagtagtcatctagtctgattcatcactatactagcttagatagctgttgaaaattaaagagcatatatagaagagaatggcgctattcctagtaggtaggtagctgtgctgtctagtgatatagagtacttcatccgttccataaaaaatcaacctagtattagatgtaacatattatagttagtattagatgtaacatattatagtactacgaatctgaatataactttgtccagaataatgtatcatatctaattctatatttgtttttttatgaaaggagtatgtatttgcttcatttcttgatttgtatttttttcgttccaaaatagtttaatctaggattgttatccatgcacaatgaagttggataaattttcatatagattcgttatattaaaataggtcatatcatattctacattgagttatacaggaacggaaaaagtactgtcatatggtagccgctaacgaagatatattttcgttggtatctgacttaagccggctgtcatagtgactggacccagcgaaaacatattttggcccaaaaaaacccatttccgttccttgttgtgtgcccggccagcctctcgatgcgatgcatacatagttttattttcttctctttgtttattaaccgagcgtacccctcacattattggatctccaacaataattggtactactgacattcatatatatgctaatatataaagctatttgcatttaatttaattatatgactagctagtgctacgacattctgattcatgaatacataactgcaattagcgcagacaaatttaggtaattaatatatcctaattggatatatctaagctataaaaacagccggccatcccgtccatgcaacactgactactgactagctatagcagcagcactactgttcttcataattccaaggtaattaagctagcaagcaagcaacagagatcgatcgatcgatcgatcaatggcggcgtcgtggagcgagagtgaaaacgcgaggttcgagcaggcgctggcgacgtacgacagcgacaatcccaaccggtgggagctcatcgccacggcggtcggcggcggcaagacggccgacgacgtcaggcgccactacgaccacctccaacacgacgtcaccaccatcgacgacgaccactcccacgccgccggcgaagccctccccaacggcaacaacaacaataatactaacaagtaccgatacatacctcacttccttccttccttccttcttaattctatttattcattcaaatatatatactcctgtatagagtaatttcctagctaattattattaacatatatgcatatacgtagattgatttattaattatcgatggattatatatgtttgcagaggaaaccgaaaccaggcatgatcgatcgatcgacgacggccggtgatggtgcacgcaattgcttaagctttcatggttaaatattttttttcacataaaagtaaaaaaaaaaacatgatcgatcgatgcggaccttatattgatccatgcatattggcctaaatatatatgtatgagccaatgttgcatctggccacgtacctgcgccaatattggagtatttggtatttatacggtacgtatgacaactttgtgcttgcatctccatcaatatattattactagtggagaataaatttatgtgtattcagagggtgtgtttggataataggaaatagggggtgggattgagattgggaaatgaatgaagcattaggattaaataaaagagtgagaatgaatggttaggattgaaagatgccttttggtgggttggaaatcatttccatttcctattagccaaacattgctagagtgtgatgcatgctttaccacctaaacattatatgcagctaacgggcgattgatcgctgccagcgatcgtttttttttccttttcctcttttagtaagtttatacacctaaagtttgtagatcgaatgtttataagtcaaatgtttatatacccgattcaaattcaaattcaaattcaaatattttatatttttatcttttagtaaatttatacacctaaagtttacacatctaaagtttatccacctaaagtttgtagagcgaatatttataaatcaaaagtttatatacccgattcaaattcaaattcggattcaaatattttatatataaaatatttctatacacaaagtttatgcgtgcaaagtttacggtataaagtttatgcatatgaataagagtattagatttttttcgaattttcttttactatttttttaaaaaaaatataatgtaatataaaagtaaaaaagagatatgaaagaagagtattaggggcaaaggacgggtgatcgctaggaggagagggaagcgatcacccgcccactagcaataccctcatctttattctcacttcccctcgaccaatatatctccatgcaaatgagtagatctaatgggcgagtgttcacatagcttgggtgcgccaaacatgttcggtctagcccacatgggtccaacccatcacgagacattatcccaaaagtttatgcatagaaattttattcatttcagaactttgtttgaattcaccggattcactatgattggcctataaatgcagccatagaagcaagttgtcgataagctcattattattaatagaaatctgtaagatttcatccccaagtttcattcgaatgccatataacaatcccgttattattagtagaaattttaggccataaaacatgttatgttactctcaggctcccactaagtcaaccagaaataaacttatcgactaataaaaataacatagacgaggtgaaggactggaagtggcccccacaagcacgtctagtagaagctaatgtggatggtgaaaacagagcaaagagcaaattgtttatggaccgatccgctccgagtttgactaaagtaaagatatggtaagcgttagcatccgaccacagatctaggatttaccaagggctgtgagtgtaaacggggtgtgtccgggtgtgcagtgtgctcgggagcgaaaaggaacatgatcgtgtatacaggtttgagcctttcgaaggataatacttactcatgttcttggtcggtatcaaagaagtttgtataaattaccaggtgccctcaggctagtctaggaagccggatgtttttgccaatgacatatggcatattaccaaaatcccacggtcgaatatccgatttcttatgtgggtcattcaagaaagggctatttggaagaaaagatgtaccatcacccgatacatgtatcatcatgttccattcaaatggcttatctattatttttaacttgaagactctatcgtgagtttgggagcctatctgtcggcttctttttgttctatattgtttatgtgagcaattcaactgtgtaaatttttaatacctcatggtaccttctcaagaaacataaaattgctctgtttatgtatgtatgttttatacgataattttgatccattcttaagccgtatctgttttgactctgtatcatttccgtcatccgcattgataccaaaattgaacccgctaaaagattgttgtgtaggatatcatatgagctctttatgtccgaatccactttatttgcataattgcatcgcgtcactggatctaggagcttcggcaagaagatgtcatgattatacggaaaacggctcaaaaaatacatccgtcctaaaaaaaattaatttttcatcaatgccaaaaaaaccaatataaaacaaaaagattaaaacaccctcactttatgaaatcctaatactattatcagatttgctagacaactgcatttatccactacttttaccaacttcaatcatttgcaacttgttttgagagacaaacaggagagacaaaaatgatcttattcattcagagaccataaagcagtaagagatgatttataagataaggattaagagaagttagggagtgcatttttaagacggattcgtccgacgtttatgtgagggtgaccagctagctgatagctgagtcaatttgtgtgacttaatttgcgaccacgtagcagtatatgtatagtattagtatagccccgaagttagttgaagacctcttggagtagagatcgaggaagaagaaataatcaatggagtgttgggagaagaagccaaggaatctgggtggctcgctgccggtgcccaacgtgcaagacctcgccgcccgcccggaccacctcacgcccaccctcctccgccgctatcttcgcccgcaccacctgtccctgcccgccgacgaccaccatgccatggctatgatacctgtcgttgactttgccaggctcatcgatcaccatgaggaggccgccaagctgaggcacgcctgcgaggagtggggtttcttccaggtgatcaaccacggaatcgccgacgagacggtggaggagatgaagcgcgacgtcatggccttcttcaacctcccgctggccgacaaggcggcgttcgcgcagcagccggaatggatcgagggctacggccaggcgttcgtcacgtcggaggaccagacgctggactggtccgacctctacttcctcaccacgcagccgcccagctaccgcgatctccgcttctggccaccggagacatcctccaccttccgccgctccatggaccgctactccctcgagacgcagcgggtggccaccgagctcctccgagccatggcgcgcaacctgggcctgcgcgacgccgacaagatgacaaggctcgccgcggcgcagtccatgcggatgaactactacccgccatgcccggccaaggagagggacagggtcctgggcgtgtcgccgcactcggacgccgtggggctgacgctgctgctgcaggtgagcccggtgaaggggctgcagatcaggaggggcgacgactggatccccgtcgaccccatccccggcgcactggtggcgaacgtcggcgacgtggtcgagatggtgacgaacggcaggtacaagagcatcgagcaccgggtggtggtggacgcggcgcaggagcgggtgtccgtggcggcgttccacaacgccacgttcgggtcgacgtacggaccactggaggagatggtgggaggcggcgaggcgcgctaccggagcatcagcgtggaggactacgtcaggctcgtcgtctccagcaagctccagggcaagaacatcttggacgctgtcaagattattactacgacttaatttctcatcttatcatgcctgctgattaatcaatcaatcaatctccctggttggttggttgctgccgagtaaactattcatgccacttcaattattagtaggtaaaaaggatctatcatgcatactactttccgtttttattggagtaaggtttatataggagtacctttgaataaacaaacaaatctcgtctactttgatgtaaaggtttgttgtatatgaggtttgcttcattgtacgctacagttgcctgagtatacggctaatgtacatgtgtcttgctacataaacaattagtaattacaaggtacacaagctttagcaaagatgtgtgtaaatcatatcatgcgtgctcatccatcgatcaaacaatccctccatatatcactggccgggtgccgggtaaattttccatgccacttcaattaggtagaaaggatctatcatactttctgtttgtactgaactgggtccctactttgaataaacaaaaaacctcgatcgtgtactttgatgtaataaagatattgatgggccgggttgctatgggagtatctatatatctttcaaaagatttttatgatcgtatcatacagatttttaatctttagagtaaaagacaaaaagtaactaaaaaacatcataatggacattaatattaccatatctttaaagaaaaagaccaaatccattataaatttcaaaacttacatgtaaagattcaaaaattacactgtaacatacaaaagttacaatataagttttataaattacactgtaacttacaagaaaatacactgtaaatttaagtgagaaaatcgagtgagagataagaaagaaatctttcgagtgatatatagcaaaatcacgctacagttcattttttcttttacaccagattacgctacagtttgccaaacgtttagggagaatagccaatatgttccctaaagttttgctcttggatcattttagttcttaatattttatagtgttcaaacaagtcatatcacgtggtttaacatagcacttggtgccaccaaaatcaccacatagacatgccatatcaccctcaatttacctatataatagaaacataaacataaggaaatgaaaacattgagttggactacaggaagcaaatctctactattataaaaattgaagatgtttttgccggtattttggtatgtcattcgtgtatgagtcggttttaagtttgtttgcttttggaaatatatatccgtatttgagtcggtttttaagattgttcacttttggtaatacagaaggaatcatataagaattctatttaaaaaactcaaatgctaagctgagatgatcggactcctaactgcaactcatgattttctaaaaaaaatatatatccaagggaactccaatagtgaatttcatcttaactaaaccatataataataataagattaaaataaacttcacccgttgtaacgcacgggcattttttcttatatgattaaaaaattaaaaattatataactctaaatttgccattactttatatagcaatacgtcatattctatcttcatggtattctcagactagaaactttcggcccgtcattctcatattttcgaagaatttctcttttcaattgaatcgaaaatgttctctagcaaattatcaaattttaaaagtgtttttcagccgtgatatgtttttgtgatgtttatcattttagcaaaattttccttgtttttaggttgaccatctgttttatgataagaattaccaaattttggtacatgaatatgtttagtttgtaaccaatgtttagcaacatcaaaatttaataggattggcgaagtgggcatagctcaacccattaagttactaatggtggaacaaacccatccaagttcgaattctatacggacatgggtactcgtatttacgattatttatttatcacatatatagtagacgacgtacccgtcgacaacgatacgctcatggtagcttcatcaatcttaagaaataccgagacgttcgtggtggcttagccaatcttaagatatgtcattacagtttcttggaggtgatcatagaggtaggatgtgtgtttgtgcgttcttagatatgagtgtgcgcgtgttatgagcatatatgtttgtaacgtgttttaaaaacttttaataggattaaaagtggtaataaagcaaactgaacatactcgtatatcgaactgtcataacttctaaaattagcttgtacctcgtaattgtcgttgtttacaccataaaattcccaagagaaaagtgaatctacacaatatgtttacaccataagtttggaaaaaaaatcaacgcaagtcattttttcatcttcagtccgaaagtataagcggatatttttgcagatattttgttagacagacagacgaagaagggaaaagagacaaagcgcgcgtgaaaaaaagaaaagaaaaggagagaaaatgttttaagctgagaaaacaaacccaatccaaagcgataggcaaatcacatccatccatccattgccattgccacccatggcgccactccccgccgccgccgccgcgccggccttcctcttcctctcccctcccggcaaactgcccggcggcaaacccaggctgaaaccctcctgtgccgcctccacctcgtcttcgtcgtcgtcgtcaccctcgctcgccgagcagctggagcccctgtcccgcaggctcctccacgggaagcccacgcccacccagcacgcgccggagccaacctgggtgaacccctccaagcccaagcccaccgtcctctccctccgccgccaccgccgccgctccccttcctcccacccctcctccgcccctctccagccgctcctccgcgccatccgcgccctccccgacgctgccgacctcgcccccaccctccacgacttcttccccccggcctcgccgccctccacctccgacgcgctcctcctcctcaactacctccacccctcctggcgcaagtccctctccctcctctgctggctccgcgccctccccgatggcgccttcccacttgacaccatcgtcttcaatgtcgccctcaagtccctccgcgccgcccgccagtggccccaggccgagcgcctcgccctcgacatgctcgcctccggtgtccccctcgacaacatcacctactccaccctcatcaccgccgcccgccgctgccgccagttcgacaaggccgtcgagtggttcgagcgcatgtacgcctccgacggcgtcctccccgacgaggtcacctactccgccatcctcgacgtctacgcgcagctcggcatgaaggaggaggtcctcgcgctcttcgaccgcgcgcgcggcagcggctggaagcccgaccatgtcgctttcgccgtcctcgccaagatgttcggcgaggccggcgactacgacggcatccagttcgtcttcaaggagatgcgcgaggtaggcatcaagcccaacatcttcgtctacaacgcgctgctggaggcgctgggcaagaccggcaagccaggcctggcacgcaacctgttcgaggaaatgacggccgagggcgtcgagcccaacgcgcgcacgctcacggcgctcgcaaagatctacgggagggcgcgctgggggcgcgacgcgctgcagctctgggagcagatgcgggagaagaagctgcccgccgacaacatcctctgcaacacgcttctgagcatgtgtgccgacgtggggctggtgggcgaggccgagcagctcttcagcgagatgaaggacccggacctgggcgacgtgccgaagccagacaagtggagctacacggccatgatcaacatctatgggagcagcggggatgcggaccgcgcactccagctgtttgcggaaatggtggagagcggaatcgagcccaacatcatgagctataccattgtgatccagtgcctgggaaaggcagggaggatacaggaggcggtggacgtgctagaggctgggatggccaagggcctcaagcccgatgaccgactctgcgggtgcctgctctccgtggtcgcgctgagcagcggggacgagacggaggtgattctggcttgcctggagaaggtgaggagtaatctggtgaagctgatcaggatgctcggggatgcccgggtgggagtggaggacctgagggtggagctgaagggcatactgaacagcgcggcccctgaggtgcggcggccctactgcaactgcctgatcgacatatgccgcaaccatgggtaccctagtgagagggcagtggagctgttccgcctcgcccggcactatggcctgtactcgaagatccatacgaggaaggaggaggagtggtcgctggacctgcggtcgctgtcggtaggcgcggccaagacggcgttcgacgactggatgaagaccatccgggaacacgaggaggaggaggctctgccacagacgtttagcgtgtacaccggctccagcacccacaaattcgcgcaggggctggcgaccgcggtggcctctcatcttgagcaggtgggggcgccgttccgtgccagcgactcccagcttgggagcttcatcagcagcagggatgatctgctctcctggttgcacaccaccatgtcatcgccggatgttgccgtatgatcgccggttggttgcatcatgcagtcttgcagacaggacaggagggacgacggccgtgccgtcacattaaaatgctcgtcattgtttggttttggttggctgcaaattaaaatgctcccaaagaataggattgcgaggaggatggatggatggtgctgtacatgcgcaaacactccggataattgtcatttctctgccttttttatactagtccagtttgtaggaagctggacaagtgataagcagataagctagtactagtgtggttttctcacctcttttatttatactcctactagattactcacagttgttagggatgaggtgagggcactctgaagatgagagagagctcacagtttatggtttttgtacgacgaaattattattacatatctgggtctgggtgccagccgcccgcttctcaaattgtacttggttgattttcatgtgtggatccatggggatggtcatagatagggcgccataggaaggagttttgcaagaaaagaaaaaacaaaaacaccttgaatttatgggctgtcgaaatgtaaaaaggccgagtccacatgcagcccatcagagacggcccatcaagaatcttttcttacagatgcatgatgtcccatgcagccccaaccactcctcctcctcatcggaggggttcttcttccgaaatccgaatcgatcaatcgagcaagggacgggacagggacgaatcgtcgccggagaagaggagagggagagagagagagaacagaggggcagaaggcgagacaagatgatactagcggtgctcttctccaactccgacggcaacatcctcatcgagcggtacttacctcccccatcttcttcttctcccctccaagaaagccctttttctcgggggatctcgcctcctgaggcagatctgcccatctcttccacgctcccccgctacctatggccaacaaattccacctcaaccatttccctccaaaactaatccatctctactccccgtacttaccgctgatagaaactgatttatcacttgcgggttggtaaacgtttgcagcttccatggtgttcccgcggaggaaaggctgcactggcgttctttcctcgtcaagcttggcgccgacaacctcaagggggccaagaacgaggagctcctcgttgcctctcacaagtatctacttttcccctttagctcactgattgattgattgattattctactctagcttaagttctccagtaagttggtaccaccaaatggatcttcaagatttaccaattgttcaggcccttttttttattcgatccctggttaacatcaatattacctggttcatgtcttttggccataactgcccagtagcaatattgtgttaagatcgctccctgatgtgccaatgttaatcttattcctatcccgtacaaatctattttcggaaaattcattcattcattcatctcctaaattcgctctccagtttgccaccattctgagcatcaacttgatgctcctctgtttttttttaaaaaaaaaaatcttctgaatgaaacagcaggactgctatttggttacattggtgaggaaataaacgttccaaaattacaacaaaaatgcccaggggccaaaagaaaaggagagacaacttaccagttatagtagataatgaacctggaactgcaggtcgtgatgctgaatgtgtagaattaacctccttcagtcatccttaagcttgaccatgtgttatacagtaagtgtagtagagcatatccactgatcattaatcagatcccatggttgccttgagttttgtttttactgtatgctgtccttctgaatcatgcttgtcatctcctacaaatcctttgctcatctgaaatagaacatttccctctatcgctgctatttactattgggttttttttcaggtccgtctctattgtttatacaatgattggggatgtctgcctgtacattgttggcaaggatgaatatgatgagcttgctcgtgagtgtcgtcaagcttatgaattatgatattcctttccttatgtaaaagttactaatctagtttgaacgccttctacttccacatcaattgtactcatggttggtgattattgtctgtagtggccgaggtgatatttgcaatcacatcggcagtgaaggatgtatgtgggaaaccgcctacggagaggctcttccttgacaaatacgggaggatctgcttgtgccttgatgagattgtttggaaggtacagcttggggttgatcttctagtgtgtgaagttgtttcccccattttctgtgatctactctagtacctgagagcttgatgatatatatattgcacgttgttgatgcagggtctgctggagaacacggagaaggacagagtccggaggttgatcaggctaaagccgcccgttgagccatgattttttgatcactttggaatatgtgtgtatccttctcgtcgtgtaatcatatctctcgcagtttatttgctggcagttgtttttttattccctttgggatggatgattctgtatgtgtacaatcctaatacattttgccactgatgatttgtactgttacactactctccgtgtccatggatggaaggattgcagtttggcaatatgctgcattgctgctgcgcttttggtttcggtcattgctacggtatgctctgctttaagtgaatttgaatatttgatgaagcaaaaaatgagtaatcaccatgattattacatacatcgttgaatttgatgaaatggcaaggcaacctgtgcctttgagggaaaaaaagcaatggcgaccacgtcgcctgagctccttccaaagcaagcaccacatctataataagacattaattatattatattatgaaaatataaaacttggagatgttttcattaaattttttttacgttatccgtgtttaagttgattgtacgtccccaacccctccttctcctaacccaatctaaccagcctacaccatcacgccctcctctccaatcacctctatttcatcacaattggtaaagtttttatgaatcacaaaaattgtcttcacctcatgtaacccaaaggcatttttgctagttaataagaaaaaaaagaagaaagggtcaaaagcaagcgtgaggggggtgaatctcactataaaaagaaatttccattcgtagcacaaaacttaaccaaatttaaaaacagggcaataaataaaatttcagggcgcgaagaaaataccatatatatgtatctaaaccttccatctcaaaattatttatattctttaaaatcaaaatagatactattaggtggtgtttggatgcagggacttaactttagtccctatatttagatactaatttagagtattaaatatagactacttacaaaactaattacataaaagaaagctaattcacgagataaattttttaagtctaattaatccataattagagaatgtttactgtagcatcacataggttaatcatggattaattaggctcaatagattcgtctcgcgaatcagtggatgtgttttattaatagtctacgtttaatatttataattagtgtccaaacatctgatgtgatatggacttaaaagttttagtcacatctaaacagggtcttagtaaagagaaattcctcttgtgtggtgtgtagtaaatccctccctttgtttttttgggttaattagatccatgccattaaaaatatactagttttgaaatataccactagtattcaagtatttggtaccatgccattataattttacacatatttgagacatgtcactatttaccccttagatatattttaagaaaagattggacaaaattgcccttcttcttctttcctcctcttcttctcccttctcttcctgttcgatgcagcggggagcggtggagcggcggcggcggagtgagcggcgagaggcggcagcagctgctactgcgcggcggcgcggcagtagcagcagcggcgcgcaagtgtggcggcgcggcggcggagcaagattcttgtggccgctgctgaagataggagagagaggtatggcctgttcactttgatgccaaaaaaaaccttaccaaattttggcattaccaaaatttttgccaaaattttggcaggatttcttatatagttaccaaaatttggcagcaaactaaatatagtcactttttggtaactttatcaaaatttggtaatgttaaaaataacatcaaagtgaacaggcccgtaaaagatagatgagagatagagagaggtagaagatgagggtatttttatccaatacatataaaatacgcatcttagtggcatctttaagattgtaaacaaatagtatagtagtggcatcgttacaaatacacaaatagtaatggtatatttcaaagcatatacctaattaacccttttttttagaaaattggaaccatgccattataattttgcaaaatttgagatatgccatcctgacccacatgtcatttactcatgtgggtcctacatgtcattgagatactgatggcatatgtcaaactttgcaaaattataatggcatggttccaatttaccttcttctttttttttagaagttccagtgttgcagccaagtcggaagtcgccattcgtcttctctctctctctctccgcgccggcaaagcggccggtggcggcgccgacgagtcagcaagcggcagcgcggaagtcgacggccgcgagagtgggaggcggccggtcggtgatcgagtgcggaagtcttggtgaaggcccaccgcgtcgcgtccgtgtcctcctcgagccgcgtcgtcgtcgacctccttcaattccctcatggctcgcaacaaggtaacctcgctcgctcgttcgcacctcctcgtcctccatgatttgcactccaactccaacgccacccttcctaaaccctatctataccctcctcctccgtccccttcaaataaaataaaggttttatccccccattcctagggtttttgggacagtaataatttacttcgcattcgattgttgtgatttagtatctatttacatccatcttcacattaacctatctgcattcctctccttccgctgcaccatgcacttgttgttaggaagtatcctgattttacattttcgacttgcacaccgtgataccaaaatctaatgaaaaaaaaaataaaaaccagaaatcaaacccatgatactgatcccccccccccgtccctgtgattctgcgtgtttgacaaaaataaaaagagaagaaaaaaccaatatgcaagaccatttctggtagcactttttattgccaatcaattatattttttttaatgtaggaagcattggttttgctattggatgttggcccatccatgcatggcgttctgcaagaagttgagaatatctgctccacccttgtgcataagaaggcaagcacacactatttccattttaacttcccagatgcaaatgctactacctggccacctgcaattcatcataacttgtaaccaatcagcctcaagctaacccccctgccttttcccccctctctgcagctagtttataataggagtgatgagatcggtgttgtcctttttggaactaaaggtattgttgcaagcaaatgtttaactaaaattttgtttgcacttcaaatgttctgtgttgttttttattagcttcattgaacaagcatatatgattcacaatggaaaaggataaagacatagttatattaaacaagtatgtgattaacaacagtgaaggatcagacaagttaatgtttcttctctcacacatctagtctagttaaacacttcttctcaagttgctatgaacgatagatctacttagacaccaacgtttgcattgttttgctgcaaatttgagaaccatgcatgaacattgtttgggtcacatatttcttgcttcaaaagttccttgggctgcttgatttatgtttatatgtgcagaaacaagcaacgaactcgccaaggagcttgggggctataagcatgtggtggttgctcgtgatattaaagttgttgatgaagaaacaacaaatgctctgcaaaaccttccaaggggaacttcccctggtgactgtatccacaagtagcactgtatgctgatgtttggtttatagttattgttaactagacatccgttactagatttgccataactactactatcagcacacgacacctatttgatctttcattttatgaggcattttttttgtcttgccctgctgcctgcatttgcatgttgctagatcatatctatggtgtaggagctcaaattagtatttctcagtccattatccttaagtgtttgcattttgggggacttctttgttgtgatactgccatccatattcagcatccggctcttcatatagtagctcctgcttatggatttgtgcttgtttcatcttcttttttttccctgtctttaagtcatatagtttctttgttttacatcataatagcgttgtttgaacttgctctgtactcttctcgagtttgatcggaatcagatactggaattccttgactaaggcaagttttggatgctattgttgttggtttggatatgctgataagaaaatttggaaatatcaaaggaaaacagcgtatgtgtctagtcactgatgcacaacatccattaagagatccaccccaagggacaaaaaaggatcaggtggacactattgcagaccagatgaaaagacacgaaatcaagatggactgcattattttcagagaatctggagttcgtcacaatgctgtaatggatgaaaacgaccaattattataccacttcagagagaggtcagtaacaaaggtagttcatgttgacagcccaacgtcactcttaggtgctctcaggactagaaatgtacttccagttactgtcttcaggggagacttggaagtgagctctagctttaaaataaaggtggggtgttgttttcttaaattcatgtaatgttttttttttcagttagagaaatttatattaattctggttcagtttgcaatttggtctgacgtctttgtgaacaggtgtgggtctataagaaaacatctgaggagaaattccccactttgaagaagtattctgataaggctcctgcaagtgataaatttgcatctcatgaagtcaaagtggattatgagtacaaaagtgttctagaaccagacacagtcgttccaccagatcaaagaattaaaggatatctttatggtccacaagttgttcctatatcatccgctgaatgggaagctgtcaagttcaaacctgagaaaggtgtgaagcttctaggttttacagatagatccagcatatctcggtaacccatatccttcaaccttttatttggaataagattatgttctttggaccttgtggtcttgtattcactgatgccatttctacatttaatttcatgattatttcaagttgtttgaggtaacttgtttgaagacatagcaaaccaatccatgtgaacattcaagcatgaatagttagtttatgtactttatatcattggagattgagctgatactatgaaacaaaacattataaaataaattcttgctctagctgattacctgatccttgcaattatgcctaatataaatgtttaaagagtacatgtttcgtgttatgtggtgttgcatttgagtttaagctgtaggttatcatttatcatgttataaaaccccttgggatgaatatgttgcaagctggaattggtgaatggtttatgcatgaaaacaatacatgaatgcagtgctctgattcgatcaatcaatcataaatccttgcacgtaaagtttatgtttttatgtatagattacagaactcagatctgtactgggtcaaacttctgtttatccctaaggactgccagggggttcagcttatacaaaagctaatataaaatttcttttctgaaagtatctcatttccaaaatttgtaaagataaattgctgtaaacatgtttataagtttaatattaaatgtctttactatattgcagttttaagaccagatgttagtaacggtgacacagtccaccttttttactttaacaggcactattttatgaaagatgtgttctcctttgttccggaaccaggaaacacaaaagcagttgctgccgtttctgccttagctagagcaatgagtgaaatgaacaaggttgcaattttacgatgcgtgtggaggcaaggtcaagggaatgttgctttgggtgtattgacaccaaacatatcatcagcaaaaaatgttgtatgtactttatttactcacaccttatacctgtaggattcgtctgatgattgcatatgttcaagcaattctttttttttccttttccctgcagctggattccttttacttcaatatacttccatttgctgaggacatcagagagtttcagtttcggtccttcagcagcctgccatcatcatctcagcctaccaaggaacagcaggaagctgcagataacctggtaaagatgttagatcttgcaccacctggaagggaagagatccttaagcctgatttcactccgaatcccatgttggaggtgctattcttccttcagaatattgctatttatcaaaaccaatttagatattctgatatttttttctcatattatataccttaagctatttttcctcttcttttcactttttcattggagtatgctctgcaaaggttcttgtatgtatttgttttgcttctaagtttactaataggttctagatcacttgacatttttcttttaatgctccttttgtgcatattctttattctgttgactaaggttcacttgccacttccccctttagagattctacaggtaccttgatctcaagtcaaagcagccggatgcaaatgtcccacccctcgacaaatgtctaaagaagataactgaacctgatcctgatgtcattgattatcaagcaccgctaataaaaaaattaggcaatgtatttgagctgaaggagaaccccaaggttagaaatattgctaacgtatttgtgttattgacttgatactgtaattttggggaaccataaatctgtttggactgatcacagaaaaagaaagcacggacacaggacagattgacttatactggcgcagacgatcaggctaaattattagaagaaccttctgcagagaaggttggggtttcggaagctttatatcctccaaaaaagaaggctggggagattggcgatcataatcctgttcaagattttgaagccatgctgacacagagatctagctcaacgtgggttcagacggcaattgaagagatgcagaagtacataaccgctttaatacaggattcctgtgatcgggataatcaccaaaaggcactggagtgccttgttgctttacggaaggcctgcattattgaacaggtaatctctcctatggttattttcatttgattgcatggtagttagatgtaatccatgccccttattttgctgcgagacctcatgtatagtttaaacatgcttgctcagttgtaacttaggtgttgttttccattataggaaccaaacgaatacaatggattcgtaacaaagctctgtcagaaatttaggccggctggtgataaaatttttttgcagcttctttcgtccaagaaagcttcgcttataagcaaagaagaagcacctgataggtaagggaacctccatatgtgctgtagaaaattctatgtgcattgttttctctcagtttttgccatttaattaccctattctatatgcatgtagcgatgtgacggaagagatggcgagaaacttctgtctgaaacccgagccgtcctctcagtagccgagactgcaggcatggatgtggatggctttgagttctgaaggcctggaagctaggtaaaagaggaactggaagacatcgaacggccctagtactaatttctaacgtacgcctggttaaaatgttatgtagctcggtttttggaaagctctgtgtcatgtgagtgatgagcaacacgagctactattgttttcgaatggatatgtatgttgggatggaaaaatcccagatgaaatgtaaaagacttgcagtttgagatgtcccaagctccaagacttcaattcctcacctccagaagctctgaacttaaaattcagcgtttctgcggccgatatcagcattctttgcgtgacatagggaacacactctggcgatcagcctcagggtcagggaaagaacacttactcattcccagcctttattcaaaatctgtgaaacaaacaaaacacgcacaaatccctgcagagactcactagattcaacaagagattcatcggcattcatagcctgtaaactacaatttgtattttgtagtagtacaacaaactgagctttggcaacagctaattaggcgtccttctctgccacaagcttgtcgataagcacagcagcatcctccactgtctgaatcacttgcgcactcgattcgtccacggtaatctgaaatgcctcctcaaggcccatcacaatttcaacctaaaaccaatcaaaacacacataaagagtaatcagaggcatcatggctgcaggcagcaaatactaaattcctgagattttcataagaaagaaaaaggcgccacattcctgggataaaagagaataataagctagatcctgggaaaagagagcacaaagctagatatggaattgattcttcattccactatgaacggagaataaattcatttatacaatgactaaatataaaaaggtgtacaattgccgcatctgcgaaaaatgtattgttgagagcaacaacaacatgccaggagagatgttgactagaataatttttaatactaatctgagccgtgacaaatatcagagatcactgtggactttcaacaagaaagtatgaggttgccaagaaaagggctagttgagaggagtcttacagtcccctttaaaaaaaatcaataaagtagtccaggtgatttagatagtgttgaattattacattagtccagaagattaccgtgtcaagtgaatcagcaccaaggtccacgaattttgtttctccagaaacggcagtgccttcatctactgctaactgattcttaactatttcgcaaaccttatcaatagtgtcttgtttggcctgttcaataatgtaaaataaatcatcaagcagagtctttgaaaatatcctgcataaattttcatgaacatattgtaataatataaactgctacccacagcaattacagcatgggaccaaaattaggctcaataaagtggaaatactgcatgctttaagtaaatatgaacaggactaagcaatcaaggtagcagggtaacacactgaaaatctgcaagcagccaagcagtttggaaaattcatcaggagtaaccgattctatagccatcgtgagtgggcagttctcttgcaagctaggataatttcactgtcgaatgcatctttctagttcttaaaactgattgtgaattttttttcaaaaccattcctcctgccataaattgtttgctatgctgtcactgtaaatctttaaccggtaacatagttctttttctaaaaaaaaaaactcatacaacataaaacattggcatcatagtcagtaatgtaccagggcagcagtgtaggaaaactaatgaggaacactatattaccatcaccaataattttctttatccccttgcaccaagtaaaaggaatgtaagatgcagtaggtgatggcatgatacatcaaaacatagtgaaagttcttggcattgtatggtgtgtgtgagaatttcttatggtggtttcggcaaactactttgttggtgaacgtataagagaagaagaaagattgcagtgaagcaataatttcattggttgactgaactaacatgtatattaacatctggagtggaaatcaaaactacatttagcatcagaaagtaattgcagttcagttgattatccacatggcagaaatgtgcattccaactctgttggaggcatcacgcacttgcattgagcttagaagttaggcatgactgtacagtagagtgcaaattccaatggtggaggtagcaaagaacatgacagtgatattacatacataccgaacaagacaaggcctggaagcgacttgggaccgggcgcaaccgaatggacgggaagcttgctgtttgcctggagaaagaagctgaggttggattgagcattgagcacatcacctgtatgtgtatgtaaggaatatgaacacaattaaaaggggggcaagcttgcttgaaaaaagaaaaaaaaaggaagagcggcacaaattgaagaagtagctagccaagaaatgaagctggggggtgacctagtatacctgaacccgagacgcaggggagagaggcgatgtggcggcggtgatgggagcagccatcgttggcgcgcgggaggacgatgacagggggcgggcggcggagagtgcgaagaagatggacaagaggagaggagatggaagaatcttattgctaagctttttgcctcgtttgtatcgacggccgtgcaacttaggatgcgcatcaccatttccggcctattttttttgtcctattccgacattatcatgggagatcccacaaaaatgggatgcaaacgaggaacactctctcttgtgatcaccatcaccactactcacccatcttcatttccaccatcagattgtgttactcacctttttttttccttctatattgtccgtgacgatcaaaaaaacaaaaattactcaaaaatagaatacatactaattacctaattattaatccatatactaattaatatgatctaattttattagaattggataatctaccggagtcctgttatccagaagattataatgtttgaaggcatatattccttccattcaatatttctttttccccaataacatcaaagatacacaatgacatagctcctttgaaatttggagacccgtgtgaaatcatagccgagccgtaaacttaaatgataaaataataataatttacattagtccatggttattttatagctccttcctagtattggattacaccttttattttctctatggttttaccttttcacaaccagagtgacatttttctgatccaatttttagaaaacaaatggcttgaaagttgaatattatatacatgatgaaaataataaaattggaatttaggaaatgaaattacattataagaacaaagttcacgtttacctgatgagatgatggccgatagaatgagactatataagaacttaatcatgcaggtggtgagagcctatggctatagtagtgcaacctcaccttcatacgaccggtggcaggcgcgaggctgcaaggtgtgaaccaacattgcagagcatttcggtcgagacaatggtgagctagtagtccagtcaaacgtcaagattcgagaaaagaaagcaaaacgatgttgggcgaatactccatgactctcacgcctacttgcgccatgggccgagcagcctagaagcgcttgatcgacctaactacttgggtcttgggcctcccgtgcacgatggtgtttggggaccctagatattgggattgtgaacagccgctcagctcgattccctgggacggtcctgcacgtacacagttatgagtatgtcctattaatacatgtttaaatattttgactccattagctaaagtttactcttttatcaattctattagttttagttaaaattaggaaatggtactttacttgtgataataagcgacaacccattattaaacaaagtgagaaaaatgtttgttatatctctagagcctagactatgttggaggcaattttttatagagtggtgtattttgtaatgatggctaactaataattggaagtctatggtttttaattttagtttcctttttttaaaaaaataaattgattagttctctgtaggcatgaaaaacaaccaaactaaaattgaaaactctacttgtttaactatggtccttgaaaggtattgaatgaacagtgttccttaccttaaggtatatatgggtgtatataggagtatcttacaatagacatattgcactttacgtcgacacaaactaactccaattctcaagtaaaaaaaactcatttaccaatgacataggatagtttaaaagttatcaatccttccacaagaatatcttaacatggttgaccggcttccatactacttagtgagtagtaaactcaacatatttgttcccatcatcctaacttttagcggtaccaggtaaataagcacaaaataaagaaaaatgatcatgtcatcaatttctctaagacattttcctatacctctaatacatgctctagtactgttataattgatatgttgtttggctacgtcttcttaatatacggtgtcatttgtattcttctgcacgtttttgttgtcctattagtcccttcccgcctatatattatttatctttgagtagaagaacatgctctactatgcatttaataggtgctattttcgccaagtataattaaatacgttctagttttgtattaaatagtatgtcagacgattttgccgctcttgcatgcacgctacgtatctactatagtcttatcatcagtgtataagtgacccattttactgctgttgcatgcacaacttatataacaaacaactaattggatttatttatagtgtatataaaactaaaaatatctgtatgaaagttttgattggaaaaaaaaacaatactaatacgaatggatggagaatacaagtggtggtattggaggtggcaggcagcagagcacacaggatgggggtgttgcgggcgcagaagatccgtagatagataggcctcccctcattttcaaccctcggaagggaagcctcctttgtttttttttttcccttcttgttcatttctctcttgctccggctcgcctcgcatcgcctcttcctcctcttccctcatcgcgttcgcgtttccatccccatctccatctcctcctcctcgccgcattcgcatctccctcctctcgccgccgccgccaccgccaccgccgccgctcccttcctgccattaccgcccgtgcccctcacccccctttgcccctcgatctctcccccctagggtagggtaggggcttgcctccgattccgtacggacacaccctacctagggtagggtaggggtaggggtagggttgatagagagaggttccgggatgacggccggcgagggctgcgcggcccgacgcgggtgatccgctctcacgcggggagcccctctcgcgcgcgcttgcttcacgtgggggatcccgtcgcggctatccctcctctcctctcttcttcccccttctagtctagtttagggttttctatctatccatctagattttgatcttcccctcctcgctgcttcccctcgcccttctgacctggcgcagatgttttcccacggcgctgattccgcccacgacgccggcgccgtcagcaccggtgcctccggcgtccccacgcgcttcgtctggccctacggtggcaagagggtctacctcaccggctcctttaccaggtttgcatctcttcttcttcttcttcttcttctttttttaccttatcttctaataaatggagtatatcctataccatacctatcttattattaccactctttaccttccacttgtgctactcttgtttatctcccaccctaccctagcgatcagactgctgatttgggaatacttcaaaacctcttcaactgtactagctctagcgcgccatgtagcttgcgccccatcgcatgccgtgcccttgtttcatttcatttcatccaactatactgcattgatacaattcctgctttatatttactatgtcactgtgtcgtatgtgcatacaccagttgattccattcttttgttttctcccctgtatatggtggatatgctatcatcatgatttatttacttgctatgtgcccttgccttcgtttaggacgattataaaccatgcatacgctgacacgcttctaaagaaaagttaacacgactcctttttaattgcacatggccttcatattcttttacgtggatcggttaaattttttacatagttttaacactagttagctttacgctatgtatataggccatcttacaactttctgtgttgaatttttattttggagactaaataagaaagtaataatatgtgttagttctaacgtgtattgaaagaacttcaggcattattagtaaaaaatatggtgtaaagctggcgaggggtggcagattcactgctaccatcatttgcccaatattaaaagttgctgtgacgtgtataatgcattctctggtcaacatatacatgatgtctcctgacgtcatgcactatagggtcctcgcatggcatgctggcttaggtattagcttggatacgtttaaacatgaatttttcagtatgttggcttaggtattagcttggatacgtttaaacatgaatttttcagttttatttcctgttaaatacatgccatgtgttctttttacacacctaatggccctaatttttcttaggtggacagaacatttgccaatgtctcctgttgaaggttgtcccaccgtttttcaggccatatgcagtttgtcccctgggattcatcaggtgccctttttatcccaaagtttatcatagttgtcttagactagctttgctacccaataaattatgttcttgtgatgcaacatctaatgtgtgaacattcttttaaatcattgatattcagtacaagttttgtgtggatggggaatggcggcacgatgagcggcaacctaccataacaggagactatggtgtggttaacactttatgcttgactagggactttgaccagataaatacaatattgagccctagtacacctggaagtaggatgaacatggatgtggacaacgacaattttcaacgtactgtaagtgccacttatcttgttttgaaatttgaaaatacttgataggatagctgctattttcacagttgcgagcaaacagtgacactgtggtatacttgttgccgcaatttatctctgggttgataataatgtaggggtagtatgcttctgaagcataccatgttgggcagatacaataatacaacacactttaatagcattacaaaggtcacacaaattggaaaataacatctagccccatgccccatctgtcagcgcatttgatgctacctgcgaatttatacatcttttcggtgttactgagcaaagtgtgatcattgaatgctgggagaaggggtggagttgtaattatcagcacctgtgtgcaaaatacaaatgttctctcctctattggaaaatttatttataggaaagcgatacaagctgagtagctgatacatttatttttatcttcactaaaaagttcatgtgtgtgatacatttatttttatcttcactaaaaagttcatgtgtgtgatacatttctttttatcttcactaaaaagttcacgtgtgtgatacatttctttttatcttcactaaaaagttcatgtgtgtgatacatttatttttatcttcactacaatgttcatgtgtgtgatacatttctttttatcttcactaaaaagttcatgtgtgtgatacatttatttttatcttcactaaaatgttcgtgtgcgcaatacatttctttttatcttcactaacaaggtcatgtgtgtttataatgcttcctatttgtttagttttgccttttgcttttttcacctttctttctagaagctaaatataatataaacaacttttcttgttttcttcaagcaggtttctttgtctgatggcattattcaggaaggtcctcagagaatttcagaggcagctatacagatctctaggtgtcgtgtagcggattttctgaatggacaaactgggtatgatttactcccagattctggcaaggtatggaaaatgagctcgtcttgtatgaattttagtgctctaatggttattcttattacattatatttacaattcaggtcattgctctagacgttaatttgcctgtgaagcaatcttttcatattcttcatgaacaggtgactatgccttcttctgctagtttccctccaatctttcattcttcttctgctctgtagcctgtttccctccaatctttcattagttgttctgacattgaactagtgatattttgctttgatctgtaaatatagtggaataggtacatacctttttagtaaatatgttggcctgttgttgcgtacaatgtttggtttcattggcagcttcaattcatctgagattgcatgaaaatggaaacactgcagcctcatgccttaaaagttgcagctacttcacctacttcacacttcttgtacaacccaatgttgcatccttcctcttgtacacatcacctagaatgcatgtggtcaacctttaaaagcttgaaagagcactatatatgtaaaaacattcactttaatttattaatcgatacatcatcaatggggtctaatttttgttaagatttgattagagcaagtaattgtcaagggtgatgattgatgtgtcagacatccaatacaacaattagaagaggttggaggaagtaggttctattctgtttgcactccacaatttccatataggttataagaaagttcagctctgtgctttcttagctgccatcttgattctgatttaattatttttggcatcttgatataactggaaatttcatagtttctttaaccatatatattgaagtacaagaaatattggctggttttgggaacatacattaaataaatagtgtaccttgcagggaattcctgtggcacctctatgggattcattcaggggccagtttgttggccttttgagcccactggattttatactcatattgagagaggtaatttattctgtcacttactgtttggtgttagtattctttaattatttttttatgtgtcattgttgttctctattgtatattttttattgttacaagtgatggtttaatgttcatttcaaatatgctgccacttttagtggccctgcaaaacgaaattgcgcaattcttgttttttttttttaaaaaaatctgaagcagtgtaatatcattctttgacagtattaagttattgacctagaagcttatttcacatgaattataaagacgactggttcattaatggaatgtgggagtctatgcatttgaacaatgtacctgcttgtaatcccgattctgctgtatcacttagtaaccatgcatctcatggaactttgtttgggtgaccacaagaagttcagccaagatagtgatcatgttgaactgtttttcccttaattggaagtgttcagttagtagaacctccaaaaatttgaaatcgtatcttttggaaggtggactctagaaaatagaaataaatatgctagtagtagcgactgcatcatgatactttatttttatgctgtttgaattgtttctgcttccaggtaaaggattattaatcctgaccatgtgatttgttacttgaaacaatttgtgagcatattccaacagagtagcatttaatatcttgtttatattgcagctggaaactcatggctccaatctgacagaagagcagcttgaaacacatactatatctgcgtggaaggaggccaagcgtcaaacttatgccagaaacgagggttcttggagggcaaatcaccatttagttcatgtgagttgtccactgtgtttgtgaaccaattgcaaatctgtatgcactcaccacaaattgagactgctgccatcaacttctatctatatttactggccaaattacactccagtgaattttagaattcatgtattgcattctaaggataatattttaccctttgatttatttgcatttgacaaattgttgtcaacaattgttgtgtgagtaccacataacagtttttggcacaccatgacacacatttttgtcataacattttttggcacactatgacacattttactttttgtgttacaactaagttatctactggatgctgaaatatattttgcttaattagctttaattgccatgctcaagtgagttacttagtgaactgcaatttgtttggtgtgaaatttcatcgaaccccttgcatcaactgttccttttcatttccatcctagtattttataacatgcttagttttataatgatcatgtgtctcatgcacttatgctggagtgaatctattgtttaggccaccccttatgaatccctgagggaaattgctatgaagatactgcaaaacggtgtttctaccgttccaattatgttttcctcatcaccagatggctcatatccacaattgttgcatcttgcttccctttctggaattttgaaatgtaagtgtttctatgtatttgcatgaaaagtgtgctatacacaaacatattacatgatagcttaacaacatttcattttcaggtatttgtagatattttaaaaattctcaaggtaatttacctattttgagccaacctgtatgcacaattcctctgggtacctgggttccaaaaattggtgatcctaatggccgtccattggctatgttgcggcctaacacatctcttagcgctgccctgaatttgctggttcaaggtatgttatctgtctgttttaccataaccaatgcctgggaaagtacttgcatttctgtttcttggtgcaattactgaagtttaatactaattccactgagatctcttacagctttcgattatttacgctatcttgttgccaaattaatgtcttattacaattactctgtactctaattgtttcattcagctggtgtgagctcaataccaattgtggatgacaatgactcactgcttgacacatattccagaaggtgcccatttgatactcaccattctttgtgtagtcatatactattctttggtccatgtattcattgtgttttttccattatgtagtgacatcacagctcttgcaaaagacaaggtgtacacacacattcgcctagatgagatgaccattcatcaggtatgctagtaaatatttaatgcgtcttgatttagtttgtgtctggaattttagctgggatacagttgtacaataatttttgcagagtttcttttggtcttgaagactggttaacttagaaaataataactttactgatttatgtatatgatagggaaatctgtatcgatacctgcatcacacatatatactatgaggacatgcctttgtggttctggcatttattagccctgtgtctttttgcacgcagagcatggagcatgcacacacatctaaaacaaaggctgtaggctgtagtttgatgtgttttgtccatttatcactcttactttccataccggtcaaacaaacatatactataatagaataagtagtgcaatgctgtttaaagcaggctttctcgtgaatttgtgtatatgttatccatcgagctggtgtgatttttggtgtgaacctactcatttttgttgttatgttcaggctctgcagcttggacaggatgcaaattcgccctttggattctttaacgggcaaagatgtcagatgtgtctccggtctgacactttgttgaaagtgatggagcgattagctaatcctggtaattatctgtgcctagatatgcttcctgaaagcaacttttcgggttcaacttactaatattttttttttgcattttatattgttggtaggggtgcgccgtgttttcattgtggaagctggtagcaaacgtgtggagggcataatatcactgagtgatattttcaagttcttgctgagctaagtgaaaatgcccgagccatctgtgttttgttctcacaactgccggagttaacaatagcagaaaaaaattgtgaatctccaacatcgatctctctggcttttggatcagacaggtgtcttttcccgataatggccaaccagagtctgtaaagtcttttttttttcccttgccccttcgttaccaaaatgtctggtgatttttatttattggattgttttgctgcttgctcggtttctgagccccccaaggagttagtagctctgttgaaagggtgggatgggcgcttagagacatattttagcatgaatcatcatcacagggaagtaagaattgaaggaaagaggggatgctctgaagcaagaaggatgaattcaatgtgttgtttttgctcaacaaccgtttttttggcgggcagtgttgcaaccatgaaaggagaaattacagtcggctccttgcttgttagacaaaaaaaaaaaagaaaaaaaagaagagaaaaactattggatatctgatgatgtagtgactgagaagcaggagtggagttgtgtaaaacctgtaccacctgatttttatgtctaaaccgcagcttactcattttccttgtctatgattcttgcttgcttgtgtagtgaatagtagtttttcttgtctggtatctctctctggtagcggcgccgacgtgcggaggctgtttgtacaagttgagccgcatgcaatgcatgttgaggagcaactggaaatcgatttggaacttcattgatgcgtgcaggtgaaggtgaaggtgaaggtgcaggtgcagcgtgcggtgcgtccttggtccctgtcgagtaacggcgacgggcttggcgtcgagcggaaagatctagagagggtgggttacgtcgacagacactggataagatcaatccacatcgccacattactccgcccttttagacgcttgtctgctgctgctcatcagtagttcatcagtagtagtggtaggggagataattcgtcgttcgttttgtgcatccatccagaattcgttccagatccagccagccagccatctcaagcttctctcttctcttgttattaagagcaagcaaacagtagtctagcgaagcgagactgcgagagcagagcattgttcttcttctctagctattagtggtggggaataatggctcccgccaccaccgcagcaatggccctcgcgccgcctccttcccatcaccatcaccatcaccatgtcaagcagctgcagctccctccgtctgtctccgtctccgtgcccctccgctccggtttccttggccgcgcactgcctgctgctgcccacccacagccgctgctcgccgccgagagccgccgcagcagcgccgtgtccgtgcggatgtcgtgggacgggcccctctcctcggtccgcctcattatgcagggccgcaacgtcaaggttctcctctcctactgctaccactagtttgcttccctggaatttccttcgtttcatattataaggttttctagcattactcatattcacatatatatatatatgataatattctagattcattatcatatatatgattataggtaatgctagaaaatcttataacctgaaacagagggagtatatataattcggtaatggaactagagtatttgttttattaattggacctttatgaaatactagtagaattcaacgaaactacattcttctttattggttatattagtagtaatttgcttcactagaattctattttatactagagagattaaaaattattacaaaactaactgtatacccgttgcaacggaatagtaatatggacctattacttattactacctccatattttaatgtatgacgccgttcactttttgtccaacgtttgaccattcgtcttattaaaaaaaattatgtatctattatttattttattatgacttgattcgtcatcaaatattttttaagcatgacataaacattttcatatttgcaaaaaaaaaaaacgaatggtcaaatgttagtcgaaaagtcaatggtgtcatacattaaaatacggagggattatatgggatagctacagtagcagagtcatgataaagtagtaatgtgttgggaggagcggtagagcgttgtgtggaaaaataaagatgggaatggaatggaatgaaaagcgtacgtgcgtggcgtggcggtgcagctgaatgagaaggtgaaggagcacatcgaggagaaggcggggagagcagtggcgaagcacagccagcttgtgaaggaggtggacgtgcgcctctccgcccgcggtggcgagctcagccgaggtcccaagatttgcaggtgcgagatcactctcttcaccaagcgccacggcgtcatccgcgccgaggaggacgccgagtccacctacgccagcatcgacctcgcctcctccatcatcaagaggaagctcaggaagatcaaggagaaggagaccgacgtccgccacctcaaggggaccaagccccccgtctccgactggccgccatcattgctcgacaacaacgacgacgacgcccaggcccagctcaaggatctggaggaggccgtcggcgccgaggacgaggacacggtgctcaccaaggtctgcagtctgatgcatgatcaatgcatataaatcaaatcattcatgaaccaaattaatgcaactgtgaatgcaggtggtgcgcaccaaggtgttcgagatgccgccgctgtcggtggaggaggcgatggagcagctagtgaatgtggaccacaacttctacgccttcagagacgagaagaccggggagatgaacgtcctgtacaagaggaaggaaggaggcttcggtctcatcgtccccaagggagacggtcatctccacaaggagaccatccccaactctgaccaccaccacccctcccttgctgcctagcctctacacctcctgcatcaccatcctcatttgctaattatttctatgcttgcccaagagtctctaaatattactagtattaattaatccaagtgatgagagaggtctttgattttgtctccgtgtacatcgatcgatcgactcttgactactctgtttaaccaactgttttcgatatatttatattattaatgatttttccaaggtttttactctgctttatttctggaagctgcatgtatagcttgtgcttttgctgtattattgcaaattttaaaaaatatatcctacatcttagccactcgatcgagaaacaactgaggaagtccatttgtacctgtttttgaagataggagaaacgttatattcagtttttactgttgacagagttgattcgatccaaatcgaagaggtgaggaatgtacaatagacttattcatgggtgtgtaagttaataaataggaataagttcaccagaggtcccttaacttaaccgcgagatttttcgaggtcccttaaccacaaaaccagaaatgtgtacctctaaactcactgaaaccgttcaaaggaggtcccatagcagtatttttgcccggttttggtgacgtggcattctagtcagcaaaagaaattaaaaaaattacatgggacccacatgtcatcagctgcacatttttttcttctctcttcttctttctctctcctctcttcaccggcagcgggcggcgatgggtgagcacgggatgcgggcggcatgcggagagccagcggagtgggtggcgaagctggatccgcatgtgctgctggcgccgccgccgcggcagatgaaacaactaaccgaccatcgctgcttccaggggcggagctagtatatattagggggggtgcccaggaacccggttaagaaaattttttagctataccttatctatttttaccatgtatgcacccccctcaatgtaaacttaggcacccgcataagcttaaactcgatctaaagtagagtaaattaagcaagtggcaccaccctccatttcgctctagctctgcccctggctgctccgcctgtctgctacgcccgtcgaccgctcgccgccgcgctcgcccgcccccacccccgccgatgggagcgaggcggccggccgcgccgacgtgagaggggcagaggcgacggtggcggcgctgacgggttccttcccctgtcgctggtcgctgaccggtcgggggacgacattgacgccgtgttcaaccccgaatggcgccgtacgattctactgcttgctatatagctcaacgattat

SEQ ID NO: 70477 - DNA, 504 bp, Oryza sativa
attgatttgttggtttccttgatgtaaaaagcttccatccgctcgcattacctttgttccttttgtcatgcatgatcaaggtctgtatatctcataataatctggtagatagatgataccagtgataataacaaattaagtaattaatatctgactcgattttcttaatttctctcttgatcagaagcagcagtactgatcagttaagctcatatgagcttgaatcactccaatcagttgaaagtcagctggcagctgctgctcctccgacattaagcccccatctgcaggctcatcaactcagcacggtgctaatgatgcaggagctagggttccaatggagcagctgcgctgcgccagcagatcaacatagtattgcaagctccacgaataataatagtaatgtgatgatgaacgaggaggagctacggccacgtcctgatcaatccctaatcagcaatccaaggtcatgcagcgccaccacgcttttcctccgccgcatct

SEQ ID NO: 70478 - DNA, 716 bp, Oryza sativa
ttcctgcaccaatgatgagagttgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcaaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagcccgttgcccatgctggcttgtggttggcacggttaatgtttcacaaccgaaactcgtgaaccggtccttaattgtcatgagcacgaccaacaaaaccatgtgctcacaacccaccattaccaggttttagttggcacattaattaattaactaatcacgattgaccatcgtgaactatcatgaaaccatcatgaaatattagtgagtcattagttatcccgaatgtgtgctaatgtttctaagcagggctaagcaattatatctaatatctagttgaaccaatataaataaagctcaactagtcaaattgtaataacccaaggtatcaaggaataaggtaatcaagtacaaaagggccataac

SEQ ID NO: 70479 - DNA, 28161 bp, Oryza sativa
ctccccctccgtgtccggtggcagcagcgcgatcgtgcccgaccgccccagcaccgccaccacccatccccgcgtggtgggcggcgccgacagcaccaccttcgccaccgggaacacggggggccgagggatgcccacggattcgccggacgtgacgctgcacagggcgatctcgcggtcgtcgtccaaggccatggcgagccaaccgcccatgtggccgcagcagcgggcggcgctgaggcgggcggggagggcgaaggggaggatctcggcgcggcggaggctgaagaaggcgagaggtccccgggggggcccagggcggcggaggaggaggcgcggggcctcgaaggcgaggtcggaggggaaggaggcacgggcgcaggtgcgccaggaggagcagacgaggcggacggtgacacgctccagggggctcatcagcttcatgattccttccaggagctccggcgggagatccgcccaccccacggacaaatccgcccgccgccggggatccatgtccgccccgccccctgcttctctctcttcccccctcccccttttcttcctctttcttcttcttcttttttaattatttttctgtcaatggccagtttatatttgtccttacacttcctccctaaaataactttgagtacctgtttgaaaaaaaaaacctaaatattttgcggggttcttgaccgttggatcactttgagattcgtgaagtgcccaaccctaaccactcattttctcgctcctcactccgaacgccgccacctctccgcccgatacccctcctccccaacaactaacatacaaatattgttatatgcctcaccaattatagaatacgccaacagtaccagcggggttcatcagacctcaccctccctccctatcctatttctcaagctgatgatggtgaggtgtccccatcccgttgtctttgacgactcctcaccatcaaagacaccactgcctcctagctcgttgtgctctgagctatcaacattggtcgttccaccgcccataaattactatcaagttcttgtattttacaaccatccttctaaaacttgaggaactctctcctctttcttctaccccgcctcaaccttaaccctatatcttaactggactgggcctcctaagatcaaagagctcaccggaatgtgaagaaaatgtcatggtgtacaaatctcagattgaattggatggtccaaaatatgtaagatgggactttgagtttctattgtagggagattaataattttggaaaactattgaccttattactttctctcttttatgttgtccccacggcacacaggacaagatctctctttgggttgtttaatttgattcatggttaaaatttgtcaatccaactacaatagcaaaagtacgagtaataacaaaaagcttgacgcaaatttaattggcatatgaatacgttagctccacgccttgagaaaaatattttctttttttaaaaaaaaatttctgcaacatcatcaagatcactgtttatttcttaaaatatttaatttgtaaataatctataacaataatttgttcaataatctaaatcaaattattgcctaaaaagtatgagtaagcacgatcatggaattcaatcatgcagacacggaaatacatttacatataacatgagacgtggccatattaggcatcaaaccaaacatcctcttatttttggcagccagggaagagacaaggtcatattaaggattaacaaacaatttggttttgtggattcataatgtaatttgatatttgatgagtagcaacgattatgagttgttggaggaagaaaccatgggagaatatatatgtttttattgggaataggatgaaaaggaatgatcggtcatctttggaatatagagagatgtttgatgaaatcaatgggaaattgcttttcctagaaagagtgagatgttcctcgctagggatttcatcttgggaataagttcactttgattcccttaactagtgatcgaatctgattcatatccctgaaccacaattacggatatctcgaccccccaactattaaaaccggtgcaatttaactcccttggcggttttagagggcggttttgctgacgtggtgtctacgtggcaatattgacctggtcttcgtccccattcggcgctgacgtgtcgattaggtggcattagaattaaaaaatatgtttgggggcccatttgtcattaaaaaaatatgtgtgggacccatagacatgtggccccacatctcatgctctctcttcttccttcttcctcccccctctctttctcttccccatcggcgagcgtgggacaggggccgtcggcaggcagtggtggtggcgggcgggagggtgggcgagcgagggtcgggtcccctttgcgagctcgcgacttcgattagacctctttcagtccccgatcaaccaagccaccaccacagtcgagcttctctcctcccagaaatcccaatccacacctcgctggcgcccaatcaccaccactgccgaaaccccccaaatccggtctctgccgatcaccattgcggagctcgagctgtgacttgccgctgcaatccatcccctccgtttcttcccatttctcccctccctctccttcttttccctcttcctcttccacggcagagaggccaggactcggggagggcggcagtggcggatgaggtccgcgcggccctcgcacgctgtgtccagggcgggctcagggtgggagcaccgaaaggcagtgacgaggagtgacctcccccatctcttttgtggtcggggcggctaggctatcagaggcagcgagggagcggaaggcacagaaggacgaaggcggtggctgccgctcttccaaacgacgttctaccactgctgttgccgccgttttgcttctccgactcgatgcttcttcgtcttctccaacgaaggcggctacacgaagccgggaaggttgtgacggcgacaagaggttgggagggcggtgacggcaaagtgggaacaacgccagccgactcctcttttcctcaaggagtcagctccttgttcccgccatggcatcctcgatggcgaccaccctctacgtcaattcggtcgtcgacgatgacgtttagtcgcacagctccgccgccaagctgtgccgctcgtcgccggctaccgccatgaccccatccatccatctgacgccgcgaacacagccgtgtcgttcggcccgaccaccgcgggtgccacacattgagctcatctggggcgggagcggcgacagctggggaatcgagccgctgccatttccgcatctccgtcgcgccttccgtcgtctccgccgctcaccgtcgtctctagccctcgcctcccaccgcgggaaagagagagagtgagaggaaagagagagaagggagcgacgaggagagggaggaggaagatcagagagcatgagatgtggggcccacatgttagtgggtcccacacatatttttgtgaatgacaaataggccccacacataaattttaattctaatgccacctacgcgccgcgttagcaccatgtggaacgaagaacaggtcaataccgccacgtaggcgccatgtcagcgaaaccgccctccaaaaccaccgagggagtcaaattacactgattttaatagttgggggttcgagatatccggtattgtggttgaggggtacgaattagattcggtcactagttaagggagtcaaaatgaactttctcctttcatcttgtggaggaaagcaatatatatggcctagtggatgaaaagatggctcattggcccattgggaagggaaggcaggagcccatacatattccaatttttctgggctgtcagtgcataaggttagtccaataaggaataagtctatttgacccccttagctcttgctcctgattggatcacctccctcaagcgtaataaaccaggtataatgcctcccctttaattaacgtattatagtcatctttggagttatactagcaaatatgcccgtgcgttgcaacgggtgaaaaaacgtaatgataatatacgtttttcatgcataaccacgtcgataacaatcagaaaattagaactacgaaactttattttctagcgcgttttcttttgtgcttttttctgacatttttccctcacgtgtttttttaaaccgtttttattttctcgcgcattttttccttttttaatatactgtagaaacttctctttttatagttagattagattagattagagataaagaagatatataaatggactaaaaacgacgaatataaatttgacttttttcctccgcgcttttttccgtccttttaattttttttctcgtgcatttcttttacgaagggtttttttcaccactttcacatagtgtcaaacctttctagatataataggattcgattttttttaccgcatcgcgtataattcctttttctttagaaacagacaattttttcgcccttttttatcgcgtcaacggagtcggaatcgttttgattttttccctttttttggatcggacagatttttttttgcccggtttatttcgcccgatcgattttttttaccgcgtcacatataattccttttactttggatttttttcgccctttttttaccgcgtcgacggagtcagattcgttttgattttttttctccctttactttggaattttttcgccctgttttcaccacgtcgacggagtcggattcgttttgatttttcccctttttggctttttttggataggacagatttgtttttttttcgccccgtttttttatcggacttttatcttttttttcgcctggtttttttattttttttaccgcgtcacatataattcctttttctttatcggaaagttttttttcgcctttttttaccgcgtcgatggagtcagattcttttcagctttttccttttcttttatcggacaattttttttttcgcccatttttttttctcctgtttttttcggatcggactatttttttcttttttcgcccggtcgatttttttaccacgatatatataattcctttttctttggaataggacagttttctttttatttttttaaactctttttaccgcgtcgatgtagtcggattcgtttcgatttttttcctttttttgctttcttttttgtcggacagatttgttttttttccacccggtttttttccgcccaggtttttttatcggacttttctttttttttttgctccacgatacatataattcatttttctttggaataggatagttttctttttatttttttaaactctttttaccgcgtcgatgtagtcggattcgtttcggtattttttccttttttttcctttttttttgtcggacatatttgttttttttccgcccggttttttttcactaggtttttttatcggacttttcttttttttttcgctcggtttttttctcccgttttttgacggacgacagaagcacctagagaagtgttttttttcttttctccaatccaatacagatcggatctcttccagggaaatcagattttttttctccagggaatcggactcttttttttcgctttttttattcattaaacggtttgtctctcggacttttttttcccttttaagggatcgggtgtttttttgccagggacaggtgtttttttcgcccggtttttttttcacttttttttggatcggacttttttttcgtccggtttttatgatcggacaaacttggttttttctgcccggtttttttttcacccggtttttttgacggacgatggaagcacctcttattttttaagtagtatatagtagagtagtagataataaccacaacatcatgcgttcttatatatgggcttgtttgattgcatccatttaaaaatactccctagcaagccaaaattttagcaaagtaagagttttgacaatgttacttcaaagcttttagttagctttgccaacatattggaattatgttcttcttcttcttcttcttcttcttcttcttcttcttcttcttcttcttcttttgttttttgcaacaaaccaaaatgaacaccgaagtcagtcgccattagcatttttttttggtatggtttcatacttttattgagtgttaaatcaaacacacgatatgatatatctcatcactagtctcatttgttttttcgagtataaataattataaatgtttacatggtaaacaaggttttttttcatgaaataatgaatcgtaagagaaataatcaagtgaatgaaagagatgatgaaggagcatgcatgcaggaatcctatgtataggaaggtaggaggacatgcatgcatctttttggttggcagcaggcagaggcaggcatggcattggcatcggcatctagagccgcatggatgatccagatccagtccagagaaagaaaaaaccaaaaggaaaaaggaaggtcaatgccatcctcagctgtgttcaatccgtacctccccggccaccaccggccaaaccaaaacataggccagccacccgcacccacagacccagaccaagcttttgcgtgcgtggtacgggtaaacgacggttactactaaatactattatctttaatttaagaaaactattttgtgtaactaatgggtaattaactgcacaacatatagaaggtatgataatttgtgtgattaactagttttagatgggtacccaacgcgttgtttgcgggagaagtgtgtgataaaatagtatatatgagttgtaaaattttatttcttggttactatatatttttttaccttaatcaattatccaaaggttataaatgattaggttgtatggtgtgacttttggagagaaaatatacaatttgcatttttgatgaatcattcaaaggctaaaaacaattaaggtgatgcatatcataactacacttagggtgagtttgagagataggggattgagaagattggaaagatacgcaaaacgagatgagccattagcgcatgattaattgagtataaactattttaaatttcaaaaatggattaatatgattttttaaaacaactttcctatagaaaatttttgcaaaaaacgcatcgtttagtagtttgggaagcgtgcgcgcggaaaacgagttgttttctcaccctatctcacacaaacgaacacagccttagtgaagatcaactttatagatatatagatttcttacatactatacgattttctattgtgtgcttatatattataccttgatcaaatatccaaaaggttataaatgattgggttgtatagtgtggcttttggggaaaaaagatgcaatttgtacccttgatgaatggtccaaagactaaaaatagttgaagtgatatggcttcatgaaagaggagggaattagaattagcattttctttacagagggaaaaatagtaaccttatctcctcctcctccctcctcattcacgatgtgcttgggatgagaaagcttgtgctgatgccgcgtgctccgcttcccacacaacaccttggccttgccggtgttggtgatgcctactagaccggcctcctcccgcccttccccctttgtccgatgttcttcttctccaaatacaatgatgtgaagcccctaccctgtcggtccttcctcatcgccggtggctcctatcataaccagtctcatttgctgtcgtctttcgatgccaaccctgcctgccaccacctctagccccatggctccgacagtgccaccgctgtcctccattgctcgctggccactacccaccactgctctgaccgtcgccactactgcccctctaagcctagggaaaacccccttcccctctttcttaaccccccctcccaccttaaccaccctcttgaaacctaatccaatccatggcaatcatcaaaagggcatcagagaagaagaagagctcacaattaatcactgaaagaatattgctatcatttttttcaaacgtgcaaaagccttgcacatcgatatattaatagggggaaaggagattttacaaccacgactagctgatgcaggtcatggggggttacaggagagatggcgggcacactagattaactaggaaagacaaccaaattcctgaaaacaaaaaaagagaaagagcttgtatctaaacgccaagaagaacttttaggggactagataacgccacaacccaaagctttccttattgaacgatacgatgaacaccaccatctccaccatgaaaagtatctccttgaaaacacgagcatttcttttcaaccacaagtgccatgtaacaaggaggacaagggagtcgaaccctttcctgttgtaatcccctgcagctgcgggcaagaatactcccaccaaacctggttgctattgcaattatcatcgttgttgattagttaccccttcttccttacccctccctttattcatagcaggtatcggagaagaggaagagcttccaatcactgaaagaactacccctggctgttggatgcccagacaagcgatttcaatcacctaaaggctagcaaaaatacccttagttgcttcctctcatgcatcccaatggccatgcatgggcacaatcacacggctattaaacaatgtggtgcttgctaatgcagtaaagccagctgctggtgcttgttgcacagggccagaaaagcaaagctacagaggccatggatctccgggccatatggtctccactggcagttgctctgaccaaaagccactgttgcatgcatgccaaacacagctaccgcagtactccactgcactgctctgcaggacgacctgacccagatctgaccatgcattgccttgcatatagcagcacatagatccatcatatccagagatgagaccacacgatgagactacacgacgacgctgcctatttcccatccaaaacaaacaaatctagtagatgaaatataatattctctctatttataaaaaatccaattctaaaaattaatctaaaattagaccaataaagtatatatgctagcattatgaatctgaacccatactagttttgattatttttccgcaaacttaaccatctcaagcgtaaccccatactccctccatcttagaatgggtccaattttttatcgtcttctttttatcctaaaattattttgaagtattcactgcatcagaatttgtaaaatagaggataaatatattgataatagaaaaagagagcaataactacattgggattaataaagtgggattcccagactttttaattttatattgatatgcagggcagaagaaaaattaacttattttgagattgagaaagcagggtaagtattttaaaagttatacttgtctctatcagttactcctatctcttaattagtatttaaatttctctgtctattatcgatctgaaccacactgccctcaacaatctctcgatacaataaaacacattatgacttctttttttacattcttgatccaaccatctctcaatggataaaacacattatactttttttacatccttaatctctccaatacaatctagaaatacttacttccatcattttaaaatatacgaattttaattttatgtgttttagaaatatatttgtgaaaagagggagcagtatatatatgaatatatatactgtgttactactactctactcctaattatatcagatccatctatccattacgacggtttaacaattttcagccttaattagacgatcgatgatttggtactgccttccaccattaattccatattgttgagacctttcaaagggattgaaaccaaattaggtgcggaataaattcacatctattttggtgtaaaatgaattaatgttctcaatccaatctaatttctttctctaccggattaactgaaaatagcatagtttcagctcaaattaaccagctatatatatacgtaccattgtgttgttatatttaggtggtgttattttttaaggaagatgaagataagttaggatacgtaaaacaagaaaaatattagcgcctgactaattgagctttaattattataaagcaacttctttgggatccgtacgggaagtacatacgtatcaatttaattataatacgctatacatccgtaaagaaaacttcattctttacaggaatctgcacaagtgataacacgtgtagataaatgtgaaaactttgaggtagtagccagtagactactccatgcggtcgtcaatgcatgcatggatgatctttttgttcaggtgtcacttggtacagtgcacctagcttacctagcacctcgaagctagctaggctttctgttcagttactactacatttagcctcgaaagaaaaatcaacttttatacgctaatttagtgatgtatatgttcaaatttatatacctaaattgatctattttgagacggagggagtaaccattacacctagctaatcttctgttcaatgcgcgtattcctaaccattcattttaatttggtcaaaactattaatcatctttgtgcatcattaattcactgtaaaatacttcatgcaaaatgcaatatatattggagtatttaataaataaccaagctaggaacttaatcaaatttactatatacggctatgtatatactttatatagatatgtacttgtctttcattctagactaaaacgaaataattacgaaaatgaagcctactggtggagattaattgagtgcataattatggagaataatgtgatggtctgaaggagggcaacaatattcttcgttgagagcctgagaatgacattttgacaagtataggtacaactcacctcaccggtcaattatattgcaaccatgcattatactatatggcaccatgcgttgaataattaagctacatgttccacgaaagtgctacacatttgtctgtgaaaagtgaaaacaaccaaatattgacttttagcttagtgctatatatatactatgtgatgttcacattatttcctgatagatagttaaaagtgtgatatatatatatatatatatatatatatatatatatatatatatatatatatatatatatatatatatatatatatatatatatatatatggttaacagcacgctgtatttgctttcagaattgcaaataacaataaaaaacaactacaattaattataagtaattttcttagtgtacgtaatttattattttcaacataaaaatgttttgtttcctttgatacgctttaggttttgtcatatattgatgctacctatttcaactttgtgcccccaagcatttttagaatcctacgtccaccactaacattactttggtcacagtgcgctttctattggattttattgtgactatgaatttgcagatggttgacactggtgcgcgagtgtggtgtgcgtacggttaaatgtagactatttgaaagaacataaatccatttttcaaaataaaccaagcacctgtttgtagtgctacagtaaactcataaaagggacaaaattgaattttaatgaatgcatggactggcctgctatatattccctccatctacttttgatagtcatatttccaaatctgaaaaatttatttttgataggcatatttcaatccaacaacctatcatcttaatgactttctcagaattaatgtgtgactctctattcttccacacaagattggctgtgtcagggttacgggttaggcataccctttacctttcgatatacgttacatatcggcatggcatacccacgcgcatacggatacttcccgcgtacactaaggaaatccttcacgaagtctacgaatgggaagagtcttactcggataacactaggtcatcaatgtatcgtatagggtctgttatctccgagttctacttggaaaccgtctaacctgcgatataaaagggactccccggggaggacctagggcattgaatctcagagccaacacaaccctcacagcctacgaagtcggagcccgcaaggagccaagtcgccggggatctagtcgaaccaactcgaccacgatctcgccggatccgtcaagttccattgttccctttgtaacctgtgttttccactatataatcccacatcaactggattagggctattacctaccaaggggtctgaaccagtataatcctcgtcttttgtctgcttgatgtcgtattacgtagatccttgtaccaacgtaccccaataccctctatatccggtctacgggtaccacccgtcgacagtggcgcgccaggtaggggcccttggtactcaaggttctactactatgtcatccagcctcgtcgacaacagcgtcaacaccaacctcagccaagtattccctgcttcaacgatgctggtgtggacccaagttagcgaaatcgtcttcccggtttacaccacgacgccgatctcaaccggtccgccaatgactggaaacgagaacgcagtggctacaaaccaaggcgactccatgtcgaaaaatcctcccgccgaggcggagaacggagtatcgacgacatccgagctcaagaaggattctaatgtggccaaaccttgtcgttccgacatgaaccgcgagccgacgaagatgacttccgaagcgacaaggtcctggtgtcctatccacaaaaccaggaaacacactttgcaagcctgctgggttttcctcaacgtccgcgctgaaatttgcgcctacaaagagcgtggaattcagcgtatttctccaactcgtgctgtctattgtcctattcacaagacaaagaatcacgacctttcaagctgcaaggtcttttccagcgccatggaagcgccatcccctaaggtccaacagtcacacatccccatctgggataaagacaaggaacgaggagcgacgccaacttcagatcgatttgttggggtaatcgatatcgatcctcacgaaccatcagtcttgcaccttcacaagcgcgcctcgggaggtattggctatcgatgatgtcggcatatcagcgtgcaccaatgcagaagcggagaatcaattgaccactccagctcagcacatcagagccgtcaacgctatactgagggaaaccccctacgatcccgttctgaacgacaatctcgcgcgttggacagaacgactacgggaatcagtgaccaacctcagtaacgcgttcgaagaggccgctgccgcagcacacccagagcagccaccaactggcgatgccaacggtgaaaaccctgaacggagggaattgcctcagcgagctacccctccacctcgtggcactggcgatctccgagatcacatcaacggccgccgagaggcacgacgcacatgagacaatgagaatcgttcccgacgtcatgtctcttcacggtgccatgataacgaagatcgaggagaccgctcaaacgaggaccgagaccgtgataaccgccacaaccaccacgatcacaacgatcgcgaacggcgggtgccaaacgatactgatcgaggacgtcgccataacgacgacgatgatggagactggcgccaagacaacagcgggagacgacgacaggattctccagatccaagccgacatcctcgtaatcgtacgccagaaccaaacgacccatcatcatcgtcatcatcctcgtcttcctcatcatcagacagacatccatgaaggacacacgatcgccgacaacccaccgcccccagcgctgggtgtagggctttcagtcgttccctacgtgatgtccgatggcctgagagattccgaccccgagcaatagagaaatacgatgggagcaccgacccagaagagttccttcaagtctactccacagtactctacgctgccggagcagacgacaacgcattggcgaattatttgccaactgcgttaaaaggctccgcacgttcatggctgatgcatcttccgccctactcaatctcttcgtgggcagacctgtggcagcagttcgtcgccaacttccaaggaacctacaagcgccacgcgatcgaagacgacctacacgcgttgacacagaacccgggtgaatccttgagggaatatgttcagcgcttcaacgagtgcagaaatacaatccccaaaatcaccgacgcttctgtaattcgtgccttcaaatccggtgttagagatcgctatactacccaggagttggcgacaagacgcatcacaaccaatcggagattgttcgagattgttgagcgatgcgcccacgcagatgatgcgctaagacgcaagaacgataagccgaagaccgggggagagaagaaatcagccactgacgcacctgagtcaagcaagaagaagaatcgcaaaaatgggaaaaggaaagctcaagcggaagtcctcgcagcagaatacgcgaaccctcccaagcgcccagacccacaaagtagcgacacaaagaaagcatggtgccccatacacaagacggacatacatgttttggaagattgctttgttttcaaaaaatcgctcgagaagcacattgcatctgaaaaaggcaaacgagtacgcgtggtcgaaaaggacgtggaggcggctccccaggaatcagactcagcatatccagaccctgacctccacgtttcacacatcttcggagattccacaacatactcctcgaagcgagagtataagaaagtggaacgcgaagtctgttcgacatggttgggggctgcacccaagatgaagtggtctgaacagaagatagagttctcggaagaagaccaccccaagaccgccgtcattccaggaatatatccgatcgtggtcgaacccactattcggaacatcaaggtcgcacgagtcctcatcgacggtggcagctcaatcaaccttcttttcaccagcactctggacgcgatgggaattccacaaagcgagttgacaccaaccgatcaaccctttcatggaattactccccaatcctcgtccagaccattgggcaagattacgttgcctgtgacttttggccaatccaacaacttccgaacagagcagatcacctttgatgtcgctgaattcgatacagcttacaacgccatcatcgggagaactgcacttgcgaagtttatggccgcatctcactacgcgtatcaagtgctcaagatgccgggaccgaagggaacaatcactattcaagggaacacaaagctggcggtgcaatgcgacaaacggagcctcgacatagttgagcaaacgcccagcccacccgccacgactgagccacccaagaaagtgagcaaaacaaacaagacgccgaaaccggacggcgcaatcaagatcgttccactctccagtgccaaccccgacaagatcgtcgagatcggggcgacactaaccgagaaataggaactcgtactcatcaccttcctccgcgacaatgctgacgtgttcgcttggcagccgtccgacatgtcgggggtccccagggagataattgagcacaaactcatggtgcgacctgatgccaagccagtaaagcaaagactgcggagatttgcaccagaccgaaaacaagccatacgagaagagctcgacaaacttctcaaagctggcttcatcaaagaagtacttcatccagagtggctagccaatccagtcatggtgcggaaggccaacggaaaatggagaatgtgcgtcgacttcaccgacctcaataaggcatgccccaaggatcacttccctcttcctcgaatagatcaactggtggactcaacagccggctgtgagctgttgagctttatcgacgcttactctggctaccaccaaatcagcatggcaaaagaggacgaagagaagacatcattcatcacgccgttcagggtattttgctatgttaagatgccgttcggactgataaccgcaggaaataccttccagcacacggtccagggcgcacttagcgaccagctcggcagcaatgtcgaggcatatgtcgacgacatcgtcgtcaagaccaaaacatttgactcattgattgacgatctgtgggaaacgttcgacaacctccgacgatatcgcctcatgctcaatccagagaagtgcacgttcggagcaccgtcgggaaagctgctcggtttcctcatctctggcagaggaatagaagcaaatcctgagaagatcaaggcaatcgagaacatgaagtcacccacaagactcaaggaagtacagaagctaaccggatgcatggcagcattgagcaggttcgtcgctaagatgggagaacgaggacaacctttcttcgctctgctgaagaagcaagacaaatttgtatggacacaggaagccgaaaaggcattcgttgcactcaagcgctacctatcaaacccccctgtacttgttgccccccaacctaatgaataattattcctctatattgccgccacgccatattccgttagcaccatcatcgttgtcgagagagagaaagtacaacgaccagtctactacgtcagcgaagctctccacgatgcaaagacaagatatccacagatccaaaagctactttacgcggtcatcatgacatcaaggaagctacgccactactttcaagcccacagagtcacagttgtctcctcctttcctctcggtgaagtcgtgagaaacaaatacgttgtcggttgcattgcgaaatgggtagtcgagctgagccagtttgatgtccactttgcgccacgaacagccatcaagtcccaggtactcgccgactttgtagccgattggactatgcctgataacaaatcagacaaccaagtcgataacgaaacgtggacaatggcgttcgatggtgcactcaacagctaaggagcaggggcaggatttatcttgacgtctccttccggagatcaattcaagcacgcaatccacctcaacttcagggcgaccaataacacagccgaatacgagggactactcgccgggataagagctgcagccgcacttggggtcaagcgactaatcgtgaaaggggactccgagctagtcacgaaccaggtgcacaaagattataaatgctctaaccccgagttatctaagtatatcacagaagtcaggaagctagggaaaaggttcgatgggatcgaagtccgacacgtctaccgcaaagacaacatcgagccagatgacctagcacgacgtgcgtccagacgagaaccgctcgagcccggcacttttctggacatcctgacgaagccatcagtgaaagaggttagcggcgaagttagcccggacacccccgacattagctcggaggccacaaaggcagaacgcgccgttgccgatatcgagaccacagacgactggcgcatcccactaatcaaattcatcaacagcgaggagctgcccaaggacgatacagaggccgagaaaataacccgtaaagcaaagatctactgtatggtcggcgacgatctatacaagaaagcgccaaacggggtacttctcaaatgcgtctcgtccgacgacggcagacacctcctccttgatatacatgaaggcatttgtgggtcacacgccgccggtcggacattggtcgggaaagcttttcgacaagggtttttctggccaaccgtccttaaagatgcatgcgacatggtccagcgatgtgaagcctgtcaattccacagtaaacacacaaagctacccgtgcaagcgctccagactatccctcttacgtggccgttctcgtgctgggggctagatatactcggaccattcccacgaggacagggtggctacccacgggggaaatcaaggctgacaacgccatcaaattcatcaaggggatattttgcagatacggactaccgcaccgcatcataaccgacaacggctcccagttcatcagcgctgacttccaggattactgcatcgggctgggagtcaagatatgcttcgcctcgttctctcaccctcaaagcaacagacaagtcgagagggcaaacgatatagtactacaagggatcaaaacccgcgtctacgacaggctcatgtcacatgacaaaaaatgggtcgaagaactcccatcagtactatgggtcgtacacaccactccgacgacgtccaactaggaaacacccttcttcctcgtgtacggctcggaggccatactccctagcgagctacgacatcagagtacacgagtacagaagcattccgatgaggaccaggaggagcaacgaaacgtcaatgtaaatctactcgaggaacatcgcgaacgagttgccattcgagcagccagctatcaacaggccctccgccgttaccacgagaagcgcatccgagcacgcatactttcgatcggcgactacgtcctccgacgggttcaaagccaagcagggcgaaacaaactctcacccaaatgggaaggaccttacacgatcacacaagtcttgcggccaggcgcattcaaaattgcagacggcgagggtcgcaagttagcaaattcttggaacattgaccaactacgtaaattctatgtatgagtcaataccatccgtacctgtaagacaccttacagtatcaataaagcctattcttaggcccatattagaatcaaagtgttcccgcccgatgatcccttaccctgatgacacctagcgttgaaacctatccttatgtccctttacgccgtcttgacaaggcctccgaggaacccaagggatcttcggctggggacgcccagagccgataaggccttgtcagatcctgtagagacgaaagaccatgtaagatctggtcatgtaagagttctcgccatgcatattaaccaagccgcgaaatcggaaattaactttccaacttcacggctgggggctaggatcagagcttattcaaccaaggcaggtcaaaggtccaagagccttatcctccgagaaaatccctcagacgacaaggctgggggctagggagagtgtacgactcaaacgactgattaaagtcgtgaactgagaacacactcttacacatgacatccggagtaagaaagatttgttaaagatagatttcttttctattttacaaaatacttcttacagtttttacacaaatccaaagctatattacacctttttcctgagatatctatcacagggtacgaagactaccaagaaggccaacgccaatccatagactggaatatcttctccgccaacggcgccatcgacctcgccaggtggtctatctctgccggagtcctccgagaacgagcaaagccctcacggagaaaatcgaggtccaggcgcgggcgatgatctcgtagacaagccaacacgtgccctccggcatatcggctcgatcgacgacattcctgcttcaaggcctcgtcgatacacttgccgacgccatcaagttgagcacaggctccgttcagccacgagatgtacccagccgcggactcctcgggatccccacgaggtactcgaagctctctacaaaccttggccatggatgtgcagcaactcttcaagtacgagttgaaccacacctcgcgacctcggagcgtttccacagcctgctttttcttcactacaaccatagttctctcgagttccgctacttcaaattttgtcttccaatattggatacgacgatcttggccagcaagagcactctcgagatctgctcagtgtgggaacgactaagtcaggctacacgcctcttccgagaacataggtgatctagtcagaggcgcaaaaagggatgaatggatcactaacctaaggaagtggtcgccatctccgtccccgaggcaagggtttggtctacattgtcgggcgatgcatgttggtcaaacgtgagagccggaataatcgccggtgactcgggttgcccatgctgctggacatcctcgtcatcaacatctctacaagggacaaaaagctttcaagatcaacatgcaagagtaagctagaataataactgctcgcacaaaggcggttaagatccagttttacacagcatatctagggagtacaagaggccccactcttcaaaaagggggagaacagattcccccaggtcaccgacttcttccatcatctccttacgcgtgttgctagccgccccctgatccaagatctcgcgcagatcgagttcaggatgcgccagctttacacacgcaaggacgtggcacgccccggtgtagatcccgttcgatgtctcctccccgatcctagccgcatgcttggaggggatctcctccatcgccgccgccagctccgcaagagaagatgtcaacgagaactcgtcgggattcgccgggatagtagacttaatgccacactccccggcgagctggtgcagaccagtataggtgacccgcaatgagccacggattttcgacagattgttcccaagctctgacatgcggtgctcgagcccctgccgttgtcgctcgttgccggccaccaactccctcatcttcttgaggtcctcacgagcctccgacaactcgtgtgccaatcggtcagcccgcttgtttgccgacgacgccgccgaccttgcctccacaatctcgtgaccgatgccgcgagcaccagcctcgaggaggcgccccatctcaacctagagctcctcccaggtgaggacggtagccggtggaccacggccagccgcgggatcgttgactgggccgcttggtgtcacctcgcggcccccgggtgcgagcatgacatccgacgaggccgcagcgggcgacgtgccggaggtccctccggacttgtcttgcccagccttcgcccgcgccgccctatgagacgggcatggttcagacaacactcgaataaaatcacagaaacttaagttcatcaacttacttctcgccaaccgtcacaaggcgttgtcgtcgtggaggcgggagagacgtgtccgaggcctgaaaaatggtcgatgcgaagtaaggcgaaattcttctggctgtacgatttgacgacaggatagcttaccgagggggttgatgccttgcgacgatgtccgctcacagaggagaacttcctcccctttgtcggaacattgccaccacttgtagtagcagcagcagcatcagacgcctccttggcgaccttctctttcagagacgccgccacctgatggtccgcgagcggctcgatgatgtcagtcagatgaagggcctacgcttaatcaagtcacgatgtgatctcggaaggaaaacgtagaatgcctatcgggtacacttacattgatggcagcatcacgttcagccgcacctttctcacaaaagggaacggggatggtactcgccgttgtcggaccactgatcatcacttggccaacacgacgttccacagctttgctgttcagacctgtgaatcgagaccaaattttgataaatcaagaggaacacgaacatgagcatgtctggataaatgcgagaaagataccccgaggagaaacccgggtcgcatcctccggtccggaataatcaaaggctggatgtgcccgagcctggagcggctggatccgcctaccaacgaagtctgcagcgacttcataccccgacaagcctcgtactcggagatcgtcgataatgtcgataaacgactggagagagggggtcaaagggggctttgcggtccaagacgaaatcttgtccggttgttctttgggaacaacgaagacagggtccgaatctttgatctgaaggtagaaccacctagtccgccatttgttgcgagaagaagggcactggaaggggatataacgcgacttcaggccatcccgaagtcggaacccgacgcaaccagacaccctgttggactccatccaacgcagctcgtagtagaagcgaaagagatcaagaaagggctctaccccaatgtaggcctcacaaagatgagaaaagatgctaaggaaggcgatagagttggggttcaaatggagaagagaaagaccgtagaagttcaaaaccaagagaagaaattcggaaggcacaaggagaaaaccgcagagaatatagtcttcgatcgcaaccatgcgacctaagacgggctggggattagtacctcctgcttccctttccatggttccgcgaccaggaagggcgccgtcttcctgaagcttcttcagtgacacactggtggaggatgatttgccgagatccatcgttgatcggagatcgccagagaaagggctcaggtcgatgaactagggtttcttgtggcagcggagaagacgaagagcgcttacaggcgggatgttttcttcacaataggcggacttcaaaatggatccccaaaattcctttaaatagacacacttccgacggtacgacttccaaggaaaggggagagatgcccgccggagatttctggatccgttacgcgcggcagttttttggacttcagtttaaattcactcgtgaccgttgggcttcacacggtgttctcgactacgtcctgtctctatggtcctcacaccgggaacgacaacagtctcgacacaacaagtcgcgaatggttacacgagttcatttaagcagaagtcgggggctactgtcagggttatgggttaggcataccctttacccttcgatatatgttacatatcggcatggcatacccacgcgcatacggatacttcccgcgtacactaaggaaatcattcacgaagtctacggatgggaagagtcttactcggacaagactgggtcatcaatgtatcgtatagggtctgttatctccgagttctacttggaaaccgcctgacctgcgatataaaagggaccccccagggaggacctggggcatcgaatctcagagccaacacgaccctcacagcctacgaagtcggagcccgcaaggagccaagtcgccggggatctagtcgaaccaactcgaccacgatctcgccggatccgtcaagttccattgttccctttgtaacttgtgttttccactatataatcccacatcaactagattatggctattacctaccaaggggtctgaaccagtataatcctcgtcttttgtctgcttgatgtcgtattacgtagattcttgtaccaacgtaccccaataccctctatatccggtctacgggtaccacccgttgacaggctgcatgtgcatcgagaaatgtaaatattaatgaatcgcttgtttacgaggaatgactagtggcatgtttaaatggatgataagtagaattacttatccttggtctatgtgccaagatgaaatatgactatcaaaagtagatagagggagtatttaattgatagtactgtgtacatataggagtttatctttttgaggggcaaggcaaaaaagggtaggatgtagagtttgatcggccaaccggcctatttaaccagtctcgttatcatggagacaacaggcactttacgctgttgctgcgcacttgatcgatatgcatttatagtttgtactcactatcttttagaacttaatatatataaatgtgtcatattatcatccactaataattatgattagagtattttaaatttcatagaaacatggcatatcattcataattttgttgtacttttaaacctcagtatataagcaatgtcaaatcatcatctccacatcatttttacattatttaaatacatacatttatcatttctataatatataacctatatttatccatatatcgtaacaagtgcgaggtatcaactagtaatttttcaacttcttgtgtcgatcaagcgagcaagtgataaattaaagagggtggaccagcatgcatatatttatataaataggaactagcatttatatttcgatgttaatgcatagcaacacagttagactggatagacattaggtaaagtcttcaaattaatgtaactttcactaaaaaaatgattttccatggcaatttcctttcatttttttcagatggactaaaaatagtcttgacagtgaaaaacacgttcacttttactagcggacgacataagcatcggctagtgaaaatcgatttttactggcgtgcgtttaagacgtccgtttgtgaaaatcaattttagaaaaatatgcatttgtacctaactttttcctaaaaagtcaaatgaaaataaaatttataccaaacttgtagatctagtattcgttataagattcaagatctattttacaacatttcagatatatgatttaaataacctttgatggacacatgatctgtaccaaagttatagagctctacgaaatctacaactttgtagttcatgaatttttttatttgaaatcatttagagagacaaataagtattttaagtttcgaacaatgaaaatcaaaacaatagcattctgaataagtgcttcatggtgagatggtaatgtaatacatatgcgtagagagaggtctttgagtttgaatcctatacaaaccacatacctgcgaatttaatctgaaaagttgcctaaattatcaattaggatgcttagttgtgttatatgcctagtaaaaatcaaaatattttttgattttatttttgctgattttcactagatgtcggatgcagtcagtaaagatcgttgatttggactaacttctaattgcttgctgaacgtctagccgctaggaaatataggttttagccgccagaaaaaaatgttttttatagtgtctgacccataatactctctccatctcattttaacctcagccatggttttccgcgcccaaatttgatcgtccgtcttatttaaattttttttaaaaaaattaaaaacataagtcacgagaaaagtaatattcatgtttttatcatctcataaaaaatattaattataaaaaattttcaaataagatggacgatcaaagttggacacgaaaactcatgattgcacttaaagcaaggttaatagtatagccaactactagctccaaatcatctatagccaatttaatagctaattcatacaatagttgcttactatactattaatacctggtcccatctgtcatacacgtacacattatgtcttgaaatccgtgctgcagctggctacatatctatagcccgctgctcttctatcttctcttttatctttttaaaatatgtttatagttagcttataatatgctattatacctgctcttaaaatgggactgagggagtatatttataaaaccattaacattatactaatataatatgaagaaacgtgaggcaaatgaaacaatagtactactactagctagtacacgtactgcatgcagcagtgttggtcgttggttccatatatttcttggcatgcaacgatcgaatccgatccgagaaaaagctactactgtcctgtgctgtctgcagctttgttcacttgtcacatcgattgatcgtcccagctgccgacctcgcgatctgcaatttacacagtacagcgatggatcgatgcattcatcgatcgatcaaaccgttaattacctacagaaccaacgtaccagaaggcttgctagctagctgcagcttaattaattcactgtattactacatgtgtgttactttctcgatcagcttcttgcttcgtacgtgcttccatctccaccacaaatttctctgctatatatagcttgctttctgcggctgcatccaccggagaaaacgacgtatatatacagccagccgacttaattagttttcggtcaatagttctataagctagtaatatataatatctcatttaatcctaatactatacatatgttgatgtactacatatatactgcctccatctcgtataatagctacttctaacatttaaattttgcctcaaaatatatacattacctagctacttctccaactatattatctcaaccaataatcacagcatctctcatcatctaattattccacctactttctttattatctcaaccgatcatgatcattaatttcacggtgttccttaacctctctaaaaaaaattcaaaagtattactgtagtgctatactctctttttttttagtaatataattgtttttgttacatcaaggctttgactaataactattttgcagtttctaaaaacaacaatcgttttacatttatttcacgttttcatatccattggttatttgtaaaattttcttaataggaataaaattcatcctttcatttaatatatcacttgccctttcaaactcagtcacattagatagaaattacgaataataaatttggcaccctaccttatttattgatatgaatatgagcacaccaaccttattcttaaatttgtaccatgtgtgaaatcaaacttaaacatattttaaacattggtacttcacaaaaaaaaatgtgctgtagatttaaataaaagattgcacatttacttttcggggtgtgcgtgtgtgcgcgatcagatttgaacctctgtatttatggcttggtatgtgatttgacaatttgaatttagagtattaaatataattggcatgttatattttaaatttgtatggcataaatatgtgatatcattttaggaattacgacgcttaccttattaaacgttatgaattttaatgacactttaaagaatattaattctttccttattatgagatcctacccagaacaaggtaatataccattggattctagtctaatggacagtgaaaacatttggagcaccttaaaaaaaattccattgtttttttatataaaaacaattattgtaagtaagcaattttaacatgtatctttaattttgtgttaaatatatatatcttgctagagtaattattgtcaaagtcttgccctaacaaaacaaaataatacacaatatattttttaacgaaaggagcatatagaatggctaacgcatgccacactgggaatatggaagaattaatccgatttgggatgaattgattattctcgatcgtccctaagaaattccagtaccggcatatatatagtggcattcgttcttgtataccaaacaagtaattattaacttgcaattcaatcaacaaaagattctggtacataattaattgacacatttaactaaagaaaaataacagcccccaagtccaacttttgaatgatgtgtaattgccctcgagaacatttttatatcgataaattagttatagctaggtctcgatgaaatgctagcttaattcagcttgcatatatagaagcataaccacacttacttaaattatcttgcttggaccaaccaacaaaacaataagagggttgagggttgaaagtttttttttcagaaaaaaatattacatacatgaattatctacccaatccatgtatatatatatatatatatatatatatatatatattctcaaagatggggggctgtacaatatctatatatatgtctatatgagcatattaaagcattaaagcattttctttttggggtaaacctcgagaaggaggacagggagttcatgttttatattaggaagaaaaaggagttggcctagtttatcatgggccaaaaaaccaaacaaccatacgattaattgatgaaaaatcggcaaataaaaacccaactctatcagcacataatactggtggaaaaaccatttttggtcggtcggccaaaatacacaatattcccggttgcaataaaaaccgggactaaagatatctttagtcccggttcaaaaggttagagttttttttttatctttagtcccggttggtattaccaaccggaacaaaagatctatttttagtcccggttggtaacaccaaccggaacaaaagatccctattatctttagtcaccaacaccaaccgggactaaagatctatttacagtcccggttggtgttaccaaccggaataaaagatcggcatgcgcaacatgggcggcggagagtacgaggccagatcgaggaggaggaggagcagttaatatattctatctcctcactggccttatctcttcctccatatctcttcctccatatctcttcctcttcctcctcctctccttttaacttctctcctctaactcctcttctccttttcctctttctcctctatgagcgccggcgagtggagggcctggtggccggccgcgt

SEQ ID NO: 70480 - DNA, 4558 bp, Oryza sativa
ataatatttccattagcaaaccttagataatgaggtttcgatcaaattctggacttccttggtaccggtagagttgcaaggtcgactcacaactgggagaggcagtatctcttcagatccagcaagcctctacagcatgatatgctcttactgttagaaccaagcaaaagcaaaccacatacacttgcaattacggtaatggatgttcatggactaaacaaacagcataaaagtgcagtgcggtgtgccttgaattattattgcaatagagcagggcggggggcgtcgcctgtaccctcagaagcatcggtcccttctcagatggttggagaagataataacactcaagggatcctatcttcatcgtttcagtattgcattttgaggagcacacaagtccctgatcaagcttgaaaagtgtctcacatagaccatagaaaactgcacagaatatgagaatacacactatagatgttgaaatgtcacgaccatttaagaagccaaagacatattgcagatataccgttagacctacgttgggtgttctgatctgagcactcatcatcaagagcaacctcaacatcattagagctgggaatcacaatatgaggcgtcccaattatgagtcctattaacagagtttgccattaaattttgtacggagaagatacagagcctctaaagactaactaatgtaatgcctatcacaatagctaacagtgttggttaccttcatttagtgaggctaaattggtgcgctcaatcacgtcaaaagaaatggaggatgaggctcgtcgcaagcttgaaacgccttctgagtcaggaagaaacagtactgtctgttccccaattttcacagcagtatcagtaacatcagaagctgtgagctgtcggctagttattgggcacatccattttgccttatttgtgttagcaaggtcaatagggcgaccatggcacctgcatatctgttcaatatggtctggattaacataggtaacataaacctgcaagaagctacaggattgcttaaagtaaagtgtgtagacatgatagttattgtccgaagtaaatgaaaagctaaaaaaagggcatgatgaaatcaccaaatccatatggcaaaattccttcagaaacttgcaaggacaagatgaaagtgaacgtcaaaagaaattaaccaccataatcagtacagttaattagtaatatgtgacacgtataaattgcttcacctgacatgatggaaaaccatcaatgatgtgatttgctgaagcatacatgctgcaagatatttgattaacagtgctgataatgggaactctgaatacaaatacagcctgcaatgcctcctccttgtcatcctttagctcttctaaccacctcttgactaatccatgcaaaacttgagtctctgcatttccaagtttgtagttacaggatgacactattatagtttgcgttaatcaagagggttgttttacttgtatataaggagataaacaagaacctcaccaggactgtatcttcgtaccacacagttttcaaggtcacaaattgtgtctatgaaaccattggaattttcagaaacaccatcacatacgaatgcagctcctgtttccagcaatacaaactccactgtaatacactgttctgctgcgtcctgatgatgtcaaaagaaaaggaatattaagcgggttacttgatcccttggaaagaaagttgcaaagacaatcgtccacaccatgagagatcttcggagagcttgtgtgttttgtgcagacatacataaagcaatcacttttttggaggtatcatcagtggcccaagaatagatagctcgattgctaaaaagatttgttaatgacacatctgcagaggagaaaaattgagtaagataatattttttgtatttgaagagcgtgcattgtactcagttagagagcagagattcagtcgtttatgttgcctagtaagtttggttatggaaatgatcaaacattgaacacggagatcatccctagttagcatgaatataattattacctccagtagtatgtagagatccatgttggttaggacgaaaggcatcgagaggcaaattgttgacagcatgatggaagtctcgaaggttaaatttctctccaggcctatacaccaccttgagctggtggaagttgacatgttatgttagtgagtttgggaaattcacaaaagtgaggggaggaatatgtatttggctggtttgagattagtgagcaccgtaaatagaaatctacttacatgagcatgcagtaacacattttatatggtgagtcggtattggttaagttgttcatgaaggcagcttagtagtttcagtgagggatatgattggcaatcaatcgagatatgaatgatgcaataaaaaacagtagtaattccacaatgagccacagacttagtcagtgtatattggccatcttttacaagtaaaacaaacagctcagatttgcaaagcatgtagagtgaaaacttaaagaaaaacagagatgaatccagagtgcaaacatccagcatcgcagtgagaaacaagctcattatctaaaaattaaaaaagaagaatagtcagaaacaagggcagttacagataatagagattgtggtgtgtgatttactagtgatggtgccggttggttcaatcaatcatttactgctagtccactagggagtgaagaagtatggcaatcggggcagttaatagagagagagagagagagagagactaaaattcggaaaagtgaaagtgcaggcaagagaaaaacgaattaaacctgaggaggcgaggaggaggcggcggggtggacgtagcagagggcgaggcggtcggggaggtcggcggaggggatggcggcgtagaggttggcgaggtggagtaggcactgcatgcgtagcgtagatatatagagcttaattaattaatttgaagtttgcttgctcgatcagaagtagccgccatggccgccatagccgccaccaccaccaccaacacgaggtagaaggaggaggtgacgtcacgtcacctgcttgaggaggtggaggagcggaggggggatgttccgcatgtcgagcaggaagcagagcagcgccatggatctcgatctcgaactctcctcctcctctgcttctccttgtccggccagatcaaatcaacaaaaccaaatcgatccgtttgaatttcggagacgccgcgcgagccaagccaagccaagccactctttctttttcaatatgcgaccgactcaacctcactgacctatcctttctttttcttttctttttttttttgaatacaggacaggagggaggaggagtataaggacataaatcataatgctaatatacacatgcgtaaggccatattaccaataatggtagcaattggatatgttttttccaaattattaaaatgagattatttatcccacgttttggaaaatacgttttctaaccacacatttttctatcgcattattttaaggtactagtaacatactcgtatgttctaacgattatataattagaaatgtcttataaggacaacttttttaaaaggaaaaggaacttacatcgctttagctaataagtcctcgcacacaagatgcgagataaaattataacttccatccaaacacacggcaggagaatgacaacttcaggtaaaaaatattagagatctgttaagtttattttttaaaatatttattacctccgcctcaaaatactcgtcgctttgactttttatttgcaccgtttgaccattcgtcttatttaaaaaattagtctaaataaaaaagataaatcttacttaaattacttttgataataaatcaaatcacaaacaaaataaataataattccatattttttttaataagacgaacaatcaaacgttaaaaaaatataagtattttgacggaggtagtactcccttcgattccattttaattgacattttggacattgaccttatttttctattataatatgtacaataaataaatgcatgttttacttttattatagtgctttaaaagacaaatctatatatgttgttttagtttctttaaactaaatatttttaaagttattgatggtcaaagttataaaaatttgatctcaaccttgtccaaaacatcaattaagagtagtatttaattattcttataaggaaactgatctgttttcagggctggacgccggtgcgccctgaggagaggagagcacacctagaagaagtgacgacgctggcgaagtcagctcagctagctgctcccagtgccattatcatcatcatcatcagtggcttgctgcatgtcatatatagtaccaccataacacaaggggcgatcataaattagccatcactcaggaagcacaagccatgagcacttgttgcctcacttgtactagagtgtctactacagtagtatatagtatacaaaagaggaacttggaatttaaatagtagaaatacaggaggagcatcatctatctggcagtagaaatccccagaacaaat

SEQ ID NO: 70481 - DNA, 846 bp, Oryza sativa
agttgtatggtagggaggaggaggtacctgctgtgaaccgccgcggtcgccggggatgcggttgaggagggaccagtcgacgcgcgcgacgtggtcgatgagcgccgacagctgcaggcccagcaccatgggaggggcgtcgccgtcggtcctcccaacaggggtagggggagcgggagcgggagcgggggagggagacatgcggtgctctgcctccgcgcccatgattttccgttccggcgacggcgagaggcgggcgagggtgggggtgcggcggctaggggccggggagggagaaggagaacgcaccgctcctccaggtccaggctccagctctcaaggaaccaatgcccccattttatagcatcttccttcctcaccactgctccttccttccttgcatcaatcttgatgcaccacccatccctcccaactcccaacgagaaaattgacatttaaccattgtcaaaacggggtttcgctggaatgccactcccaaaagtggtttcgttaaaatgccaccctcaaacaggggcaacttgttgcaatgccattccatccatttcttctcagtttaatgttttttgtaatgtttttcttgttgagatgaccaaaatacccttatcctatctcatctctcctctctgtcttcctcctctccgttcggctcggcggcgcagctagagacggagacggcggcagcgcggccggagacggggaaggcggcggcgcgcttggggatggggaaggcggcggtgcggacggggacggtggcgacgcggatggggacgggaaggcggcgacatggctggggatggggacggcggcgactgggacggggacggc

SEQ ID NO: 70482 - DNA, 2289 bp, Oryza sativa
ttcctgcagcccatcaaaaatgagcgttgcaaattgcaaaacaaacactactagacttcaactttacatcttgcattaaaaaccaactgtttatcccaccaattcacaagacaaaccaaaacgcctcattctattatatgttcaactacaactgaatgatccaagtcaaaagctcaggggaattacctttgaatatgtccaggtgcactacattttgtggagacccatttgaaagcttttgctctgtagatttctttgggcctgtgatcacttttacattgaagagtgatttatccacctcagtagcaggagcattgttcccaaatggagatatactgaacccctcatcaagcgcatctggtatctccacgtaggtttgagttgtaacgatttcatctgcgctgaacccaaaagatgccctgtatgcttcaacctcctcaacatcttgtttgtcctttgagacactaatcctcccaccattattatatggaaatgactgctgagcctgatccaggtagaactgggcagatgcagctggccgaaagaagttattatctaacatgtagtttctagaggcggctgaatcaagcccaaaaatattggacggtgaattcctggaatatggtgtgtcacaggcagacctagaagtcttccaatgtgcggtgcagacctcttgctcagggatgggcgaagccctggaatatggtgtgtcgcaggcagacctagatgtcttccaatgtgcagtaggcacctcttgctcaggtataggtgatgaaagaccagtccttggagttgctgaagcaggtgatatgaggctgcttgaagggctttctgggtaaagcggataagatgcctggagccctgaacctccagaatatgctgtagataagtacggcatgttgtgatctttgccagcagttttcagatccatagatgacaaaagaaaccgcgcatatggaacatctggagaggagggagtagttgcatgagctagttcaggtggaggggtcagtggtgcagtggaaggctcggtcgtgtaagttgagaagacaggtggtgagacaagctgaggctcgttagcatatggcccaacagcaaacatattagatgttggcccacccggagagtttgcagatattgacaggaagcaattaggtgattgggcagtcgaaggaattgcagaattagagaaggacaccggagaagacggtggagcaagaagagataaattcagagccgcactttggttggaattggcaccagattggtgtgcatttccacgactagttgacgcattcccatcaggtacacgtgctgcaggaactatacgcttcccacccttctgtgatccgaaacatgacaagccagacaaacagccagcccatccactccgctgataaatgtagaaagttattagttgttgcaagaaatagggagggggggggggaaatcatccagcattccagcttgattttatgaagatacataaagttaactccaggaatgaataatgaactaatttacagttcaaaagcaacatactaatccgttcaaggctataataatttttatagggctatttagctcttccctgtcatttttatgatctgtgtagacaaacagcattattggctaattattaagcatggaaactacaattagagtgagctgaatataacaacaaataagcataaagagaagtgtgcggttaacaaaagtaagacaattaatgttgtcgtcatatcatgtaattgacaggaatgtcgatggtcttgaaatgacataaaacatccttgcatgctacaacgagtttaagatggcccaattgcaagttgcaaccagcacggagacagtacgaacagttggtactgagtgagtaggaaaaggttgtaaggtcgacaggaggtagcaattgcaggtaacaagtagtacgaaaaaaagcaacagaaaagaaaagatgaagcaattgcatgagcagcaagaagatatagtaataccctatcctgctgtggtgggtgggagtggaatctggcctccgtcgcagcagcagcagcaacattcgctggcctgctgctccctggtgtagccgccatttgtgataagagaaggcgcggcgcggcgcggtcacattctccggaaacacaccgacgaccaagcttgggtttgtcctacggatccgagctgagctcctagtagaggtagaggaggagaaattagaagcagcaatcatagaagcagtaatggacggaggaggagatctcgacaaactggttactagttgtattaagg

SEQ ID NO: 70483 - DNA, 12111 bp, Oryza sativa
acgcacgcgcacgcacgcacgcacgcaaaacccaaaaaaatctcgggggtcaggtcacagatcgggtgcggaggaaaaggtgaaatcctgccccttctccttacagggaggattgacaataggctgtccaaagggatagaggggagatcatggaagcgtaagtgacgagcgccaagtgcaccttcttgagcggcgtgtaggctggcgccttcgccgcggcggcggaggccctaggcttggccatggcccgcgtcgatctgagcgacagtgggtgaaggagatcgagtgaggcgccgagacgagaggagaggaagcggcttgacttggctctggctcctcgtctcccctgccttcctagtatgcgtgggtggggcagagacagacggggcccaacagggtggaatgcccgtgccggcgagtgtttttgtgtgtggattgtgggtgtggatcggtggttctcgcgcggatcggagggcggcgcgtgcgtcgggatttccgccccaacgcaacgcgcccaaggggaggggatggatggatggatgggaatctttgcgacgtgcatggcctgcaagtacgcgacgaagcgacggcactgttttctgtttatttgtgtccactgctatgcctggccgtatgacacggggggatatttcgtgttttccttggtactgtagggggggtgatacggtgatgggtgatgagcgctttgtcagagtatttcaatatttgccaattgtatcgggagtttttttaagctaggaaaaccgtggtctgggtctgttggaagtatatttatttcatatactgccaattgacagtcacacacatggtctcatgtaactgtcaattgtgactgtcaattgtgagcaggtcggaggataagtgattagggatttcttatttaaaggacaaatacccatcgttgtattctataattagaagaaaatttaaatgacaaattcctctttgaattcaatttgatctggaaaaaacttccatctaccaatcggcttcttttcttaaccgaatcaactaattttggtgttaatacgatccgattcatttttatccccactgagaccaatgggacccactctaatttctcccacacacattataaccattgtactctttccgtcccaaaatgtagcaacctaggatgggatgagacccattataggaatttgaatctggacatggggccataactgctattttgctatattttgggacggaggtagtaggaagatccatatttgctactactacttacggtggaccacacccttattgtcaactgttacacatcattggccttgcccttaatgtgtgagagataagagcagttagccaggtacaatagcagactattaagctaactataaacatattttaaagagataaaagaggagagagaagagcagtgagctacagatttataatcagctgcaggacgaactccaagacgcagtgtgtgtatggcaggtgggaccatgtatcaatagtgtaatatatgtttataggtaaatattgtatgaattggctattaaatcgactatagatgatttggagttagtagttggctatacttttaaacttgctctaagacaacgaaacctagcctcgttgcaaccaggaggccctgtttaggtggtgtttggatccagggactaaacttgtccctgtcacatcgaatgtttggacattaatttggagtattaaatatagactacttacaaaactaattacataaatgagatgtaattaatccataattaacacatgtttactatagcatcacataggttaatcatgggttagttaggctcaatagattcgtctagcgaaatagtccagggttatggaatagtttttatttaatagtctacgtttaatacttataattagtgtataaagatgggatgtggcagggactaaaaatttttagtgctatgtaaacagcccgttagttaccaaaataaaattttcacgccgtcatagaacatgcataaagtataaatgtaaggaaaaaacaattacacagattgcgtgtaaattgcgagatgaatcttttaagcctaattgcgccatgatctgacaatgtggtgctacagtaaacatttgctaatgacggattaattaggcttaataaatttgtcttgcagttccctagtgaaatttgttttgttattagactacatttaatacttcaaatgtgtatctgtatatccgatgtgataaccaaacccaaaaattttccccaactaaacaaggcctatgaacaatagaacagaaggctgctgccttgtctcctcttcctcctgattcttcccttcctcaaacactctatttctctagccccaaactcccaatcccctgctactttccagtccaattgcaggtgttctccgcggcaacaatttggagatcctgctcacctcccaatccggtgcacgccaaatggaagtacgacgaggtctaacagcacaacaaactcaacgcagtacagaagagagaagctccataccctggtacaaacctccagtaataacccaggaaagaagagggagaataacatgcacaatggactggacgtctccaggcctgcctcttgcttataatggttaatggtgtggttttataaaactttatataatactataatacccgaagttatgtgtcacgtgctaaaatctccgaggttttgtgcaacttaaaccataatagatgaagctttctaaaaattactctattaatttcgaatttcaaaattaagttaatacatactaaattgagatgtgtacatattcatatttatcaattcttgatataaattatttaatcttcttggataatgaagagaaacttagacaagggcaaaagtatcaatgcaaatgatagtcctacttagaaatcatattataattgccaaagttcaaaaaaaaaacctatttagagtgggattagaacaacaattataatattttaagtgatatttgttataatgtcatctcccagagtgggtatccaatgttctggaataaagataaagtatgtccccttttatcccaaaatataacgatttgtagtatttaaaatttattccacaatatggcaacctctccatatactcacttatctcaactatcacaaccatctcatatttaatttctccatctacttccatatcttaaccaagcacaactatctcctatttaatttcacctaatagaatatacatgaatgcaaacagatgtgcaagaaattacagttatataaagggatatcacctgacaaaatgggacaatacacggatataactgctatctctgaccgtgatgggctcccgtgctcatagatccaataccattcacaggtgaataacataggcatacttacatccaggcactgatcaatggacatgaaaacaaaacacgtatttaaatacgaggtcaaagtgacacttggaaatattgatatgaaaaatccattttcaatcatggctagcatgtgaatcgatttgctgtccatcatgaagatgcccaccatgctccatccatgtagctactgcttagatttttgaggtttgaaaatgttgtcctcgtagtatttcagttcagcgatgctttctttgatatcattcattgccctatgttttttccctttttgaggagttcgcttcctttctgcgaagaacgtggcaaaggatgtcaagtttcatcgatatatttgcacgatttatttcacatcacaggagatcttgaatttagaatttaatgatgcgtggaagatgctggcacagccagcaacatgacctttgatagaacaatgtcactacattgaacctcagtagaactaaagctctaatttgagttggcgcaaaatctaaacatctcctccctctgttgattaacataggcgcacgttgacttcacacaaggatatagatgataaaaacttgaaatgcaccacaaatgtaattattttgggattatgaagatgtgggtggtaatacataaatgcatatgagagagagagagagagagagagagagagagagagagagtaaaaaagatgcacagtaatgaaacctcattaaaaagcttcatacaagacaatttttaacaagaccattcaatttcaaactttaggacttacatttgtcaatggagggagcataaaacaacaactatcatgatgttaaaatttaacagggatatgtaccaggctaacaaatgctgtcatttggctagtttttctactgaaactggagatttttctttttgtttggaaacaaactggagtatttattcatggcaattgtttagttacaccctggctctgtttcataatagttgtgtactttcacgacttcagttaagaaatctaaagtttagcaattgcaatgatcctactcttagcttgatttttagtgttgagagagtgatttactagttgtaacgtgtcatcaaataagggtatgtaaggatcaagatcatagtaggcttggaagaatattggcattgaattgttttatttgtcttctcaaacatcataaataaataaaaaaagtcttctccatagtatcataatacgagttgcaattcttcatggcattgcaacacttgaagcaaaaatactgttaagaaataggaaaactgtatccctattggcagacaaataagtgcagttaccaaataaattaatggaatatcccagacttgataggaattaggaaaacagtcaaacactaatactcatcaggcagaacttaaaaaatttagttcacctttggggtaccatctgatgcacaaagccattatactgctcacatcaacaataacgtgagagaagatggctgcaagctgcggcatataattctgtaaagaaaagtataaaatagaaatatcatcctccaagggattataagtcatatttaaaatggaaaaaccttgcaaaaatgatcaatatgttatgcctagtatcgcaagaaatattgagcatatatttgtgcaataacatgcgttcagagtgaagaattcataatgggcagatgtgttggtccatgaccagaaaatgtccccagaaaaaaatgctcatctcactgtgtatcatttctcactgtgttgcacaaagtaaaagaaataaagcatcaatatcccagctagtatatgacacctctaaagggcaattcttactaaccttcaaaaatagtaaatccacataaacagaattcccagctattaatggaggagatgaaccaacatgcttcttaacaaaatctaacacctgcaaatggaccaacagaagcttctattacaaaaacattagtgtaactatgtaatctttcaagatacacattaatttatatcttgtcatgggcaagccacagccatggaggatgcaaggggctcagacaggggacgctaccagcagcacctaattaggatttaagatttgtgcagttatctctagctcgttacatagtcatcattccatcagggagtcaagtagactaacccctgtagttctgggcgtaaactagacctataggaatacaatatattactagagccacttattctgacaaatatcatattattcagaatgaggataagtaaatgaaactatactgcaaatttaaatcatgatgactatttgatataaatacatttaccaaaatgttatacgaaatgtgagtttcaagtagcaaataggcaactaaagaagtcctaaactacaccaaaggtttaaacattgagacatattggttgagtgatgtaacttcataagcatgtctaccaatatgttgaaaaatacgagggtaaacatatgcatacttgtgtctctgcgtcatgctctgaaatcgtactctgtagtactctctgtgtcaatcctacataagtttcacatgtcataagattaatatttagaaaattaacacacaacaagaaaatggtactttgaatataacaaacaacctctctcttaatgaaatgatacgcagatctcctgtgtattcaggaaaaaaaatacaaacaatttaccactagctgcatgatgagttttgcaccattcatccatgttatctaacagatctttcttctgatttataaccaaatcagggccctgcataaccaaaaacagtcatgtcataatattcaattggcacctgaacaaagaactaaggaacagactagattaacaaatagctgtgggtttcataacatatgatatttgtagcattcaacggtcactcatctagtattaatcaaaatagcggatgtgatgaaaagaacaccattgtgttgtacgaattacagtatccagaatatatgtagaacaaactacgaaggtatttaaattcaactgccacctctatttgttttgtaagtttaccgtccgttatgatgcaagctatctccaatatccgatcctttgcaacatccaaacctacattatccaataagtgagttcccattagtcctacctaattattttaggtatgatgtaaaaaagacaaaacatgatctgaaatatatttcttttaactatacataaaacaattaattgagagaaagagatgcaaagagtgattaaattcccaactgcagcaaccatcatcagatcagaaatcaacaacatttagctatcactaccaaagttccagtattatccttgttattggatgttgaagaccaccaactaaccaattatataggatataggagatctggagataaccatatttggttcgaaatttgttctgttgttcattagaatccaagattatagcccgactaatgaaacccacacatcagaaatttgatgtatgtctcccttttcacaatgaacaagtgaacaatggcttgacaccatgttaatagaccactgatattctgtgaaaaatgctatatcatccagaccgaacaagtgaacaatggcttgataccatgttaatagaccactgatattctgttaaaaaattactgctatataatccagaccactgagcaatcttgaatgatttgtcatttacatatcaactgtgtgcatatatacttattaaaggtccattaataacgaaatgataccatatctctccttagagaaacattataataaaaataataaaacattctattctgaagtatgataaaaacacaaactgttaggacgaaaaaagtaatgaaaatgcaacataaaaatgaattcttcccataatgttgcaagataaacaagtgataactcaaaaaacacaccagtcatttccaagtctatccacaccaaaggcatctggtaatcaccagatgatgatacaagagatccttcatcgtaatttagtaccaacgtgtcactcagcgcattttcacctgcatggtggatgcaacatctaaccccattaatgaatatatattgattgagaataagaaattcaatggaaagaatcgtataagacatgaacataagtgtcagttgtagttacaggtaagaaaaagggtcttccttacatgtatcataatgctttcatttgcttaatgaaaattcctttatctaataagatacataccatgacgctggtagacatgcttatggaacaagtccattgtaaataaattttcaacataacagaaaaggaatttattcaagatcaaacatcaaatattctaaaacatatagggcatgtggttataatgtcaaaagagcaaaacattttgcaaggctaactgaattcagtacaaaagtaggcaccgtggtttgctggatttttttttaattcaagttaaattgtagtccagtgaacccccaggcatactatacaaaatgtaactgcttaaactaagaatactggagtaaacatgagttacagtagcaattctctatgcaggaataaagcagcggaaatctatatcagcgtaatgccataatccattacttagtttactttagaagaacaggggtaacaatcaggttttaccggcatcagcctctttgatgctggaagatgtttggatcagtgcttcttctgtatcatctgctccaccaccttcaccatctagatgaagaaccaagaacttgttcgcaagctcactcatctcccaaatttctctttcagctaatttaatccacgcaccaaacttctgaaaagaaaacgagcacagattgaataccatcaaacacatgtaggtcctcggaggttcaaacaaattagctgcctagtagtggatacatgcaagaaaagtaaagctagcatatcactacctctttcaacatcatgtttaggaagttgtcaccatatagtaatatattagttaatctttgtacacttcgcccccaaaagcaagaacgctttacctttcccacccctactctgaggtttacaagctgcacgaggagattaaggccccgcccttgttgaaattgctcgataacagactcctcctccctcggcgaaggtgcgcaccggcggtcggcggtcggcggccggcagcggcagacgcggaatcgcacgcacgggcacggagcaaccgaggctgaggttggtttagggaggaagcgctgccgggggacgccggagagctggtggccctttccccaccgtgaccaacctcggtggacttaagttgggccaacatcggtggcttcggcccaacagagcggagccgaactgcaatgaaaaaaaaggggaaaacatccaattttggatggtggtttcgttccacacgacaggttgacatggtcttcatctgttgtggcccctatgtggtgcttatatgtcattacagttataaacaaaatataaataattcatgagtcccatctaccagtgacatagctaatgccagtccaatcctcctaagcaatcgttggtggtggcgtctttgtttgctgaagctcctttgctactgtcgccgatgtgccaccggccttctctcacaacctgccatcatgcttcaagctccttgcgcatgcaacaagggtgatgagggagacaagggacagcttagagactgtgtggcgagtgtctcctagagctacattctaacaactggtgcaaattgttgtcatggtcattgtagcacgcagtcgtgaaaccgtgaccgccgatgacgcactcatgtacctagtggtcgcgggcctatggatctgccacgtaggcttagctgcctcgaacatcgcaatccatgtctgcgataaggtcccccgagtacatgccgtggtgtttgaggtctctgacgttgccattctcgttgtagcttcaatcatcccgttactttgttgctacacctcgtcctactcaccatctccgacatcaatgatgacatcgagccagagaagatactacaaaacaaaaataaatgcctttgggtccaatttcgtgtgtgtccctgcggattaccgtatccatatcaatcaattctaaattgcacaagtttgtactcagtaggatcgaatataaggaccaacctaccagagagggtgaatgatacgaacagtaaaaaccaaatccttttgtagaattaaaaaaccctcaaatctggtggagtggagatgcgaccggtcaaactgttggatcaatgtttgttagactattgatgtgccgcactaccttgccgctagtcaaaccgccttggagcctccggccagactactcgtctgttgtctactcgctaccgccaattcgaccacttgcttgctgctggttagattgcccgctggtctggctgtcgagatttagaaaaactaggtgatacctcgcgctttgctgtggaattgatggatggatatatgtgaaatattgtacaaatgatgaatgttgaaatgttgtgaaaatgatgtgggggacaagatgatgcgtcatgcttatataaaatttaacatgtaaattgctaatgggtgatgaggtgacatacttgcatattgagctttagcttttaataattgctagtgggtacaaaatatatagaaagtatagatatgcctcgatgaaactcttgaaagtggatcagctttattatatcaagatgtgtttataaagtgcatccaaatcactcccgtctcaactcacgaactagaattgaaagctcaaagcagactctaagttttttctcccaaaaaatcgatgtatttttagcctcaacccctcttctatttatactcaaaacatggttgttgcggctagccacaaatcctaatagaactagaaatcctaattacataggaaaccactcaaactagggaaacaacatccttttacaattccaaacttcaacatttctaaacttggactccaatccaaatttagctctgcttttcatacagacgcttgtatgtgatatggaaacctatgttactactgtttttttgttcgagtccaatcaaatatatattattatgattatctctgtctcaagatacatgccttagacatgaaacaggcaaatgttttttatttaattgtgatgagatgtcgatcacttgtactttaattatttagatgaaattgtggtctgggtagtgctaattagattaaagggggttttgcatcgcttatgatacatgacctagtggatgcatggatttgtgtggccaaattgggtatgatgttggtttcatagttggaaaataatatagtactataaaagatacccgtgcattgcaacgggataaactaattttatgataaacattgcatgattaaggttcagttttcatgatatgactattttccaaattatcaggtcaatgtaaagaaccaaaccctaaaacaaataaataatttaatagtccgaattacctattagatcttaaccaattccccccggagtgatctaggatttgggtggaaatcagatcagtgtaagctagtacaaaacacatgctactccgtattggtaaactgtaagggcatgttcaatggtagagacgagtatggtctcttaaacaatataagattatctagagaccgtgtctttataatagttaacacgacaaagactctaatcattaactcaaaaaatattccttttgttaatattcttttcattttttttaccctcatgcaaccatatttctatatatattatagtgattaaaagtcgttgttatacataacaacaatgttttgtctctcctctttctctttcttccactattgacaaccattatacataccctaacaatcatattcagagattaaattttctctctggaacaatcataataacaaaagaaatagtagaatgcataaaatccgtttccttaaaatacaaaatctgaaccgagaatatgcgggatcccctccgaaagagctaaaaggcgatcagccgcgtgcccccccccccccggcgcggcgaggcacatggcgtgcgcggagggggccgcgcggcagcgtgtggccgcgtgcgtaggttggggcccgctggttttttccgttggtttcttttcccttttttgcggttttccttttggttttttttctgtttttttccttttcggttttttaaagcatatacgtatacgtatatatacaaactttgtatacgatatatataaagtttgtatacacgtacgtacgtatataaagtttgtatacttatatacgaatatacgcgatgttttttttattttttaatacgtacgtatacaaagtttgtatacttgtatataaagtttgtacacgtcgtatacaaagtttgcatctgtgtatatttttttatacatcaaaaaaatatatatagtagtaatactagtagtaaaattggggagaaccatcattgccagaatgccggttgtgagaacgacctaaaattggggagaaattggataggttaattcaacgaggaaatactgaagtacagtagcgtggatgaggagggaaggttagagagtagtctcttctgcttctacttgcgtttatatttgagtttgacgaacctgactcatcacgtttataaaatcgtgcggttatcacgtgcgataactttcttattttttaaaaccacagtatatctcaccgtaactgtggggttactgtgataaccgctaaaccgtgaggtgatggtaacaccacaaaaacggtttggtgaacctgactgactcctcgcccaa

SEQ ID NO: 70484 - DNA, 79148 bp, Oryza sativa
  unsure (1)..(79148): unsure at all n locations
atatacacccactctgtatggcttcatttacagctactaactagattgtggaacagaacatttgacttgcacctcagcttcctcctcctctgctgcaggcaaacacttctcatgcgggcacggcctggcgaagaatttggggatcctgtccccaggcataataacgggcaaaccacactctttctctgctttctcgttctgcaaacaacaatacatggggatcattcttagatttctgtaagtctacaagaaacgatcatttcaggttaagatcaaagtaagatatgaatagggatcgttagtactgtagtaccttgtgatcagatgttgtcttgctcggagacgcaatggagatgacggtgtgctggccttcttggagtatcacatcaggatgccgagaccagaggaaggcacggagcttgtcccagtggtagcaacatgagaagatgccactgagggagaagataacaaagatcaggagcgccgtccctaggggaaaacccagagttggccttgaggaatgtgccattggaatcgtcatggatggagcaggcgtcagatctccaagcttatacatatgcatcagttggctcctgctcatttggttaagagcccagacttgcaaggtaaggagactgggtatttatacttgcagccagggcaccttgcacggacagaggatgatgagaagtggactggcttgcacggccaggaagacggaaccatccgtggtactggctagtgctgtggcccacatgcatctgctggtgcccgctggtagtgcttgatgctgatctcactgcctgtcttttccaagaaaaagaagctgtttaaattatatgaacacatagctttatagggtgggagaaaaggtaatgaatttcacttcggacaaaaactacaggtatgttcacaagcaaatgtttattaggcaaaggatgatgaaatgatttactgatgtactgaaatgttcagcttcagaaggacaaaaacatatcagcctagcagggcagcaggttggcaatgaaacactccatgcggattttctaaggaaaaaaaattactgagactcagagtttacagctttaaccgagtaaagaggaatcagaaagtgggctcaaaaagattgacatacaacatgaacctactatgcaagagcacataggagatgaacatgcatcactttatctaagtgttcttcatcattcaccttttgaatactatatgcttttcaatagataaagtgccaacagattgagtatcctggacgaaatccacacttgtgtacggatgccacacatgtcaacttatcaggaaaatgtggctgctcttgtgatgtcaaaaaaaatgtgactgctgaccataactgtattaagcctggaagctagcctaaataagggaaacttcactctatggtgtaccaagtgccatgaacaagtttttttcagtcataataggacactgcaacacattagaatgacccaacagctttacaattctacacaagaagcaaaccgccgggagcaaaagaattgtaatcataaataaatccgtagttagcaaatagatcagcacaaggcaactagttcttaggtccagtctttcctatccaaaacggtgtgtcaagcatgttttcaattcaaccaatagttactaatatgttagctagctaggttcaactttggcatcagttgagctgcatgagcaatccaattcacctgtttcccacttggaggttcccacatgcataaataataacagagataaacaactttaatgatcgcactacatcctgtcggaaaaattgttatgcacattggtgggctcgcttcctggtttttcttcaatggttcgtggcctagtatatcgaatctggaacatacactcaccacatgtttgtagaagcagatcgaggaatttggtacagaaaaagatactgatgggaacaagcaaatttagtgatcaaaacaagcacgatgtatcgagaggtctatgaaattagtatcagacagaaaatgtgtacggtggaagaaaattgtgtgggtagctatagcagatacatatatgatttacagattctgctccaattcatgaaggaaacataatataatcgtgtgggtagctaaatacccttagcagttagcagcatcacaattttaggctctctagtgcagaagttgaacaatacatgttggataaattaggtttatagaattacttccacatcatccagccaatatgccactgtactgggacctagcaccactagcaatagtgatgcaccctaggctcctaacccacctacaaggctacaacgaagctatttgagagggacctctccggtaagactttaggtaagtgctcttccatattattacagaacacacaagaaaactgtactgctcaccatcagtcatggtctggtaaatcaggcgtcagatcccaaatgttacacgacacagtgagtagtacataatccattctacaaaattacaatcatggataaacttcatatttataatgtaactgcaaaacttagctgtactcatccatcatttgtacgcctcaactgaagtaacctgacggtaatcagttccaactattggaactttgcaatttatctagatgctcttcaatatttgtattcactttgtctgattatgtaaaaagacaaaaaacattttgctataagtgattgatcatactaactcttgtcaagctttcagggtagagactggaaacaactgatttccctccgccaaaacaaaatgcggtaataatatatggtgaaattgtttattacagacatactgaaaatggatatttagatttgcacgaagtttagctgaggaataacatctctaatgcatagtattaatgaactcacactactcgtgcaaaataaggacttgatattttcaagcccaaggcactgtaccgactgatctaatggaagcataacaggggctgacacctttataaaataatattttttgatcactagatgagatggagaaaaagaatacatgaaagatattaaggatcttgcttagtgcaattttctaatgagacatgctttttgtaaaggtgcattaaagtaagcatcatatgaaccaggaaaagaaataactaggggaagggcccttaaaaggctaaaaaggtagttcagaagtccagaaactggccaaatcatatcaatctaacttcacaataaacaagcacaaaaaatttagaggaaaaatagaagcagtaaccttagtgatcttttaatgagtggcttaactgaaatgtaaagaacatgtaaactaattgtaacgcaatcttaaagcaagtgaaattaaagaacagggccacaggaaagggcgtgtgatttttcctttgttaatgcaaatgatattttccaaacaaaaccatagctgtcagcacaaattcctgacttcccaacattaccatggggaaatttgatgttctgctggatgtacagttaacattcacccaacactatgtttctgttacttttgctattttgcagttagttttgatttaaatatgacacaattgtgataaatagagttaggaacctgacccaagtaaaatgtgttctacatagtggcatgtctcagatacctttcatggatacgaaacgatttgaatatcttgataaaattttcttgtgagtctgtgatgcagttctcaaagtgtgtttcccctttcagaacagttcactgcagcaaacagaacagtcagttaattcatgctttgggtgataataaagctgtaatggtcatataggcaactgggcattgcaaaaggaattcattggaaatgatgctagcaccttgacttgcaatgtatcatccaactgcttccaggcaatctccgcacacctcgctgctccatctcccttctcacctgttctgccttgtcatgcatacccatgcctgaatagatgttcgcaagtgaaacaaagttacctgcattctccggttcaatctcaaacaatgctctccctgcaacctctgccaaccccacctccccatatttcctgcaagcagcaagaagagcaccccaggctttcgcagtaaccttaactggcattgtctgtataacatcataagcttggcgtagtcttcctgcccggcccaagacatcaaccaagcatgaatagtgatctccacaggcctcgaccccaaatattttggttagaacatcgaaatacttcaatgcatcatctgcgtgaccagcatggccgcaagcctttaatacgccaaggaacattatgccatcaggccggacattgtccagctccatatgcctgaaaagcgacattgcaacatctgcgtggccatggaatgcatatgctgatacaatagagctccagacaaccacatcgcgctcctgcacctggtcaaacacgttccgtgcgccagccagagaaccacatcgcccgtatgcttcaatgagggagcttcctaggtggcagctcgcaaacatgccgtgccgcgtagcaaaaccgtgaacctccttgattgagctcaacgcacccagcgccgtgcacgaggggacgagcgccagcagagtaatgaggctcgggagaacgcccattctctgcatccgtcggtagagatcgatggcccgggccggatgttccccggactcagcaaccgcggcgatcacagagttgaagcaggaggcggtcggcgccacatccatgagatcgagctcacgcagcgcccccgcgaggtcgcccgatcggatgtggacggagatcatggcgctacagacgatggcgttgcggtggggcaattcgtcgaacaggcggcgggcgagggcgggggaggcgcatgcgccgtaggaggcgacgagcgcggaggcgaagaatggactggagaggaagccacacttggcggcgagggcgtggagggagtctgcggcggccgccgctgaggggaggcggagggcggaagaggacttgagggccagcgggaaggcgtangccaaggaggggtcggagagcggccggagggaggggtccgagaccatgctggagaagaaggcgagagcatcccggtgacggccgacgttgacctgggaagtgagcaacttcgtcagcgacgccaggcgttggtggcgggaatgcatcgatcgccgcctggtattccaaagctccacgaagactgaccgcgagcgaggtgatttgaattgaaccggagcaagtcaagacggggaagatgcaacaggggaccgatctcctgatactgcatctaaatatatgaggccctacatatatagttttgtgataattttaaaatataatattttaaatccgtattttttttatatattttgatcaatgtacatgtatatgtagttttgtaaaattcactctttattattccatctggctataaacattttatatttagaacaagatttatgttttaagacaggatttgatcaaatggggtagttgatgatatacccacaaacacttctttcagtgcgagactgcgccgcgtaacccgcgctgcttatcgtacttcagctctgtggcacgcttatgaattgatctgttgcattcaagtaaaattgatctgttgtattcaagtcaaatcggtgaaatgtatttggggacgatttggtaactagtggttgtcttttgtaatatatatccaacagctaatatctcctagcaatcaatattatcatgtacacgtgatattttacattaatagctttctatgtaatttgcaagaatcattactcgcatgtacttgcaatattttgttatgaatatcattgcacgtaacttattttatccactcatgttttttttttaaaaaaaaatactttgacggatagctgtacatttcgagggtcatcttcgaccaatattcttcaaacccaaacagtatataaaacattctaacatttctgataccataaatcgcaaggacaaacatcacaacgattgatacagttatcgttaccaatagactaccacattgaaaagtatcccggtcagatgtcaatcgtcgcaaaaaggatcagtttctgcaaccaaggatggcggcattgtccagccggttgaaactcgtaaaccatttccttcacccttcgtgtccagttaagaaatttagctgccccagatactactaaatgctttcttatgcacaataattctctgatctatagcctgtataaatacacgggaacattgcttgtacaatttcgcaatttgaacagatgaaaaaaaaaaaagaactctcgaatcagtaactgccttcgaatggcaattgatcattgggcctgggggtctgcacccatagcaccaaaccttgctccagcgccaagcccagcattgggtggccttgccacaacaacattgtcatcagcaaatagcgccttgatgaacgaaggagtcttcaggggacgcctcccagtcatccgcgggtatacatcttccaggaagtagtacacatgcccagcaatcataccctgaaagaaacaatatttgtcaattacagatatggtccaagaagaaaacagcatattgacaattttaattcagtcaatacatcaggcattcataccgaataaggacatggctaataattcattaaaaaaatacagatgcatgaaaatgatggtcaggagagtacacaggcataaattatctctgaggaaaaagtctctgttaatacaaacaagcaaataagatccattttaagttcatgatattggcaaatacaaaccagtcagagaagacacgagccagccagcactccattaccaagttaccattaatacatgctgctatgtctaccagcatcgtcacacatagacagcaaaaagaccaatagcttatttctgttaaaaatatgctaacatgttgaaaataaagttttcagcttccatacttcaacaccaaggttaaccattgaaaatagctagtaccatctcaatgtagctagttaaacctacatcaggttatagctcactaacccagaaacatctattggcaagctgggtagaaaatgcaaaatagagcccaggttcaggcattcaaaaacaatggaacaagcttttaacacaggcttatgtcacacttgcaaataagcaatgccaaataaaagttggacagcaagatgaccaataaaaaccagtcacaggcttgtagctcatggaaaacgaaacaaacaatattcatacaaaaccatgatagaagaaataaccgttgaccatactgagcttgcaattctacaaggcattctttaactgcagcattggcagcacagacactaaaaaatcacagtgctattatgatattcatcataacgataagaaacataccagcaaatcaacccatgtactgcttcccacaagaatagagaaccccagaaggacctgcaatttaaaagagaacaattcacgcagctgtttctcatctctgatataaagttgaataaactttgaacaatttcagtgaaatttcatctgtgtgatatcaggtgaaaaagtaaaatcaaggatcactacaaagcaaaaacaagatcagagccactagagtttctgtttctctactttgtaataatacattctgacaatgaaatatgtgcgcgatgcaaaaggatgtccaggagttggttgacaaaaccttttcagcgtacattgtcacagccagtttatgttgaaggcttagcaaatccaaaaggcattctgtaaagagagcacatttacatttgctaattccccattttactttatcacacagtactgaatacagaaatttattcccactctagtgaggtactcccctcatttcaaattgcttgccgttctagctttgtcctaaatcaaatgtttatatgaacatcaacttgtagaaattcatatagtttaacatcataaggtttatgtttttagattcaccatgagaaatacttccataatatatattgcatgttaacctacacgaatttccaaaaatggatggtgaaaaatagaaatgtttgactagtggcaaagctagaacgacaagtaatttgaaatggagggagcattcatttttaagatgaacctagacctactggaacaacaaattggctccatggtaaaggaaaggtctagcattttacaccaagttcctgtgacgtttttacacactaaatagaccattcttgcaccaaaacataaagttactactacttcatgttgtgaaatagtgagagcattcatcacaaaacaaaccaacagaaaagcatttgttgggtaatgcttaggacaaatggacaactgttgggaaaaaaaatggtttgcttttgggctcttggctaataggggaaaaaatcaaacatatattttgctctacaaacaaagaaaaatattgaaattgaagaggttttaaataattctattgcataaaacatatgaaatcaattacagatttcaaatcgtgtgatttaacattcaggcatgaaaaaaatgattatatgaagaggctctaggaagttaacttaagatgagaatcaagtgtgcattagtcatgtagtcatgttgtggtacatggaaaggaaactaaaaatacttacccaaggtaaataagcagcagtaaaggtgaacaaacccaagaagctcatatgaatgaagggattgtgcttgctccatacataaacctgcaggtccatacgagaggaattactaaaactcaacttctaagtatgcacccaagaagactattttcagagcccagaaaatccctaagatttgtcctgcacccctaacgatggtgtagaaaaccaaaaaccaagtataatgcttgtactaatctcgtaccatcataaatgtcaatgaattgctcaagaacaggattctggcaaatgtctcagaaatataaggtatcatcccaccaatcagaacaatgccagtcaggacagtagcgccaaacaagagcatgtagaaaaagtcagcagttcttcctctgaatgagttctcctcaagaagcttgcagtatcgtgcaagaaaaaacatgtggaacagaaagtccaaatctggaaacaacaaaagatggattcaggaataagagtaaagggattaaattatgcataaaaattattcaataatgctagaataacagcgcttacatgttctacttataatgcaatacatacgcaacacacgtgtagcgaactaataatatacaagcacttccatggtgtcacatgaggacacataaattagcacgataacataaatctatatccgctgttaacttataatggtaactggagacgtggtaagatgttagatataattttctaaatgcgctatacatcaggatcatacaattaggggaacaaaatacagggtagacacaattaattcaatgaaaacaaacaaggaccttgagtgggtgggtataaggagctttcacacattatgagtttgaaatacattgtgatcataattaaagagttgcaaattgtataccacttgataagttctttgacgaggtcccacctaaactcctaatgcagcccaaaggcacttatccctaatcaataccacaggttgaagctgtccaacaaggacgctaaagagcgagtttaatagtagaggtaactgatgcctctatttttgcccacattatctactcatcgattaggacaataccaattttattttatttgtttgatatcaatctattggttatcttcctattccctctcttggtgatggagcacatgtacaggccgtcttttgcatgaggggcagctccttttcttctccacctcataatgagcactcttggcactagcgctttataccttactggacattctgtaagtagccgtaggcgcataagccttcatcaatgagtcatgggcagaacaacacttccgttctagcttcacgtccgaaagaatcacacctctgaaatgataccctcagaatacaataatagaattatcattaggactcttattgggccgccttttttaaagcccccccttttaaaaatttggggcccccaaaaaaacccggttgggttaaaaaaaattacgattgggatccgcacaaatagtaaatataagtagatactgtttgtaaactgacaatcttgcaagtgtaagagaaaggtaagaggcgcatacccatcttacggaagtagaggaagttggtgacgaggcgccagatctcgtagtgctgcaccaccagcttggggttcagatacaggtggtagggcgaaatgatctgcgaggcaaggagggcattaggccatcagcgcaggcactcaaacaagcaccagatcgaggagagagtagaatcatgtaaagaggggcgggcggagagagagagagagagagagagacctcgagggtgcagccgacggtggtgacaacggcggcggtgaggtaggagcgcgtgatgatgggcatctgccggtaccactcctccaccgcctgcgccatctcccgcgaaaccctagcgggcgagctctcctctctcgagtctcgagtaaaccctaattgacccgaatcgaatcgccgatgagatgttggcagcggaagggggaaggggatggatggagatggagatgggtcgcaaactcgcaacggaaagctgcgtgcattggtgtctccggtggctgcgtgccttcctgcctgcctgcgtgtcactgacatgtgggggccacgagtcggtcgcattgacgtggtgtgttccagtaggatagcgacacgtcagcgcacacgttgcaacgcgccatgtttcgttgacaattcaaatctgacctggtatgtactcctatgttgttgtagtatgttgttggtcaagccagggattacaagtggtcatatagaaaaaaataaaacgtggatgttaattatatgtggttgttccttctctataatagatactccctccgtttcataatataaatcattctagtattgcccatattcatatagatgttaatgatatatatatatatgtctggattcaataacatctacttcctccgtttcatattatactagtaagactttttagcatatgtctagatttattgacatatatatatatgtgcctagattcattaacatctatatgaatatggacaatgctagaaagtcttataatatgaaacggagggagtatatgaatatgggcaatgttaaaatgacttacattatgaaacggaggaatcatattgtattgttttggtgtaagtatgcaattggttatacggagtatatggaaaaactaaagtaacacttacaatctactcctgtattttcttactagcttaacaacttaactactccctacattttttatttatatgacattgtttaggccctatttatttcagcttagaattattataatctgaattattagcaataatctgaaacaatcatgtagatcattataataatctataagctagattagtataatatgataatctcctctaaacgtgcttctttcaaattagtaggtggctaaagacccactaatcttaaaatttgtatgcaaattacccaccacttccatcgaacccaatagattgagtacatccgcttcctctctccacagtgcaggcgaatccggcgcctcccccagccgcgcatgcatccgcttcctctctccctagtcgcgcgcgaacccttccccaagccgtatcgtcatcgccgccatttcatccttctcccactccacaatagcttagggtattagagacatcagcctttcgaaaccaataatatatgtctctaataatccaaagaaacaaacagctaataacttattttattataacttattataatccagcttaataatctggattgcaataatgtttagttattaaaaaaaagggtagtacgcactggaaaaatttgagactcaagtgaagttgttgaaagaagatcgaacgttagaaaaagaattatgtcgtgatacagtgatttgttctttaatgagaaaaggttagaatctttaatacctgcaatgcacgttcttatctttatcgtggagacgtaaataattactactacaatacattttaattgaaacagaataaaacaagctcgatgatacaaatcaataaaatagtaacctaatgatatgacatgcgattttattgacaaatttattatcaccactcgtaagagtggtaaatagttaattattccaatgagagttgggttcttctttgtatggcagggagaaagaaaaaagataaatgagtaattttacactcaagacatgactaatgggttagggaaataatttcctagctaaaaatacttatatttttaagacggagatagtacctcatttcatctcagtttttcattcatttacatttctcaatcaggcttctcatgatccattatccacacatactgcggtgacgtggcttccgtagatttaaaaaatgacacacgagcaataaccccaatatttgggaaaagccttctcttcaatgataaaaagatggaaatgatccaggaggatgacatttgcaaatacgtgaaccggatgagtcaaaaacccaacagagactggaatcagttgagtttcagcatcagcgcccccaaaccaaataattttgaactctccggactccggccgccgccttccagaggaacctcgcggctgccggtgccggtgccggagaagacatggccgggaagaagaaggccctaacaaatcccgcctctccctccgcctccgcctccgcttccacccctaagaaatccaccgccacctccaaggaccgctccacgccgaaaccccgcaaaaaccccaaccccaaggaggaggcaccaccgccgccgcccgccaacaacaagcgcctcaacccccaagggggatccaaccgtaagaagaaggccgatgcggggacgccctccaagaagccgaagcgccagccgccggagcccaaacctcggaagcacaagggggccaagagcgagaagccgcaccgggtttccggcgaaggggagaagcccacgcccacgaagaagaagaagaagaaggagagcagcaaggagcccaagcgcgagaagcagcaagcgtccgcgcctatgtcgactccctcgaagaagaacaaggaagccaaacgcgacacaggaggagcggggaagcccacgcccaccaagaggaagctcggcgacgtggatcccccacaggagcgaccgtccggtgaaggccaggcaagctctcccacgcccgccaagaagcggaaggacaaggcggcggcggcggaggcggttgccgaccacggcgccggcagcttcccgatggctcgggtgcggcagataatgcgggccgaggacgccaccatccgcccctccaatgaggctgtcttcctcatcaacaaggccaccgtatggttctttccttccttcccacattctttcacttaactcgcatttggttaatgaaacttagtttatgcaatgatttgtgatggcaattagcaatcgaggattggagcttctccatcctaatgtgatgatttgggttggactggaatctagttaacctaatgagatttaggtcggcgttgctgtgatcgcccacaaggtgtttgatgaattgtctgatatgatcacagatcacgaatggtgttttctacctccaaatggtagatgttacaggttgtctcagaagtccaaagcttgatttctctgcttctgctgccatcaaacttttggcaggagggtttatgcacgattgttttatgtttgtatttgttggtaactcgctaaaatgttgctgttctctgatgcattaggcatatgttactggtttatggcatactggcaatgagaatattatagagggcatattaagatagaatctgaagaatatattttcatgatttacctagttattctgtcagattactgtgatattcattacggaccagtgtttcattattttttccattcctcgtccaaagctgatttggttaatgttatatcgctcacttgaacctgtaaatctgtaactgcaggagatattcttgaagaggtttgcagacgatgcttatcgaaatgctttgaaggatcggaagaagtcaattgtgtatgataacctttgtaagttgcacattcattcccattcacttcaaaactttctttgttgctatgttgaaaatgcactttgtatagaaaagctaagggatctgcatttattaagattggaaaaaaatgtttgaaacattcaaacagtacatagaaaaatgagaaatctcagataggtgaaagagggtttccctattctactaatgtaccagcacgtcatcatcaagtttcaaaacaacacaatttgtggaaactgtatgctgtctcattagaattttttttagtgaaatataaactacacatgtcctgaggttgttacttttagtgttcatattttcattttcaatctctcaagagatgaagaaccttccaagattgcaatgatagtctggtagttatcccatctataggtagatgatatttccatttctgcagacaggtttgtcaagccaggagagaaagagcagttagtatatagctatagtaggaccattgtgtgtaagagggcaactgcatttagttgcgattcagcttatcaatgccccaatatcactggctggatagattccattgacaagagccaaaagataaatactctctcaaagattgggtacagatgttgagtcctacaagttgcaacatcaaatggttacatacataggatattttgttatggtcttgtcaatattcttgcctgtcccccctttttcttgataaaatgtgtccacctatcaatctaatgatcataactttactcatagcacacacatttctgtgatgttggcatatatatatatatatataaaactaatgcatttgtgcagtgatgaaacatttttatttctatacaagccagtgtaacatgtactgatattttttagactgtccaacaaagatagttgaagtccactcatgttctgaaactggacagaggggaatcaatcccatcgagaggctctcttcctccttttttctgaatctgtgagagaggcaaatgagaagttcagagagacctcaactcttctgcatttctctgtcagtagtgataataacttattaagttgatcaaattagggatttcactttcagtacagatgttgcattacttgcatctcaaatatcattttttgagccatattttttgacattggcctttgatatatgccccagcttcttttttttttctctcaatgatgcagactttcagaggtcataggataaattctttataaccagtgacctacaaaataacctcaggaattcatatacttaaacgtctatgctttgcctacttgcaccttttttttttttttggggggggggtgtgcaaatgttccaacttcctgacagagttatcgtgtaaaattgactcaggaaaaacaatcataaaacatgtttcttatgatctgtgatggcaagatcagcatccaacatgtgaatagctttaacatctttcatctcaactcatagacatacactttttgtggatgggctcatctctgaattgcaattaaagttcattgatcctgtcttccgtgaggttgaagatatagttaatgttctatttcttttgtccttttatttttctttatctcacagcacatctgccttccttttcagcaacagcagtgtgcaaccagaaaagatacaagtttctctcaggtcaatatttgtcttttttacaaacccatggaagcctattttaatcagcaaaggctcttcatatgccttagccttttagcaatatcattatttacaaatcgtttctgtggtctttgctcagattttgttccacagaaagttacagctgaagatgctttgaaggctccagttagcagccaagtgaaccaaccacaataagttgctagtgctccgcgaggtatgctgctatgtttttactacttcctagcttttttaaggagcgaattactggaaattagttttccatgttgtgaaagttccagcattcagctgctccatcctgtagggaggtcatcctttcacgagttatctcctgggagggttctgcaattgtaaacgccagctgtgcagctcatgttgccctcaggactggcatcttgcgacatgttcaatatgattctgatcagaatcggaggcttaaaagaagattataaggggaaacctgagtaatctacatatgaaagaagcatgatgaaactttttgtcatgagaatcacttgaaatatgcttgcttagagcctcaaatcaggatcacctttttggctgtgtaagctgtgggttgtgtgaggtggatgtagcttaggctaaatgttactgtgtatttttttttagataatacgttactagtagtatacatttgtgagttctgacttgttcatgtactagttcattacatatattttcgcaggtgcatgctttaccaattacttgctggtgcaaatatgaatgcctagcaccatgagatgcttgtcttgcactggagtttatctcctatggaatccacgagtaggctgttatggaggatttgtatttgtaccttgtttcaaaataaataaaactagtatgagatatgatatattttagaactatgaatctgggtatgagtattataatgtataatatctcatattagatctatttattttgtaaccaagagagtgcttgctttgtttcataaaaaaaatctaattctgtataggaatctagatatagaattgtattttttttttaacggagggagcaagtgcgagcagacacggtgagtctacgagatttgtgtgtcaagtgtcaacgcatcgttgctggggctttgttcgggacgaagatccaagtatgcagtacgcgtgttcgccggtcattcgctgcacatgggctcctgacttgcttatgccgccaaagattagcaacagccaatagctagctgtaaataatgcgtaaggccaacggtaccatctgtaactttctctcactttcgttgcatctcaattctcaggaaagcaactgaccctaacgcaaacagtagtgtctttgaattggtcggtgcaactttgccacgaacaatttgctaaaaagtgctagaaaaaatgaatatacaaacgagtcagtcataagtttcagccaaacatcaatttgccaacaaattggttattatggcacatataatacttgacgtgacaaaacttcaactgcaaacctaacatgccctttgccataaatggcacagtaccgctcatgtttgaaataatcaaactgctgtctccaggccctaaattaaagctatcgttaaacatccaagtcaacctctttaatttgtcgtaacattaaaatccacgcgatcattgttttctgttctcgagcagctgctgctatagcacgagttgtaccacatgtcagtatatctgaacatatgtgtccaagggcaggtgccgaactaatgaactccggacatatgtatatgtatatatgtgttagtgaaaacacattttcttttctgttgtgtttggatgaaaaattgaaagagatacttttgttgccaagtgtctccaagcttaatttggcagaataaaaacgccaagaaagaagtccggaccaccagattaattatttgtttggtaagctttagcatcagcgcatcggctatagcattagctccactcatttgagaaaacgacgacgcattaaattagtaacagattttttttccacgtaaaataatttcggaagctagtctaacaaaaagaaattaggagtagtaataataataataagtaaagtaatctagtaacaaaattacatttgatgagcgactggccagggaggaataggttcaggtgccacattttcttctcccatcccatcatcccatggcctggcctcatgggcgcgtgatccgagaaggaaccgacggtgataaaaatattgaaatctcgcacatcccaaccaaccatgcagaggctcgcagttctggatctgaatactgttcacaccaatgcatcacggctcacagctcacttggagttggttctaatcaaaattattaggagtagcagtatatcattctactaggtatacaaaactgcgtgtatccatctccatatcactccattacgttattcctctttttttttcacagaaaaagaattttaatggtttcaacaccaagaataattaacacaagaatgaaatgaagaatctaacatctcgcggatcacaggagcaatttgaagcgcggccatggaaggcatgcatcgaatctgtgtatctgcggagctgctgcactgagacgacgaacgtatatggtggggttgtactgctgatgctactgtagatgtagatgtagtgtactactccggtgaggagctccggcgaacgatcagacgagctcgaggcgggcggagtagtcggcgtacctggaccgccggatgttggcctgccgcttcttccacacgacggcggctagacccaccaccgcggcggccgagaaggcgccgaccacgacgccggccttcttgccgccgttcaactcgtgcctctccgtctccccgtcctcctcccccgccttgtcgcccgcggtggcggcctttatctcctcggcggcgggggcaggcgacggtgttgacggcttctcctccttgtctttctccttatcgtcgtcgtcctcctcgtcgtcgccgccctgcttggccttggcggcggagggggccggcgcggacgcggcggaatgctccatgggcgacggctcgggtgccgcggaatgcgggacggggggcgagtgggagggcgcggggagaggggaggtctcaggaggcgcgggaggggagagcgcggcggcggaggaggaggcctcggaaggcggctgcgacggagcgagggcggcgtcggcggggtggaggcgctcgtctgcagccggggtggaggcggtgggcgcggacgcaggcggcagcgagatgggcgactcggcggaggcgagcagcggcgcgaggaggaggacgaggaagagcgcggcggcgcagggcaatgccgatgacgccatggcggaggcggaagcagatctgcggcgaggtggtttggttggtgacgagattggaggggttttatactcgggtcgtgaggggtggggatccctcgcttcgcttgccacgtcggcgatgcggttgcggcgggcggtagcaaaggaaagggagagagtagaagagtccaatcgccggcaacgcagtataggccggtggtacgccgttttcggcccatcttccacctctacctgccgcttgtttgtgcttcaagattcgtgcacgtggtcacactctttacttcctatatcatcatcataatgatagcagataactatatgcatcagtacgtaatttaagtgctactgtactctttttttaactcaaaacagaagccccatcaattaattctgctgtactcacggatggcacaacagtgttactctcatcagccacaacaacaaactactactactactccagtatatattggagtatactgaaacttcattttagagtttaactgaggtttttttttttcttaccatagtcttttttcaatcattgacttctaaaccatcaataacacatgtataaaagttttacacataaatataacttagttgcttcatatcttctagggcttattagccgtagctcaaactatagaagcatcatcaaattattgctgctccttagcgaacatacagacagtgctactacaacaaaatgctggcctgccagcataactgcatcatcaatgagaaaggttcatcacagttttggatggaatcatcttaacagaatttcgccctgcctaaccactaagattaaaaacaaaaataatcccagaagcgtaacaataagattgtgatgagcgacaatcagtgtagggctgtggcacgtttcttctgttgcccttttgtagcttttcccccttgtgaagcagcagccttactcagctcttctgctgctgcttcttcggatttatctgcatctgcagaatacggggaatacaggaacttctttgagttgcccgtgccaacgcagttcagcttcacgatccttctccccgtcatccatttcagcaggatcttcatgtgagtcttgctattcaggccactgataccagcatcctgttgtaacatactccaaatgagtaggggctcatgtgaaccaataattgtgttaggtatactatcttcaagtctgatgcaactttgcaatcaacatgagctgaattcgcagaatggcatcaagaaataaccaaatcccggtatactatcttcaagtctgatgccactttgcaatcaacatgagctgaattcacagaatggcatgaagaaataaccaaatcctaaactgctagttgtagattaaaaggtactgtgcagtatgtgaggatgcagactgctaatgttcccaggtgccatggaacgggcaagcagtcaggtcagccagaatggtagagcgtattagcaactgagatttagaccaactacacgtgcctcgtagagagaggcaaaaatatggcttatgttttcacttatagaaacacatggcatactcctacataagataagttgacataaaaatcactccttgaacatttatagcaccaaaggcaatgatatgcctccatttgaattcaggttatctataacaccaatacagcaccagctcattcaagcacaataggcaacataatgttgactcaatactcataagctttcctcttactttgaaaatatttgtgatataaccattgagttgaaatacattacacatggcgcctgactgaacattagcaaaagaaacctagacttatcacaaggatatactggtagatatcctagtaacagtctctgtaaatgagtgtatgacaaacactcaggcacgcacacatattgcacataaaaaaaaatccactttaaccagactgaataagctaaagaccgtgaatcaaagcacggaaaatcgcaagatgatgtggcaaaatgggttacgtggatcactggtaagcctgattcaccaaaatacttaaatgggctatgcaatagtcctaagtggacggttactctgctgatatttttatccaaatgaaagaagctagagggggtaaaaagggaggagccgctaccaatttcatagtgtaaagaacattggatcaacgaaatgagtagagcaatacttgtaggcgtctataacagttgatcttagaccttcacctactgttgatttagggggaaacgcagcaggtttgtttcactgtagaatgcacacatagccggagatttgcaccggtatctggtagactacactaaacatagagctggtgagtagtgccagtgtcagaagcaacgtaccttggcgtggttccatgtgttgccgacggtgagggggccatggtcggtgaagatctggaggaggcgaccggagatggcgacggcctcctccttgggcaccttggggttgatccgccgcacgtccaccgcccgcttccgcgagaagtgcctcttcagcacctcccacgccatccctccagctccgccgccaccgctaccgccgccgcctcctcggaggaactgcatgtcgccgccgccgccgccgccgccttggttcgctggctggggttcagttcagcttccgcagctaagcccccgtctctcccttttcacccgtaggccgtaggaaggagaagaattttggcccattagatgagatatcatatgggcccggaacaaaaaggagaagaaggcgaaggcccacgattgcagattatatgggcccagcccaagaagagaagaaggcgaaggcggcggctgggtcgggcgctccccaccatccaaccaaccaaacctctcatctctccgccgcgatggcaactgcggccgccggtggtgaccagtgaggtcgccgccggctgaagtgtggttccattcgaggtcagcaccccctttcctcttatctatctgcttctattctatatgccctcctagatgggagcgagtgaggctgggggtacttggaaacatgagcagatgagctcaattgatccgatttgattttgattgggtttattttgggttgttcgctgatggaaagaccggaattttgctcggaaccttgtgtttgcagggcagtggcctgtagcgccggccgcatatgtcagctctccgcttatgccatggagccatcaagtcgccgtgcgctcggaagcttgctgctgctgctgcgccctgcgctcggaggggaatcccggcaccccaccaaaagaagcaagcgaccttctgcttgatgcgagcttctccttccttccgcacaaattctaggtagtgttctgttcagcgtttgcaccgaaatggctagattcctgatgtgtaatgtgtcaattttgccgctgtgtgtttattaggcagtacttaagtcaatttcgtgccacaccaagtgtttggacattatacagacaattttgtgctaaaatggggatctaaagctactctttccaaattcaccgtagcagtgacctcagttagtataaagacatgcctttctctcctttttgcacctaatgtaaaaaacattgcgttttctgaacagttggctgtgttaattctatcatggaagactcaaatttaacactctctttatatgtcgtcaatcttcagatatagagttggcaccgaaccggagtcaagagtgtgaactgcggtatttcattcaggcagtttgtgttttctattgttggcatttttgtccatctttacgcttgagttaacactctttaaagtgttgccaattttttgttgatgacatgaaatgttcgaacgtataccacactgtaacaggagattacctatagcgtttgctctacttgccagttttgcttgtttgtataatgcagaaacctctttttatgcaggcagatgcaatggtccattgaggctatgaccgatgatagtgctgaccaatcaggcgacaataacactcgcctgtttagtgcaattcagtcgtttttgagcaagttatatggcaagctcaagaaactaaggaaagggctgccgctgaagatcctcttttttctcatcggattttattgtgctacggcatttgctactgtcatcgggcaaacaggtgactgggacatattgtctgctggacttgctgttgccattgtggagggtatcggggctctgatgtatagggcttcgtttgcgtttcttggtaggataaggaagatgattaccatattcaattactggaaagctggccttacacttggattgttcctggattcttttaagtatgaagtggatgaatttcttgaatcctgtaatccattcaacattgatatcaatatatttagtctttggtgaacttctgctccaggttttaaaattttgttcttttgcatgccaatgatattttgatgtagcaatttcaattgtttagtcactcccgggggagccgcataactttttctgtccaaaagttggagccatggatcaaagaagagtagttgtatcttaaaattgttgtatatacaatattgtaccttacaattgttgtatacacaatactccattgtacagcattaattaaagaattgtttttgcacctgatactggcctgtacaaagtacaaccgtttgacaatgaactggggttagttctatgttcaccaccactaaacaaaagagctctgaaatatggttcaaaagctactatgatcatttgaattcatcagctttgacatgacagtcctctatccctcatcgtcttcttcaccttttcagcctctaccaaccttcccacattttgatagatctccatcaactttacaaaattgtgctcattgtcaggctccagttcgatcaacctcttcgcaatgatctctccaaccctggcgttgcgatgcatcaagcaagcctgcagtagagccctcaaaacagtctgttcattgtcgagaggcttccgcttcgacatgaactcgtaagcctcatggatcatcccagccttgcctagcatgttcaccatgcaggtatattgttccatagtagggggaattctgtactcattctccatctcagagaacaatctcatgccaccctccaccagccctaaattgtcacaagctgagaacaccaacgcaaaggtggtctcatctggtcgcatcccggaatccaccattcgacggaagatcatgagaattctgtagtcctggaggtgagcagagattatagcattccaggactgcagatccctcatcgtcattgactcaaacaccaacagggcatggctctgttcgttcttatcagagtacatcctgatcagagcatttgctactgacagctctgtctcgagaccatgacgaattgcccaggcatgaatctccagtccccatttaccattgtcacaaaccaacggcagtatcgacagcattgttgataatgtaatggagtcgggctcatgttcttctctcagcattcttctccagagctccagagcctgctgggagagcccatgtcgcaggcacccagcaagcatgatgttccatgagacgccgtccctgtccggcattgcatcgaacacctggagagccctccgtacgtcgccgaatgtggcgtacaaatccacgagggcgtcgcacacaggcacgtcggacgcgagaccggcgcgcacgacgtcacggtggatggcatggccgagctcgaccgagccgacgccggcgcaggcctggagcgcgctcgtgaaggtgaagcggtcccgcgggacggtctcctcctccatctggaggtagagcgcgagcgcgtcctcgtggcggccgaggcgcgcgtacccggcgatgaggcagttccacgggaaggcgtcctcccgggcgcgcgcgggcagcaggtggtcgaacaggtggtgggcgtaggagacgaggcccagagaggcgtggaggtggaggaggcggcgggcgagcgcggggtagcggcggaggagggagacggagaggaggcggcggaggcgggcgaggttgcggcgcggggaggggtggagcgggagggcggcgaggagggagtcgaggaggtcgggggtgaggaggcgcgggtgggacccgaggtcggagaggacgcggtccagggtgggctgggtggccggcggcggcgcggcgcggagggtgagggccgcgccggagtggggatggcggcgagaaggtgggcctcgtcggcgagctggcgcggtggagcggcgccgccgctggatggcgcaggtcgtgtggctaacggttgctgggagcgccattttcgttggaccaatccacacccagagcttctagaagcagtctcattttttagcgccaaaaaaagaactactcgtggcaaatactccctccgtatttcaatgtatgacgctgttgacttttcgaccatttgttttattcaatttttttgtgtaaatataaaaatatttatgtcatgcttaaaaaacatttgatgatgaatcaagtcacaacaaaataaatgataattacattttttttaataagatgaatggttaaacgttagacaaaaaaaatcaacggcatcatacaaataaatatatggaggaaatactattcagtaaaagatggacaccacaagtccatcacaggatttagagtggaagagaaaaatatcatatggtttgatgggagtctctttgcatgcgggaaaactagttagcgcacggcggcgcgtgtttcacacctcttccacgctttttttttccgtttttttaccgtttgttttcccacttttttctgattttttttatatttagcatgttttgagtttgaaagtttttaaattttgagttgaaaattttcaaatctaaacttgaaagtttttaaatctggatttgaaagttttcaaatctggatttgaaagttttcgaatctcgggttgaaagttttgaaatctcgggttgaaagttttcaaatccaagttgaaagttttcaaatttgagataaaaagttaaaagttttcaaaatttgacttaaaaaaattcaaatttcaagtcaatatttagaaaactttcaaatcatattttgaaaactttttactcaaaaattcaaaatcatctgtttctatttttattgagaaattactgtagcatttcgtgattagtgctaattatttggattagcaatgtagtgctgtttttcttccagaaaagcgctaagcgcttgaggcggaggcccgcgtgcgcgcggcttaaagttctcgcgcgcgcgcgagctaaccacccccctttgtaggcccaaagaggatggggggcttggttttgtcaacacaaaaataatgaatgaggccctcttatgtaaatggatttacaagttggaatctgggtgcaaacagcctttgctgtgatctgcttaggagaaagtatatgtcaaacggtggaggttttttccaaacttctgctgatgaggtcaaaaaatggatgaagcttggcagtgcatatgttgtgggtaatggtgaaaatattagattttgggaggacatttggctgggggaggtccctctaaaaattcagttcccatacatatatagtgtttgttctgatcctagtgatagtgcgaaacaaatgcaagtggatggggaatggaggattaatcttagaagatctctaggcccaaatgatctggaagagtggtcggagcttcaagagatgctttacttcgacacagctgactgcagaaaatgacactatgttttggaaactaaatcagtcagggacgttcactacaaaatctctatacagggctattatctttggagggattaagggcaccaagctccaggagctttggaaaaccccggttcctttgaagataaaagtgtttatgtggttaatgctgaaggggaggattcaagtggcaaagcaacttaagaagatgaattggtcaggcagcccgttttgtaagctttgtgggatggaggaagatgtagatcacctaatgtttagatacctaccagcacaattcttatggtgttgttttagggcccctttaaattgtaggaatggaaaaatggaggaataggaaaaatataggattctgacaggaatgcaagtgtaaaacagaggattgcaaaacacaggaaaaacacagaaatagccgtttgattggaccgcaggaaaaacgcaggaattagaggagagatgaagactcataggaaagtttccataaggtagaacctcatgctagattttctccaaaacttgcatagcattaggcattccataggaatttaataggatcctataaaattcattcctttgattcaaagggctatataggaaaaattcctatagaaatgaaatcctttagaattcctatgaatttcctttgaatcaaagggggcctattagagatgctttccattggataggatccccacctctaggaatgaactcttagacttcattcaagatcatgggggagttaggaacaaaaacttgttttatttgtttgctgcaggtgcttggtcgatatggctagtgaggaatgactgggtttttaacgacaaacttctgaccaacgtgacgtttttacctcacaaagctatgtcgtttatgatacagtggaaaaacctggcgccggtgcagctgaaggaggagttggagaaggtaaagcgatcgctgcttgccaatatccgcgagacaggagattcaagcagctgatgtcttcgtgtccttgatcttttaggctgttttctgttatgctagctgtgcattagctttctggcttgtctgttgtgccagcagcacttctacttagactctttcgctgttaattgtgaagctggcatccccggcactactgtatcagactcttatgctttcttataaaagctgggctttatgccttttctccaaaatactattcagtaaaaaaaatcgtaccagtagtattttctatagcttgttaagccaaaagtattgttcagaattggcatattaatagagaaatttgagatgaacttttcatgtgctatatatgtggatcatacactggacagaagtacaaatgatgagttgaagtgtctggagaatgattgacgctagttgataacgatggtcatcagtctgaatgaagggtaattttagaggcttggttttcccggacgcataagcaaagaattcggatacatggatatgaggggatgcagattgctgcacgaaatcgaaaagaaagttgcctgccgattgatcatttcagttgatctcttttcaaaaaatcatttcagttgagcggttcggttcagtcagttgaggcatccatccatggattgcatcgcatcgcatcttgaggtaggtggtgctttggatagctctgaattcaagcaagcatatccaaccgaccggatgatacgttagcttccagattccacaagctatccaagaaatcatcgtttttgcttgcgtctcttaattaaatgcatccatgcatgcgcatcataatatgcataaaaaatgcattagttcatgccccacaaagtagcattaccagtacctgaattatcagaaattgatcatttgcgtaatcatcactaagttcgttttgacttggattcagagatatctgaagccggtccatcggatgaagaaacaataatattaatttttccctcgaatatactactacttgcagcatgtacccggtactccgtactagtatagctttcaagcgttggtgtgaaagtaatattaaggtccagtagaaagcacgtgtcttgcttacgagaagcagcaacacataaaactttcagtaaagtctcttctcttgctcatgctagccctgtcattttcagtcctaaattaaatctctctttcttgtccatcggtttatcaaagaatatcccactcaaagagcataattcaggtttccttctcaactcaactctcctgatctctctggctctgcctctctctatatagtgtcacagtgtattcatgcagaaattgatccaaaccaaaaccaaaagtgaaaaaagaaagtaccaagaagaatataatcaacacaagagtacagtagtgtagcaatggcggcggcggcggccggcggcaagatcaagacggtggtggtgctggtgatggagaaccgctccttcgaccacatgctgggctggatgaagtctctcaacccggagatcgacggcgtcaccggcgacgagatcaaccacctcgacgccgccgacccgacctccagggccatccgcttcggcgacggcgccgagtacgtcgaccctgacccgggccactccatgcaggccatctacgagcaggtgtacggcacgccgttcgtcgacgcgcgcgccacgcccatcacccctcccggcgtcccctcgccgccgatggccggcttcgcgcagcaggcggagaaggagaagcccggcatggcggacaccgtcatgaacggcttccggccggaggccgtgccggtgtaccgcgagctggtgcggcagttcgccgtgtgcgaccgctggttcgcgtccaacccggcgtcgacgcagcccaaccggctgttcgtccactcagcgacgtcgcacgggctcgtcagcaacgacaccaagctgctcgtcgccggcctcccgcagcgcaccatctttgactccctccacgacgccggcttctccttcggcatctactaccagtacccgccgtccacgctcttctaccggagcttgcgccagctcaagtacgccggcaacttccaccccttcgacctcgcgttccggcggcactgcgccgagggcaagctccccaactacgtcgtcgtcgagcagcgctacttcgacctcaagatgctccccggcaacgacgaccacccctcgcacgacgtctccgagggccagcgattcgtcaaggaggtgtacgaggcgctgcgtggcgggccgcagtgggaggaggcgctcctcgtcgtcacctacgacgagcacggcggcttctacgaccacgtcccgacgccggtggacgtgcccagccccgacggcatcgtcagcgccgcgccattcttcttcgagttcaaccgcctcggcgtccgcgtcccggcgctcttcatctcgccgtggatcgagccgggcacggtggtgcaccggccgtcggggccgtacccgacgtcggagttcgagcactcctccatcccggccaccgtgaagaagctcttcaacctcaagagcttcctgaccaaccgcgacgcctgggcgggcaccttcgacgtcgtcctcacgcgcgacgcgccgcgcaccgactgccccgccaccctgccggagccggtgaagatgaggccggcgacggaggcggcggagcaggcggcgctgacggagttccaggaggagctggtgcagctgggggcggtgctcaacggcgaccacgccgacgaggacgtgtacccgcgcaagctggtggaggggatgacggtggcggaggcggccagctactgcaacgccgccttcaaggcatggatggacgagtgcgaccgctgcaggaagtgcggcgaggacgggtcccacatccccacggtggtgaagccgccgccgccgccgtcgacgtcgtcctcaggctctagctcctttgcttccaagttgctgtcttgctttgcgtgtggtcgtcctaacaagaattagtcagtgaagatggctgattaattgcttattcatttcgcttgttgattactgtatagattattaatttggttgtgcagggaggagtacagtactaaggccggattttacagagtgattatgggtggtgtgtagattattgatgtgatgattgtattacgaatgttggtttactgatcctgctgatctgaccagaaaagaactctggaagttcagctcaatcagattcgtcattgagacccaaaagtttccattaagattgcatagtacatcaccaactggacaaatgaatagcaggcaaacagaatatctggaaaagaacagagaagctaagaacaatttcacaggaaatgagtaacagttagaaatggctacaaaatcaaaatgttacagctggagtttatttcaacggcactaagatggcccagagcagtgatctacaacacatcatgctgtattagacaggcatttgaagcaggatgaaaatgcctgctcatcatgtgcagacaggtaatgctactaagttcatctaggaaacattggacacgtttaagcgtaactttaacgccttcagctcaagaagatataagcgggattggtctcacagcaccctgtatacgacggaatgcagtcttgatcctttctctcagtgtagcattttcacattcaacaccaccactcctcccatccaagtgtgctacttgtccatccacagatataacaagtttcccttcctctgcaactttgacatcaccaaaaagtgacaccataagagcataaactaccttctgggccaccctttccgtctcttcctgtgtcttcactgcttcttcaactgggacaactttgggaccttcacggcctatgttcaagaccatggcgaccacagaatcagacaccatatcactgataggatcagacgaccactgcaatgtaacatagctttctgattccaggcgaatggtcactctctcatgcacaatcaatgttggaacatcagactcctctgttgatgactccacgctctcatatatttgcttcagtctgtactttatgacttcaaaagaaccagaatatgggacggcaatcctttgggtaatgttagctgtagatagctgcgtgtacacacggagatcctcaggagccataatttgatatgtgaatcccttctttacaagcaagccattaactgattctccagcttccggtaccttttcagccaacctgccaattgtcttggccattttctcagaactgaaatacatctccactgattggcaattcttggggttaacaacttttatatttgtcccatcaaactgagaaataagcttctgcttaagtcttgacatctcatttgcttccccgtgtacaagaacaatgttgggtggctggagctcatccaagaaggtgcttgtctgagggaaatcagcatgagcagaaaaggaaatatagtggacctgcatatgaagaggagcagtgagcccattcgccagtgtcacttctcttggctcgttaataatggtctttgcaagggtgccttccacaacataacctggaataacacatgaattcttcttatctgtgcaccatttgtcaaagagctgcctggagaggccactctggagaccacctgggcttgccataaccactgatggacccacatcatgaaagttatctatgctattcaaagactcaatatgcttgaaatggaagggattagattgtgcaaactggttcctaatcctttcattcatggagttgatgtatgtctggtagacagccatgcatttcttggcaagaggggaggcataatagattggaatcttatggagctctgggtggttggcccaatactcatccaggataagtagcagctcttgagctcttccaagagcaaaggctgggataagaacgcgaccaccctgcgagacggtcgtgtgtattacatcagtgaagcgcttctctcgtacatggcggggttggtgctgctgcacgccataagttgactcgataatgcaaatatcaggggagaactggggaagttcagcagctttcaggtggcgatcttcctcacgggagtagtcaccagtgtaaagaacgcgaaccccagcaatgtccaccatgaacattgcagcgccaagtacatggccagcagtatagcaccagaagcgtatgccattaacttccaatgtctggtggaagtctatgacctgcaaggcatttttatgttaacaaaagtattcattcactccatgaaatacatacaagctttcgatcatcacaagaagaatcaacaatatgctatatggaaggaaatggtcaatgtttacaaagcaacaatcagatgttacaggtttctcagttgattatcaaccatctagaggatttctgtccattcaaatttgttctaacatatgcatttgaaaggggtcgacaaagtgctgtactgctatataggcaatttaaatccattcagggagataaaatacctcaattttatccatggaacgaagaatgtcttgctcgtcaaacagcatatcctccacagaaactttgctgactttgacataatcggaaaggagcagcctgtagatggcctttgtggcatgggtcatgaacacgcgccccttgaatgtcgtctgcaaataaaaccagagcaacttgaggatgctgaatggtatcagggcaatagctgagcacttactgtcgaagcaaaaaaacggaagatggtggaacattaccttctccaagaagtagggaagagaggcagcatggtccaagtgaaagctgcaaattttaagggcgaagttaagcaagagacgcacagatttgacagaaggggcaaagaaaataaaagaaaaagggtgaaaagagagtggggggaataagtactgggtgattaggaggacatcaatggtggagggatcgatctcatcgaagtaggggagcgccgccatgccggagtaagccgggtggatgccgcaatcgaactatccaagaatccaaaccacaccacaccacatgacaaacaaaagcagaaattatcataaaaaagaaagcagtggaagctagggtttggagggaaagagtggggggattggatgctcacgaggacggtgcggcccttgaatgacatgtagacgcaggagcggccgacctcgttgccggcgcccagcggagtgatgatgagctggtctccctcccgcccgccggaggcctgccgcttccccggcggccccccggcggtcggtgcggcggcggcggcgacggacgacgccattttccccttcacttgctgacgagcggagaaggaaagaccttttagggctttggacacggcggactcgaagcaggctgaattaagttgggcccggaagggcttgcagtccaagcagccctggagctggacagtaagttcactttagctcccttaaccaatctaatttgtatcttgaaccgcaattaccgggatttctagccctcggcccttcgccgccaacactgctccagatcctgcaccgaagtggagaggaagagaaacatagagagagaagggagaaagagggaagagcaagaaggatagaggggagatggcacgggggcctcatattttttattgtgtgaatgacgaatggggctcacacacatatttttttttaattctaatgccatctaaactccatgtcaacactcacgtccgtgaaaccgtcctccaaaactgctgagggagtcaaattgcatcggttttaatagttgagggatcaagatatcccatattggagttgaaggaaacgaattatattggttgagatatcatggagctggagcataactttagcacaactcagctccagcttcacgtcttctagagctagagcctagcctaacaatttcagttccaacttaaatggatcagagttggatggggaactctcacaaaatgaactagagatgtagagctgggtttagactgctccacaactaaattctagacctaacgtctggagctaaatttaggagttggagctctaccaaatagacccagagaaattcgatagcaggcatggagctagcccatcgagctagactaatggggagaagaagttgagtcgtgcaggcttgacgtacgcaaccgtccttgcattgatctataggtgtcttaggtggtgtttggatccaagggctaaaattttagtctctatcacatcggatgtttttgacactaataagaagtattaaacttagactaataataaaactaattgtataaatgagagctaattcgcgagataaatttttaagcctaattaatccataattaccacatgtttaccgtagcatcacatagactaatcatggattaattaggctcaatagatttatctcgcgaattagtccaggtatggtatgagttttgtcattaatttacatttaatacttctaatgagtgtctaaatatccgatgtgatagggactaaaattttagtccctgatccaaacaacccgttagattcgagggctagtttattcagtttgaggaattttaatccatagaaataggaaagtgaaaaaaaaataaatgcacgtatcaattcatatgaattttttcaaaagatttgagtgaacggaagtcttcctatgttttttctctacaacttaaaggaaaagaaaaaattcgtttggttttcctataacttatttatacaaaccgaatgggaactgtagaaattatttttgggaatccattttgtttccttcaaaccgattaaaccaatgcacaaaaatgctaattgtcagggttatggataccacatacctaatagtagttgacttaatctcgacaggacccaccatataccatgtcttatacggaaacaaccttcggatataggaggagttccgtataaggaaggatgaatagagttctacatgaaaatggcaatgactactcggagtatccatattggttttcctagttctacttggacaaggggacacttatgggtataaatacaaggccccctaagaggagaggggacacggaacaatagatcaagacataagatcaacatacaagccaacatacgccaagacaagacgctggatatcgacttaagagataagcatggctagtcccctatggtgtctacagatgctgttaggagagacatagcgctgtctttgatctcaccggatgcggattcgatgaggaaggctaccctgttgtcgactacgagtcagaactttagaccaccatattgacaacagttagataggctaccccaaatattgtactggtgtgactatggtaaataagagcaacgaccggcttcggccaacatgagtagggttattacctgacaattcaggggcccggacatatatacaaatccttgcctccgtctcttttacctaaatctcgcgtatatcctagtaccaacgatccccatactatgcaaataccggaatcgcgacatcaaacgtcgacactaatataatgttcctatgtagtcacgtgcctttgttggttgccctgttcacatcgtggttctcactaaactgtgatcttcactcaaccttttcaactccgctcactcagtttttacgcgtacgtttcctaaactattaaactgtatgctttttaaaaagaaattctatgaaaaagttactttaaaaaatattacatgcgcgagagattatttctcacctccaactaccgaacacagctttaagctacccatcatggcgttactaaactacgcatatagtattatatatggtactacctaattcaaggtcttcgtatcaaagtctttgttttttctataaaaaaaaacaaacgaagaagaggaataaatagatggctccacggctgccaataaagcgcattcccgcaggcgcgttcaaatggaatcaatcctttttcacatcatggtgtcactaattttatgcataatataagcatttctgtaatgattcatattactccaataattgcaatggtcttagagtcaatcagatcgattgttacaaagaaattcaaacatataaaaattaacaactgaatgacaaatatggaatcttttagcctaaccttagaatttattaaacacctattacctcgcctcccaaaatatatagatttttaggattgtacatggttatttaaaaatagctaggtataactaaacgagagaaaatcgtgattgagtgacaagtggaggtatgtggggaaattaaatggtggagaattttgattagttgggaagagaatattgatggagaagttatcatattctagaacgaattctagagattaaaaattattatattttggaacgaacagagtatatagatccttgaaatgtaaacatagacgggtacaacacaaacacaaatattgaccagacgcgtcaatgccccccccccccccccccccggggggagtgcatcgattcttttacaaggaccaccttcacatcatgccgtggatagtctatttcaaagtttccttttttattattaagaagaagaagatatagactctccctcaatggcttacgagccgtagccaaaatttaaattttaaaaattaaatttgaagatgattttgaggttaacttattaagttgtatcggtaagctcacctattaagttttaagttttaggactatattgcacccacatgtcaattcaatctcccgtgaatataatttacttattttttaaaatgacttaaaacacatactcctatatgcaaattttacctctaaaaaaatttagttgctttagttcaatttaagtcgtggagcaaacgataaaattggtagtaatcatgcaccatggtcgccgaggaggcatgtcaatgtgttccgacacgtacactagtaaatgaaatggcagggggagggttaggtgaagacaaaaatgtgtttttcataaaagtttcttctacttagtgtgtctagatccagggtgaaaattttttaccgtatcaaatcggatatatgaacacatatttaaagtattaaatgtagtctaataacaaaacaaattacagaattcacccgtaaactgcgagacatatttattaagcctaattaatccgtcatcagcaaatatttaatgtagcactacattgtcagatcatggagcaattaggcttaaaagattcgtctcacaatttacacacaatctgtgtagttagtttttttaatccatatttaatacttcatgcatatgtccaaacattcgatgtgacaggataaaaaaaacttgctaggagatctaaacaggccattatatatttctactatcctataatatcattatatatttctactatcctataatataagacatggtcaaacttgacacggtaaaaaaaaactaatcttttctcttataatttatcatatattataaggtttgtagtgacaaaattatagccatacgaaagtaaattcaaatgtcaattcaatatacaacttttagcaagtaaaattcaattcatatcgtactaaatattggtcattttgaatgtgaaatcttgaaatacgcgagcaccttatattatgtgagtatcttataatgcctatcctacacattttgttaactttattttttaaaagatactagtattatattagactagccagggaatcatcaatcatcattttttttgaacgaaatcaatcatcattttgatacacgggttctttcggaggtgcgcttcatcaagcatccaatccacttgaaccacttgactgctcctaaaagcaatatataagcagaccatcgtctagctaagcttatgatcatgagcaaactcctaataaaatccctcacccataggaaaatcggagcaacgacgtacacgctcaaattcccacatacgcgcgcctcgatcgatcgatcgtctctaagtcgagtcgttggtccttgtgtggttgagagagagagagagatgaatatcgggcctagagaacagagagcatttgcgagaatgacgccagaagaccgagcgtggttgataaagggcaagtcggtggtgctgacgtgcctagcgtcggtcctcctgctgtcggccggcagcatcaaggcccccaagacttgcaccggcggcatgttcttggggcctataatcgctatcggcctcttcctcattgtcatgttcgtggtgggttcgtgtggcctgaagaaaaacgatggtgacctctacgactgctacctcctcggcgtgttcttggcaatcctcctcctcctcgcctttatcatcttcggatacgttgccgtgggaggcatcgacgcggggcatgcggcgaatgcccgagagtacagcctcagtgagtgcaagcgggggtggcttaggggtcgcgtcacccactcctcgcatttctgggcatcaaccagcgcgtgcctccgccgcagccacgtctgcaacggcatgactaacctggtacgcaaccccgacaccggcatttttgttccccgcccatcctccttcgaaaggtgggccaagagacacggggtggacgccgacccacgtgtaatgtcccctatcgaggtacgtaccgcctttttctctactccctccgtctcaaaatataacaatcttgtactagataggacacatattaatacaacgaatctagacaggttatactaagatatgtcccatccagtataaggttgatatattttggaacggagggagtatcattcgcatgcacacctataaaactagcgagaagctccgcgcgactggatacgtgtcgcgcgtggagagaagagcggcgaacactaattgcataaatgagagctaatccgtgagataaattttttaagactaattaattaatcagtaattagcacatgtttctgtagcatcacataagctaatcatggattaattagtctcaatagatttgtctcgcgaattagtctagggttttgtcattagtctacgttctaattaatgtcaaatattcgatgtgacaaggactaaaatattttagccctattcaaactcccccttattaggttgtgtttagctttaccctgcgttcccaactcacatctcttgttattttacctagatgactattctattacattgatgtggaaaattaagttatgtaatatgtataaataagatgtaatataattattaaaacttaaaaaaaatgacttgcatctacagtctggatgctgcaagccaccatcatcgtgtggattaacatacgtgaatgggacgacgtggatatcgacagcagcatcagcaggtgccccagctgccgttgcccaagtaaccaacaacaacaaggacgacgactgtagccggtggagcaacgaccatcaaacgctttgcttccagtgcgactcgtgcaaggctggcttcctccgccacaccagtcaggcctggagtgtcgctgccatctatatcgttctcgccttcatcgggctcattctttcctcacttgcactctacgcagatcaagcaactgggaataataatactggaagatcacgatgagtactagctagcagctactcccagttatatatatacatgtgcgtgaaaatctctgaagcttaattcatttaccttttacctgcagtacgtacgtacgtacaaaagacgtactaggatcgcatgcacgtgcgtggtgtgtaatggtgctatatataaaggcctggtccttaattaatttgttaacgtttttactgaaactagctactctctccgttttatattataagtcgtttgattttcttactagtcattatcaaattagtttcattaaatctaaaattgaatatattttgataatatgtattatttacgttgaaatactactatactcttctagaaacttgatcaaacttaacgagttcatggtgccttgccactatactctcccagcacacttatgctttgtcgtcatcatggttacattgtggtgtcctctgtccttgatatgggatgttaggtcccgatcttccgataggtactgataaacagtcgatttgtgcggagtcgtgacacaactcgatccggcttttgaacgaacacgctactgaggctcacaatcgcagaaccacgtctcctctggttatcaaccgtgccgaaacccggttgacctcgccgagaaggctaatccctgtatgcaaatcgaagaacacaagcaagaacaagatatattgcaaccaaattacatatgaatgattaaacactcgaatttggggttctacaaaccgatctagcggcgaaactattcttgacagaataatataagcaaaacttgactctaaaagataacggctactgaataaatgtgattagggacgtcatagggttgccctagcgcgcacacccccttgggctaagcccacgacacaattacaaggcccaaaacttttccacacacacaaacttccaacttttctgtcacatcgttccaattttaaccaaactttcaattttagcgtgaattaaacacaccctaaggagaaataggactatatttttggcaataactaagggaaagcctggaagctttcatggacactgatgtcacaaactgcacactttgttgctaatcagagatgctgtactgctagcgatcagacttggctgcattttcagtcgcgtgatattttgacagcaaatatttgatcattgcacacatccgcaagccatcaagacgatctggaaacgggaaagatctggtagacactattgaatcgcaaaaccacgaagctatggatcaccaaaaagatgcaaaagattagccctaatcgcaccgtgattaagcagttgtctgcgacgtaaccaatctcactttgcatagtattacggtctgatccaaagagagagtataaagctaggttgttcctgacaatcaaacttgttcctgacattacactatctcacccgtccgtcactaaggtgactaactaaagctatatcatctctcaaaatatcgttctgatggtcttccagcatccttttatagcattcatccaaaagatcgttcttgttgagatcaatcgtagcatgtatagtgaaatcagattagaaacataagcatctgtctgaacagagaaatcaggcagcccactagtatgctttcctaagactatattcctcaattaccaaatcaaacacgtctgcaaactgaggatttcgctgcgccgagccgctggccgcgcagccaacgatttttgccgcgccgctgcctgccgggaggaagtgaaaacctgcatcagggagagatgcggttcctacgtcggggcgagatgcgatgcgtcggacctgatgcgaagaagcgaagaaaacatcccataccaaaattacccctaaactatattaggatattactaatctatcctataaaattaatggtcaagattaattctacttgtggtagaatacttcaagtagagagcattggagcgtaactcttctccagaatatacaaatcggtcacctgctccactcaatttacaggcataacgctatctactttcatatttagtgatgggttattaatgtatgacctggatagaaccttcgcaggcaggccaatttcctaacagtttccatggtgtaaagcagtagtaaagaagaaaaggtatacgccgagctttatagagaaagcataaagtgtctacaaggtaactgctgggaactccagcttacaagacaagacggatcaaatctttcaagctcatgatgttcttacaggcattgaggtttggagttggcctcgtcgccgaattgcaaacacctggacgaagaagacaacggccagcctcggcccgtcccctggtaagttgtactgctaccagatgtacctcttccttctctagtcgctgttgtctaaaattatgagaaacagctggttggtagttagattttaaaaatttagaaaggctgagtttcgcagcttctagcatctagtttattttatgaattctacaactatagtttctgagaatctggacaaaaagctggactgtttggggagcttcttattctgggagaagctgcaacagttagaagttggatatttttttaccatgtcagaatgtcactataatgtcttaataatagttttttcttcttaaaatatagcaatctaaaatcgaatgagacacgttctagtaatatgaacgtagacatgtcccgttcagatttatggtatatgatatatctcatccgatccttgtatttttagacagaggtggtatagtagagccccattgaatgtgatttcataatattttcaaaattagtttttaagtcgttaaaaataaatatataacagttttatatataaattaatttggctcatttacgtattagaaaatatgggtaagtgggcaaccgatggggacagtagtttagtggcgtcatcctgccaaggagcctggaggtcagcactgacgttgctggaggtgagtagccatgggccaatggccatggcatgtaccggccggcggccggtgcaggtgaattgagatgagaggctcaacttgtggctgctttattgtgttaccggtgaccgacgacttggaccgtcaaatgcctcgtcgcgcactagtggaaattaaggcagacgcgtgagctcgttttataatactgaaatactttctccatttcagtgaacagagggagtatagttttttctgtcacatactcatgtggaaatactccctccgtttcaaaatgtttgataccgttgattttttagcacatatttgatcgttcgtcttatttaaaaagatttgtaaaatatgtaaaactatatgtgtacatgaaagtatatttaataatgaatcaaatgatatgaaaaaaataaataattacttaattttttttaataagacaaacggtcaaacatgtactaaaaagtcaacggtgtcaaatattttgaaacggaaggagtatcatactagtctctatacaaatatttttcttttctttttgttactttatggaccctaaacactatgcatgcggtggaaaagtttgggagttggggaccctcgatttctgctaaacgacatgacttttaaaaaaaagaaaatcatcggattttcttagaatacctttgttaaattaatttttaactttcccattgtcggcattgacctcagctcagacgaggtgacgaatcctagcaaaaaccgtgttgctttcaatataagcagagtcttttgaccttttctctagaaaaaaaaaaagacgaggtgacgaagctgttggaaatttggtcataattcggcatattttaatccaaaataacaagataataaacatgatatttataatgggatttgatccagtgataatggtgaatgtaatcaacatgagcatgcttaacgttgaataagcatcaacaatcacataatgacacaatgttgacattgcgatgaacattaacagtaaaacttctaagtgaaataatgtaataaggttataccccaagaatggtcctccgctggagtttgaggcagtattgcctccgttggtgttgacgggagtctccttctccttgtctccagtgttcgacatgttggtgaagatgaagtagatgttgacgaacagtgagtagtcgcgccttgcgctccccaaaaacctgatcgcccgcccgtctgtgcaaacgtcgcagcaacgcgtggtttcggaggcctactctcccaacgcgtgtgcacacactcgtcgggatgggattaccgtagcaacaacagctttagaaaatggatgaaagtgtgtcttccttttctcgcgggagatcaaatccattcccattttataagaggaatggaagatgaagagtaagagtcatggaataggaagaggaatggagcaactaattgtcatcaactagccatgaaccatcctccactacacaaccatcaaccaacaatcaattaagagtaattgatgtaagttaccaatggaataggaagaggaatagagcaactaattgtcatcaactagccatgaaccatcctccactacacaaccatcaaccatccatcaattaggactaattgatattagttaccaattccttaatcaaatggattaattctcaaaactcttcatcccattgatatcccatagaagaatgaattcacatgaattcctagcataatgagccttggaatttatttgatttaattgatttaaatggattaattacccaattaaatctaacagaagctgagtctaaaggtgattcgattcataatgcatatgcagtccacttgagtcacaggactagctagctattcccgaatggacaaacgtacggttgcaatatataagcagccgagcatgcatcgttgggagcaacatacactcaaattccctggcaggctcatctgtttgttgggagagagagaagagatgagtaatattgggatggggatgggggtgatagaagctgggcgatttatgagaatgagttcagaacgacgagcgaggcacttggtgggcatgggtgttgtgctgacgttgaacacgtcgatcctaatactgggtagcgccacccgtgccccgacgcattgcacccgtggcgtcttcttgtggccctgtatcgcgatcggcctcttcttcatggtcgtcttcatcttgggcctgtgcggcgcgaagaacaacaacgagggtctcttcttctgccacctcctcggcgtgttcatcgccatcctcgccctcatcggcttcatcatcttcggttacgtggccatcggaccaggcatcgacctcagcgatgtgaaggcacgcgagtacaatctggacgactacaagagcgggtggctcagggctcgtgtggacgacgccgcgtactgggcaacaaccagcgcctgcctccgcggcgacaggggcgccgggtgcaaggccatgacgaaactggtccgtgacccacactccggcttgttcgtccccgacggcggccgccggcacgtcgacatgtcacctatccaggtatgtacgtatttttgggatatatggatcacggatagtttacaattacatactactatcactaattggaacctctccctagtagcttattataattaactgaatatatagtctggatgctgcaagccaccatcatcgtgtggattcacatatgtcaacgggacgacgtggacaccaacaccagcagcagcaacaaacaacgtcgactgcagcaggtggagcaacgaccaacaaaagctctgcttccagtgcgattcatgcaaggcaggcttcctcgaccacaccaggaaggcctggagctcggctgccttctttcccattttctgcttgatcgcggccattctttcatgctgttcaggtttaaaatatggaggggttctccatgaataagttgttatcttactttgtttatttttatcatgtttaggctttgagccaacaaccttataataaatgattgttcctttgtttatttttgtcatgtttgggcttcgagccaagaactttataataggagactgtagcttctctcaaagcaaaagccagatttaatattcattatctaaaaaggttggaggagttactagatgggatacaaacagctcataagagttttcatattatatttattgttatttttttaaaaaaaaatagaaaatgatttttttatccagcctctatatccaaccggatatatacattttttttctaaattgggaacttagtccatcaaacagctcagtccgaaattcacgcttctatggaaatttgaacctaggaccttgagatgctactcttatttgttgctaattaagtttcaagagaaaggagagaagtttaaaatctgaattaagttgaagcaggctgaattaagttgggcccggaagggcttgcagtgtacgtgaggcctggtcaatccaaacagccctccagctggggaataagttcgcttaactatcgaccaatctaatttgtatccttcaacccgatatctcgatcccaactataaaaaccgatgcaatttaactcctttaataattagaggttttcctggtttcgctgatgtggcatctacatggtagtgttacattggtctatgttgttgatatggcgcttaggtggtattagaattaaaaacatatatgtgggtcccattcatcactcacccaaaagaaaagagggctgctatacaacggaatcccgttgtgacgagatgataccggttaggtatgaggttctgatacctctgaggtatcatgtcttgatatctaaccggtatcatgtgatacttgtgaggtatcatgtgatacctataaggtatcagacgattcctattacgtatcaggtgatactcgcgaagtatcatatgatacctgtcaagtatcaggtgatacctgtgcgattcctactacgtattaggtgatatttctattcctaccacgtattaggtgatacttgcgaggaatcaggagccgggcaccaaagcatcgtcgccggtgatcccaccgtccacgtcggagctcgtcgccagcggccacatcctccaccatccacgccacgtcggagctcgtcgccggtgtcagcgtcctccatcatccaagccccacgccgaagctcgtcgccggcggccgcatcctccaccgtccacgccacgtcggagctcatcgctggcgcccgcgtcatccgtcatccacgctccacgccggagctcgtcgctagcggccgcatcctccatcgtccacgccacgtcggagctcgtcgccggcggccacgtccttcgtcatccacgccacacatcggagagagccccttcctcttctccggcgatttgctccctgacggagcggcgaggtgaggcgaggcgaggcagcgggggccttctccgatgagctcctctctctctctctctctctctccgcttagcaagcccccttcttccttcactaccgcatgctgccattgtgttgctctgctgccccgcttagtgctctgggacaaataagaagacgataccatcacgggtgttgagaacgggataccggtatctagctttttcgaaagaaaattgtggggaaaattaattaaggttgtaaagtaagtaaaagcgaagaagactaggtatattctttcttcgatactttattcatcggctagcccaggttttatagcctgcgataataaaaaggttacaataattgagctcaatcaacactgattacaagctctaagttcaggaacgtacacgagcaacgacaaaatgaatgacgtaaatacgtaaagcgcaccggtgtatcggatgtattcgaactgtacgtgcggcttatgctgtatatatatgggccggtcgaccgtaattgtgatgtacgtgcggcctattatgctggagcgggaatgtcgctcgcatgataagttcatgtgaggtccattaacttgtcaacgaattcgatttccgtccttcaaccgaaaaactagatacaacggatctgtcaactgttaaactagtgtagatgaaatcccttagcggttttggctgacgtggcggtcttcatctaactggcattgatataacgtttacgtgacaattcgattcgaaaaataataaacccagtgagacccaactgtcagtttcacacccaaattaataaaaaatggtgggtccacgtgggccccacatgacatttccactcctcttcatcttcctcctcctctctcccctctcccctctcccggcacgacagagagtcaacggcgggggaggggaggggattaatcggcaccaccacatccacgcgacggcgaggaggcggcgcggcgatcacataccgcaccaccgccgcacatcctcctcccccggccggggaggtcacgacatagacggatcatccaatcatccgatcactgccgcagccaattaacttcagagctctcgtaggtgttcgtccatttgtgacagtagcaaagagaagtggtgagtttgtagtgttgctgccatggccaactacgcctgcgtcgtcctcctcgttctctccggcggggtggcgttggcggcggcgtgccgaggggttggagccagaggcagccagccgacagtcagcatgggtcccacatgtcaaggcctattcatctctctctctctcttcctcccttgttcccatctcactaggcaacgagcagtgagctagtgaggagaaggccggccaacgacgggcggtgccggtgaggcgatcggaggctgttttgctcaagcgggaccatgacacgacgacgtacgtcctgtggagaaactcaccagcacgcgcgcgcgagctggactcgatgcatatagcaattaaaacacgccctacagtgctggcatgagatcattgaccagatggcgataggcacaatagataagagacaaaaataaaaaagtttgtttcgttggaagctacttctattaagctaggtagggcgcgggacaacatgcaaaacgatataccccatattactctctccgtttcaggttataacatgtcttggattttagtaaaagtcaaactgcttcaaatttagctaagttaataataatatttatattaccgaattagtttaattataaatatatatcttctctactattataaaaattgaatatgtttttgtcagtattttagtacgtctgtcggtgatatgggaccgggagtatcatggccagaggcttgaggcagacgcaatcgcccacgtggcctggcaccttcggggacgtcgggcccgagggtgaggtgtccgccctcctcctgatctcccccgagggggggtcgggttgcgcttgccccggcccctagggccgaggcaccccgaccccttaaggacgtctgcgccacatatatgggataagtgagcacagctgtgctcacctaacagcatttattgcagtctggtcaagcgtgtcacgctgcatgcaacgcagcacagcgcgttcctttatccggtctgtgaccagtcacagaccggtcagatcacgggttaggtggcgactgacgggctgacgcacgctttgccccgtcccgtcaagacgaaagcctctaggcactcgtctcaagccggagctagcgtgttatctcttagagataacacgttagccctggtcagatttataccaggcttcatcctaaccattacaggcaaggtgttacacaaagaagggcgaacatgcatgttgttaagctgacgcgtggtggacaagaatgaccggtctggcactggtcgcgtcagctacgggcagccacgatcccacgttgcgcctgtctccgccgggagtggaggtaggtgtgggctgtcccatcggagtgtcattcggacagcaatcataccaatctccgtccataaagagaagaaaagtccagtttggaaagggaagggtgcatgtggtatccccttgaagtataaaaggaggaccttgcccatagagaagtggttggttgattcttttccagattgagagctgagaacgggggagaagtcgactcacactttgtagctcattcatacacaaatccacaaaaacacaggagtagggtattacgcttcgcagcggcccgaacctgtatacatcgccgtgtctcgtgtgtcttgcgggcgagtgatctttccacagacagagagagtgagagagcttgggattgcaccctaagcccctggtcgaaccggcaaaggggggcttgcgcagtctcccggtgaggggccacgagctccgtcatctggcgcgccaggtagggggctcagcgtgtgttttctgagctctcagactcttccgtgtgcgccaagtttttcttgttctgcctaatggccgagcaagcaaaggcgcacgacctctctccgagtgtgagcggcgacgacggggagccaaacccacgccgtcgagctcgtactcccccgcctccacaccaaagtcctaagcagggggaggcgctcgagagggttggtaaatccgcagcgtcaccggttgcgggtgatgcaggagaacggcgagatggggagcgttgcctcctcgtctacggcgacggcagcacgcctcagggcgcgcttcaggctgctagcgcgctcctacgtcacccacccgtcgtccatgaccctgagtctccagctcagcgatggctggacgacgtggccaacttggtcgtgacggcccagcagcgcctgggtgctggtggacggtccgccgccaccaagacttccggcgccgctaccaccggttccgtgtcatcaaggcggagggcgcggcgagcggcggcggctgcacggcattcggctaccactccctcgtcgacaccttcgactcgggaggatcagcatggggagccggatgcccgcctcaacatcgagcgccggcgtaatagccggcgtactccccgtgcaacggagggcgcctcctcgtccagagtgtcacctcgacatggacgtgaggatcagccctccgtgcccccggctggtggtgttggctgtagagcctttgtggcgagtcttcggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggttggctgatgaacttgtcacccgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaggaggaagcgtggacatggaactcctccggttccggagtggcagcttcggccgcccccggatccgccgctcagacagggcggcgtgacaggaggaggaagaagaggtcggaccgttccggcgacgagggtcatgtcctcgccgtcgagggcgctccgcgggccacccgaaaggggaggcctgcgagcgacaaaaagaaagaggctggtactcccagcagggagcgccccgccggcaggtggtgctccgtccacaacacctccctccacgatctcgcggactgtcgtgcagtcaaaaacctggctgagcgaacgaggaagtgggaggaggacaggaggcaggaacgccgtgagggcaagttcccggcggttccttccggcaaacggcgaagtgaggccaagcagaaggcccccgctgttgacatcgatgatggtgatgatgacctaggtttccaagaacctggggccaccattgccaccgtcgatggaggagcgtgtgctcacgtctctcgccggagcttcaaggctatgaagcgagagcttctggccatggcccctactcatgaggcgatgcgtcgggcgcggtggtcggaggttgctctcactttcgaccagaccgaccacccaccgtgcattgcccggggagggcaggttgcgatggtggtttcccccaccatctgcaacgtgaagttgggacgtgtcctcatagatggaggagcggccctcaacatcctttcccccgtggcttttgatgccatcaaggccccggggatggtgctccgaccgtcccaaccgattatcggtgtgacgccggggcacacgtggccattaggtcacatcgacctaccggtcaccttcggtggacccgccaacttccgcacggagcgggtgagcttcgatgtggcggacctcagtctgccctacaacgcggtcctagggaggccagcgttggtgaagttcatggcggcggtccactacgcctacctccagatgaagatgccgggccccggtggccccatctctgtccatggcgatcttaaagtcgcgctcgcttgcatggagcagcgcaccgaccgcctcgctgctgcgtccaagcccgagggtggtgacgagaggcttggcccctctgcccccaccgccccgaggcagcggattgccacatacgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatagtcgactccactgcggggtgcgaccttttgtgttttctagatgcatactctggttaccatcagatccgcatggctagggaggatgaggaaaaaactgcgttcattacccctgtaggaacctattgttatacatcaatgcccttcgggttaaagaatgcaggtcctacttttcaacgaactactcgaatttctttgggtagccaaataggacgtaatgttgaggcttatgtcgatgacttggttgtaaaaacgcgcaaccaagaaactttacttttagatctagcggaaacttttgagaacctccgctccgcccgcataaagctgaaccccgataagtgtgtgtttggtgtacctgcgggcaagcttctcgggttcttggtctctgcccgaggcattgaggccaaccccgagaagattcgagctatcgagcggatccgcccccccagcaaacttagggatgtgcagtgcgtcactggttgcatggccgccctaagtcgtttcatatcgaggctgggagagaaggcgcttcccttatttaagctcctcaagcgttcggggccgttcacttggacggaggaagctgaacatgcccttactcagttaaaggcatatctcagctctcccccggttctagtcgccccggagccaaatgagcccctgctactttacttagcggcgaccccccaagtagttagtgcagcgttggttgtggagcgcgatgaggacaatcctcattctgcgcacccccactctgtgccgacttggcccgggagcaggcagggaggagaggcccccgagtcgaacggtggcctaaggcccctgacgaccggagtcggccctctgcccgcttgtcaaacggtgctgagtgcccccgaccctcaggaaggccccgaggccactgagggaaggccgcacttatcgccctttggccccgaggctaaccctgtgctgattcgacccgggagagagcagggagaagaggcccccgagtcgaacggaggcctgaggcccctgacgaccggagctggccctttgctcgcttgtctgacgacgccaggagcccccgacccccaggacggccccgaggccactgtgggaaggccgctcctgtcgtcctccgaccccgaggtcatcggcacagaagacgagtgtgccccgaggggccacttggacgaagagcaccccggggatacggcccctagcgaagaggatcggccccgccgaaaggtgcagcggcctgtttactttgttagtgaggccctccgggacgccaagacccgatacccacaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatccccgaggccagcgcggacccctcacagctgcctcacgccgcccactgggtgatgcaattcgacggttctttgtctcttcagggcgccggtgcaggggttacgttgacctctccaaacggagacgtcctcagatacttggtccgtctcgactttcgagcgactaataatatggcagagtacgagggactccttgccggactcagggtggcagccgggctggggatccgccgcctcctggtgttaggcgactctcagctggttgttaaccaagtctgtaaggagtaccggtgctctgacccgcagatggacgcctacgtgcgccaagtacggcgtatggagcgccattttgacgggatagagcttcggcatgtgcccagacgggataacatgatagccgacgaactctcacggctcgcatcctcgcgaacccagaccccaccgggcgcctttgaagaaaggcttacccagccgtcggcgcgacccgaccccttaggggagacggatgcgcctgaccggcccccgaggcccgtcggagtccaggcctcgggacctgaagggagcgctccaagctcccttagattgattgcttggatctctgagatccaaacatacctcacagataagactctacctgaggaccgcgaagggagtgaacgcgtacaacgcatttccaaacgctacgtgttggtagaagggaccctctatcggcgcgcggctaacggaatcctcctgaagtgcattcctcaggaacaaggcgttgagcttcttgctgacatccatgagggcgagtgcggagcccattccgcctcgcgtaccctggttggcaaggcctttcgtcaaggattttattggccgacagctctcaatgatgcagtcgatctggtccggcgatgcagagcgtgtcagttccacgccaggcaaatccatcagccggcccaggccctgcaggtcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaattcattaagggcatcacggcccgttttggggtgcctaaccgtattattacggataatggcacccaattcactagtgaactcttcggcgactactgcgaagacatgggcatcaagctctgcttcgcctcacctgcccaccccaggagcaatggccaagtggagcgcgccaatgcagaaatccttaaaggcctcaaaaccaagaccttcaacattctcaagaagcacggcgattcatggatcgaggagttgccagtggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggtgtcccccggccgggctcggtacggctggccacgggcgacggcacggagctgccaaacccgtggaacatcgaacaccttcgtcgcttctacccctgaagggggggtcgggtgtcaggttctggctcgggccaaccccgcacccccctcgggtgtgcaggatcggccgggggctaccacacatgcacatatattcctttttccttcatttcagcatttcaataaaaacgttttcaatttcctaaaggttgtgtctgtgccgtttttccttctgaagaatcttaacttgagataaagtcattcgtgctcaaccttgccctcgggggctcggttcggtcagctaaaatcgccaaccggggcccagaaccgagccgtgccccggggcgtggtgaactccgggggggaatcggcaaaaacccacaatcgggtcacccatacccctcggtcaccacgttcccggcctggccagtctcgacatgtggatctccccaggcactagcccgacccgagccattcgaggactgggacttgggcacgggcccttatttcaagctaaggcgcaaaaggaccatggcacagatcatcctcatctcgtatgtatagcaaaataaaactaacacaaaaattttttttcatcatttctgattgcagattaagttaatttgtacaaaaaagaggcatgaaggccttagaagaaagaaaaagaaaaaagattggcgggggcctgggggctcattctgacgcgcccgggtcgccggcctcgtcgccaccatcgtcctcaccgctggcatcgccctcctcgtcggagctgggggcgaacgcgagccgaggggccgagccctcgaagccgttgacgatgtggtcggcggcatcccggacgcgcgcgcgtgcatcgtcctcggtcccgggagggaactcctccagcgccatccatggggagaagttggggtcccgggcctggtaactcgctagcacgagttcgaccgccccccgggcgaggtccctcaaggatgacttaatggtcttctcgagctcctcggggagttgttcgaggacccaggccatcctgttgaggtgcggagcgaggccttccaggttggcggggcgcatcctcgtctggcctttccagaggcccgcttgccgaccggcgcgatccatgcgggagaccgagtcccaaagcatgtcgggccccatctcgcccgccaagcggagggcctcggcctccccgatggaggaatctagtgcgcgctgcatgtcagcgacggtgtgttcggcagccgcgaggcgagcggctaagtcgctttcgcccgcagccgccccaccgacgcgcgcccttgcgtccagctctttttcccgcgcctcgaggtcggcagcccgctgctccagtgcggctctctcggcgcggacgcattccagattgcggagcgcctgctcctcctgcgctgcctcgcggagggacaggctgtccgccagccgtttggtcgtggcctcagcctcctcgagagctcgctcccgctcagcgagtgcgtcctcgcggaggcggagcgtgcactcctcctcggcgcaggcggcctcgtgcgccgccagcgtcgcctcccggagaacagcggcggcctcgcggtccgtcaagcccctctccacggcgccggcgtgttcttccagcgccatggcacgggcctcaagagcctcctcgcgccgccgagacgccgcttcagtctccgttacccgccgctctcgggcagcggcggagtcaaggaccccttgggcggcgtcgagctttttcttcagctccgcctcccagcttgcgtgctgaaggcggagggtgtcttgcgcctcgatcatcgcggtggtggcgatgagggcggccgcccgctcctcctccacctcacgggcgatctctgccagcgccgctttccgggcttcaagctccgagacatgacggcggtgagccttacggcccacctccaccatggcgtccaccgagcgccgcccctcctcaacacgcgcccatgcggcctcgagctccgctcgttccgcacgcagggcctccacttgggcgttgaacccatccagcactgcggtgtttgcggcggccagggcctgcagaaggggctcggcgctcagcggggcgacagaagatgaggagaagagccgccttggagaaaatgcgacgcggcttggccccccggaggatgcgctgggctcggggatgtcccccgggcccgtttggtcctgggcgtcgcccggtgaggtaggcccaggcgatgcgcccgcggcctcgtcgcgagccgcttcggaggatgtcgcctgagggccgcccgagggagtgggcccaagtgacgcgccagcagcggctgtcgcctcagcctggcgagcccgggcggcctcctcccgggcagcttcttcggcttggcgagcccgggcggcctcctcccgagcagcttcctccgcttggcgaacccgggcggcctcccgggcggcctcttccgcttcccgaaggcgatctgcggcttcacgccggtcagattctcgcctccgctcctctgcggccgctggatcctcggcctcggactggccggacttggagtgacgggaggaatgcgacgggacatcgctgaaacagaagaaaaaaccagaagacgaacaaaatgagtaagaaaaaacttctttttgggagaaagatggttgcaatgagagtgagacgaacctgcgagggggtcggttgaatgaccaccttggaggggaaatcaggtttccccggcatggttccgtctcccccgttttgcggagccgtttcttcttgcgctccccctcgggctgcgacgtcggcgcggccccctccgggcgccgactgctggcacgcgccgccccgccccctcggggaggagatgggggaggtgttcctcccagcttcctcttcccctgggcgtcggcagggcggctgctccccgagcccccgacgcggggcccagaagcacgaccccctcctggggcagattgttccccccggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccgcggagctaagattcagcaccctttggaccacgatcttgaagtcctcgggagcccaatcccatctggctccctggtgggtccgcatgtaatcttcaggcccagtgtactcccaggcgctccgggcgcgtcgttggagcggcgcaatccggcgacggaggtaatcgccgtacaccatggccccggtgagcccctgggatcgcaggccagccaggcggtcgaggacggcgtcgtagtcctcccccagatctaccgtcgcccgccagctggagacctgcgccgggggctggcttggaagtcggaggcgcgcttcgttggcgaggggggtgtagaaccagtcgctcttccagtcgtcccacttcttgcggaggacgcaggggatgtagcggttcaacaccggcccccgcggctggaagtagcagccgccaaccaccgacggcggtgacaccgactgcacggtgaaaaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaatgagaaaatggcgggaccagcccagccatcgcgaaggggaggaagaagatggaccgccccgggtagtctggtgccgggcgcccctcgcccagcatcactatctcccgaccggtggcggactccggcatgaagcggcgcggcagtccggcgtgcctctcgttcacgatgcgggaaggcggtagtacactgccgtcgagcagagcagagccccgtgccatggcggtggaggaagagatgattgagaacgagcgcgtgtggcgaaagtagggcgtagcagagaaagagttagagctcaggcggcgaaggcaagaggaacaatggcaaaaggaagggagcaaatccttttctcgatgcttttatacccttgccatcgctgggcctggctcctcgtttctcgcgcccactatctcgctccctcgtatctcgctatctcgctccctcgtttctcgtgcccacgtttccactaatcccattcgcccgcttacggcgcgtgaagtggatatgcggttgtggcaatcgaaatggattgtatcgtgcgcgcgttaattacgctcgccgaccgaagcggcgttaccgtatctccgggcgagacagatctgctcacccagattcgcgcgctgctcaagtggtgtggcagtcttgaatagaccgcccattatggacaaccaaagttatcaataccaatgtgcatggattgagaccgttgggtattttgcccagctacggaaaccggtcccacctgtcaccaggctttaggggtggcgtcacacctgaccgcttcccttgggaagggaaattgctctggcataacgccgggggctactgtcggtgatatgggaccgggagtatcatggccagaggcttgaggcagacgcaatcgcccacgtggcctggcaccttcggggacgtcgggcccgagggtgaggtgtccgccctcctcctgatctcccccgagggggggtcgggttgcgcttgccccggccccgagggccgaggcaccccgaccccttaaggacgtctgcgccacatatatgggataagtgagcacagctgtgctcacctaacagcatttattgcagtctggtcaagcgtgtcacgctgcatgcaacgcagcacagcgcgttcctttatccggtctgtgaccagtcacagaccggtcagatcacgggttaggtggcgactgacgggctgacgcacgctttgccccgtcccgtcaagacgaaagcctctaggcactcgtctcaagccggagctagcgtgttatctcttagagataacacgttagccctggtcagatttataccaggcttcatcctaaccattacaggcaaggtgttacacaaagaagggcgaacatgcatgttgttaagctgacgcgtggtggacaagaatgaccggtctggcactggtcgcgtcagctacgggcagccacgatcccacgttgcgcctgtctccgccgggagtggaggtaggtgtgggctgtcccatcggagtgtcattcggacagcaatcataccaatctccgtccataaagagaagaaaagtccagtttggaaagggaagggtgcatgtggtatccccttgaagtataaaaggaggaccttgcccatagagaagtggttggttgattcttttccagattgagagctgagaacgggggagaagtcgactcacactttgtagctcattcatacacaaatccacaaaaacacaggagtagggtattacgcttcgcagcggcccgaacctgtatacatcgccgtgtctcgtgtgtcttgcgggcgagtgatctttccacagacagagagagtgagagagcttgggattgcaccctaagcccctggtcgaaccggcaaaggggggcttgcgcagtctcccggtgaggggccacgagctccgtcaacgtcatccgtgtatgagtcggtttttaagttcgcttgcttttggaaatacatatttatatttgagttggtttttaagatcgttcacttttggtaatactgaaggaatcatataagaaatctgtttaaaaaaactcacatgctaactcgagacgattagacttctaactgtaactcataattttctaaaaaaatatatatccaagcgaactccccgcgataaatttcatcttaactaaaccatacaacagattaaaatagacttcacccattgcaacgcacgggtattttttttctagttttttaagaaatttatcttgggtcaaaaatatattttttctataaatttcatcaaacttgaagcagtttgattttgacaaaatcaaaacatcttataacctaaaacggagcgagtatattacaagattagacagtacgtatactccactgaatcggccagtagtagtatgtcatcgatcgatcgtgtcctgttgcatgcgtctgccgtgttctggtttctggtaggacgaactagattctatcaaatcgaatcgatcaaaggcaaattaaaggcatgcatgggacggcgtgaagtatgtactgtagaggtagaggcgtatccggccggccgggtggtcctagaaagccgtggtacaatgcaggcagccatagccgggcacgcaatgcatactgcagcccggcaaatcagtggcagtaggctgcaactgcaagcaaagcaagttcgtactactggctgcatcgtgtaatactccctccgttttatattaaaattcgtttgattttttttatcaaactttattaagtttgattaaactcataaaaaaaatttaggaatatctgaaatatcaaatcagtttttattaaatctaatattaaaatattttgataatatgttttgttttgtgttttgaaaataccactatattttggcacctcccaagctaaagcgcgttgaggtaaccgtgacctctgcgagcatgataagccacaccatggtccccctaccacgggcgttccgtcgcctccaaagtgaaggtttgagaccgctggcaatatatacggcctcatcttttcgcttatgcttatcagtcaaaatttgaattttcaactttaaatttgaagctgattttgagggttttttcatcaaagtttattttttagcctttacttttaggtcgctaataacacgtatataaaagttttattaacgaattacttctcatttacaaatatgctgtttggtttattttacaaataagccaaacaatgagggcgatagtatggcctaagtgttggagcggctacagtctagctagtacgatgggtaggcatgcagcagtgagcaagccatggctgcctcctactggccggccaagccagccatcctgcagcctagtactacttggtagctagttcctcctagtagagtagtactccgtagtacaagtatagtagcaggatgaggcagagaggccgggcgtgcgtgttgcaatgcaatgcattgggtgttttggtgcgtgcgtcgccggggaggggatcgatggtggatgaactggcatggcatcatcgatcacacctgtgccggccggccggagctagcgagcgatcgagcgaagacgaagagagaaagtgagagagattcctcagcatgattgtgtcgtggaaggaaggaacaagcatgcatgcaacccacaacccaagctgcaatattgcatgttcatcgtactacataggagtacagaccagtagtactaccctgctttgcttgctgcatgtcgcacatcgaccatctatctgtctctgctactgctacactcctactcctactccgcgatcgatccatcggtgtggcttggccgcaccgtcgtcgacccaaccacaaacgaactgtctcgtcctcctcctccatatccgaccatccgtatcagctgttgcctgccgcttcagcagtcgacccacccgccgatcgaccaacctgccactgctgactaaccgcgccatgtcctgctcgcaggcctcaccctctttttttttcacaaaagccttggggatcgatatttattatatatctatatcttacaactgctgacgcagattatggggattacagaggaaaggaagaatacgctagattgaaagacaatcatattgcactcctggaaacaacaagtaaacaaaaggagaaagagcttatgtctaagcatcaggaaaaactcctaggagactaaggctgtgttcgggcatccttgtacttacccatccggaacagtaatcacagaaaatagagtggtctattagcgcttgattaattaagtattagctatttttttaaaaaaaaagattaatttgatttttttaaaagtaactttcatataaaaatatttttttttgcaaaaaacgcaccgtttagcagattgaaaagcgtgcgcgtaaaaatcgagggagtgaggttgggaaaaagggtgccaaacacaggctaagggcacccacaatggttatctataagctctctacaagagatccatgtcagcatatctattatataattaaaggaatagaaaaaggagccttcacgttcgctctcatggcctagaaattctcacattaatcggagaaaaagaaaaaacagagtccatatagaaatacaatttacaaatagctgaaattcggaattaaaaataaggaatattagaagaggggactagagtccatatagaaatacaatttacaaatagctgaaattcggaattaaaaaataaggaatattagaagaggagactagagtccatatagaaatacaattagaaaatacctgaaattcggaattaaaaataagaaatattagaagtagagtatagactccatatagaaatacaattaggaaataactgaaattcggaattaaaaataaggaatattagaagtagactatatagtccatatagaaatacaattaggaaaaaatagaaattcagaattaaatatataatttaaggaatagaaaaaggagcctccacgttcgctctcatggcctagaaattctcacattaatcggagaaaaagaaaatacagagtccatatagaaatacaatttaaaaatagctgaaattcggaattaaaaataagaaatattagaagaggagactagagtccatatagaaatacaatttacaaagaaatttggaattaaatatataattaaaggaatagaaaaaggaacctccaagttcgctctcatggcctagaaattctcacattaatcggagaaaaagaaaagacagagtccatatagaaatacaatttaaaaatagctgaaattcggaattaaaaaataaggaatattagaagaggagactagagtccatatagaaatacaatttagaaatagttgaaattcagaattaaaaaaaggaatattagaagaggagactagagtccgtctatatagaaatacaattaggaaataactgaaattcggaatgaaaaaaaggaatattagaagaggagactagagtccatatagaaatacaattaggaaataactgaaattcagaattaaaaaaaaagaaatatgagaagtagagtatagagttcatatagaaatacaattaggaaataactgaaattcggaattaaaaataaggaatattagaagtagagtatagagtacatatagaaatacaattaggaaataatataaattcggaattaaaaataaggaatattagaagtaaagtatagagtatatatagaaatacaatttagaaaaaaaaatagaaattcggaattaaaaaaataaggaatattagaagtagagtatagagtccatataggaatttaaaactaactaaaatttggaataaacataataaaattaaaagtagagtttagagtctgtataaaaatacaatttacaaataactaaaattcaaaattaagaaaaacattggaagaagaatttaaggtcaatataggaatacaaatattggaatataatttagaagcaactgaaattcgaaattaaaaattaaagaatattgaaagatgagtttagagtccacatagaaatacaattagaaataataaaaattcataaataaaaatgaattaaaaaaagaaatattaaaagacgagtctagagtccatataggaatatatataatttacaaataactaaaatttgatattaaaaataattaataactaacacgtatataaaatataatataaatattacacattagtagttttgtaaagttattgcaaaatttaaaattatgttgtcattttaatatatttgaataatataatgagaaaacatatatgctattatatgagagaaaatataatgatgctagccgcgcaatctgcgcgggccactatgcttgttttcctaattggaagagattaaatgaagagagagagagcaaagctatctactaacatggagatagtctatagagaaaaaagaggcaatggattagagagctatagatacccatgtagacataccattgaaatggtttactattaatctagtctattgttgaggtgtacatgttttatagatagcaccttactttaccattgcgggtgctctaagagcatgtacaataagctgactcagcatgctccaaaacattttatattatctaaatcctacgtggaagaaagagaattgaagagagaaggaagcgagcgaccattctgtcgccagcgctagctgcatgtgcctgcgcgcttccgaataaaaaatacgctttgcggaccccacaaccaaaccgtctgatcccctgtatgttcccatcttcatgcctgctttttctcttccgctccgtcgaatgctaggcgaaatctccgccgcgccaccaaactgcgtcgctcacctcatctgtgttatttttaaaccgcaccaacccaaagcttcccctttcttacatgattcgatcaacccccgtgttcgccgcccttatggacacgagcgttcctttctaacctgacctcaattgtcaacgcccgataaaaccgtgaatcgatttatactgtaagtgctaaccactagcagagcttcaagattttataactaggccgacaagtatttgtgtcgagaattatattttcaggttatataaaagggcattatagttcgtcgtgtcgttacataataatggcataatataaggtgtgtattagatgtaatatataccaagtagataacggatctagtaccaaatgtactaggttgtaacatctccgcccagggcttaataggattgataggatactcatatcaacaatttgtaacttctttttcagaagccgatctcgaaagaacataggttaagcgtgcttggttgcagaaaagacttgtgttggtctgtgagggcagtctatggcctatgaaagttgccagatgtaagcgggcccaggccggtctgcgagaggcgggacgttgcacaggcctcaggtgttgggtacataaactctccgtccctaaatatttgacgccattaacttttttaaacatgttggaccattcgtcttttttaaaaaatttaagtaattattaattatattcctatcatttgattcattgttaaatatatacttttatgtatacatatagttttacatatttcaaaagagtttttaataagacgaacgatcaaacatgtttaaaaaattcaacggtgttaaatatttagggatggagggagtatttaccaactattacaaacaacagatccacgattagaaaaggaggtgcatgcgcatgcaatatattgcatatgcactcggtgtgaaatggcctacgtgcatcagtaatgatgcagctaatgtccgatcaatcgtactaaaagaacatcaaacactcgatggatgcctgccatgcaacctaggcatattcatcaatggcaagtgcaagtgcaaagctagctgctgccgctgccgctgcacacgctccactcaaaacaaatcatagcgtgatgcagaggcctatctactgtgcgcacacgagtaattataagtgctcggattactgtctctctctccgaccatgcatgctgttcctcaatagccgctccatctcctcattagaaaatctctttttttttaatatatactactaccatttcatattgggttattgtattttatattatagacaacttgtctattatttcctccgtcctataaaaaaccaacctagtatcagatatagaccacgaatctagttatatatctatccagatttgtagtactatgatgtgtctcattcggtactatattcgtttttcatgaggcggatgggagtatctcataaaatatacgcgcaccaagataacattaatttgaatattcttctttatctgttggatatataggcctaatgggagaacgtccacgcacggtctagatgtatgcaaacacattcggcttggcctacatgtttctgaccctttgccctgaaacgtttttacataataattttatactataagctttttaatatagaatcattctatataaaattatttaaatccaatcagtattagagcaggtacaatagcaagctataagccagctgcaaacatattttaaggagataaataaggagagagaagagcagcgggctacagatttatagccagctgtagcatggactcaaagacacagtgtttgtatgacaggtgggaccaggtattaatagtgtagtatgtaactattgtatgaatgagctattagattggctatggatgaattgaatctataaaatcgaactttcagtgcattaacttacaagaagatcgaggaaattaatgatgtggcggaaaaagaaaaacacgagcattcgtgattcgtgtgtggcccggacaggcgaacattccggcactagcccttaatttcgatcttgtggttaaagtttgttatggagatcgtgttgacacttgacagagtggcctaattggtttcttatgctgcagtgagagcgttaacattgatgtatggctgacacatagcacctgatcattaagcaatggtgggcccttcattacagataaaacgccccctaatttctgcattgaaatgaagtgaaattgactaggtactagagtatatgatccatcatcataatagccatgcacctgtgttttgagtgtgtgtaataataacatctatggcactgccactaatacttgttcaattcatagctaatctgtagaggtttttcaagtctgaactgagattactttggagcacttacaaaactagagaatcaatcgatgctctcttttttttaatcaaggatgtttatacaaaggccaacactagaaacaacaacgttaatatagatagacaaaatgcaaattattgatggagctggatataattcagagcagaggattcttgtgcagcgagacaggggtaatccctagcgataacttatatagaaatttgatggataaagaaatatagtagtacatacatacagtctacagaagaagagaagagataagaaaagaaatgaaaagaaaaagaagaaagtagaaaagcagagtccgtggagcagagagaagagcaggacagagttaatagttatcacgcggtaaattaattaagagcgggacagagttaagagcgggacacgcggtaaattaattaagattatgataattttgaataggacgaatgggcttgcgttgcatcgctggcgaatggcgatggccggccacgcttgcagctcgagtaaccttagctatcactctgctagctactcctacgccggctcctccttccgtcgcatagtataacaatttgatattgaatgaaatattttacagtacaataaatcttaacacttttttacccagatttattgtacggtaaaattttttatttaattgtataagttgctatattataggacggaggaaatagtacagcagtgagtagctaggagtacaaacttaattactagattaagtagcgataaatgaatatccaggtccagttccaggggaggggacgacgcgcactcctttctccagctgcgcgcgcgcatgcgctgtgctttaactctctcacaagacaacctaacctaaagcaagctaagctagctcctacagggagtatatagcacgccggccttgcacttgcacctcacctcgcctcccttgtatatatacactcactagtacactagtagccggccggccggcgagcgagagaggtcgagtcgagagagatcgatcgagcgagagctacctagctagctaggctataggcctgcacacacatacagctagctagctagcgcgctcgagacgatgctggcctgcatcgcctgcgtcaagcaggaagatggcggccgccgccaggacacgccgcgcgccggcgccggcgccggggacgacacgcccacctgcagggaccccgtcaagacgctcacctcccaggttaatttcttacttaatttattactactataccttcatttttctccttcctttttgtttgctgctgctgcttcttcttcttcttgttgttgttcttgttgcaaccggccgggctaccttgcttgcattgcatcttgtttgccatcgatctgcactccagcttattttcgatcgatactatcatctgttacttaaccatctgcaccaccgtaccatccattactttcttgaggctaccgatcgagctttaattaatttattaattattagctgcgcaatatataaataatacatatatatatatatatatatatatatatatatatatatatatatatatatatatatatgtgcaagttttttttctatataaatatacactattaattagccacactatatgctcagtgtattactagtagcacatcgatcgatctgccgatcgaggatttgatcacggcacatagagggttgttatgacacccggcacttaactccgatcctgtaccatcgattccttcaattataatcgggtagtactgtcttaattcataattaaataaataaaataaaattactagtaaatgctaactgagtacgtacgtactcagggtcagagatgcgtactacgcacatatatgtgcagtatatacatgtacgtatatggcgttcgcgaaaaaaacttagtacgtactgtatatatatacatataaagtattcgatgatttcaccaatccaacacaacgtacaatataatagtacctgcagatgttgtactcctacgtaatgagtagtgtttagaacttattaatttactactactacgtcactagctagatcgattgatttggccttatatatgtactcctacgtgtttgaaggttctctagcactacttacatactcgagactgattaatttcaaaactttacatcgtttgtttcactgtttggacggtagagtttgctatatatatacacctagcttttcctcttgcttttttatatgatacacgcaaggcaattaatatcagagtcttatactctctccgtactcgtaaagaaactcgtttaggacaatgtttaagtcaaacctttaaaatataaatcattaataactctcaagttgttgagtttgaaaatgtaaaaattatatgaatagatttgtcttgaaaaatacttccataaaagaatacatatatcactttccaataaatatttttatagaaataagaagttaaagttgtgttttggagaccgtgaagctgttcaaaatgacttctttttttttaagtacggagggagtatatatatagaagaactaggtagatagagtccccaattaattgcattacggtagtaattaactgacaaaaagtgagtgagagagatgaagctgcagctacataaattaatggacatgatgatgaggacggaaacgataataataatacagttaagcaaagtgtgatgctgcgagcagagcagtaatgatcgagagaggatgagtggctggtcggccggccggagatcagagggcgtgcccgtgcagtcgctttcgattgagcaatatatatatatatatatatatatatatatatatatatatatatatatatatatatatatatatatatatatatatatatatatatgcgcgttgccatcctctctcttaagtttactatatgccctaattaattactagcttaataatgtttttatacaaccggaatatatacccctctattctaaaaatacttatatttttgaatggatgaagtagtgcatagtaggttaataataatgccagtgtaagaagcaaccagaggtattaccaaacaagagagaagactgacagtacagcaagactacaagagagacgactgaccattgtctcgcttggcacgtcttccgaggcgtacgtaggggcccaccaaccctacccagggcatggatgatggatgcgagcgggcgtgtacggtggatgcgtggcccacgtgtcggaatcatggcagctcaagctgatgctgctgctgataataacagcatacgctgctgcttttcgcagcttcattgctttggctgctgcatgcatgagactgtacatgatacagatgatgcagtactagcaaaacacaaaagccaggcgccaatcccgatccatcatccgatctccatcgatccatcgatcaatcgacctaccttactagtattgcattgcagctagctactaatttactgtaggatcgatcgagtaacaactgtgatccatggccggccgtgggctccattgctcccagcagctgcctccttctgctacctcagctcatcgatcgaccaacagcatgcagacatcgatcgatcagatgtctgcaagcttcaacagatgaagctgctaattaactattagcgccaaccttaattaaatagtagtagctacctaatcagtccaacgtcgtccatgtatctctatcacttttctcttttcttctttaatcgatcgatcgatcggatgaatactatagtatactaacacctggtggccggtcatctgccaaaaagaaacgcatctcacttctctccatctctttcggcgaattgaagctttagctgagcatgacactgacgctagctagctatctttgtgccaaagtcgatcaattcttctttctcttttctctttttgttattattatgcttgtctactagaaacagaatactggaagctcacctgatcaatcatccggccagtacctgcctttaacttcaaagcaagtttcgcgccttttttgccccggcctcttcacgaccgttgttgcatgatccatcgccatttcaccaatgctttcccagctctcccaatctgaaacttttcagagtagcatatcacaagttagcttgcagtagatgcctgattcaatttaaccaatcacccgtttcacccatctgatcaaactaatccatgctttggcatcaatgtgaaaccagaaaagatgtgccccatttagtcctgatcaacatttgttttcacatttggacttgctttgaatccaatgttttcacatccatactttctgtaaggataataccgctaccggtctaccatatgaaaatctgaaattagatcagataggactagatatattgtttttaattagctattcccatagatgtagcagccagatggacactgcacttcatattatttaagctaactgaacacagttactaatatttgagtgatgtggatacagttagttagatactgtatatatgttcaaactgaaactgaagcgggcaacgagatggtcaaaatgaggggacaggtagcgtagtgtaggctgtggctgccctggttggtggatgatcacctttcactttgtgtcgtttccttggggagagatcctggaacaaattaaagcaaagcacatagtatgcgtcatctacatatgtctattgtttctttctttcattcctcccccacaaagagtggccatggactattcccttgttcttttgtgacaaagaagctttgtgccccaacttcccatagctatgtgtccatgtcttttgcttctcattttctctcttttttcaacaccaaagtatatgtagtataaggtatgctcagagcttcagatgagatattgatataaggatggggctccagcatgctttctttctcaaaaggagagattgagagagtggcactagtgcactgcaatgcaaataaagagatcccctggttggatggatggatggggatgttgcactgcatctgcattgctgcttgcatgcttcagttgttatcagtagcacggcaagaatctatgtgcggggatgttcattgtactagtacatgtttttaacaataacaatacataaaagagaccagtcctaaagtgatgcttgatatcatgaaaggggaaaacaaactgtagatgaaacatacaggcgcatggacagtagtggctagtaatggagttaaatagctaggaagaaaatgtaaatatagtatatacttgtatgagataaaaacatacatatccttgtttcaggttgtgctgctttatatatttacctcatggtagaataagaatttactaccacttactgtgtgaagtgtggaacaggtcgtatttactttcttcttcagtcttgatgaggtagcaatgcaagatggcattgtgcagtctgagctgaataaagattacaaattgattggctataggtcaaatagtggatcctagagtgtaagatagtctttgaaaatgtcattccctgacccctaaaggggaagcagcttcattatctagcattcatatttgaccggagccttcaatggattcactagctgcactgccaatagtaccccaatataaaatcgcccatttgaatgctgcagacagatttgtcgacaactagtggctattagtgcagatagttgcaagatgatgcgttaagcaataacttactagtagctattagctctagacctctagtttccagaaattctggttgtagaaccaaataccttgacaataatgcagataggaacatggatgatatactaggtagtaggactagtacctggcccaaagctgcagtcgtatgaatgagtccaaatcaagagctgaacttccctggaaatcagccagttggaagagtatacaacttattcagcaaatcatgatgccttttaagttgtaaccaagagtaatgcatccagatggaagcttaatgactgacacatacccagaatgagcacaaatgcgtcctgaattatgattcaatatattcagcaaaccatgatccaggtataatcttaacggaaggaaataacatccagaatcagcacaaatgtatgattcattatagttcttttcaggactataatgtgatcgaatagcacaagttcgatttgcattgcttggagaaagcgtttacaatttcttttactacttgttttacctgcagtgtagctatctgctgaatgcagaggcaaccatcaagggctaaatatctcatttcaatgcacctaatgaaccctgatgaagttgacgcaatgtcattttcgtcatcataggacaaaatcttgcatctgatcacattgatatttaagtatcatcctagtgttgatcatcgatgatcccatgaatccaattaggagatgatggatgatggatcatcaaaaattaaatgtgttattaattgttggtgtatgcagctcaaggacatggtgatgaagctgtccggcacgagccgtcatcacggtcagcagaggcgtggcgggtcgccgccgccgaggggccggacgacgtcggtgtaccggagcgggtactaccggccgggcatggtccaggacgacatggcggtgccgccggcgacgtacctgggcggcggcgggacgtcgatgagctcggcgagctcgacgccggcgtgggacttcgcgcggccggcggagggcgaggctcgggagtgggtggcgcaggtggagcccggggtgcagatcacgttcgtgtccctcgccggcggcggcggcaacgacctgaaacgcatcaggttcagccgggagatgtacgacaagtggcaggcgcagaagtggtggggcgagaacaacgagcggatcatggagctctacaacgtccgccgcttcagccgccaggtcctccccacgccgccgcgctccgacgacggcgaggtcacttcacttgttctttcctgactactactagtacaaatgtcatggtccccatgcatgatgtggccggcgaggcggcgacaaggcaacagcacacggccacgacggcgacgttgcctagcctagcctgtcccgttcttggcttggcatcatgcagtgatagatgctgatacgttcttgcctgcatctgcaactctgcatatggcgatgcttttacagaatattgctttcgtcgttgctagctagtagcttgcatcaaaagatgcaacgacgatttgctagctgctgctagtgctgcagagtgcagagcatgcatgcaacgattaaagctggtgatctatggatatcatattcatatatggccatttctctctctctctctctgcatttgcatgaattaaaattaattatttgagcagagggaatcgttctactctcaagtggggtcgacgagggggagccccgccgccacgccgtcgccggcgccgctcaccccggaccgcgtcaccagctggagcgccttcgtccggccgccgtcggcctcgcgccagcagcagcagcacagcttccggccgctgtcgccgccgccgccgtcgtcgtccaacccgtcggagcgggcctggcagcagcagcagcagccgcagcgcgctggcaagagccccgcggcggcgtcggacgccatggacgcggcgagaacgaccagctgctcgtcgagggacgaggtgtccatcagcaacgccagcgagctggaggtgacggagtgggtcatacaggacgagcccggcgtctacatcaccgtcagggagctcgccgacggcaccagggagctccgccgcgtccgtttcaggtcacaaccttcatttttctactactctagctacctatccctgatgtagtatctattaattacttcctgaatgatcagatgatctgctaattactatagatgattgattaaatgcgtttttgagtattgctgatgattttgttcttgcagccgggagaggtttgcagagctgaatgctaagctatggtgggaggagaacaaggagaggatacaggcgcagtacctctagatgatcactttgcattattggtaaatctgggaattactactagctaagctacaagttggatgcttccattttgcaaggaggaattaaactacataaagtttattttacaagtaaatagagtttgtgttccaagttggagctgggaaagattaagataggaggtgggaggtgaggggaaaagaaagggaaaagtttagggcattagtacctgccccaggtaatctgtgactggtgtaccataagttccacacatcaacatccttcagctttgttcaatccaatttctcttgagtatgcctagcaacttatttcacagcagaaaaaaatgtgtgcattttcctttcttaatttaccacctgtaaatgcaatatagatatagtgaagctacgaatcacacatgatagtttcatacaacagccaaagtgatccagcatttacaccgcatgttggcccaacgatcaaaaaaattacaatgtacataaatcggtaaatgtaagctagcaagattaatacagactagagcatttatcagaggcataagcataaacctgtacaattactaaccaaatgaactgcggtaatgcacattgacaccgccaactgatcgatgtctatgtgcaaactaatgtagggcatctgtagtacacactgtgaatgctccacttcatgcaagttcgcgcacacccttgtccagtggaatcctcaacagcaatttggataaatgtgaagaaaagtgatctaggacacgaccaatttgtgtcaaaacatgtaaccggcaaggagaggagaaaaactctggataggaagttaaaatagacatcctaaaccaatcttttgtttctcctttggttcaaaagaaatcagtgaaaatatcagtatggtctaagatcacttctcttcataccttccaatgtttgcaagaatacctattaagacccaagggtatctgcgatttcacatgctgaacttcatccatactttacctgatgaagatgaattaatgtgccgaccagagtgctctaagattatcatcgaacagctgatgcgtagggagacaaaaagtactcccttatgcgtgatgccccgtcccttgctaacatgccctcaaggtctcccagaattcttgccaaccaaatctctaggctacgctgaatttccttgaagttgttccgaattgaactcagtgctcttcttgtgctcattttggcttctgctgtcagttcatcaccaaaacttccttttgcagtctctgcttgcagtgcactgagcttctgcctagtttcagttgctcggtgctgaaggtggaatgcttccagcaagtattctgtttgcctctgtgttctaaactctgagctcagtgttgaatcacaggggtcacttgtttgctgagcaaaattccaaataaatagaagttagtagtttcccactcctgctgcagctgtctaatacagataaggacaggaccagtaaaaaagatatcatgcataacaggaaacaatatatcggcatagtgagtgaagtagtgtacattcgttttcagaatttatgaatcaccttaagtgagccagcataatgtcattgagtgaagcacaattttaaccaacatagg

SEQ ID NO: 70485 - DNA, 21578 bp, Oryza sativa
ctttccccacgccgggatcgagctccggggaggggagctgcgagctggtacgtacgcttgatttctttccttgccaccgcgatattccgatgtatccgtgatgtgtcgttcatgggtagatcggctagggatttggcggcgttgaggaaagcgatggctgaggggtggggggaattgttgtattagactctcgaagctgatatctggtgtggatttgcggtggaagccatggtcggaggcccagtgccttccgggagttgttgggttatcgggagcccggagggcagtgcggctcgccgactgctgccatgatccccgtcggcaaaatctccagattgggggagatggggggtaggaaccatttggattagtagtgtatacacggggtttcgtttattatatttagagcgctctacatgtagacagcacacagcagctttaacgtatggatggtgtatcgcagggaatgtatctcgaagacattggattaggctattattacatttagagaaccagattgggtttgcgataactagaaattgagtctgttatgaatttattgatggagcggacagggaattacgattactatctgtttagcttttcagttgtgaatgatgattatttcaatttagctaatcaaggttcctcaatcaaaccgttctaactttttctatttatgctcttggttacattttgacagaaacactttgtcatatcagtcaacagtagagaggagaccagatgcaggtcagttctaattcatctttggttgcacatttcttgtatagttagttaggtatgtaatgtgatggccaactcttaatcaactaattattcgggttatgttttactggtctcactgagacgtccatgctaaggtggtaacatttaataggacaatccacatttggcagcaataactgtactcatcttttcctttagtaaacggtttggcgcctagtatagggctcgcgtgtttgcatggaagagttggcactcggtagttggagagctttgccgacggttaccaatgtgaccagtactggtttttgtacacccatactttcttgtcgtcatacactagcaaaagtttgtgtacatcccttacttttactaatggctcaattatataacttgatttacttcactacaataaaacttataaatgtttggaagatcatgtccaagagactttcagtattattgttaactggaatgagcttaactactactccctccgtttcacaatataagtcattctagcatttcccacatttatattgatgttaatgaatctaggcatatctatctatctagattcattaacattaatatgaatgtgggaaatgctagaatgacttacattgtgaaacggaggaagtatgtgaattgctcctttagtttggttcctaacatgctatctgaatgtcttcaaaatattttctatcgaaaggcatctagagctaggctctttaaggagtataaggaggtgcagcgagaaaagtcagctgatccagatatccagttaatctgcgatgattcaaacatattcaagtggactgctcttatcaaggtggtttttatattgcaacttgcaaggtgatgctagaaacagcaatataagtttttaactaatgccttttctgattgtatatgttgttagggcccttcggagacaccttttgaaggtggtgtatttcaacttgcattctctattcctgagcaataccctctccttcctccgcaagttcgcttcttgaccaaaattttccacccgaatgtgcatttcaaggttacttctgcattgccttctctgcgtacattttactttaggaaatttgacctatttgaaggcatttgtctctttcaagtgttggtgagaatgtaaatatgaagttgctgtcatcttcttcattttatcaggttttcctgtaacaatctgaatgtactaacatgacagaatttactgtgtagactcaactgtgctcttcctgttattgtttttgtcaagtcgcttctatattgttacatctgaattaacagaattgaaggagtaatttcagttatcattctttttaccttgtttgtgtttccagacaggtgagatttgcctggatatcttgaagaatgcgtggagcccagcatggacactacaatccgtttgtagagccataattgcattgatggcccatcctgaaccagacagtccacttaactgtgactcaggtagctccaccttcctactaattctgccacatatagttcagccattattttgtaatgtgaaagtaatagatgttcatgctctcactgaatcaagctatggtgcatgaagatttccatcttcgaggcctcaaccactccatgatgtgatctttttggagtagtttgagacatgaaaatatttggttctaattattgtcacatggtacattagccagttaaaaaatatggagaaaaacttggctatttactctaatggagcccctctatataaccaaaggaattacgtgataattgatatggtcagactccagtatcaccgttgtcctaggcgagggccaatgagtcccaggacgaggctgagtccacctcgggtggcgggtgtgcttgggatgctgattagattagttcgttacattgaaatagtatatctttccaattgttatctcttcccagttagagtccaacttgtaagggccattaaaaggtgtttgctacatcatcgcgagtttcaagttccttgtcctcattctttttatgcctcatagttccatgccgcctactctcctgggaagcctcatcatccacatgtcctaatcttccgcacacaacagaagaaactgatttatgtagttacaatatttaattttgaggcggtcagagaaaccattcctgctgatccattttacgcaatatggattgaataattgccttgtaaatatttcattgttggttattagcatttatactaatgagctaagatgtgcagtgtcacttatattgtatagttcctcattatgaattagaatgtaattttcccagtaaatttgtattggtcccattcaccgcctcacggtttatgtttgagattttttcagatggcactttggtcacattgcatccaaaatatgattatcataggtcaaaattatgaattactgtatttgataacttagggagctcttgtgtaatttcatcatctgatgatcatatacagtttgtcgcttcaagcattttgcaagtccgatttctgattgattatatagcggtttaaattactttttcatactttttacttggttgtttgaaaagaggcctgctgtgatattttaatccttatcttagtttctgctaattttcttccgtaaatataggcaacctcctgcgctcaggcgacatcagaggctatcaatccatggcaagaatgtatactaggttggctgccatgccaaagaaaggttaactccagggtgcaaaaggaaatatgcgccaagcgaaggcatggctgattcatgtgatttgctctgttaagtgtaactcttactgtcaccatgtgaacatctggtacttattttcttacctcactcttatggatgtatgccctggagtgaagagaagaaaaacatgcattgtaatgcttggtctatatgatgtcataaatataactgggttcggtacttctaatgcactgtccattgttcaattacttctcctctttttcctgtccggataaaagaagaatacttgtcctgtatgtttctgaaatcgccatacggctcctataaaacgccaggttagagccgcactactctaatcttctatgatgctgtcacgccgagaattcctttcatatttgctggtgttcagtttaattaacgccgcacacatacagatcacccgttgttgtattgcgagcatcgaaatcaatcaacactatatatgattttattgttatcgattgttccaatcgaatttccactgtgttacatgacttggagtcttggaccaaagaaaagaaaatttcctgatcagttggtatcgctggaaaacaacctagtgggcgcacgacgcccgttcctcgccatcgttgaagaaggcagactgcatgcgagcgactaggggaacgccgtcggaggcatcttcttgtcagccaagaagtggctgaagaggctgagcgcctgcctcggcgcgtgcaggggaacctcgtgcccggcgccgcggatcgtcacgaacgtcaggccctcgtagaggatcgtccatcctccaacctgcataaatggttcagtttgatgctcacaacgacctgtttctgaatatttctttgttgtaggatggtttaattacctgctgatggtcgtaccacggcgtccactcctgcaccgtcttcagcccaagcttgttcagggtgagcctcgtcgacgtcacggggatccttccatcggtgtcaccgctgcacccagtgaaactcattgtcagctcaattcaaacgccatgcatctattgctgtgtacacgttgttcagacatgctgaagtatactacaaggatgtttttttcacctgaaaacccagaccctgatgccgccggcgacgagcttacggatgatggggagagtcgagaagggagcatctctccacttgccgatcacgtcgctgcaacaaacacaccgtcacaaaacgattctgtcaactcaaagcttcaaagactcaaaagagaacagaggttgcaaacgcttattgtttgcacctgcagtgcgtccagttgtagccgatattggtcacgttggcgtgcagcgcctcctgcacgtcagcccggttgaagtacacctcggcgtgatccgacgtgcacggatcgtaccccgccggcctcatgtaccacccatgctgttacaaaatgacaccaaaaaaaaatcatgttgtttcttctctctgaaaaaatgtgatcgttctgtgtgccgatgagttgcctacgcacgtatttggagaagatttttggggcggcgccgtggacggcgacctggcgctggccgaacgccgccgacgacgagacctcggtgcagacgggggtgtagaggctgtacatgtcgatgaggcggtacacggcgaagtactcggtgagcgcgctgtcgcacgcgtcggtcacgttctccatgctgaagttgcagtacttcttgacgtcggcgtacacccggtccgagatgacggcgtggtcccaggcgtagtcgatcatgcccgtctggtccgtctcgtcgtccatcagggcattccctatctgcgtcagagtaatgagacgacgtgatcgaagaaataaaattgtatgagatcagtattagttcgaggcagaattgtgtagctaccatgaaacccttgaagttgatgtagttctccttggggccttgcttgttgccgtcgaaaatcttctccgaaagctgtggaacgtaatgccctgacaataacgcaatccgggaataatgagctcgcatcacgattttttcagaagctagatgctgaagtgtgtatgtgtatcagttcagttaccagcgtagctctctccagcgatgtagaagtcgtgagatttgtactgagggaagcgcttgaaccagttgagcaggaagatgtaagcatcatcagctgcgtgcatggcaatccgagttcagatactgtttggatcatccaaaattgaccccttttttttatcagagtattctgttgttgatgtagaggttaatttaccggtgatcttgtcgccaagctgctgcagatcggagcttgtgttagtgtatgagaagccgacacccacaggggactccaggaacatcagattggcctctgcagatttttaacagtgaacattcagttgtgccaaaaaaaaaaactctgaacccctgttcattgcgaggagtcagtgacagactaacagaatgcagggtttggcatgaacaagcagtacgtgcctttgttccacgagtacttgttccattttagctccggcttgcccttctgcaccaagaatggaccgagctcctccgcttctccatacccaacagacgaacacccaggccctgcagcaaaaacagcaacatttgtcatcctaactcaaacactcagtacacactcctgacgaagaattacacacagggtttttaagctactagctcataatcacgaacgaaaagagagaaaaaaaaaagaaacttcacatgcatggtgaacgtcgaccgttaaaacgttgcagagaccagtagatcagtcgtgtccatcccgcgcgagagacaacgacgcgatcacgagcacgagtacgacacggcacgggtcgccatccagtcataggccacaccacagcggaagcagcagcagccagctagcttagctaatggaccgaattattcgcgcatttctaacgagaaaccgagcttagacacagctcactttcgcgctcccgatccctttccggcgtcctgcctgcctgcacgtgaacgtgatccatctcattcgaccagttcacggcgtgcatgggtgactccgcgcgcggcacagtacgcagccacgcgcgcgcccggtgagatccagcaccgggccaccggcacaggcgcgcacagccgtggcccccgtgggcgctcgcgtaccgtcgtttcagatattttccccggccggcaaggcaggcagggaaggcaagcagcggcagtagtagcttcgatccgttccgtggtggggcgcgcccgcgggttgggctcgatcgggcacgcgaggtggtggccgtgtcacgacgcgcggccggtggtggcgcatgcttttgcttagctggtccccgcccgtgtagcatgcagcagtggccagcggtgtgtagtagcgtacgcctccgcctcagcgcgccactgctcgctatagaagtagcgatgattggtggccggtggcccggtgtgcgcgtccgtcctcctcggtcgcgcgtgaaagcggcgccataccgaccgacccgctttgtttcttgtctccatgtacatgatactacgtggaccgttggtgatacggtgcgtgcgtgcgtgcgtgcggccgtgcgctagcgagcacccccgtgcagtcgtgctccgtatgcctttccgggtcgatgggtacgtacgcgtagtgcggttccaacttccatataggcagaaacagaaggcgacgacgagtgaacttttctacccttttactcttttagtctctggaagcttgctctgagctatatatgtgggtaaaagggaatcggcggcaccaacagctgacggttgttcgtttttcacgtgtacgtttccaaactatatgtacatttttaaaaatattttctgtagaaaagttatttaaaaaaattacgttaattcatttgttaagtttgttttaactaatccttaattattatacgctaatggatcgtttcatattacgtgcgaagagatggaggttgccccaaccttcacctctaaacacagccaacctctttgttgacctttagaattttaagaagtaattggtaaaaaaatttagctggtgagaatctagaaaagctataaattctatctatttattttctaaattatataactacatatttttaaaacctagataaaaattagactatttatgaaaagttttagttttgaaagaaaccgtagctaccataaattcctaaaacaagacctaaacaagcttgttttggtctcctctaaaaatattaaataataggttaatactgcacacaacagggccaagtttcctttaaaaaaaagaacaacaacaacaagaagaagagagcgcaagaacagtaagtgtctctcctaaccactaatcggactttgtcggatggtgtgtaattgttctttcctaacaaatcccaactaacaaccataactacatagaattttcaacgttactaggttctgactgacatatcacagatgcttcgacgccttctgattgagtgcaaccaaaaaactcaactgatgcaagcaagcaaaatgatataagcccccagaccacctctgccactttgcttcagatgctggcaaaaaccgcgcggcttaattcagatcccgatgaggatgtgaattgtgccggaagatcagcttatcgccgggaaacggacacccgcgaggccccattggctgcgtggatctccctttgttcccggagcaagctagctgctagcctggctcgtgttgaccatgccaagcaggattggctatccctctggttgctaccagcaaccagtccaaatgcagaaatccagcagcatttcgttctctagctgctgctgcagctagctcgcatggatcgcgcccatccttctcgatcgaacgggggtattcatgcagtccatatcgtggggggtccccgggcggcttgtcttggaccagctgctaggagagtacgatatgctcttggctggacagcaaatccgtctggctagcgagctagctcatcgatcaagcggatggattcaccggtacgttcgtgaggatgagcaggccacagtgacagtggtggacctcgtcagacttgttctgtgctaacttgaacgtgtatttggctaatttttcaaattggaggtgaatggggctcggtctgtagtataattgaactgggacaaacactgaactcaattcaaaacttaatcctgccttctctatctagtagattaacttatctcatatagcaaaaaactgaggcaccacaaattatactctggaccgtgcaaactttctcctaaagagaacaaactagctagttactttccaacccttcaattttccaactcttcgtctccggcgctttcgactgggacggcgcctcagagcagctacatatgtatgtgtcctctagttgtgttttgttactctcgttctgatttttttctaaagagaaacacggagatgagatgttgacatatgcaacgaataattacaatatgcgctgttggatgagattcattcggatagagtgaacattggagggtttcaggctgagtttgagaaagaggagatagagaagattgggaagatacgtaaaacgaggtgagctattagtgcatgattaattgagtattaattatttcaatttcaaaaatggactaatataattttttaaagcaactttcctatagaaaatttttataaaaaatacaccgtttaatagtttaagaagcgtgacgcggaaaaaaatgtgcattctatctccaatctcccagaacgaacgctgcctcaatcacaggtttttggaagccgttcaggggaacgcccggttttggcctcctaaactagttttagcatctgaaccgttatggtgcagacaatgattttcttttcagattttctgatagtaattttatttttgaagagttttagacaataaattttttgagacaatttacatttttttaaaaaaaggataaaaaagatgaattacatcaccagcctctgcaactaagatacacagccaattgaaggcgacgagttgtagactaactaactaatatttctttttgttacgtaggcttcaatttgcacaggaatattctggccagtttttgtgagcaatagccaattctgaatccggtgatcactgacaatggcgtacctggctcaaagctacggccggagctgggttacgcgtgtggctgaatattgtttggcaatgttatgcaagttggtcaaataaatgtgataagtcgactgtacattagccattgaaagagactctacgcaattaaggtgtactcttttcgttctaaaatataagagattttgggtgaataagatatattctagtattacgaatctgaataggctctctgtccatattcataatattatcatgtgtctcatccaaccaaaatcttttatatattttaagatggagggagtaggagtatgtgactaaagtaggtacttcacttgagttagttataatagcatacagactattactccatgaaactgccaatagtgaattatgctagctggaggacaaccatttgatgggatagcagatggctcctcttttcgcttgaaatgctgattaattgattggttagttgggcatggtgattgtactatgatagacacttgaaacatgcattcacttacgacatgtcacaattcacacatactgatattgtcatctctacccgagcctcttaatcactacgatatcatcaatgtatatatacttcaaaacattaaagaagaaatgtctagtttgagttttagaggtaacgagaagatcacatcttaggattagtcgattagatcattcccagcaacatttttatagaaaacccagtatcatttttgtgctccagaaaacctttaacacccagcgattttaagttcttagggtaattttatcatccttaaaaagatactagacgtactactctttttagtataaaatttgctgtaaaatcttcgtacctccagatactttctcaagaagtaaaaaaattctctcttacgtaaggtaaaaaggtatcatactttttaatattaaagatacctggcacacaaaatttcgcactaaaaataattttagaacatttcggaacttcgaattttccttaaaacactccgttagaaaaaagtgagatcgccattctatcttcattcgtaattaacatcaatataaatataagaaatgttagaatgacttaaattgtgaaacagagggagtgattaataccgagttaatgcgcacacaaattttgtggagcaaaggcaaatggcagttggtggtagaagtggttaattgtgtgtcgagtgctagtattacgtaccgccgttgagccagaggacgaggggcttcttgtcggcggcggcggtggcctcgaagaaccagtagaagagcgcgcggccgtgcgtctcgttcaccgtcacgtacccggcgtactgcgcgaaccgcacggcgggttgccccggcagcctcgtcacgcggtcggcctcctgctgccgcgcggcctccgcgtccagctgaggcgagccgccagcggccgcggcgcagagcgagagcaacgcgagcgcgaggaaggaggaggagacggcggcagcggtagcgccggccattgttgtgtgtggcgcgctgtatagctggtgcctaccgtaccgcgcgctagctgctgccggtgcatcgtcctcggcggattatatatagagagagcaggagcagtgagcacagtttgataatgacaaaatttactaaatacattgtttactatcgacaaaatttgatcaaataacctctttgtgatcgcattgacgacataggaaaaatcctcaattctaacggaggtatatgaccaaatatttaatatactgtaattggaataatattgcaaccgtatcctgcttacggctactccagtagagtttacatagccgaggtgataagtggagcgcttctaaattataaatgaccattcctcaatcctaggatatatgatactccattcgtcccatcttaaatataactattgttttctgcgtctaattttaattgtttatcttattttttttaaaaaaaaattaaaacataagttacgagtaaaatactattgatttttatcatctcataaaaaatactgattataatattttttaaataagacggacgatcaagttgaacacggaaactcatatttacatttaaaatagaacggagggagtagtacaggatgtttgtctgacacaccaacagaatttgggagaaaacgagaaagcaaatctaaaaattaaggcctgggtatgcatgtacgacacatatacacgtaaatggtgccgtatctaaaaatactaatcgaatgaaattgctcccaatcagaaaaaaatacaaaagttggtttattgaggacaacggatcgaaatacatactatgtgtttggtttatttaaactttagtctaatactcaaattaaaaatatcccaatgcttggacttcctgaaactcaattcaaaattgtgtttggtttgaccgagcaggaattttagaagatttttagttgctataattaaaaatacccctatgtttggttttatgtactcttgtgctcactctggttataaatatttagtgtttataacaaagttcgctcatacctttaaaattccgaacaccaataatttctcacatgcttaaatttaaaaactaaataaatggtttaaggttgttattgaatgttcatactaaatatttgttggtgctatctatactacttataaaataacaagttttatacttgattttcatacattttaattctttttttgcgaggtcatattttatttatgtcacactggagtgtcttttttttgctttgattgtcactagttaaagccctttaatgagtacatatcattatttgctttgattgtcaaatactctgtttcatgttgttattgtactctacgtatgatgctcgctgcagttaatcacatactaaattcgttgctgatacgctttttttttctccagagagaatcacatgcagtgctttttcagtaatttgagatatcacagcattttttttatctcgtactgcaaagcaactattgagtggcaagcaaaaattgttcataacttgttttgagggcagtacatattcgaagctgtcatgcagatatcttccgtgcttgtttactaacttcaggagatcataaaagcagtctctgaacttgacgttttgtgggtggatttagcgtgtgcagctaacgagtaagaactgagatcagtgttttttttttctgtgtacaacatgccaaaacattgcatggatgacggaaagaacagtattattttgagattcgaagttctggatgaactttgcgccggcctgacagagctttgccggacaactttggtcttggcttcgtcgttcaaaaaaaaactttggtcttggcttcgctttttgtttcaacttaaattttaagctaaattacagtaagaaggtgtgcgtgtgcgcagtatgctactacatcgttttgtccgtttggaaattacagagaatgcacttccaagctccaggaatcgattcggcatttcggccggcacatgtctttcctgaatgtttttgttttgccaaaactttttttttacagaaaattcgctccctgcaatttaggcaatttggtaaatcttgtactaagacaagcaagtcaggatgcttaattttagagttaattttgatgtttaatttactttttttattggtttttaataagtcgctaaaaacatatatatatatatatatatatatatatatatatatatatatatatatatatatatatatatatatatatataagttacattgataagtcatttttttccattaataagtgtgacggctgatagaaaacgatggagctgttaactgtcaaacttgtattgggaagagtagggccgcatataaaaaaaaattcctaagttatcaccagaaagatgggctatcaagattcaagcaggaagcaaattctgatttggtcaacagaatgtgtttttattctatgtgattagattgaatacatctctctctctcgtattccgtgcaaaggatgatgatattattttttttaaaaaagagagaagtactataattctagatttcttaagatactgcaaataaatatttcttcacaatgtttgtacttcaaaaaaaaaaaaactccacgatgataacctaagaattgcacatatagcgacatcatcactgaaaatgtagcagtttcagttgtgacttgtgggcacaaaccaaaccattcttaaacttaataatgaagcaaaatgtgatttggcctgaatatgtttgttctagatggttaaattcaatactatatctcaaaatgtaggcggtacaagtctactttttatatttgacaattaatacacgtggaaaacatgtaatttggttacatagaaatagtattggccatcattttttttcttgagtaatacttatataccttaatatgctattataaattgtacttctaaaacttcgacaaaaatctaaaacatcctattatttgtaacaggtgaagttcagcaattaaaaacatcccttatgctcgaagcatcaggattctttagtatgttttaaagaaaagttcaagtaagaaattagatattcaaggaagagaaggcacgttaaactaacaagtcaacagctcatctcatatgccggaccatttaggcctggtttaattcccaattttttttccaaaaacgttacattaaatctttgaacacatgcatgtagcattaaatatagatataaacaaaaactaattgcatagtttgtatggaaatcgtgagacgaatcttttaagtctaattagttcatcattagctataagtgctatagtaacccatatgtgctaatgatggtttaattaggctcaaaagattcgtctcgcggtttccaggcgagttatgaaattagttttttcattcgtgtcaaaaaccccttccaacatccggtcaaacatccgatgtgacatctaaaaatttttttttcgcgaattaaacaaggcctgaatcaatcatgatcgtcatcccctcaagaaatctcattagttgttgtcagtatattgcaatatcaagctttgatcaggtggagacaaactccgaccgaaactaatccccaaacactagctttagtacaataatgtgtctcgttgtgctgttgctaacctattttatgtcaacacgttgcgacaaactgacagcaagcttgcttgttctctcaataatttggttttttgttccattcccaaatgagttggcaacttaattaactcgcaggaggatagatacttcctgtaatgataaacttgatttgatgctcttcatcaattgaatattcagctccaacagaaaatgaatattcactattcagcatgttgccaccaatctgaacaagtgatgctcgatgtgaaagcgaaggcacaattgcaaccccaaaataccggggaacaacacaagatttaatcctggagatcataaaatacattggccagctaacttggtggatagtcttcctccgagcaaaatcaaaatcttaaggcttcccggagtaaccatttgaccaaagtacatttcttatcatcttagcaaagaacagtgtgttctttcagaatcgattgagatagcaccagtcaccaggcaagcatattccaaggagatgagcagaaacacgtccatctgcagacagcaatacagcatggttcaatggagtgcatagtcagcagtcaacttgcatacatgacattcagtgaagcgggaatttcacggaagaacgggtaatgcggcaaagaaggcacaattagataaactttggccatgcactatagcatgagttcagttcaggacagatgagcaccacaatactggatacccatcatgatattgagcaacttgaagcagccctaccagcactactactactactactactctatatgacgatcatctcaaaggaaatcactagataagaaataaaagctgtatttgctcatctttcatgtttcagatgtatggatggctatagcaccactgcaccaatgaactaatatttgcttggcaaatgatcaagaaaatcaaactatcaaactactattggactctatgccatgatattctaatcttgaaatgccaaaactagctggcgaacattctaggacaactctagtacttgacagtcagattaaaaggtaaatcaattcaataaggaaataagttttgtacttgttacatataagaaaacaacgaaaggcaggcagcaaaaatgtcaggattcccttttctatgcacaaccatatgatagtacttatttagcaaccgtaatgatatatccataaccattgatgaattatttccccgtaagaatattgggattaagaacacatagttcccaggactaatgaccatgtaactggtagtttggtactcatattttttatgcattacaaaagccttgtgagaagagtatagaacaggcactctaccaaaatggtaattaagatcaaggactccagatgagcataataaaattgccatctcacttcagaagctaaatcactcccagttgcaatttgccgatcgacaccgggacaaaaataattgttagaaagcaatgcaggaagaattgttacaggctcacagctaagatgtgcaaaactagctccatcgtctcttatcctcttcttcatcaactgggatataccactctggtcgcttcttcgagttgctgtaccggtagttcaggaagagctcttcatcacatatggaccttgtactcaccagcactagagtcttcagaactggagactccccttcctgattaccagaacgtccagacttgaaccagaatgaaccaaatcgtttcattgtaacgggctcttcttcaccaccaaaagtaatgttagggatgtagactctcatgtccttctctgtcaatggaaaatcatatgggcagatcatgacattgggagttgacccttttggtggatggtttgcaaagtgaccaaaagcgagtgggtttcgtcgttcaagcacttccccaaaattttcagtgtgacccttcttcagaggcttgctgagcatcctccatgccctatcagagttgctctcttggcttttggatggcactgcattgtaatccaccaaatctgagccatcccatatttctctgctatcaccacctaattgccatggtttggcatcaattattgttccatcataccttgtgatcagatagttgttgcacgcgtcgatttttgggtatccagggatatatcgataataagcaggtgaatatacaactccagggtagatggctaggacagcaccagcattagtttctccagataagaacagaccttgccctgcatctttgtgagggatttgtgacggcctgatgtcaagggtgtattgaaagtgatccctaaatttatttgacaattcagcgcgatttaaaggcctagtagaagggacatctgcactgcagagtaaatggatcagaactaagcttctcaggattcaactcataaaaggaaatatgtaagtgtaactgtgtctccaaatgtaacaaacatgatgaacacaaaaatttcgctgcaaacagagatatggggttaacataatgcatatacttatttctgtttagcctacttcagcagcacaaaattgattaaggatgttaaatcatggtacgtaaaactgaagcataagcgaagtacacaaaaataggcagtttgctagccaagcaagtacttgtcatatctgatgaacaatattatacttcgtccctttccaacgaatgatcaagatttgaaatgaaaacacaggcactgtactgtgattgtcatatttgaactcagaagtatgctttggtgcaaaaaaaaagtcaaaagtatcagttactaatggtacttatgcaaacacataatgtactaaccaattttgactgatactgtatgcaagtggagaactgcggatgtactaattcaatgcatttagttagaacaaattacctggcttgtttgcagatgcaactcctgtgccaacagcgaaactcaacccactacgccgaggataattattagcttctgaagcaccattttttgtatcaggaagaagaatgctatccattgcttgacacatatttgtaagttgatagtgaacattctcctgtacttgcttctgctgctcagaaacagaagctttgctagccatgtcaataatctcctctgcgtccttctcttcagcattagcccccaaacggtaatagctgagcacacatcgaaaagaactcaggttaggaaaatagtcatcttcataatgcagttgaaaggctgtggtgaattaacattttgaacatagtaataataaatcatatattttagtgggatgatccgccagttgctgataacagaagagtttgaaagatgcacatgtctaaccaaagggtttcaagaagatcaagtgtgtgtagcatctaaactatgagaatccaacgactaccttaattgcttttattgcttattagaggtttacattatttaaactaaatttgaaatagtggtttcaggtgttcgttatttacggaaacacaaaaactacatgctgcatacacataactggatatccatctgcggcatattacagtgaaaaggaactggtatttttcttcagatattggcaaacctggtgtagagaaacaggcgatttacgtcagcttcgaattggagatgccttggatctcgagcaaacaatcgattgttagcaaacatcggattcttagccagtgttttgacagcctggaaatgcatcagttaatgaattggaacaaaaaaaaagtaccgacaaaatgaatatcataatgttgttcgatgggacaagcactgcattcatttagtcatttgagtcggcattagaaagagtgtgccgaagtcaagcacacatcacccgaatcaacacaagaaagtgaagaaattctacgaaagaaaggcagggacgacggagagcgcaacagaggtaaaacaatgacttgcaactatacaaactagattgcccacagcctagttacaatcaaaatgccaccagattccacaagcataaacaaaaaagaaatccgcgtgttaaccggatccacggcgcttctctcgctcgcgcaaggagcagatcgggatccggaggtgatggtttgcggggggatgtagacggcgaagagagaaagcgtgtgtacctcttggaacctgatgaagagggagcccatgcctgctttggcttggcttggctggcggtggcggccgctggccgctgtgcttgtctggtcgcgcgggccggggcgagaagagcgcgacgacgccagcggccggcgtagcggtgaggttgagagcttcgggaatcaggaggcggcgatcagtctactggtggtgggtgagaagaagggttttggcgtcgggaattgggccgcccccacatcttcgtggactttagcccgttactgtttgggtcggctctgcattttattttatttttactttttgcaattagctgatctttttccagaacgaacaattacctgattttaacatttcgggtctcatcggttacctaaaagcttattataggttgtaatagattattagaaaaagataataatttatgtgtaagatttttatatgtattcttagcaatataaaaaccaatatggaaagagaaattacgttgagaatatcttaaaattaagttttcaaatttaaattttgattttgggttattctttttagggtaaacgatggggctcgtagacatatgctgctttagtaggaaatccgtaaggtatatgaacgaacttctaaattggagaagaggatatttataaggatacttttattatgtaatacttcctccgttccagaatataagaaattttagcgttggacacggttactaagaaagtaggttggacacggttactaagaaagtaggtaaagtgagtggtggagagttgtgattgaatgagtaatggaggtaggtgggaaaagtaaatggtggaggattgtaattttattggtggaaaaattgttatattttggataaattctaagtgctaaaagttgttatattttggaatagagggagtagcaccttgcatgaagatgctatgagagggcatggcgcattttctacatgccctgatgcttagattccagtaccgaaaggaagaagttccatgtttcggacaatggtatttgtatccatatacttttcttgagccgtgcataatctcttcctaaattagttaagcatcaccagcaacagtgctatttcctgctcgtttgatacgacattgttcttcacataaccgatgttctattattctcagtttcctattcgtgcttcacttattttaaattagtctggataatgaaacttgctcttcactgaagcaaagccgcgacggcatgatagtcaagttgggaactcctcgtagttcatcaagccaagcgaacctctgtaatcggttaagtgtgtggtatgttcagggaaaccctgggtatgctccgatgatgaaactgctctgaaggacgtaatgtcctcattaaaaaaaaactaggtgttcagtgcaaaaggctaaagtaaccagacattggattaaaaaaaagtcattttaccagggcgaaaggcctaaccaaaatggcatcagataaatacacaagaatggaatttcaaacatgtcactatggaatataccggtaagaaggtatccatttacatcagaataggtggatatggtgaattggtgaatcctcaatttgaaggaccttacagaatctccgtctcatccaattgtgttcatatacaaatcgattacctgcatttggactaaaccaagtatgtgcaggtataattcaatgatccacccatccaggttgggatgaacaagtgatcgtggaacctctgctttcccgattcatacgatgatgctctgaagttataaaaagcatcaggctccatgcctgttaagccccaagcatcaattcattaaaaacaatccacttctgtaacttggtctagttcatatgcagatcatagtttatggagtactacataaatgcaacaattttgatcacagaatagtgaatattaaacaaaattatgcaagtttgtaatataccaaacttgtcatgtttaactactttaagattcagatcatctttcctagcttcataagaatcaaaagtcaaatgactccttccgctacaatgcccagaactgcaatgatgaatgtcaaaacactagtatggctgacatggagttccagctcaaaacttatccagatctaaattgattatctactatatgtctggtgaccaaaagatggtcaaacctttcagctagtttacatcataaacccttttcttattagtcgattactccagccatctatgaacactgtgctccattatctaaaaaatgaacactgtgctccattctgacagcctaacaaacaagtctcaagtaagtaacttctgaggccctgtacagtgctccccttctgaaatataaaaccagctcggctggcttaggtttaaaaaaaaaagtaacttctgaggcttcctgtgtagtcaggaaactgaaaataccttttagtgaatcagaacatcacagtatcaatcataatttttagatagcacacaaattcatattgttttgatagaaggcctaaaccaccagggcaaagtaagagacaatcaactcccttaaatcaaacaagaccacactgaatgatcaacatggacatcttaatgaaaactaattggtcactgagacaaccgaatgaacatatacgctctaacccctaatgttaggcagaacgcaaaactatgccttggcaaggaggaatttgcagttgagatacaacaatacaaaggaccttacgaagttatcagtatggaaggaataaaatttccttagatttgcaataaatatcagcagtagctcaattcaggcaatcaagacaacatgtaaggagccgaacacat

SEQ ID NO: 70486 - DNA, 1736 bp, Oryza sativa
acagcacagctagtgctcatataaaggatcaagaacataactaatagaataacaagttggaataactcacaatagcatgtacatgacaaccataatatatacaaaatagaaatgtattccaacaatgaagccaatgtaaaaggttacctgtagacaactccaatgttcggagtcaatgactgaatcttttgcacctgaatttgcatataactatgtattagtgcttctgagaaacaaacaacgaatagcatgtcgcaactcactaaaagaggaattcagcattaagagtgatgttagacttacagatgtttcatcgactaaaatagaaggcaatttcttctcagtggcgataactacaccattagcagctgcaaacataacaaatatacctcagaatcaataaactaggctaaaagggaactgaagagaatcaacagactgtagtctctgagcagtaactacacaaaaacatatgatagaacaatctggtaaaaacatatgcagtatgttctacaccacaaatttattacatacaacaattacatctatcagcgtgaagaacgcatgtcaaatagtttctttcaatttttcatacaccaaaacaaaattcatgggctaaaaccccaagactttaaattgcataaatactgacaagtggcaacaaaagctgattttaagggtatgtaaacctaccagtaaggtggacgttgacagggcaaacaaattagaattttgcactgatactaaaatgggcttccaaaccctaataggcactagatcagactgcacacacatacaactactaatgggaaaactaggtcagcatatacattcaacgccgtaaattggcatagaaaacttcatcatcacagatgaaaccaagcagcttgtatttcttatgtggttataaaggggagcacttgccattgctgttacaagacatacatttatgtagattaataatgattttccatggaatccacaagcatttgtaagcgaaaacgaagcaaacattacaaaattcccaagtatcactaaagcagaatagcagatgcaagtaacatggcacctattagtaacctaagccgtagcaaacttcacactccaggtctccagaacaaataaaagctctgcaacgacctaaagttatgcgaaaagtgcaaaatccccaacaagcgccacttcgtcatgtgaaccgaaccagccaaaatctcaaacctcccctccccttctcgattctcataacgcaatagaagtatagagaagggattgcttcacgggacgcacctttgatcccgagggacgtctggccggatccgaccgcggtgagcgcgtgctcgatctgcaccagcttccccgacgggctgcaaacgaaatcgccacaaaaaccacagatgacgaaaccgaaaccgcaccagatcacgcccgatctccgggcgagggaggcgcaaggcagcacatacctgaaggtggtgagggagaaggagtactggctgtctcccatggccgccgacgcgcaggcctacctgtgagctgctgctcttcgtgtctcgcggcggaagaggaggcgaccgagcgagcgattgcggcgagacggcgtgggaagggagagggaggcagagcacaactcgccaaggaagaagaggagagagagaaagagactggatggatggattgctccgcaagaaggtggtgggtcttgggccggaaatctggcccatctgttattgggtcag

SEQ ID NO: 70487 - DNA, 10846 bp, Oryza sativa
aggcagagcccctcctccctctgccgccacgcccccgctcccctcctcctttttcccaaagcggcaaggaggcaagccccttttctctccctcttttctcctttttccgtcaccgccggcgtcatcctcctccctccgccctgtcgccgatttggacgcgagcgccgagcgccagctcgcgccttgaccgccctaagtcggttcccaaaccgccattgccgcccttaaagccccgggcgccctccctctcttctccttccatcgcctccactccattgccgccacccccgtgctctgttcgccgtcgccgttcgtcattgcgcgtgtcggaggagccggcacgagcaaggacgcggaagaggactccgggcgcgccctctccttcctcttccccggcccgaggccggagagattactcccgcgccgtcggcctctcgtcactgcgcccgcccgcacggtagagcatctccccgttctccctcctcgctccatctccccccttagttttcggtagtagcttgtgtagcctccccgtatctagccggcgccgccccgaccgttgccgtcgctcgccgtgtgctcgccgccgtaaccgcccgagctccgtagcacccgctcgtcgccggcctcgctcggcgtagctccgcccaatccgacgctagcatcggattcccgtagccgcgtagatgctctcgccgccgggaatcggcccctcgtgacctcgtcgccgtttcccccttcttccgccgccggatgccgccgccgcaattcgccgccgtcgggcatcctccggcgaatccgagccattggctcatctcctctcatcctgtgcagctacccggtgtgcttgccttcgcctgtatcgccgtggttcgctccgccgctcgccgctgtcgtccgccgtccgttccggccggcgtcgtcgtctacctcccgccggcccgcgtggcagccacgtaggcgccacgtcggcgccagctcagccaaagaccgggtcgagccgatctcggtcagtccttccccgtgcgcgcgttccaccgcgagccgtgaggctgcgcgtgggcccgccgcatccgcgtccaccgcgcgccgcgcgcgtgcaccacgtccctccctcaccctagcgccgcgccgcgtgctccctccgcacggtgagccgagccgctgacaagcgggtcccacccgggaccacgcgtggtgagcccggtcaaccggctctctctctcctcccctcccgcgtgcgcgcgccttgggccggccggcccatttagctcggtcggaccgctccatttctctcgggccgcgccctagccgcccgaggaaaagtctattatccctccctctttcctttccttttcttttctttttcaaaaaggatttaattaaatcatttttcctttagaccaaaaatccaataatcttagaaattcaatatcttcccaaccgtaaacccgtttgactccgttcaacttccaaaattcctcaaatctcgagatctatctaatggcacgcttagaggtcattaatagggctttattttcgccgtttgttgagttgccccgtttcgcgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgcattgataggatcgcacttaatctgttgtcccgtctgcaaggcagattggcagacctacctaatttgttgcatttgatccttcctttgttaattgtgataccatgtccccttgtaaccatccagttgcgtctcgatattcgtgcaccctgcgcgagtatcgacggacgccttcaaacttaaaatctgaaaaacaacttgggtaaaacttgggttttacaaaagacttggaaaacccgacacctgggtcggtgcttgcgaactaaatgaatttccaaaaccgcggaccggggaacgtaccgggtgtacggtttcccgctcttgcacttaaggaccgtttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacagtcatgggcggatgtgaggtgattcctagcgtagttttgtttaactactgcttgtgaaattgctgttgtgaaaaggggttcgatgtttgaaaaatctgtagctaatggtatcagctaggcccgggtggccgtttgaaaagttgttggcccgggtggccgtttgaaaagctgttggcccgggtggccgttgaaaagctgttggccgggtgccaaccttgtttcaattctaaagactgatacattgcacatactccgaccggacgagatgcactgtctcatccgtgtcgtttgagaagcactcacttagttgtttcagaaaagagttcaaataaaatcaattgtaaaaacaacagtctctccttgaagcctgcattaaacacttatttcccctggcttgctgagtactcccgtactcacccttgctctatataaataatccccccagttgctgaagaagatgaagcggatcctgctgatgaagagttcttccaggagcaagccggctacgatgagttttagggtttcggcctagttcccaagtcgcgcctgtgatgtttggtcctagtcctggcttccgctttccttttgtaatgcagttgtgagctcggggtctgtccgcagcccaacatgactgtacctctactctataataaagagacctctgttgctgtgataatctgtcttcctgtgataccagcactgtttcctgggactggtatcgaataacaggttaatttggagcgtcacgggctagttccggtcggtactagttcggggcgtgacacctggcttgctgagcacgttaagtactcatccttgccccttataataatctatagagtttgaagatgaagacgtcgacccgaccgccgagaagtatctccaggagcaagccgagtatgaagacttttagatgtttcgtgcctagccccaagcctcgcctgtggaataagttagttgcctaggttctttgcctagtgcgtagtcacttagttgcttagtactccacgctgttcgtttctgcgccatcgcttttgtgtttttctgtaatgttgtgttgttcatctatgggcatgtccatgatagcaacgtttgtaaggactactacccagtgatgtaataaagcagtttactttgattccatatttattctgtgagtaccagctagtgtatcctgggactggtactatatcacaggtaatgcataacaccccggtgtgagttagctgtgtttatggctaacaaatgtcggggcgttacaaaaaccagtcaaaatttcacttggaatctacttccgtcccatgccaaaaacctcaaaatttcacagatttcagtctgcttaattttgtcgaaaacataaacccacatggtgggagggttataaaattatgatcgatataaccacaattagcttactttatcttcgttatttctatcggctatataatcaacaccgatcctataaggcaccatggcaaatccagggttgggattagtcaggatgggaatgggtatggtcgatccatttattcactaaacctatccgtaaatttgtcataacggatttttagggtcgctccaaaattataaatggatcaaatggcttaaaccattagaacctagatttaaggggttcgacctaaaatgacttcacatgtataaatgtttcaagaatttgtacaaagttacttctctatataataaatcattcctacaaaattcaactaaatttaacaagtttttatagtgtgaacgcgagtttaaaaattttgggtccgaattttacacacatgtaactataatttttgaatcttagtaatgcggcatatataggggggcatgtctaaatggcttaaaatttgtacaaagttgcttctccatataataaatcatctctacaaaattcaactaaatttgataagtttttaaaatgtgaacgcaagtttaaaagtttttaggcccaagttttgcatacatgtaataagaatttgttttgtctactagtaacatagatgatcaatttggatatccatgtatatcctattgatataatagacttatgatgaattgactctattaaaccatggataaatgaacttacttaaaatggttaaaccaacgaggctggcccgaggcggtcgccggctcgacagcctcccccacccgcggctcctcgacgtgcctctttccgccacaaccacagtcgacgacgtactcccctcgcgacgatgacatggtggtccggacggaggtggcaggggtccaggcgacggcctccaacgatgccacccgtgcaaaagagggtggcaagacggtggtcagcgcctaagcggcggacacggcgggcgttcggtgtagatggaaaattcgggacccccggtgtttagtgtttccgaagccgaatcggatcacaagttaagcgccgattccgaagcagaaacgggacgagacaacgggctatataaccacggggcaacgagtgcacgcactcagatcagtactacgtacgcacgctcgcgacgcgatcaacccaacccgatcctgcgacatggaggctctgccgcagatacggcaaaccctcagcgagatcgaccgccgcatccccgacgccctccgcgtcgcgatgggcctccgcttgcggcccaccgccggcgccgcgctggaggaagtcacgaggatcgccgcgtcctgcctgcctcggccttgcccggagggcggcgacgaccccatggagtgcgacaaggcggcgccggcgcgggcgctgcggatggaggccgcgtcgtgcttcctgcccgaccacgacgaggacacgcacttcgttcgccccgaggcaggcgtcgtcgccctggcggacggcgtcggcgggtaccgcgcgccgggcgtcgacgccgccgcgttcgcgcgcgccctcatgtacaacgccttcgagatggtcgtggccacgacgcccggcggcgcggggggcatctgcccctacgcgctgctggggtgggcgtacgagcaggcggtatcggcgcggacgcagggggcatccacggcggtgatcctgtcgctcgccggcgcgaccctgaaatacgcctacatcggcgacagcgcgttcgcggtgttccgcgacggcaagctcttcttccgttccgaggcccaggtccactccttcaactacccgttccagctcagcgtcaagaacgggaacagcgtcacctcggcggcgcgcggcggcgtcgaggtgaaggagggcgacgtcgtggtggccgggacggacgggctgttcgacaacgtgaccagcgaggagctccagcggatcgtcgcgatgggcagggcgctggggctgtcgcccaagcagacggcggacgtcgtcgccggcttcgcctacgaggcgtcgacgacgatgggcagagacacgcccttcagcctcgagagccggaagaagcaagggacgattttccggcgagggaagagggacgacatcaccgtcgtcgtcgcctacattgtctgatcatagggtcattggtgtacattctatgatctacacgggtgtacgtacgatctgtaggctgtagcatactaaattgcacgatcgatcagcttgtcgtcttgtcgatcgatgtctctcgagcaaaatccttgtattatgcggttgttaaaggctttattaagatttgtattaagtcttacggtgtatatacataatgatcaattccaggataattctgttgttcgttgttcgttctgttttattatgagaattcaattggatgatctaagataattaccgatactacttttataattcgtccactgcgctttaatatgagaaatacataatacaagaatttcaggggaacatattttattgtttgcatgttatccacataatcatgattttaaaatacagcatcaacttttttttttgtctaaaatacaccctcgaactttaaaataaggtattaccctctaactatcaataccgtgctcattactccgtcttaggccttgttcggtttggaggtgattgaaaaggattggaggggattgagggggaataattccacaccacaataggtgtggaataaatcccttccaatccatccctcatggggattaaccgaacaaggtcttattgtttagtatgatatcggggacaccacgtaggatgcacgtattaaaaagccagaaggccctagatgtcagacctacctctcccctatctttctccaccttcctgtgtcttcggctgttcggcatcctcagaagtatcgcggcgaggacgccattgacgacaatctcttcgatttgttcccagtcccctacccgttttgccgtcgtgctaaccggccaccgccgatgcaccgcccctctccttactccctctcctctccctccgctggcgaggatgacggggccagccccatcgactaagctcagataagacgtttttgacgacgatgtgtgtgtgtgtgcgtgtgtgtgagtggcggtgaaagacagatggggaggaagcgagagtggcgatggcagcggagcccaagcttgatgtagaggtgaagctcatggaggaggagcgggtgctggagcccgagttgacgttcttagctcaaggcgaatggatagtgacgacaaactttgacaacccaagcacgaagtagagattttgccatcatcgtgcacatcctcttctttctcctccgctcaaggacgtgctattgcagctcacccccgcaccttcaccgtagcgactgctgagccgcagtctccgctgctttctccatgccaacagctagacaaactaatctaattatttagaaccacttgtaaagagtggcaaatagttaattattcctcacatatgggcttggccaatgtagcgtccacatgcaccaaaacccaccttaacatctctgggtaaagtgtcatgtattgtgttgatagttgggtggtgtattatatctagttttgtagtttggcggtgtattttagacaaacgtaagagtttaggtgtgtgaaatatgctttttttttagaaaaaaaaagatagattaatacatgatatatcaattaaaatagtgcaagttaaaattcgagttcatcaagttgtagaaaaagaataaattaaattatagccagttaacttatatttttagtcaaatttatttttttctacttggagtaattctatcgcatattaatttatcttattttttgttttagttattttataaccatgtaaatcagtaaatgatatgtaaaatagtgagtgtgtatttccttgatagttcagatagtttcccaagtttcatgttgtgttgattgttagggcatatacaatggttatcaatagtggtctcttagcattgctaattagaaatatttgttgatatggaagaaagagaaagatgagagacaaaacatcgttgttatgcataacaacagcttaacaacgactcttaatcactataatatgtaaaatgaatacttttttagttaatgattagagtctttatcgtctcaactattataaagacacgtctctaaataatcttgtttaaaagaacatactcgcctctgccattaaaagtgcccttagccgtaatccgtctcgatctccgactccaactgcatatcggacagcatatcgcctgcagtgcgaataggactcgtataccgtttgccgcgctatttattaatggatcactgtctacgtagcctggcacgcgttccccaaaaactcttaaccaaagatggagaaacgtatggagacgttggagcagatcaaagagaccctgcgcgagaccagcaagctagtccccgacattgtccgcgccgcggtcggcctcgagcaccattaccagacagtcgagctcccccacgacgacggctgcgtcaaaagcttcgccgcggccttcttgcggccgcaggcgcaggagcaggcgcatggcgacggcgaggtccagcaggcagtgaggatggagtcggcgtcgtgctacgtgcccgaccacgacgaggacgcgcacttcgtgcacgacgcggccggcgtcgtcggcgggtaccgccgcagggtcggcgtggacgccggcgcgttctcgcgcgggctcatgacgagcgccttcgcgcagctcgtgacggcggagcccggcacgcccgtctgcccctacacgctgctggagcgcgcctacgaggagacgctggagtccggcgcgcagggcgggtccacggcggtcatcctctcgctcgccgacggcaacgtcctcaggtgggcgtacatcggcgacagcgccttcgccgtgctccgggacggcagggtcgtggtgcgctcggtgcagcagcagaggtacttcaacgccccctactacctcggcggccggcggggcgacgaaggcatgacggtggggatggtgggcgagatgaaggtgaggcgcggcgacgtcgtggtggccgggacggacggcctgttcgacaacatgtccgacgcggagctcgagaaggtcgtgcagatcgggacggcgctgggcttctcgcccaagaacatggcagacatcatcggcggcaccgcctacgagatgtcgcgctgcttgctgaaggactcgccgttcgccgtcgagtggcggaagcagcacgagaacgaggaggggcacttttacggcgggaaggtggacgacatcaccgtcgtcgtcgcgtgcatcgtctcgtcggattcatgacaattctctcttttgtttgctcggttttcgatcaccatcacaccatggttgatgtttggatgaatattaataccccgtttatgtaagtaaattctattactagttagggcgcataacagagcaaccgatcgagcaggccgtttagggctcattcggtttgaagggtatttggagaaaatattggaggattcaaattccttaggaattaacactactaaatcattaaaaatggaggattgggatataggaaaagtggaggaaatttttctacgtttttcatgtattccgaataaggcctaaacggccctgttgacatcatcgctaacaatggacagaaaagtgggactctcttcaggtcaggctgtcagccagccagccagtcagttgtcacgatgtcatcttagcaaaagagagaacgccactaaaaaaaaaggctagcccatgatgctccgattcaacattcaatcagacaccatcaactagcctcaaacaccatcgtcgtgcatgaattttcttggctcgagttacactttgctgatggcacgaagcatcaactatcatcaggggaactcaagagattttcataccatatacaacacttcagggataccgcaaaaggctggaagacaaatcgatgtttcagaacttgatagtgcacaaatttcctcccaaaatcatccataaagtgacgcacaaatctcagttacaacgcaagggaggaagaattaatctaagaattcaataacttgtacagcccaaaatatatcaccgagacttctgattcactcatcgtcagcacccatgaagtttctgcaaggttgacgaggggcagcatcaagaacagcagaggaaatccaggatgctggagcagcaatcgtagcagcaagaacaactgcgtacacaaaaaaaacaaccaatcaatcaaggagaaaacagagcaagatgagaagatcagggagaactaaatggcgcaggcaccctccttaccattcatccatggtcttgtccgtgaagtcgtcggtgttcatcgcctgagccggtgggggatccatcgccaagaagtccaagaaaaaaaatatgtgaggtgaggaagaaggcagaaggctataaaggctgggaagtaggagtatactagagtaagcaagagcaaagggacaaataggctggagggaaatgcagataagtgtggagcacatgggatggggtggtggtataaagaaaaggtttttgtcaggatttaaagtttgccctgtcgactgatgaattagcttttccgggttctgtctagtgggttcttaaaatgggtagcggtttggagttttgcagtttgcaccggcctatttggtgtcaggaattccgctgattgcgcatgccatgatcctcgattcagcttcggtgacattgctatggcaagtcaccggatgacataccgtgcatctgagccatccaaaacgaatccaacgtctgctttagttgggcccgcacgcaggcaaaaaaaccgccgttttcatccccactactggcgggagacgatgcccccaatttctcattgcgcgcgtccgcgagccagcggggagtgtcgccactgaatccgggagagtcgtcgccaccgtgaccggaaaggtgacaggccgacgaggtcgccgcgagtgtggagggggtccggcggccgccacgtgaggccggggccggggccctgccgtgccgccgcggcaggccgcgcgtgcaggtg

SEQ ID NO: 70488 - DNA, 2877 bp, Oryza sativa
aaagtgagaggttctccttctttatagggtgtttatgatggttgtggaggttggttcacccacaaccgtcattggggagtgatccaggccctccacgtggaagcagatggagggtggcgtctatggtggttaggccaaactgtgggccccacctctcagctgctctttcggctgggaggctgacaggtgggcccctatggcactgcaccttggttggatccattttaagtcgattttgattggccggaagtgggccctccaatcctcatgctcacatatgattggccggaagtggcgtcgcatggcgggtgtaaatctctccaaattcaccaacataaatatatttaccaatactagtggaaatggttagtaatacccctaccactaagtttgatattatattttgaattcttttatgcaagagttgatagttaaagtttgcacttaacaactgtcaacaatagcctaaaatattttcaagagcacttaaattcctcgactttggatctatgcaaagatttgtactcagacttttttttaaaagtgctccttttaactccagtgatcgtgcagaaatggcatgcatgattaggttacgaatggaattagggatctaagaggtcttattggagtgtgaagagatggatatagggtttagaggaagggtccgagtgacggtggtgccatcggagtcatgagagcgaagtcaattgttgcaacacaaaatcgaaaaggttacaaggtgtaacagcactccctccacaaccgtgcagcccagcctaaacgacaagcgggccactaacacataccactccacttacaattttgccctcgctttgtgcaaaagggttaaaccggaaatgataaggttggagggaagatgccttataagttggttccaaccttgctaaactagcaaggtggtactaaacatgcccacacagctctcatgggccacacagacctcatcctaattggcccaggatgtcacacaaggcgacagggtggtgaccggatccggcaatgctagccatcggagatggagaaggctcagtagcatggggaaaggtcattatcaaaattgtagaagaagacatttactcgagtatggaatcgatcaagaaaagagctgggagggtagaagggaataggtgactgacggggctagcccagttccatggaggtgttgtcgaggatgagttggtagcaacgacatcgtgtcacaagagtatgaggaaaaaatagagcggacgaaagagatgaagatataagattccatgctcgaaccttcaaacatgcttagccatgtaaacaccactacaaaaatgattttttccgtgaggtcgaaaggggttttcgcgtgcggatctcccatccgtttgcaccgaggggtctgcaaaaattcgattttttcgtgagggtgacacactcgcacacgaaaatccaattttcgcgtgcgggcacttaagccgtccgcacaagaaaacaaaaattcacaacaaagaaaaaaacgaaataaaaaccctagccctggaaccctaatctagccacctccgccgtcgccgccaccgtcctgcccgaggcccgccgtcgtcatccctgcggtcgccggtgacggattcagccgcccgaggcccagcggcggaggatccaacgctaccgttgttgggagactgccgccaccatcgccgtcatcgttgccgccctatccgaggcccgccgtcgtcattgccgcgatcgccaatgatgcatccgccctccccacggaagcaggcaacagccgccaccctcctctccggccgcaacgcagctgacgcccctcccctctgccggatctaggaggggagggaaggaaggggaggggagctggagggagagggagtagaggaccagcgcacaccgtcgtcgggagggaggtcgccacgcgccggattccgctcagggggagggcgaccggccgccggatccatgcgaggatggccgccgtcgccggatccatgtcgggtttggctgccacccactggatcccgcgcctccaccatcggagggggccgccgtgccctcgcctgccgtcaccatcgcctacacccgccgccgtcgccggattcgtgcggggcttggccgccgtcaccggagggggccgccattccctcgcacacttatggcccgtctgcaacctattagggtgcttgtccaggaaaatcatttctgtactagtgaaatttgaatatttttcccaccaaacaatcaaatggattgtttttttattttattggttaatatggattggttttgttataatagtcgttggtggttacaagagcctcagtagcaccttaggtcctgggttcgactctctatgagagcggattttccaggatttaacggcattgtgctttcagtggtaggcaacatacccgtcgacaacaagacgtctgcgataatttcgtcaatctcaagtatttgccggcccagttttcaaagatgctcataggagtagggtttgggtgcgtgcgtttatagggtcagtgtgcgtgcgttgtgagtatctgcgttatactgtgtaattcgtaaaaaaaatcatggtgaattagtaagtatggagaaatcatttaaaaaaaagatatttagttacatttatgccaccgtaaaagccaagttaagtgatgaaacacgagcttcttgacaaatctcgttgctggttcaaaggtaagctgaatatacaaacatacatataaagagtaaattatttattggcccatttaagttgaccgtatccattatttgctttgaaattgcctttccataaaatggttctcaacttgttttcctgatcggtgtacttcagaaacagccacaagtttttttcgagtgaaa

SEQ ID NO: 70489 - DNA, 2408 bp, Oryza sativa
gttggggggcacggagatacggggggacaccggacaccgacacgctccgtacggggttacgagttacgaccggtgtttgggagctatagtagctggcacgatggatctggacgggtttgggggataggggattggggagagccgtgaggatgtcccggttcagtggacggtcgggtgtggttgaggtcggccacgcctgtcgcgagtttgactttatttactgttgatgtgacttattctcaactcctcctccccttcgtatgcaacatggaaaacgatagattaatacataactaattaagtattaattaaaataacttaaaattttggttaatataattttctaaagtaactttcttactaatacttttgtaaaatacatatcatttagtagttgagaaaacatgcgtgtgaaaaagagaaagataaagttgagaactaacaaaaaaaaaaaactacatagtcgtcgttgtgatacggtcacatctaaaattcgcaagcgcaccattatcgatgtaacactcacctccattgacgcgaaaaacaacacaattgtttgggagatctgcttaactctagtgcaggtctccgaaaaaaaacgctagtgcaggttctaaattattgatgagatacgggcgtgctagtcagtttgatcctgcgactaacaagacatataaatatgtaaatgatcgaaaagccgatcggctaacaagcaaatgtagcgatattagctgatatcgatactagccaatgtccatagaattttgaacaatcgactatatgtccgatatagattctaacacttgtataaacaatgatagaactttaacaaacaatccaatcagccgattataatataatgaagtagatgcccgatgaaccaatcgacgatatttatgctgaatattaaatgttggctcagtggttaaaacttacgttggctggaagtctggtgcacaaataatttattggctagcactccgataaaacataggtaagaaacctatcgacttaacaatacttagattatcaacaataatgtagtaggtcaaacctaaccgatgattgtatataataatctaatactcaataagccgataagcctatgaaaacatgatggacataccacatatatttaaaacaacattgtaattgtagagatatatcgtctaagacagaagaccagacctaaccgatacagtctcaactaaactaatgtgtctctaaacacaatgtgattaaagatagaatcgaaatatcagttaggcaaaatatcaaccgaaccagagtgatccaagaggtcaaagcgatacagccatgaataacaccaatgcagccgacataattcaagggccgacggaacatagggcttactcctttgaaggagatcgaagccgatgcagccccgtgttaagtgccaagttccgccggtgataaataaaaaccttggaaaataaggtggtgatgcgtcaagactagttgtattgatcgagagatagattacagggaccccgggtgtacgtatttatacccataggccgataagagtcctagtcgggcacgacacaaactttccaaaagataaaaggaaaaacataagttctgattggacatgacacaaactttcctaaatacaaaacttgcctaattaatatataaactcaagctgctatgtcgtggtcttcgtgactccttctcgaacccgttctcttctggataagcttttaatcgactgattgtaatctttccttaaccgaatccactaaagaatcttatcaaattttggcgttaacattctcatagcattccaagagtatcgaatcatagggaatgtgtgtgtatatctaagaacataattcaatccaagaacaacaactaagggtaggcttagactaaaaaggattcctatgggttaatttactagtgttgagttaaaggtaaaactctgtcgattgcttcgggcacaccggctctccactggtctctcaagctgagtctggcctacggctctatgatgtacccgaatatggagggatacaaagggcagacatgactgtcacgacctgccgcctacctcacttttcgtggagcacacggtaaccgctaacctataaatcacgcctaagttattgattactactctagtctcgcgcatgaacttttttttttatccagagtcctagtactagagcagttaataattcaattaagcgacgaacccgcaacaatgggaatataactcactcaagcaaataaattaaataccataaggagatatcgaatacttactttattgaaagaagcatccgccaaggtacaagcgagagcagaagaacaacaactccagtgcttcttcggaactccagtggaagaatgttgacaaaaccaacttcccggagagaactccg

SEQ ID NO: 70490 - DNA, 4264 bp, Oryza sativa
tgaatcatacatcattgcctgaagaagggatctctgaatcctacagggtcagcaatagcttatctgaactattgatggtaatatttcaaagtaatacactttttctctgaatcatacatggccattatgttgaattttgtttttctaattatcagggagcaatgacagatgctgttattgttattggtgaattctagtagtacagattataccccatatgcactcaggagtatggctcaacaacctccttgtccatcatgttcagacagttttagttcctagttctgtgtaatgagccataatgccatatgaaagttgcaagttacggacttgcaattattttgtgcagccatatgagcttgcagtaatcagcaaacatcttttggatttcattcacaatatcccacggggcgcagatcgctggggcgctggctcgccggggcggacctccggggtgaggtagggagcgccgagcgtcgcggtggcggccggtcgtggaggggaacgctgacctggccatcgcggcggcggagtagaacgagtcgaccagagtccgggacgctagtcattgggcagatatgggccggttacaggcctggtttgttttagtgttttgctggtctcacggttagatccaaatcggatggtccagatgagtgactggagagggaagtcgatttgtccgactttagaggatctgattcccactacaacaggcttcttcacctaccacgaaaacgcattcgcgatggttcggttctcccgttctcctaaattgtcaatcgtgggaaatgccaactgatatgctattatacagaacttcgctttacatctatctgttcaacaaaattcatgtgcacagatgatgtgtagacaacggggaaatcatggataggtgaaaatttcattttctcgagctctcctacaactctccaaatatcaacaatcgaggagaaccaagttgcaacagctcaagagtgaaaagctcatggaatccctttattatttagtgtgtcaaaggaaacagcagcacaccagtctcggctctagtattagcaaaatgaaagttacagcattgccgcagcggttgcgaaagaaaatcagcacattctggttccccagtgtgccagggagctcgaagcagactgttaaactcgttcaatccagcgtcaagagtgagtaggtcagaggagatctcatctcttccaccgccgagcttgctatcttgagtccacaacagtgccctcaggaagcgcagacaggtgtacgagagcgtgagatttttgtgggctatcggagccagtgatcttctccttcggccggctcaacaccttcctgacctcgttagctagctcgatgattgaatcatcttcatggcctgaacaaagcaacgtagcatcatttgtaattatactatgaaaatctctgtgagtgcggtcctgttgtccaaatatataagcagcaggccatcaactagcacatacatgtactgaaaactgatgcagtcattttttttatataaaaaaatgaataggaatattaaaatgagtatgtcatgagctttgatcaaataaagatatcgtaaaaagatctttttcttacatatgttggacaatgccttctccattgagaacaggtaatccctgttattcccattggggccattggctgtagcaatttgcctggtattaaaaaaaatgatcaagtagtcagaaaatgatgctaatcaagcagtaagccagtaaaagtgcaccatgagatgaatagcccaccttgccatgtcctccaaaggagcaggcccaagatagtatttgttgcctactggatcaggagtggatacaaagctgcacaagcaccaaagtaagtgagttaaacagaaaattaacaagttatatcatggaaatttcaatcgtgcagtttgaacccttacactagtacacctgtcacagctggcttcaaagaatctccttcctaaacaataaaattcaacaataggatattagagtaatgcaaataattgacttttattttctaaaataatgcctgatgcaaaacgagtaccttgtagaaatccacagagatcttctggtcatactcacactctcttctttccaagtactgaattgcaaaataaatttgtcaagataattctagcctcataaatctactcattcttttaatctacaaggaaaagaagcaccaaccttcattgcttcttgctcctttttaagcccccctttgacacagtatgcaatcccccactgcaaatattcatatcggactgtaaatacagctgatataatattcagaaatgaatctttggaaattagtaaaactaacatctctgtggtaatgataaagcctgagcaaagtcacatatgtcaggataatgattttcagtgcacagaacttgctaaaacagtaaatctggtttgagttcatgtcctgcctgtatgttatgaattaaggcaaatgacgtgtctttggaccaaaacaagagacaaatagcacaagagtgtaaagcatggtttgtgaggagaatccaccggcagattcctgctcagtcatctgccatctgattccagatttccagtagtcatctgctttacatgagcttttgagtccctaataggattgtgctttggtgccactgctcagcatgatatgtcaaactgtaaatatcaggtgcatgagttggtcagtcatgctttgcattaagctaatctgcagactgccgatccaccataccaatgtgagtaagttactagaggttattgcagagtcgtttttttagtcaaaaaaactataggttattggaaattcgaacagtgaaggtcagtatgcccctatgatgagggaggctacagggttattgtgttctttttctaatgatgttatagagttagttactgttgtattcctctcccaaataacaaatcaagcaaggcacagaagcaacttttctctccagtcctgcacaagagactatttaaaactgaagtattcaattaaaaaaaatccctcatgtagcagttatttctccaaaatcattgacacctttaagaaggttattttaattgtcatcaaaacttaccattttgtatggctatttcctaaaacaaaagcatctacaaggttcaacagagtatcggtaatgtcaccgatgcaaatcctacggaagaatcgtcaagatagttgtatttatatatagcacaataagtgaagtatgcttcaattcagtgcaaaaatttcaatgcggtgcatcggtgaaatgggaaaacgaagatgacagctcgcttacgcatatggcttcctcgtcggactcaagtgtgcaggtcctcgcaggatgctccggcgtgccccgatggtcaatgcaagctgcagggaggaagaaaaatatgaagatgcacacataaaagttgaggccaatatagaacagcggcaagtttaagctactgattctgcatttccaagcccattttccaagacaaccaggagtaaatctatcgtaccaagattgaaggtgcgtttgtagcccttgacgaagcccaggatcttctcatcgaagtcgaatccggggttccagatcagggagccatagccgaagacccagagcaccatctttctatgcctgcacattttgagcgcaaaaacagcagataaatcagaaagaaaatcttgtatactatcgagaagattgtaaagcttctcctaatccccaaatcgagatcccccgaagcagacaagaatcactctattcggggcacaccgacgaggattgcgacctcaaatccaaccccagcgggccattcgacgcaacaatggcatcaccacccacccaactaaccccacaaaccatgtaatctcggggaaaaatggctgcaagaaatcacctggcgagcgggaacggacgggacggggccaagtgcgcgcagcgcaggcgagcgagcgagcgagcagggcaggaggaggatcggatttttgcctccctcgggcgacggcgtcgcctcctcctggccttctctcccccctcacacgcgcgcgcccgcaccaaacccccgcttccgcaagctctctggttgggttactgttgttggtgagagggagagggatgggcgtggcgtgctgtatttatgccgcgcgagcgggtggggggggtggcgagcggcgggcacgtcgtctcgtcgacgagagaaatggttggtcgccgcgtgatcgcgccgcggtcgcttgggattaggatcaggatgaggacggcgatggg

SEQ ID NO: 70491 - DNA, 10270 bp, Oryza sativa
tctttccgccacctcggtacgtgttcgacatgctgcatatatttgatctgttcatgctttactgcttagtttatatgtgtagatctaatgatgcgttcatgctagtttacatctgcaatgtcatgattcatttatggaataaattaaatcattatgtgcttataatttcaacaatccaaaaaccttattataggcgctgtgacctttactatggctggttttaccgatgcactgaggctggataaatttaccggtgtgcactttaagagatggcagatcagggtcactctgtggctaacagctatgaaatgcttctgggtgagtactggcaagcctataggcgttcttaatgctgatcagcagaaagaaatcgatgaggccactactctctttgtgggatgcattcttagtgtgcttagcgatcgtctggtcgaggtgtatatgtgtagacccccgattttggaaatcggaaatcttttgtgtttatccataccaatccctggatcagtagttggtacacacatacatagttggatcacaacatatcaagaatgaattcaggctaaaagagttaaatacttacattagggccaggtaggccaacaactatcagagaacaacagcggaagacaaaataatataagggcccggttaacatgtcacaggcagttgactggggaacgagacctagaacaagaccgcactccgatcatcttgtcaggtacacaagcgtactaacaagggcttctcttcaacaccctcctaaaagatatataaatagcaagagtgagtaccaaccgtactcagcaagccaccatagcaacaatgcatatgatagagggtatttcaaggaagggctccaggttcttttgcgtaaagcaaactttgcaaatcttttcacaagcctaagacctagcatagactaatcaagttttactaccaatgtttacattatacaacgacggttctgtccaccatccattgtgatcccaaggatagcttcccgccattgagtcgtcatgattttctgaggacgtccgccttcctttatctcaggaagtggctccatcagcataaagctcatcatgcaataacccatcccacacaagttaagaatttagagtctagccaagtgtaatacacgtctcggtgctcaataaccacgagcacggctattcgaatagatttggtttactcacactgcagtggatgtacactttatccgcactccgcgactgcccaacacataagcctcgtcccaacacatgagacgcgtcacggcaaagctttttgataacctcgcattggcagtacccgctccatgaactttacatcctcatacactctaggcgtacacggtttctagcagtgagaggagttctggcgcacccgggaagggaagactcatacatgcattaagttataattatgtttagattctcacatggcagtcctacgatggcgacaccactgtagatacccgccccgcggtcctaccaatggctgccccaccgtagagcccctgcctcacacatcaagaaaccactatgcatggatactgcctccgctcagctatctactccgctaggtctatatccatacgagaagtgcggttgtacgggggtcgtttcatgcttaacttcatggctcggtccttaattgaccggggacggcactagccttttccggacaccacccaaatcctccgtccgccccagtcgaaaacagttgtttaattttatttctcctttcacaaatcatgtcatcaacatcatggcaatgtggcgctcatgtctccacatgccgcatctcaattaccttcccaaagataattgcctaagcatatagcatttgataaatatgagtatgcatgattctagaatagcatttctaagcaattgtcataattgactagggactcatacgtaaacatggttacgaaggcataaggggtaaacaataatcaaggcatggcataatcacaagtaggatgttcatcattgcatgcaattttatttgtaaacaaaataatttcgcaattgggatcaacatgttcaaagaatagtgatgacttgcctgctcagaatagtccttattcttgatataatcttgatcaaccttcacctcctagaagttgcagacgttgcctcacgactaatcggtacacagattctataatacgtgagaaaaaccaatattcagacaacaaccaaatatgcacaaatagaatgtaattgttggggtcgaacctagggttgctcatattactcgcgcttgctaatggattccaatcatgctagaggctaaggcttcttaatctttctatcgtcatcatggtctatttaggagttaaccaatagtgtataaatgagatatacatctagctaatgtgtggtttagtctagctaatgactatggaaggattatggctacacatgcatttatctaaataaagtggtcatatctagaggttctcttatcggatggatttagtatcaatcaaattattacagtgaatcatttgtatcattattttattgatggaggttttactttaattatgaacataattttcttgtcacaacaaattatgaaaggataataattatccatgctttgaatgttagagttgtttaggttaatcatattatggttatagattatcccttaatgaacaatcctaatttacagttgaactataattataattatatgaggtcaagatttataactagtatttatctaatatacatgtttgtcatatactccctctaatttaatatatgcaacacgcaaattataatactataccgtacaactataatgggatgtatagtatatgtgtaagcaacaatattttattattggatcatatatttgagtagttgctttttactgtaagctatacaatacatgttgattttaagatggctctgtttggttaactaatggatgtcaaccgaactatatatatatatatatatatatatatatatatatatatatatatatatatatatatatatatatatatatatatatatatatatatatatatatatacttttaagtggtccaaatacaactagctctgttattattctcctaaccaagttaaagattcatctatgtgtgtttatattttagttacaaaatatgaggctaaactttatgtaaataatttataagtcatggatataattatatatgggcatctattagttaatggcactaatatttcctatgctcgtattgatttgaaacattaattataattaatttatgtggttgctacagtgacaaaacatattaaagaccaatattattacatctactctattgtacaatatcaatcctattcattagctcatttttaagttgactattatgcatcatcttgatactaattattaaaaattataaatatattttattaaatagtgaattatataatattggaaagcttatgaatttatatgaatttaggttcaagtttcacttaaatccgagttaaaatgaataaattacgctagtgtaaaaattcaaatttgaattaatccgagaaaatgcgaaaagctgctgttcataaacgatttatttttaacccaagacatatccacagccttgtaccaactgacaagtgggaccccgggtttattcctttttcctaccgaattatttttcaatgcaaaattccacaggtggaccccgctgctctctctttctcgttctttcttttcccgtcgtcttcttcctcgcgccggccatcgagcggagcagaggcgcggcgcgtgcgccccagcccgggcgagggcatcccagcggcgaccagaggaggctcggaggaactccagtgaccacccgaaggcggccacggcgcatggcgccgtgtggactggcggctaaactcggccacgccatggctgagctcgggcaacatggggctagggcgatagcgataatttctgaccgaattgatgggtgtgggagcatctacggggtgtgagggttccattttgctagctagatggagagaaggggctccgggatggcttgtccacagcgagctcaccggcggcaaaacggtggccggaccggcatggctacggttgctaattggcaaaattaaagggggctctagtttcacggaactaggagaggacataggagcgaggacttaccgagggatggaggaacgacgaagctcggcggcgttggtggacaggcatgcacacaaggtgtttgagaaaatgcatacaagagagaagaagaggcagagaggggtggacgagctcgtgggggctcttggggccttgtgatgggagccaacatggtgtgtggggaggaagggagatgggagggggtatttatagggtgcaggaagggtggccgacttaatggtcgacgcaacgggcggcgcacggggctcgagggtgagggcgacgtgcagcgacggcggcgtgtggcagcgacgggacgcggcgacatgcagcagcgcggggctcgaggcgcggtagcggcacatggcttggcggcgcgtggtgcgaggcgcgacaagacggcgcgcggcgcggcagtgaagccgacgcgacggcgatggcgacggcgcgcggcgcggcgatgatgacgacgcgacgcgacggcacgcgcggcagcggcacggggcgcgacacgatgcgacgcgcgcggcgtgcgcagggctaggcacggcgcggcagggggagggcggcgatgggacgctcacgcggcgcatgcgcgagatcggcgcggcacatgggagcgatgcgacgcgggtcgctgggtgttcggcttgggctctggtcgagcacctggcggcccatgaacagtagccagctgggaaaatcacagaaaagaacaaaagggaaaaagggaaagatggaggggccaaactgaaaaatagctgggattggaattttatttgagatgcaatctatacattttgttttgagaactcaaatattttatttgaatgtttatttgtttgtttgtttctccccaaatgaatttgctttttaattagattatcctaaaatttatcctaatgagcccattataaatatagtgatgtatttgctcaatttatttgtgtgaccaattattttgtattagttgattttatgacacaagggacttaatgaaatgtcctaaatattagcttatatattcccatgaaatactcatttgtaaataggatcatgatagtggtgatcatcatttcatgtgtgtttatatttcatggcacgcatcacatggttcaagtatttaataattgttccataaattaaattagtaattaaccttccctttgtctggctttgttttcttgtgcgtaaatatttgtagggttatccataaataatatattctcataaatttatctattacttaaatttagatctttactttactttctttgtgatcatttacggttctgcaagcaatagcaatcataacaaccagcatgatgcaaaagttttaaaaagtttgaaattttagtgatttttattgtcggaaattttcagggtgttacaatatgcatatgaccgacgctaaggagttgtgggatgcactgaatactaaattcggtgctactgatgctagcaatgatctgtatatcatggagcagtttcatgactacaagatggctgacaaccgttctgtagtcgaataggctcatgagatacaaaccatggctaaggaactcgaactccttaagtgtgtcttatctaacaaatttgtggccgggtgcattatcgcgatactacctccatcttggagaggtttcggtactgcactcaaacacaagagacaggaatactccgttgaggggttgatagcgtctcttgatgttgaggagaaagctcgggaaaaagataccgcgtctaagggcgatggtgggcagtctactaccaatgttgtgcacaaggcccagaacaaaagcaagggaaaacacaaaactcagcagaccaccaacttcaagaagaagaagaacaacaacaatcctaatcaggatgagaagacttgctttgtgtgtggtcaacctagccatctagccaggaagtgtccacaacgcaaggggatgaaggcacctgcagggcagacctctaagtctgctaatgtgaccattggcaacactagagatggaagcgggtagtaatttacctactgttttttcagttaatcagtctactaattggtgggttgatacaggggccaatgtacatgtttgtgctgacatctcattgttttcttcttatcaggccgcacggggttccaccgtcctaatggggaatgggtcacatgcttctgttcatggtgttggcacggtagatctgaagtttactttgggaaagatcgtgcagctgaagaacgtgcagcatgtcccttctatcgataggaatctcgttagtggctcccgtctgactagagacggatttaagttggtcttttgagtctaataaagtagttgtgtctaaacatggatattttattggtaaaggttatgagtgcggaggcctgttccgcttttccctttctgatttctgcaataagtctgtgaactatatttgtggcagtgtggatgatgaggctaatgtttggcactcacgtttatgtcatattaattttggtttgatgtctcggctttccagcatgtgtttaattcctaagttttccattgtcaaaggttctaaatgccatagttgtatgcaaacgaagcaatctcgcaagcctcacaaggctgccgaggagagaaacttggcaccactagaacttctacattcagatctttgtgaaatgaatggggtgttgacgaagggtggaaaacgatatttcatgacgttgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcaaacgagtttgacttattttgtgaggaacatggcatcatacatgagaggatgcctccttattctcctgagtctaatgggattgctgaaaggaagaaccgcactctgactgacttggtgaacgcattgttgaactcgaatcatgtgttaaacagagttcctaacagaaataaggacaaaacaccatatgagatatggattgggagaaaaccatcactttcttatttgcgcacatgggggtgtttggcgaaagtcaatgtaccaataacgaaaaagcgcaaacttggacctaagactgtggactgtatctttctgggatatgctcatcacagcattgcctatagatttttaatatttaaatctgaggtacctgacatgcatgttggtacaattatggagtctcgtgatgctaccttctttgagagctttttcccaatgaaggatacacatagtagttcgagccaaccctctgaaataattcccagttcaatcacaccaccagaacaaactgaacatacacatgaacatgtcattgaggaggatgtcagtgaagctcctcgaaggagtaagagacaaaggacggctaagtcctttggtgatgatttcactgtgtacctcgtggatgacactcttaagtcaatttcagaagcatatgcatctcctgatgcagactactggaaggaggctttccgtagtgaaatggattctattatcgctaacgggacttgggaggtgatagagtgaccctatgggtgtaaacctgtggggtgcaagtgggtgttcaagaagaagcttaggcctgacggtactattgaaaagtacaaggcttggcttgttgctaagggctacactcagaaagaaggcgaatatttctttgacacttactcacctgttgctagactgaccacaatttgtgtgctactttccctagcagcctcacatggtcttttcgttcaccaaatgaacgttaagacagcttttcttaatggagagctggatgaggagatctatatggatcagcctgataggtttgtagttgaaggtcaagaaggcaaagtgtgcaaattgttaaagtctttgtatggcctgaaacaagctcctaagcaatggcatgagaaatttgacaaaacattgacatctccaggctttgctgtcaatgaggcagataaatgtgtgtattatcgccatggtgggggtgagggagttattctgtgcttgtttgttgatgacatactgatatttgggacaaaccttgaggtgataaatgaggttaaatcattcttgtctcaaaattttgatataaaggatttgggagtagctgatgttatcttaaacattaagctaattagaggtgagaatgggattacactcttgcagtcccattatgtggagaagatcttgaatcgctctggctacattgatagtaagccttctccaacacctggctagaacaagagaattgctaggaatcaactggaatactccgaaatcattggctcactgatgtacctggctagtgcaactaggcctgatatctcctttgctgtgagcaagttgagccgatttacctctaatccaggagatgatcactggcgtgtacttgagcgagtaatgcgctatctgaaaggtactatggaattggggcttcactattctgggtatcctgcggtactggagggatatagtgattataactggatctctgatgtggatgagatcaaagccactagtggatatgttttcacactaggtggtggtgctgtttcgtggagatcttgcaaacagaccattttgatgaggtcaaccatggaagcagagttgacggcactggatactgctactgttgaggcagaatggctgcgtgatctattaatggatctgcctattgttgaaaaaccggtgccggctatccttatgaactgtgacaatcaaacggtaatcgtcaaagtgaatagttctaagaataatatgaaatcatctagacatgtgaaaagacgattgaagtctgtcaggaaattgagaaactccggagttataacgttggattacatccaaacagctagaaacctagcagatcccttcacgaagggactatcacgaaatgtgatagacaatgcatcgaaggagatgggcttgagacccatgtgagttatattatggtggtaacccagtctatgtgatcggagatcccgtgaattagaacctgggaagaacaaaccattagtaaactagaggagagtaccaatcaataccctctttaagtgaagatgcatgtactctcgtgagctgcaaggcaggttggctatgccttaatgagttctgttggctttaattagcgaagatgctttcccgtaaagcattcttgaaagaactcacctttgtgagcttgactattggtcgcagtctatagagattttgggtgaatcttctaggaagcttactaaagacctaggagtatgacttatacgttccacccgaggggtagtctacagacggtctagtaccagataagactctgagtgaaacttgcttgtacaagagttgcaattcaaggcgtagtctattgttcaagttgtgagtaagtgtagcttggagttctaggtggatgttcaaccttaatcggtctccatcgaaccgctggtatataaatagtacattgaaaaaggcaaatctcaatgggattttgagatttggtgggggattgttggaattaatagatgggctaaggcccattcaaagattagttctttggaaaatcacaaaagcgcacctcatgggatggcatgcatgtggagtttagtaccaccttgcttattctaggagagggggacctccttaaaagggaggatgccctcctagctacttgaacatgtgtggtggagagaagagaggaaacacacgtgtgcgctcgctggcctggcctggcctggcagggcaggcggcgcgcgtgcatgacgtacgcgtcgaatggtccgcaaaattggctcctcacccttacgcagatgcagcctccttttgcaattttgttttgctgcaagaaattcagatttgttttgttttggaaacattccgaaaaatccggtgcgtgaaaacggcatggagtccggataagttacgcacgacttatccggttcggttacgcggaatggagatcgtgcgggcgccctgatcaagctacctatctctatataaaccgagccgccgccttcacgcaacatacgcggaatcaatctagggtttgcctcctactctgtgc

SEQ ID NO: 70492 - DNA, 4444 bp, Oryza sativa
ccatttgctcccgagtcccaactaggaaggcaggcatgggaatgggaggcgttgggaacgatcttggcacagccatcgactcgtcgtgaacggcttttctatgtgacggaggccagcggcccgtcacagttgttagcgtgctgttaaatcgctgaagaaaaaccctcgttgatgatcggttgtttagcgtgtagttaaatcactgaggggtaacatacagagtgacccacatttttattggacttaatctacagattttattcttaggtaaaggctgacaagttcatttttcaagcagcaacttacgaagaaaattgtgctcagataatttgcaaaaggtcgacaataccatttaaaatgacttttctaggcactttaatataagtaggacgagagccccgcacatatacgtggacatcttatttaaagttttgtggtaattttatttttctaaacatgtgcttgttgtttattcagaagattttttcaaaagatttgctggcaggaaacaacagtggcattgactattcaggaaacaaagctgttcacacaaaaggaaagggaagaacttattcccaacgaaaaaagtgctctctgaatcaaacatgaaagttgttttccattatatggctgttcacttaacactgctctcagcttggattatacttatatccatttggtctgctcccgtccattatacacatagtctacttggtgatgtatatccgtggtcattttcttgatctgcattgaaccaagtagatgtatatcctcgataactttcttgagcttcaaaaagagccaaactagcagaggttttttatggctgtccatgccattttttattgtgctttcatgatgatgaggtcttgtctctgcagatctctaaccacttcagttgtttgtgaagatatctattttttagtggacgtgaattatctgcttggctatgaattcactatcaagttgctatgaacaactctaactctaaacaaagttgaccaataaagtagaattctgaactctgaactgtgcactgtcttggtttttagtttcctgtacaggacttttggtcagtgcatgtgacctgtagagtttttactgaactaagatgattagagataataatcgtacataacagaaatctgggatatataatctttcctgttctgtttctccttcaatctgtagcatgaccttatccttttcaggatgagagggacaccgtgtttgcaatcagcatgactatgcattatactgacaagtggacaaagtgggtttttatttgctgttgctttctaatcatgtcattgcatactggtttcagttggttttcttactgattatgcctttgcatactgatttcagttggtgtttcttactgatcatgtggttgcgtgctaatttcagttggtgttgtttactgatcgccattgcatactgattttagttggtgtttcttactgattatgtcgattgctatggtcagtgtgtgtgtgatattttgatttttctgaacagatcatgtcaacaggaatgccacctcgtggagatattcctacttgtgaagaagcaaactaaggctgagttcggcaaggagggttggaattgggaaccttcccctccgacacgtaaaacggatacgcggattagcgcatgattatgtaaaatcaaaggtgtttttgattattattctgtgatgaacaattggcattagagattattggttttgttatttggaatttatttacgaagtggttttggagatgattggatttacaggtgaatcacaggtgttattattttatgtgaccggtcagaccaggcaagggttgccggtcagactggcggtatgcgcgcggtcagaccggccagcccgcggtctggccggccgactctgtgttggtttcggtttcgggttgtttgtttggatatctgtgattatttcatgactatggtttctagatggatactatgcgtatgtaatactgttgtttgctaacgatgagtcaagttggagatagctttggtctcggaatatggtttctttgtttatttcatgtgtaggtgactcgatgcctcgggagagtatttgcggtgatggaccgggagtcggcttggggataagacgacgtccgtggtgggcagagatcatgcgggatacttaggctagagttgatgcatgtggttggtgaagattccatatggcatacgatggaggtattgtgtgcgtatgggatgcggagtcgaatttggaaggagtccaaatttgatatgattggttatgtaaagtttgtttcttgtacttgagggtttcctaaggtgtttaggacttctagtatgagtttggttcgtggctttaggctgcctacctcgggtataaatagagggggagcgtgaggcttcctggtatcgcttttgagagcaattgagttgagttttgagttagagttttgagttttgtcgaaatttttgtaaggagtgttgttggtgcactttgtaaatacggagagaaccaataaagttgtcatctactttaagagttcttcgatttgtgtttcaccaggtttcggtggtctaaccggtggcgcaccggcggtcagaccggaggcatcgcggcggtcagaccggcggggacacggcggtcagaccggcttcggcgacaggtgacaggagctgatctcggcggtcagaccggagattcaacctcggtcagaccgatggcaaccaggcggtcagaccaacatgacaatttcggtcagactgcgatccgttgaatttgagggtaacttttatttccgctaaaagttttcggtttttgggtataccaaccattcacccccctctggttagcttagttattgtgattcgatcatacagattaattaagtattagctaaacattcttagaaaatgtattaatatgatttttttcaagcaacttatatatatatatatatatatatatatatatatatatatatatatatataaaagcacactgtttagaagtttgggaaccatgcgtgtgaaaaagaacacagcataaagctgagttgggcactcacctttcccaacttatactccatcgtttgccatgtgtactcttttcaaactgttaaatgatatctgtttttttttgcaaaaaaaataaatttgcttgaaaatcataataatctatttttaagttttaagctaatatttagttagtcatatgctaatgagcaacatcgttttccatgcggatggaataagttatgaacctttattatcaaactcgacgtaaagcaagttacgaccaaatcagagaatgggagggaaggagatcgcaatgtatggtggaaatcgtagttgaaattcagatttgtggagatctcataggaatttatctaggtctactaagtatgtgcaatgcaaattagatatatacagaattgagtggatttgttgtctgaattatggggtagtatttgcgtacttgcctcatcctacagttagtaatgcttttcaatttcatcgttgacatttgagctgttatcgccctgctgctattgacctatggtgatcttaacttttggatggatggatggatagcctatgtgttgagcaggtggctgaagccataaagattgtgttcaaatcaagtcaacctaacatggttgttaaactcgatatgcaacgtatagaagccctgcacataggcatctctgccgactctgcagctgtctgtattgaataatccaaaaattaaagttaaaatctgaggttcttgcgtaatataccatttgtgaacttcgtgattttgtatcgattggtcatatggagttaataaattgcttctagtttactcagatatgttagttgatttagttatccaaacttagttaatcttgaaaatgtttcactttactttattaggaaagggtaatccaaattaagacatgggcatctctgccgactctgcagctgtaagtattgaatcatccaaaaataaagttaaaatatgaggttcttgctttacataccatttgttgaactttgtgattttgtatcatgtcgtgaccaagtttggggataggcggaaaaaggaactctcctgcctattcttagagagctcaaacagtacacacaaccttttggtgattactttgtgttataaaatgtctcttgtcccgctacaggattttgaccggcttaaatagcccatggtcgtacatgcaagattacatctttgcccccgcgggtcaaccctaggtgcattttggtacatctgtaggtcattatagtcttttggcgccagctggcaagagtggttgagaatggtcctcacagaatcttcttttagcatcttcccttactcaagtagtgttcttcctcgagcccttgtgttgagtgccttttctatcttgaaagttcaaacacttcttaccacttgctttgctct

SEQ ID NO: 70493 - DNA, 571 bp, Oryza sativa
ttacattgtgaaacggaggaagtatatgaatgtgggcaatgctagaaattcttataatatgaaatattcattaacatatatatgaatatgggcaatgctagaaagtcttataatataaaacggatgaagtacttggaagatatcagaagagcctgtgcaaaagtctataggcatgtcttgtaggacaatctctagttggaaaaaaagatgaattatccctgaactatcgcggtcgatcgaattacccctctgaacccgccagacattgcttaccctaaacctttaataccggacgaattaacaccctcaacccattccagagcggttttgtcctacgtggtgtacgcatgacaatcccatcaacattttttttaaaaaatggtgggacccacatgtcatacatcattttcccctcttcctctctctctcttcacactctctctcgctctcacgaggcggcgcgcaggggcaggaggtgggctgcggcacgagacgcggaggtggaggcctgagctgggtggctccggctggcggtgagcgctacgggacagtggcagaagcagcgtggaga

SEQ ID NO: 70494 - DNA, 543 bp, Oryza sativa
aacaaaaaagaaaaaaaacatcaagttggacgttgtggtggtggtcatcgtcgtaggaaggatgccaccgtcgctgccgaggagccgatccggaagccggcttcctccaccatgatgacgaggaagacaaccatgagcaatgcgaggagggtgcgcccccgccacccatgcgtgtcgctgtcgctggatccacaactcacgtgtgtcgccgtcgccgaatcctcctcgccgcgcgtcgcctttaccatatttgctgcccacgcatgccatcgtcgctggatccccgcctcccaggtgcgttgccgtctattatcccgcgcgccacggccttggagagccaccgctgctcccttccccaccaccgccgccctcgccaccctcatcgccgaactaaggagaagagagggggttgggacttagaaatatctgatgtttcagtttcctctagcatctatttaaatgccacaaccaattttcacaagcggacgacttaagaggtccgcctgaaaaaataaaggtatttttgcatacgcacctcttaag

SEQ ID NO: 70495 - DNA, 725 bp, Oryza sativa
ctcaaatgataaatatatgaaagtattatatgtttaccgtgttttatctaagagtacatgagcttgtcaagttgtgtggcgagattaaatatatcattgctgattgctgatttgttggctaccttgatgatgtccatatgagagcatctgaacatatatccattgaaataatccaatttcacgtccttagaatgcatacagacttcgaacaagtattaaaaaaataactcaacgcaaaaactcaacgcaaaagcttagtgcactcaggtcaagtcacaagcatacaacagaaaaacggcttccccttccatacacctgcatcatctgattataccaaagtacattcacgaataaaaacatggttccataacgtgattcagtattcaaacatgcattgcttgctgcttgccatagacaggactaatatctatactgaactgatttccttttgttttcgctatattaaatcgcctgcttcgagcacgcgcggcttagcgcgcgagaccgttctagtatttttacatatcacactaaatgtttgataagagacactactacaaaatcggtttttgcatgcggccaaaatcgattttcgtagacggttgcatgcggacacttaagccatccgactgcgaaattgaaaaataacaaaaaaaaaatctgaaaatcaatttccctagaccctaaccctagaatcgcaaaagggaactaatacaaactcatag

SEQ ID NO: 70496 - DNA, 1889 bp, Oryza sativa
taagttttagtagcctcgtctaccacagattttggagcgagaccgtggtgggtagactgctggagcccttgtttgtgttgcattggcagtaatcttcatagaggaagaagttatgtaaatgtattgcaatgacagtaatctttatagaggaagaagttatgtaaatgtacaagaaccgtaaaatttctggtaaacaatggccgctggtcacaactgatcgttggccaccttctcgcaaccgcaactattgctcactgcgtcacatatgattaagtgtgcagaagatatttgatctggcacacaggatcagcacacgtcttcgcatcatcatataccttttgttcttctggacgaggaggccatgctagtcgttaaatattttctttttatttggataaattttctttttatttggataacttagtgtaacatagtggtagaaatataatatctctatttataaacaatccattatatagatcacacccatgacccatccaaacatgtgcgtaaaatacaatgtagaattctagttataaaacagtcaagtagttctaaagaaaatttctccgagtatccaagttttagcctaagcacaacaaatttccacaacaatacaaaataaatttacaagtacaaatcttcaacaaattccttgtgtaccaccgttattttgccgcatactttgtcactcattgtctttctaccagttgtgacatcatgaggtctttcagtactagtactacacatggaattgtctatagaacagattggtgaagatacgagctattcctctcgttaaaatatatgatatttgatttttgaccataaattttttattaggatacgcttatagataagttaagtttatgactttatggaagtgcttgacaaagcaaaactgaggttgtgctcacatatcatggactcatgggtcatcttaggctgaggcatcaagaatggagtaaagctcaaagcaagcagacactgtaatacgaaagcttatgcatccatgaaaatgctcatcataattttgacccttaaatgttccattatagtaattaagcgataatagacatggaatataagaaatagaataatctaaggtgtgcttctgcagtgaaagatgaagttataacaaggacaataacaagtgagaatgtataaaagaataatccttacatgcaactgattgcgaagaagctctgactttgtttcctgttatataaaaggaaaaaaacataaatatttatgaatgtaataatatgcttatatcattatatgccacaccatggtagaatattttttaagaaacatataaaaggtgctcaaagcctgttcattgagggcttctcttagtttattgattaggtttattccagccatgttgacactttcaagttgctcagcctcaatgcactgctttaggactgcttcctgccattgaaggtcagaaaacaactatgatctttgctgaatacctatgaaatagaaaaggagtaaggtgttataagtgcatagattattttgatcaagaatttaagtaaaaggctgaaagtattatagcatcaaagtatcatatctcttcatatccagtctccaactttgtaaataaagaaaaaaaagtaaattcaggtttcagattatcagagctaaggagcattgttaataggaaactttgcagtgcaatattgttctacactgtaactcatcaaaaaaacttagtcagatttgaaaatagcaacaatccataattatggcatacatgcatggtagcactatattcaagtagataatccacagcaataatccggtaaataatctgttccaaacaggaactcatgcaaggacaatgcattaatttggtattgagttgttttagctgagta

SEQ ID NO: 70497 - DNA, 15019 bp, Oryza sativa
acacctgtccacaaaatggtcgttcagacttcagcttcctttgtcagttattaatcatgtacagagtactatttttggcataatcatgaaacatcaaagtaaccatgtgtcatggcaccttccgaagattccccaacctcggaatgatcgcagattccatcatgaattgggtcaggctggtcattgcttggtgcttgctaaccttagtgaagattgattgcacacacagtcctgctgcaaatcactcatcccttcagtcatctcctgcacagtcatcagcccatgtctatcaaacctatgtggcttcagtaggtcatcactccttattggaacatctcaatacctggtttttcacctcccttcaggtgatgaaatcagtcaaaaactcaaaacaatccatgctggagcaagttgacttggtcacccttcagcaatcagcacatccaacagctcaatagatctcctaagctttctctcccggaacacagactcaatcagccttgcccagcatctagcctctggcatgaacccagtgtccaccagtccatacaatgtgactgttgcatctgataccctcccaacatcacacagaccaatcaacagcatgtttgatgctgcatagtgaggtacaaatcctcgtccgagcatcatgcccagcaagccagccgctttctccatctctccacatgagcacaggcaattcatcacaatccggtagcttgcgacattcagctgtactccttcggacggtaacttctcaagcaaggtcactgcttccgctatccgtctatctttgcacaacccctcaagcagcagattgtatgtgacaacatcagccttacaccctttctgccacatctcctgcacaagattgatcccctcatccacattcccatgccgacaaaggcatccaacaagtgaggtatagctgacagcatccggctgaaccccagatctaatcatctcctcaaatacccccctcgctgcctccacttcccctttcttacagtgcccattgatcaaagtggcatagttgaaggcatttggctcgcactcattcttcctcataaatccaaagatcgattgtgctttctccacctgtcctagcctgcagaatccaccgatgagcaaattgtatgttagctggtctggcacaatgcggtccttctcgatcatgtcctcaaatagttcaaacgcttccttcatctgagccccacgacagagcccacctatcaatgttgaataggtgactaagcttggtctaacatcagcgcagttcatcttacgcatttcatcaaacacctggaaggctgtccccaaatcgcctttcttgacgtaatgcttgatgaggatgttgtagatgcacgtgttgggctgcggaaggtacttgctccgggggtcgcgcaggtcggccaggagctcggtgagaacatcggggcagcggcgggaggagacgaggcggtcgaggcagacggcgagggccttgcgggagacgcggccccggcggaggagcgcggggaggaggcggaggagcgcgagggagtggtcgggcgggaggaggcggaggagcgggaggaactgcggctcgaggaagcggcagggcgcggaggcggcgcggcggaggacggcggcggcggcggaggggaggcgagagcgggcgaggcggacgaggagcgcggcgaaggtggccggggtgtgcgagaagccgcgctgcgcggcggcggcgttgaagaggtcgagcgcgcgctgcgcggagggggaggaggcgatgaggcgggctaggtcggggtggtggacgtaccgcagctgcgtgaggggcgcttcgggcagcggaagcggcggcggcggcggggagggcggcgcggcgcgtgtggggcttcggtagtggagcggggagatccacgggagcggggctttggtggaagcgggtgagggtttcatgctcccctgcggcggcggatgctggggaggaaacaggctagggcggcgggcggcaggacgccgtggaatcgcggcgccgccctcgtgtggtgtctcgcgagcgcagcgcaggcagggcgccggagcggagcggagcaggagcaaggcgagtgtcctctgccttggctgggccgtttgtcaaatcttggacgctctttttgtatgtttggatggccaggatttctctaggcttcacgggagtggctgtgttcttgctgtgttcttcccccgttttccgcgcgtacgcttttcaaactactaaacggtgtgatttatataaaaactttctatataaaagttgtttaaaaaaatcatgttaatctatttttttaaaaaaaatagttaatacttaattaatcatgcaataaaatgaacttcgttttacgtgccggggaagaggggtttcttgttgtaaatttagtcataattcggcatattttaatccaaaatattaagacaataaacatgacatttgcaatatgagtagatctagtgacagtgcaagatgtatacaacttgagtatgcttgatatgaaataagtatcaacatttacatagtaacgcaatactgccattgcgaagagtattaacaaagaaacatctaatagaatcgggagaatgaaagtataccccgagaacgtcccaccgctggattttgaggcagtactacctccgttgatgtcgttcattatcttgtctccaatctccgtcgacatcttggtgaaggcgtcgatgcagcagcagtagccgtgaagaacaagagcagttcgtccgcctacccgtgcaggttctcaagcggatggagtttcggaggcacctgctcgtcccgtacacctgtgcacgcaggtgaacagaatcggggaaggattttgcagctcaggaacagaggaggaggaactcgaagtgcaagagaggccgggaagaacttctcccgtccttctagtcactgcggagtatataatatgcgagtgcgagagtaacgttcggagtcatcaaccacggtgtttaatttcgtaaccgatgcgctcgttaatacggaatcaattcacggcatttaattccataaccgacggaatcaattcacggtgtttaattctgtaaccgacggaatcaattcacgacgtttacttccgtaaccgacgcgttcattgatacgaaatcaattctccgtatttattaccgtccgttacaaaacgagagagtgtagcaaatgtctgcctcgcctcgcctcgcctcgcctcgcccgcctggctgtccgcgcaccatctcaaccggtcaacagagactaactccgtatttaagttgagacctcttcacccgatttccaaggtggtattattacccatagcacttaatgtgggccaatggaatttattaggatttaattgggcttagcccattaatctaacaatccccaccaaatttcatggctcacaggaaatgctctcgattctgatcttgtttgttataccagtgtttcggtggagactgttaagttgaacttcctcctaggaaaaaagctacaccagattacaactgaaaaatggactataccttgaattgtcagtcttgtgcgattcaggtttcactcaaacccttaactggtactaggctgccgtttgcatcccctctgtttggagcgtataagtcatactcccggccttttcatgagtatctagagatcaaccagatctcatagactgtgactagcagtcggactcatataggtgtgttccttctaagatgttctgtaggccaacatatctgctttatgaaaagctactcggattacattaaggtgtataccatcctaccatacagattagaagagaagtgcatcatgaagataagcccattttagggtctcttctctcagttacacaatagtttgtttcgccatccaaattcacgggatctctgatcacaatagacaggtttccattattgtgcaactctaagtgggtctcaagcccatctccctcgatgcacagtctatcacattacgtggtagccccttggtaaactgatctgccagatttttagccgtctggacatagtccaatgctatcactccggagtttttctgctttctgacagacttcagtcttcttttaacatgcctggatgacttcatgttgtccttcgaactgttcactttaataatcattgtttgattatcacagttcatcaggattgctggtactggtttttcaaccatcggcaagtccatcaggagctcacgaagccattcggcctcaactgtggcagtatctaaaactgtgagttatgcttccattgtagaccttgttaagatggtctgcttgcaagacttacaggaaacagcgtcccctccaagtgtgaacacatacccacttgtggcctttatctcatcagcatcagatatccagtttgaatcactatagccctctagtacttttgggtacccagagtagtaaatttcatagctcattgtcccttttagatagcgcattactctttcaagagcatgccaatgatcatctcccggatttgaaacaaaccggctcaacttgctcacagcaaatgagatgtcaggccttgttgcactagctaagtacatcaatgaaccaataatctaggagtatctccattgatcccttgctattcttcggtttttccttaatagcacactaggatcataaggagtaggagctgccttgcagtcactataaccaaagcgactcaggaccttgtccacatagtgagattgcacaagtataatcccaccctcatctcctctcggtagtttaatgttaagaattacatcagctactcccaaatccttcatttcaaagcttttggacagaaagtccttgacctcctcaatcacattgagtctggtcccaaagatcaatatgtcatcgacatataaacacaagatcactccctctcccccaccatagcgatagtacacacatttgtcagcttcattcacaacaaagccagcagatgtaagtgtattgtcaaacttctcatgccattgcttaggcgcttgtttgagaccatacaaggacttcaacagcttgcacaccattccctcttgaccttctagtacatacccatctggttgatccatatagatctcctcctccaaccctccattgaggaaagctgtcttaacatccatctgatggacgagtagaccatgagaggctgccagagtgagtagtactcgaatcgtagtcaagcgaacaaccggtgaataagtgtcaaaaaagtcctcgccttctttttgggtataacccttggccacaagccttgctttatacttttcgattgtaccatcagccctaagctttttcttgaaagcccatttgcatcttacaggcttgcacccatatggacgctcaatgacttcccaagtaccattagacataattgagtccatctcattgcataccgcttccttccaatagtcagcgtcaggagatgaatatacctcttcaatggttcttggagtatcatccacaagatatacaatgtagtcatctccaaaaaactttgcagtcctttgtctcttactctttcgagttgctacaatgttatcctcctcaggatttcctcaagcatttgatcaatgtgttctatcggtgcaaactgctcaggggataaaataggttcttgactagaagtgcttggtgcatttttcataggaaattcattctcaaaaaatgtagcatctctggactcagtaattgtaccaacacgcatgtcaggtactccagaatttactattaagaacctatatcccacaccgtggatagcataaccaaagaacacacaatctacggtctttggtccaagtttacgctttttggctataggtacatttaccttggccaaacagccccatgtgcgctggtgtgagagatttaatttcttcctttcccttcctcgaatggtgttacttccttaagcttagtaggaattctattcaggacatgacacacaatcaatattgcctcacccaccattccttggacagtcctgcagtgtctaacatggcattcaccatctcagttagagtacggttctttctttcggctaccccgtttgactggggtgaataggggggcatcctctcatgaataattccatactctttgcagaaagaaataaactcattggaaaaatactctccacccctatcagacctcaaccttttgattttcctttccagttggttttctacctcagcgttatagatcttaaagtaatgtaatgcttcatcctttgttttcaataggtacacatagcagaatctagtgcaatcatctatcagtgtcatgaaatatttctttccccctttacttaacacgttattaatttcgcatagatcggaatgaacaagttctagtggtgccaaattcctcgcctcgatgccttatgaggcttgcgaggttgtttcaattgaacacaagtatggcacttagagcgtttgactaaactgaattttggaattaaactcatgttggctaagcgtgtcatacaaccaaaattcacaaaattcacatgacaaagtcgcgaatgccacacattggactcatcatcatcatcgcctacatggttcacaactttattacatatatcatccaaggaaagcggaacaagcctccgctgtcataaccttttccaataaacattccatatttagatacgacacatttattggattcaaacacaagtctaaaaccatctctacacagtacagagccgctaactagattcttctttattgaagggacatgctgcatgttcttcagctgcacgatctttcccgaagtaaacttcagatcgaccataccaacaccatgaatagccgcaagcgatccatttcccatcaacaaggaggaacctctcccgacctgataagaagaaacagagaaatgccagcacacacatgaatattagcaccagtatcaacccaccaatcaggtgagtgacagacagagagaactataggtaaaaatttaccatacctcgatgttcctccgccctcactaataaccatgtttgtagacttcttgttcttgcgcttaggacaatccttggaccaatgcccaggcttgccacacacaaagcaatctccttttacctttcccttgcctttcttcttaaaattggttgtagccttgggtttgacgtcaggtttgactttcttgttgttgttgtgggatgcgtgagggttcttcttctgcaccaaattggcactagaacctccctcgatctttttgccccggttgccctttgcccttgacttctcctcaacacccaaagagccaataagatcagtaacactgaactcttgcctcttgtgttttagagaagtagcaaagtccgtccaagaaggtggcaatttggcaataatgccacctgccacaaacttgtccggcaactcacagttgttgttctcaagttcctttgccaacatctgaatctcatgagtctgttccactatagaacggtcatcgaccatcttgtagtcatagaactgctccatgacatacagctcgctgccggcgtcagaaaccctgaacttggcctcaagagcatcccacatgtccttccctgaaggcatgtgcatatacacgtccacaatactatcggcgagcacactgatcaatgctccacggaacaagcaatccgtagcctcaaacttagcctcctcctcaggggagatagacggttcactcggtttgccccgtgaaacaaagaaacattgcatcgccgtcaaccacaaaagtgcatgtgctttccatcttttataatttgaaccatcgaaagcatgtggttttagtgatgcagcaaagccaactaccgaaaaagacctattaagtttttggattgttggaaatttggtcataattcagcatattttaatccaaaatagtaagacaataaacatgacatttgcaatatgagtagatctagtgacagtgctagatgtatacaacttgagtatgcttaatataaaataagcatcaacatttacatattaacacaatgatgccattgcgaagagtattaacaaagaaacatctaatagaatcgggagaatgaaagtataccccgagaacgtcccaccgctggattttgaggcagcactgcctccgttgatgtcgttcatcatcttgtctccaatctccgtcgacatcttggtgaaggtgacgatgcagctgcagtagccgtgaagagcaagagcagtcgcgcttgaagcgctacccaaaatcttgatcgtccgtctacccgtgcaggttctcaagcggacggagtttcagaggcacctgctcatcccgtacacctgtgcgcgcaggtgaacagaaccggggaaggattttgcagctcaggaacagaggaggaggaactcgaagtgcaagagagatcgggaagaacttctccagtccttctggtcgctgcggagtatataatatgcgagcgcgagagtaacgctcggagtcatcaaccgcggtgtttaatttcgaaaccgacgcgctcgttaatacggaatcaattcatggcatttaattccgtaaccgacggaatcaattcatggtgtttaattccgtaacgacgcgttcattgatacgaaatcaattctctgtgtttattactgtccattacaaaacgagagagcgcagcagcagcagctgtctgtctcgcctcgtctcgccccgcctggctgtccgcgcaccatctcaactggtcaacagagactctccactaactccgtatttaagttgagacctcttcacccgatttccaaggtggtattattacccatagcacttaatgtgggctaatggaatttattaggatttaattgggcctagcccattaatctaacatttccaaccccctcctctgaacaaaaggctacttttccaacttcacctattttatttttgacgtgcacgtttttaacttaataaacggtgtgactttttacaataactattatatagcattcaagcgtcctagcgatcgtgtcgaccacatgacctgaaatgggacaggctggcttattagttcttttttaatggctttatcctgcgggcttaaggactttcgcgaatcctgtgagcatgggctaacgatgagggttgtcgttgttgcgaaatctgattaaatgacgtggatcgccgttgttgcaggatccgatgatttgccaattgttgcgagaatcaccgcagcagagataattggcagatgtgattgatgaaaagcttgtgaccttaaccttgccggcatacaccatgaagtatgcttcaagcactgacgggcgtgggcattaaaagatttatggcgtttatgggtacagcaacacacctctgcagagtgtatgaattgtgatatgtcactccctgtttcgggtagaaactgtaaacgtggcaggaaagaaatatatcggaagttctaatacctgtggtaccttatatgcagtagatttttataattactttatatgagcttttacaatactgttttataaacatgcacaggcccggccctggaggggggcaagcggtgcggccgctctggcccccgactcgtaggtgtccctctccacccgcttcacccccctctggcccaacagaaactgatgcatgcgggaggtaagagcatgcccagcagctcttctatccggtcatccatcctttgtttagcatatggaggggaaaaatcatgctccagcaaacactccatcacacacgccatttttagacatcctccaaaccgagccctctccatgccaaatttggcgtttctctctcctcacgtcatccccccaactgcctagctccgatgactcgcgccaccatccggactgtaccatggggaaacagagaggatggacataccaggtctgccatttggagatcgccggagtggaagccccgccatccgcgccgccccaccgctcgcaccgctgctccttcatcgtgttgcccccgtcgggactcctctgcgcgcagcctccgcggccaccgcgtgcctcctccctgtccagatgcaccctcgtcggtcgtcctccaccgcccctcgctcgcccgactgccgccgcccctgggctcgccagcttgatgtagagaagtagtactagtaggaacaaagaagaacgatgcagagaactagtactagtaggaaaaagaagaaatagttgagcagtagtactagcatatagtagtatatgttacttgcattgcttttatactcattttaaatatatgagttaaaaattatccattaaaaatatatctgttaaaatttactcatttcgaaatattatagcgataaataacaccgttaaattaagttattcaaaatatatcccttcaaatacaaatgtaaagttagttggaagatattataaaatatagaagaatgtgatatggaggatgcaatttggatgatctgctggagtgagaagagatatggaagatgaatctttttggatgaccatccatataggaatatgcaggatcgaatttggatgagttgctggagacgctccgagttcctgagaatcccgacggcatcgacgcgcgcgatcacgccgaaccgccgctcacgtcctgacgcgaagtcgcgaacgcaagatcgcggccgctggcagtagcaccgtcgcaacacctcagccatctcgtccaaggccgccgtccgctggccgtttccgcgcacttccgcttccgccgcgcgacgcccatgcgaggcgccagagacgcagccgccgagccgcgcaggtttcttgccgttgccgtgttctacacttcttctcatgcctcattgatgtcttgctgttgctaatttgctgaggttgtgtttagtttgtgtgccaaaattttttttaagtatacggatacatatttgaagtatcaaacgtaaactaataacaaaacaaattacagattccacctgaaaattgtgagacgaatctattaagcctaattaatctatcattagcaaatgtctactgtagcaccacattgttaaatcatagcgtaattaggctcaaaagattcgtctcgcaatttacatacaaactgtgcaattgatttttttcgtccatatttagtgtttcatgtatgtgtccaaatatttaatgtgatgaaaaagttaaaagtttaaagaaaaaagtttaaatctaagcacggcctaaatcactgcgacgatcactgattcactttactggtctagtgagcagcaacaacaccattgccatatgaaaaattgtaactatgattccatgtgtaaattgtaatctgttatttgttgcctgttgctaattcaattggacgagtgttggatgaaccaacaatggcagtgtgtgtcccgacgcacttgcggactggtcgtgcgctgcgcactcggatacttgcaatcaactacttggtaagatatactaaatctagatttgtaattttctagcatactttatacgagttaaaacactgtagttatgttaattttttcaatcattaggccatattgtcgataaagtatgcatcggatagcgagaaaaggggaaaaacgaaaaagagtggatggtttaataaaagcctagaaaggagcattggacaaatttttaagaggtaacacgtgaacgtcaagcaaatataattttaaggtaatatgtacaatgttttctataaaaattctatttctgaatgcaatttaaacgtttatggcaataactcatatatatacgttaacaacctctacatttagtttcgcatcgggaccttaaaaactcaggaccggccctgcttgctagctccaatttcttgcatgctcattgggaagaaatcacttgtgctctccaactatactgacaacgcctaattaaaagattgatcctactaacactatgggtttgttcggcggttcagtacagttgcagacacaatacactatttgtgttggccgcacaacagtgaaattaagtacaattgagccgggcctatatctctcattgttttctggttagcttatcaaccacatgaaaaattaaattttagaacttgaatttaattttaagttaaatttgtggttttaaattaaagttaatttataggttctctcatcgtattgtatctttcggcgtttacttttaaagctctaaacatagatataaaaacttgcccataaattatctttggttgattcattcgccagctcagaaatcttgtagaaacatagggattgttcattttatagtcaaaatcaactttaccaaattttgatgatgccaaattttgacacgttttgacgttaccggatttttatactatcggttgtgtttatttgaaaccttatcaaattttggttgagtttttgtgagagaacttccggaattgccaatctttgttagggtgacaatgataacattatatttagtttgtttccctaccaaaacctagtcatatcaaaacttgataaagttgaaagtagcaataaagtgtatatatccatgaatcaaaggtataaaacttaatatattttaattgatatatacggatggtttatattttagaaacacacatggaagccatatttacttgatttcaacatctactgacgaattgagatccggtgctgtagtagtaacaactgcaaccttggcagtcggagcacattataaccgttggatcgatggacccaacagctcggattcgctctaccatcccgttgcaccatcgatgctacagtaaccgctacagtgtaagtttgccacagtattttatgaacaatactttcttaccatctgagccgtcagttttttatccatcggctgcactgcaactgctaaacatgcagtcgtagatctcgatcctcaccaaggcacatgctagcacagcacaaagaaacgtaggagtactctgctgccataaaggcaaaaccatgtggcttcaccttctctgctgcaagagttccaattcctatgcatgccaatgtttctccattgtaaattacctgggtgatgaggagagcagcaacctctagttataagccaagaataatgtggagccgtggaggtgctggagagtcaaaagaactcaagttttagtagagtgaaggagaacagcattgtgacattctctaatgtgaggtacatgcctttctcggtttgatagataatgatgtagggctatcaagtatttacccaatgcttacatttgtttgttggtgtgtatttccacataagataggtgtggcactggatgcccgtaggtcgtatgtgcaatgcataggagtgggattgtgaggcagctttgggaatgatcggcatctaccacgtttacatgacagtctctctttcagatcacgaggatactttaaaaaaaaggagatttggaggcagcggcgaagccaggatttaggtattaggggggccaaccataaggtcaatgtatccaaaagaaagcttattggctgcttggtgaacaacgtgttgtatgcatgatcagttttcacccccctacagaatggtgtccttgcaatcaatcttgtgtggacgtctaggcggtttatctccatccatccacttctttagtaaggctgagttgttttggacaacttctcggtttttcatgaggtactacctaaacggttaaataaattgtttgtaggaaagttttttatataagtttcttaatatattttataagtttctaataattaatacctaattaatcatatgctgccgttagaaatatacttccaatcgctgaatcgaatgcaacctaagaattacataattgaatcatgcaagagagagttaaacacaatttatgtactccctccgtttcacaatgtaagtcattctagcattcccacattcatattgatgttaatgaatctagacatatatatctatctagattcattaccataaatatgaatatgggaaatgatagaatgacttacattgtgaaacggagaaagtagttctatactagcagtctagcactgagatttgatgcactacaaaacatctcaattacttctttaatttgaagactccatcctgttaatttgtcgcatcacatcaaaagcttcacccagctgcttgcgggagttttagtgagttgctgatcgatgctcccagctagagctatgcatacgcattcagctacacatatccatactcgcagttagtgagttgctagctaccgatatatactcttgcatctattaattatttatctagggaagggaggggggaggaggggggaggatcagaggatgaggggtgccaggccctccccggcaccccctgtggtgaacccatgtggcctcgccactgtttggagggagatacgtgtcttcaaacattcttttaagaaaaaattaaaaaaattgtgagcgtgttaggattaaacacgggacctcagggttaaaactacacatagcttgttactgcactacattagaacacgaggatactacaacaagcaagaggtggcagacttgagagataattaatgctagaccacataatcatggatagctaccaatggacacacagtggaaccgaggatgagtttgaagatccaccgaagctcacatgagtgtaattgatcaatcacagaagttgttgattgtgtgtgtcccgtagttcgtagatagttgccccttcattgcagatcatccttactcaaattgataaacaatgctaccaaagtcgacacatacaagtacagaagtgcagcgagcaggcggttttgctttcctaatcagatcgaaaagtggtttcaaaattaatactatatttgattcaaacctcttgcatgactaattcattttttcctcatagatccggcagataaaatacattaatatactaccttatgcttgacattgaaaaaaaatatatttttttataatttcagttttcaattttcaattattccaatgggcaccagtacccgccactctgcctgcagcacgagagcggcacctggtttgttcatgtttccgacggccgtccaaaaccgccaaa

SEQ ID NO: 70498 - DNA, 1466 bp, Oryza sativa
cagtgggtgtccatgcctcaaaagattgagacggaggaggaggcaatatgaccttgtaaccaacatgcactcagggtagaaccagcaatgaggaggagggggaggggatccgttttcggggggcctgcttcgccattgccatgccttcatagaggagctctctgcaacagagaggaggggaaggggaaaaggagggcaaaataggagaggcggaggaggaagacgaagactcggagagagaaggcaaatagataagaacaaagcgttacctacttattccatttccacgggatatggttgagtagtttttctgtttacatagtacatcatgccgaaactcctcatccattactatagttgaagatgcatgcttaattatttctatgtatgtatatatatatcctcttcacatatgtacatatcggtcatcagttccttgctccagcctttaatttggtcgctaatagtaaccgaaacacacgctatttaccaacttgagcaacactagaaatgggaggcatgtggaatcccatcagctgtggcaccaatcgacgaagttttagtatagcatcagctactgaagctctgggagccgacaccgtgggattgtaactcttttccacctcgtactcgcagcaggaatcgatcaaacaggaaaaaactggaattcctattagtacttgaaccatggatagctgcagtagcagttgtactatatactaatgtgctaacatgtgtcttggccggtatctcagtatatatggggttgaatttcactcgaggcgttgctgctagttgaatgtgaactgcattcttctaaagtgacagctgctggtaattgagctaatggatcgacactagggttttcaattttgatttcatccgaaattttggtactttttggaccttttttttttctcaaaattttagcataatttaactgaatttaactaaattttggccaaatttgcaaaaatttgagaaaaccgaaaatttcgactaaaataatcgcttgccagcaagggggcctgaaattttgaactgaaattgcaatccctgatcgacatgccaaatactttctggaggtaggagatgaaccgtattgtttagaaagttcacatcagtttcagagaacattgatgtgtgtgtgtgcgtttgtatgtgtgggttggggtaggggtgagcgttcggtttactcggttaattcagctcggtttcaacggtttaataaattttggttttctattgcaaccgaagaatctatataaaaaagaaaaccgagccgattaaacggagtaacttcggttcactgaacaaaccgttggaacacgttgccatgaggccacagccgtggcttcgcacgataacgtgatgataataaacagggcttgagacatgggtagcttaggagatgttgggccccattaaagagatgttgggccttaaagcttgcacgttgcctaatt

SEQ ID NO: 70499 - DNA, 1546 bp, Oryza sativa
aaatattgaagattggaccaccacttgttgtaataatataacacggcatcatatttggtgacgcatgccgagatgtcgaagctcctgtagacgtcgtggttggtgaagtaggaaagcggtagtgaagacatataattgtgaagataaaagcaccagccggcggcggcataaccagtcggcgacggaagacgatgatgtccatcagtagtggtagctgtataaaccagacgtagaggcgagggcactagtcaacagcagacgagacgaccggcgatgaagacgataaggccaatcaacactagcagaatcatgcagccatggaagtgaataaaccagtcggcagcagacgtaggcagcttgtgttgaagatgctgacgcctattagcggtgacggcgatgtagccagccgtgaagaagatagcatcagttggcgtcataacaggccagccgtgcaggcggtgacaccagtcggcggcggatgaggcggccggtcagtgaagcggccggtcggtgaagacgtagacgcccaacaacggtggcataatagccagccgtgcaggcggaaacaccagtcggcggcggacgaggcggccggtcggtgaagacgtagacgcccaacaacggcggcataataggccaaccgtgcaggcggaaacaccagttggtggcggacgaggcggccggtcggtgaagacgtagacgcccaacaacggtgttgtgaccaaccaaccgtatagacgaagacaccagtcggcggcggcgacggcaagccagtggtgatgttctgactgatccattcctggggcgtaagagataagcttaaagccatgaatcccttttatgcatatctggatctggatcctgcagaacgaacatataggatgagtagtatctgatgtaaatataatacttcgagaaaaattcaagtattttaaaatatttataaatatgtatttcttctcttgtcaattttgattcccccgagcagatgactcattacgtttaaacactctgcccgactagtcatagccatcaagcaccgggagtcggcctaagcacttcccaaacatgcatatgagtgacatgagttcgtcattaatggaacaaagtttcatgggtcggagtttactactcgggtacttttgcaattattaagagcagaaaataaattatcttatctctatgcttttgatttattccgaataatacttagcaccttgcgttattcggtccatccaacaagcccctaggtgctaggaatcggcccaaaggcaactatccattggcaaaccaaacggaaagcataggaagatggaactccataactcgataggcacttttgtattcagaatatgtcgcaagcaatcaagataaatattatgaaaattgtttaaaaaatatgatataacatctgtagcccccgactcactagtcaacggcgaaccagttgatgtagtgaggcaaaggaaaaggcaaaatatcatataaagaataaaataaatgatgacttagctttgtcatattccccttgattatggcagaggtg

SEQ ID NO: 70500 - DNA, 1110 bp, Oryza sativa
ttgtttattaatacttgctctatccggtcaacagccatatatatgagttgtaattctgttagttgcattggccaaccactgctacctggggagatactccatcatgtaatatttagttataattaccactgtatatactccatcaattatatggtaataagtagttttttttttcttttttcttctcaaatgttatgcacatattgcatgttgaaagttatttattatgtccgcagcaacgcgcggggtattatctagttaagttaatggatgaaccatctacatctgtttaatcctaaatggatgcttcagtattgaaaatctggttgtttcggttctgcctatgaatttttgctgctgttgtttctgaatggatgccattgctgctgtttatgaactgactagtgtctactagttgcccatgtggaagctgatgaaatctgatgtttgttacactgatgaaagctggtgtttgtttcactgatgaaagctggtgtttctgcttctgccgcataacatatttggcactgatacacttactagcatggatatttgggatttaaacacaagtacaaatccaggaacacaacatgtgagctttgcattcactgattaatagatgcaatttaactgaaacagccagatttaaacacaagtacaaatccaggcacacaacatgtgagctttgcattcaataccgatgcagtttaacaacaagctgggcaaaatcaacccctaatccataagaaagtttgcaaatacaaaatgcagtacttctggtgcaatacaggtttggaacaggtctgcaaataacaagaagctggacaaaatcaacccctaatccataagaaggatggctagcggcgctgctctgtccgggatggctggcggtgacggaaagaaaggtgctcgggcggcgggcaacggcggtggcacctgtgctcggccggctatggtcgggcggtggcggctgtggtcgggcgccggcggaactgctacggcggacgacgactcgtgctggacttgaagggattgtttcgcctgctttggcggtgccgaccgagtggcccaacgagcgaatgcctccttttttccgatcgagcccctcct

SEQ ID NO: 70501 - DNA, 44253 bp, Oryza sativa
caaccgggactaaagatcttcctcttattaaccgggactaaaaatcatttttagtcccggtttttaatggaaccgggactattgtggatatgggtcgaccgactaaagatggtttctctaccagtatatggcatttgaattagggttgattaatttctccgtgctagctcctaacccgatcctgacacttaagcttagtctaaggagctctctacttcccaaacttaattagccaattatacaatactatatattatcctgacacttaagcttaatctaaggattttctacttatggcccctttgatttagaggaaaaacataagaattttagaggatttcaatcctataggaaaatttcctatgaagccctttaaaacaaaggattgaatcctatctaatcctttgaaattcctatggaatggacaattctatagagattttggaggaaatttagcaagaccttcaacctcttgctaactttcctttgagtctatctctctcatccaattcatgtgtttttcctatggttcaattaaacggtcattcctgtgttttgcaatcctctattttatacttacattcctatcaaaatcctacgtttttcctattcctacgttttctcaatcctgcgattcaaaggggccttagcaaacttaattatctaattagaaaggtgactaaaatgagagaccatgattttatctttgcacttaagcttagtctaaggagttctctacttatcaaacttacttagccgattagagttagaaaggtgaataaaatgaaagaccataacatttttcaaacgaccaaatagattgattaacgttatattaatagaagggagtttagctgggatttgggttgggaagacttttccgctaatcgattgatcatcgcatttatactgttggccaacagtggcgactgcctggtatggtcattatcgactcatactccaatatgtttataccaactattatatttaaatggccagcagtggagtaataagtaacaatctattatttaaattatgataagattcactcatatatgtttatacaaacttgttactagtaagcattagatcagctgcagattggttgcatcaggtgtacgtacagaaatccttccaacaaaaagcatatgtaccatatgacaatatgtacttatgttgttaacttgttctagaattaactttccatcgagagatttaatcggttaatgacactcacgttcccctggtagccgttgtatatcattttcaggtcaagaataaactaagatatgaacatcacatccatacccatccgacgattaagttaggtggccaatcactcttaccatccatatatgcatatgctccattagttagtacggagtacttctttccaaaatagtataaacattgtcaagtaaatagccaggaatgcttattcgtctagttgcacaatcagaaatatttatattttcaaatggagggattactcaacttttacttacaggcaggggaagtcagtactgagtagctagctaattaccccgttgatcatgcaactatgcagtgacagattctgccagaatttggttcatggccgctagctgcagggcatgtgtgatgtccccagtttgaacagtagagagcagccggcagtatgcacatatgctgcatttaaggaggagttaggaccggagtaggagtactagtacttgtttattaatcactcatctattagcataatggtccatggtgaaagtacagcaaaattaggtgaaggtaacgtcgatattagttgtatagaatcatagaccatcttcccaacagtggtactttcagatcatctgtccttgtttccgtccctgttggagagcgacaatcggaatggtcactgacaagggacctctctgttgcccggaaacgacgaaacatccagttcagagttgcagacttcagacagttgccaaggatcaatggaaaattgcaactgaaaatgctggagactgcattgagattgaatattaattcctccaactataattgaatttcatccatatttttggaactagatgaatatgatatccataattgtttttaccctgggtaatctttagacctatgttatttgtttgtttttatgtgatgttcacatccatgttccatcaaaccatgtattcaacctgtattagaggttgttatttggttcaatgcttcaacttgccacacctctttagacttgtgtttggttcattgctatagttgtggcttacctatacttttttatcttgtctcgcatatcatagacttaatctttatctaattttaccatacttgtctagaatgagttatggcaatattagtaaagatccaaacaaccctgatcttcttattgggcttctcttaagtttatatgcaactggtcccttttaggcccgaaagcttgttcagtatgtgtgctgggccgtatggaaccatgacttatagaaacttctggcctgctcgggccctgagcccctgagcctattctttgtcgagactaattgggatgtggccttttgggttttcaggcaatagaacagtgtgagaatgctaccctcttatcctggcccatttattccacgaagctgaaatttattttagccttttgggttttcagaaataaaaaagattatgcaagtgtttgaaccctttattttcggtctctggacctattcagattgtagtcaaaataaaccttaccaatttttggcaatgccattctaaaattttggcaggatttcttatgtattgatcaaattttgcaacaaactaaatgtagatatgtttttggtaactttgccaaaaaaaaatgatgtgattgaaaatggcatcaaagtgaacagaccctcaataacggagtaccggcccatttattttatcattttgttccggcccatttattcctcaaagcagcagcctttaacgatgtatggcccgtatgaactttacggccttaatcagaggcacagtgttaagaccgtaaagttaggcccactacatatggttgagtaattcagtgttgccaccagcgccgcataaatatcttgggataaactaacttttgaatccagaaatagaagaaaaaaatagtctggacacatgcttgatggttgatgcaagctgatgcactcttttatctttacagagggagctccaggatacaagcatatgctagaattaatttttatacatacgtacgtaggtataaatatatggtgtaataacttaatatatagattttcctaacttgacaaaaagaatcggcgcaactaataattgaggagaaagaatttggcagctcgagaaattaaccggcctgcagacgagcgatcgcctagctaaccaagcaaccaaggcaatccgatccagcaatgctgatcaacgcccgtccgccgcctactttttataccgtgattctaaaaatcgaacataactattgttgcaattcattttttattttctagaagtcccgtcaaccgtcagcggctctgcaactatactcttacacaccccgcccgctgcttctcctttttattgtcattgagattttaaaattcgaatatgattatcaatgttgttttttttttaactttctagaagtcccggcaaccgcctttcatgtttgcttcacggcctgcctgacgtccttctttttaatcgtcattaggattctatttggtgttttattaacaatttttatatggcgtatcaaccgccaccaactctactcatttataggcatgttatttaatttatctcgtcatgtgttttagatggtcttttctttcaatagtctttatttttatcaaaaattttagttatttataaattttattcataattgaaatcttttttttttctaatttcagaatttactttttttaaaaaaaatagttgatatcgtattgtgttcttttaatgtttttatttttaattttcaatttcagttgtttcataattgtatttctacttgaactctcttttaattttttctaattttagatattattatattttttattcgaaattttaattaatctcgtatcgggttcttatatggattcttctttcaatattgcttatttttaattctgagtttcagttaattttaaattgtattcctacttggactcttctttattttcttttgctaatttcggatttatttttatttttattctgaattttaattaatctcgtattaggttcttatatggattcttcttttaatatttcttatttttaattccgaatttcagctatttttaaattgtatttctacttggaatctcattttcttttctaattttgaattttattttatttttattttgaattttgattaatctcgtattgggttcttatatggaaacttctcctttccttttctaattttagattttattttattttatttcgaattttgattaatctcttattgggttcttatatgaaaacttctttcaatattgtttattttaaattcagaattttagctatttttaaattgtacttctacttcgactcttcttttttttctttttcttcgattaacgtagctgaaattcagaattaaaaataaagaatattaaaagaagagtccatataagaacccagtacgagattaattaaaattcggaataaaaataaaaacaaacccgaaattagcaaaagaaaataaataaagagttcaagtaggaatacaatttaaaattagctgaaattcgaaattaaaaataagcaatattgaaagaagaatccatataagaatccaatacgagattagttaaaatttcaaataaaaaataaaataacatcgaaaattacaaaaattaaaagagtgttcgagtaggaatacaattttgaaataactgaaattgtttcagctaattttaaattgtatttatacttggactcttctttattttcttttgctaatttcggatttatttatttattctgaattttaattaatctcgtattgggttcttatatgcactcttcttttaatatttcttatttttaattccgaatttcagctatttttaaattgtattcctacttggactcttcttttcttttctaattttggattttattttattttatttcgaattttgattaatctcgtattcggttcttatatggaaacttcattcaatattgcttatttttaattctgaatttaagctatttttaaattgtatttctacttggactctcattttcttttctaattttgaattttattttatttttatttcgaattttgattaatctcgtattgggttcttatatggaaacttctcctttccttttctaattttggattttattttattttatttcgaattttgattaacctcttattgggtttattgggttcttatatgaaaacttctttcaatattgtttatttttaatttcaaattttaactatttttaaattgtacttttacttggactctccttttcttctttttctttttattcaattaacgtgagaatttctagtctcaacagcgaacgtggtgcctcctttcaaagctgtctttatataatataatataatagatataatagataggtagataatagcctggacacatgcttgatgattgatgcaaagctgatgcattcttttatctttacagaggagctccgggatacaagcatgctagaattaatctgtatacatacgtacgtacgtacgtacgtataaatatatgatgtaataacttaatatatagattttcctaacttgacaaaaagaatcggcgcaactaataattgaggagaaagaatttggcagctcgagaaattaaccggcctgcagtcgagcgatcgcctagctaaattaaccaagcagccaaggcaatccagcaatgctgaacgctgcgtgtatatgcatatgaacatatgatcgatcgatcgatcagtggatgcagatgccggggagcttccactggaacttgcccgagcgccgctcgtcgggcggcgccgccgtgtagttcctccagacgtcgaggacgcctcggaggtcgtgcatcttggcgccgaggccaacacagcagttggcatggagcgtgcagatcttgttcagatccttgctgagctgacagaagccactgatgtaggtggtgtcgaggaactggatggcgatgcccagcttcgcctgctgctcgtgcttgatcaggttgaacacgtcctgctcgtgcttcccgaagaatcgccacctcccttgctgccaactccggtagaaatcgagggtcttgtcgttggatcgcacgaacaggaagccgccattggggaagttgccgaggctgtaggggtcgccgatgaacacgtcgctggagatggcgatgtctgctcccattgatatgtgcctgaacgggtccctgaaccacatcacgtccacatcctgcaaatgcattcatatggattaattaattactgtcagtgcaatccttttccagtttactgttcattcagccattgattggattaattgtactcctggattagtatgcaattcgcaagtcattctctgaattttgcaatcaatcagtgagagcgccatcaggccaggaaaaccgggcatgagcgtgtctgcttcctcttgctcaacggaatctttcagtttcacaggttcagttttttcggtcgcctgtacgcgaaagacaagccacaagttccaatccaaatggacggccgggccgacaacaacacgagtagagtagagtatagacgaacgtgtcaaagtccaaaccaaacggtttagtccaacttctctcgaatcggctgcgtctctgcttagccgaggacatttctgcccagcaactatgatgaaactgtagtgcacgagagctaagctaagctagctagccaagcagagcactagcagccaatgtatcgcccaatccggccaactcaaccaccacttcgatggaacacatagtatattgcatcgaaaacgacatgaaaatgaatttatatattgcaattgaagcgtgaaaagaagaaaataatttagtactgaccgtgaagaggaagttgtagccgagctcaaggatggtctgctgaaacttgttgcgaccccacatcatctcgaggtagtccttgctcatgaacatcttctcggagcggtagtcgacgccggtggtgcggaggaagtagcaatggcggtgcaccgcctggcacccctcgtacgccgcggggtccatggtgacgatcaccaggtggtccagcagccgcgacacgccgccctccccgagcctgaagctctcgaagaagaggtccagcagcgaccccggcttcgtccacgccaggttgatctgcgtcatgatcaccgtcctgtccttggtcgccgctcgccggagcacctcctccaggtcgccgtaaggggacgccggcgccggagcctgcacattgtatatgcacacatgattcatgattggtttctgttcacatttcatgatcagtgcagatatgagatgactacagagttggatttttttgcttcatgatcactacaaactgaactccaagaattggatttttgctgcatgcatgtgacgagttggttgcgtctctatggttcagcattggctgacaagtggggccatttttttttggaagaattgagctatgggcagcaactaaagctgagtatagcagcaatctaggagaagacacgcccatgaatgccatgctgcaactagcaaatgagctcaaaccattccttcattttatctctttttatgcaagattttattttcaacaattgaaacggccaatgcattttcttctgaacaacgacatgtgctacctcacatggttgaaccaagaatagattttgcctgtcagtaagacatactactctgtcccatagaaaatctaattctagttacaaacttttacacacatatgtctagattcgtagctagaattggttgcgaacccgtcttctctctttagccttagagcaggtttaataaagcaggcgactgccggcggtaaaaaacaccacatcagcgatagagataactatgagataactagaagatgggtgtatgtacagctgctggctatacgcacaagcaccaatgaattgattatcatttttttacgcccaatccgtctgtacccgcgcattgcctcgcgtagacccacacgcagccatgggataagctttttctacagtttctttcttcttgaagttcgtgtgtagtcggcgacaatttaggtggtgtttggatccagtgatttaactttagtccctgtatttagacactaatttaaagtattaaatatagactacttacaaaactaattacataaatggaagctaatttgcgagacaaaatttttaagcctaactaatcaataattagagaatgtctactgtagcatcacataggctaattatggattaattagactcaatagattcgtctcgcaaattagtccaagattatggatgggttttattaatagtctacgtttaatatttataattattgtccaaacatctgatgtgatagggacttaaaagttttagccccatttaaacagggccttagtcgtccgctaacaccctctctcctggttttttccatccagctcatcactttggccaggttggatgcgctatcgccggcttaaaccgtatattgtacctgctcttacgcgaaaaccgccagacagaggcgtcatgggccggctgaacatccatcgccgatcagtcacacatggaccgtccgatcgggagccggactactagccgtttccggtgccacgtgtacccatcccactgcgatggccggtgacacgtgtgagaacatggcagcagtggcagtaaacctgtgggacccatgccgacagcagctacaggtaaaaaggagctagtagaacgcgatgagtcaccaggtctagactagttacatcatgtggagaagaagggaattagctgctggtgttaacaagtgtgattagtagtaatagtgtttacatggggagaggggaaagacaaaagtggttgggagaaaggggagaagatgggagcaagaaagcaggtgtcaatggcgagcattagcatagaggcaggaccgtgtctttgtgttgtaatctagactgactaggtaaataaactattactggtatggtaatctaatcagtaatcacgcgggtttggttaaccggtcgccgtcaggctacgtaacttgttcaaagaggattcctcctcctcctcctgttaatgtgttttgttaattattgctgatcgcggcagcatatgtaaatggcatctctggtttttatttgagcttattaaatatcacaatttgatgccatctccaccaccacgcactacttaattagtattactgtttgattattttttattcttgttactgttctttcagaaaaaaaacggatttgttaactccagggaggtagaaacatctgagggaaaataacctcctttgttttttttttcattttgaaatcttcagaaatgatattggtgccaatcaattcgttttgttcatagcatattgaagcaataaaaaaaatggcaaatatgtgcatacctggacgggggcgggagccggagcagcaacgacggtgacgttggcggcggcggcggcggccagcgagtcgttggagtcgacggcggcgtcctgcaacgggagcggcagcggcggcgcgtcgtcggcgttgctccaggcggagatgtcagcgaggcggcgtcccgggctggcggacatgacgaagaggatgcagacggtggccatggcggcgcccagcacgaacgacaccagcgggctaatgctgctgctgccgctgccgccgccgccgcccatcgtctccccacccttcatcttgccgccgcccagcatcgatcgatcaaccaatcaatcaaactatagctgcttcctccgttgatgtgacgaatggtttcttgctcaaattaagagaggttcttgcttcttgtggcaggatggtggaagaggaaggaaaggcaaagcctttgtctgaagaaaggaacaagaaggaggtatagtagtagcagagaggagagggaatgggggtatttgatggaggagcagcagcaacaggtaggcgaagaccagcctgaaagggaattaacgggcgtgatggaggcctaagagacagatcatcatcatcttaatcctctcccactgattgatttactcgtagttttggctttgctggtgtgatgacaacttgtagtgtgatgcgtgcctcttgcttcagcgtgacaggtttcaaagtcgcaacacacggttgctttgctttgatttgctagctgctggagctggaggtcgaggtttggctgtcaggaactcaggatgggttgggttgttggtgccgaccctgtctgcctgtaggttcgcgtttgtttaggcgtagactggacctgatgcgttgaactgttgagatggacgtaataaacccgatccggggtattattctgatttctgaattctctccctgcatccctgcaataactgaatttttctatgctacttacctgtacatgacattgtgtacgcgtctttggaggtgatttttttagtgttgcagacggctggttggttttattctgtttgctcacatgggggagaaacaatatttctgaatttccctcgtactgtgtaggaaaataaggttcgacatgaagaaaagaactgcacaatcaaacgttggatactgttgctaatttgagtacaaaacggtttcatgctttgaatattgttgcttatttatgtcaaaaaaagtattgttgcgtacaaacggcttcatgctgtatggtaaacaccgccaatcattcgcgtgctgagtcttacaaaacgaacaaacattcactatcggtctatcgccgcatgtagaagaaaatgatggtaatttcgacctgcaactgttagagttgattaattattaatttggtgaagattttttctctaccggaaggaaatgactaaggtgctattagcgacttctagctagctaggtcagacgccatctgatggccaccacaccctatatgctactagtatgatgctgcacttgccgtgttaggtttgctcatgtgtaagtcgcagcaaagctcatgccgctgttgccatcgatgagcaaaccttacctactagctctgctatctcatcgtcaactccatctttcgctacttgcatcttcagaaaaagttcagaaaaactcagcctgcctcttttcttgacaaaataggttccttgttcagagttaaattgaactgtctgcagcgtattcttttgtagtttttcgtgtatctagcttgtcattttgaggtaagcaagtaagcaccaacttctgtcattctcggtatataaacaaattggagaagtaggcatctaaataaagggtagcgtgagcctgtcattctgccgccaatttcgggattgcatgcaagactaagctttgaactataactgaacaagtaatctgatggcgatttgtcggtgcagcgatttggtactagcactgctaatctgaagcacaacagaaggattgttttttttttttacctagctttcactctgcttttgcaatcttgcatgctcttgggtgcaaactaccatccatcaatagctttggccgatacagtgctatatacttttgtgtgtttctgtcagatcagtctatgtgcaacagtgcaagtgttcttctcaactgctgaaaaagccaatgccggaggaactatttttaggtggaaacatatactatgcagtattgcagtaaattaactctccacacgggcgggtgaataaacttgtttacactgcctattattaattatctaaaaacattattcatccattttcctatagacagacgtctctattgaaggcctaaatacatctttgactaactatcttattctaatcattttgggtcagggaaaacaacatgtacaaaaacgtgcatatttccatggaagttagcagcatatgcaacacatattctgttaactaatcaggtcgggttcctgtcccgatcatgattcatgagccgaaatgtctaatagaatggcctagctgactgattgttttgcctaaccatataaagactggccgggttgattattatttatccggtattttgtcttaataatcaccagatacaagctgcttgccaaaccttaggcgcagccatgtacacatttttgcctttcctgttgttggttgaatcataacattagcaccaaactgtctgtttaccagtcttgaggaagaacaacaccgtaaatcacgctggaaatgctgcattttgctagccattcttatgtagttgatgatattatatatgctcctaggtttatggcaagttggcagagttaatttgattagaacgacagatgttaggacgattactgtgttggaagtttcttggattgacctcaaacgtgcaagcagatataaggctggcaacttgactatagttattagttggattctgtagtctggtctgcacatataatattatacaggtaatcagacagcattatatattgatatatactactgaataaaggaactaagaggttcagttttaacgaatccatgattgcgacatgaacaagaattaatctattcatatctagctacttgctacgatacgagctaacatgcacccaaatgaaaaaaaggaagagaaaaaaaagaagatatgatgtgcacaacagtacagatggtatatgtagccgtttgcacatggcttctcaagaacaaaatgcagtggcttgccaaaacttaggacagttggaggctctgcatttgtgtagcgagtataatattgggaaatcttgctgtttaagagtaaaccagctctgcatagctatatgaaaaggagtatcaggtaaccggctttgcaggggacctcacacggagagacgacgacagtggagaggttgctgtttaggtgcatgatgccattgctattgctgtattaggccaaactcaactcgctaggatgacaattattgcaggtgaagcgtgcataattaaagcatgtatagcaccaaacatgcatgaacctatcagttatatatatgggttttcagactaggcaggagaactatttttcagagaatgccctgtggatgtttaaaccaaatgaacggatcaaatcagcagcaggagcaggtaatgtgcctgtgtttgaggttgtaacacgtctcaatagtattttgcagtaatgaggtcacaagatcacataatcatatggattaatgggagatggcgaagaatcatgtttccttgtgtcgcagggcagcacatgcattgcgtcgccgccgttgctgtcctccgatttaacaagtcaaaaggcagaaaaaagaggaggagaaacagtagtttaaacaagaagaaaagtgcacaacgaaacgcggcgttctcgaggcgctttggctacctgatgatatatactaataatccaaattaaggaggtaattagaataatatactaatatagaagaatgggcagctagttagctggtgatatgaaaagaaaaaatgaaatggttggtggttgtaccggaagaaaggaaggttctgcctgcctggatggattacaagaaatcgtcgtcgtctttctgtgctaggctgcaactattgcaaagccaaacacgtacacgggtctctgcttttgcttccgttgccgttgaggttgttgctttggtcgccgccggcacaacgtgctttacctccaccgacacctcatcattttctctgaaaaatttgcaccgactcgttcgtcatattctcgtgtgaaaaaaccaactcccaggtgaaaatcatgtgctgtattttctctcctcttcttctgaagaaaaaaagggaatgcagagaccagtaaaagttctgtggagatcatgtatttatattcttgcgtgctgtctttcgaccgacaagacaataattgggttgaaagaatagctagtcaacgtccaacaatccagtgaggcagtgaccagtctagttttccatacatatatacagtagtacccccatttcgttcttcagaatttcagaaacagcaggacgaggtctcccatacttccaccgttcaatgaaactgccctctcaagaaacgcgtgcatttgtccaagtcggtgccaccatatttctgaattcccctcgtactgtgtattaaagctataaaaactaggatgaagacccacacagattatgcggttagcatgattatattttttttctcacataatagcataaatacttatgcattttactattagaatatattgaaatggcagcataattttaaattatgtactaacttgaccaaattaactaacatgtaatattcatatgtatatacgtgatagttgttaattattttctaattctaaattttagttatttgtaaatagtatttctatatggactctatactcctattcaaatatctcttaatttttaatcctgaagttcctttattcataaatttaatttctataggaattctaaactcttctttcaatatttcttatttttaaattttgaatttttcaatatttcttatttttaaattttgaattttagtcatttctacattgtattcatgtatggattctatactgctttaggaatagctcagtgccaccgagtaatgtataaaaatatatgtatatgttaatattttgttttgtgcaactacattacactctgacaatgagagcagaaaaatagaggaccgcatttgcagttcagatgtgtatgggtaatggaattcattgctattttaattttgtgcagctaatgaaattcgtttgaagacagattatgttaagaaattttagcaatccatacataagagtatagatgtctgtttgggtatctagagaactgaacacatctgatctataattggggggaagagtaacttttatttgtgaaacaaggaacggttgaaatgcttaaggtacagtcacaggactgtgtgtgtctgtattgtggtcataagtgaagaggatgagataaacatgaaaatggattttttgtgttaccagcagtttttaaagagtacgcgtatgttatacatgttggaagttgtcgctattgcttgtgacacaattgcatttttttaaatgttccgcatccttttgttggtggtgaacaagcaaatgtgtttgtctgatatggcaaataagatataaacttgtaagtaacgttctaacaaaagcagataagttttacagtgtttgcattccaaaattaataaagatccaacgctccacaattaaaggtactaccatataaaaggtatttaagtattgttataaatacttccgaagaaagggtaaaaagataattttcttaagagatgaaaaatgatataattgtcataatattagccggaggtatattgataccataatttaccataatgcaaattaccataattgccatcaacagtagggttctcaacattgaaaacatctgcaggttgtccagcaataagaaggcacaacgtcctcaaaggtgatccagatacaaaatggtggtaagccattttcttcactgaagagcctctttccttctaccagaaactaggggattttgaacctccttagcagtagcctgcaatgaaatggttgccacacccagggttactatttttttcccctgaagctgatgttctgatagaaataagaattacctgaatctggttttctgacggaatgtttttcatgcaatggacaatggctccatactctcccttatgagcaccactgctcttacaagatgagaaaagttttgtcactgccatctctggaccagctataccctgtaaccaagaattcgaaagaaattcaatattcctttcaaaagaatataaataaattaaataaaagatagctagcagttatatgacaaacgctgattgaaaaataaagtgatctcaaggaagaatagatcttttcatttcacaggtccagtttaacatgcatacattaattcagtgttgctggttacatgcttaaaatcctgtatggacaggccattttccatgtgagaaattaatgacaaggggatgcttttaactgtggtaatgaattatctaaatattgtagagcagtacaaaaagcaaatacctcctgcgatggatcagacccaaaaggtgaacggagcttccatagtgtcggcacaatattttaagcagtgaaataagcaacttctgatcatctcctccatggaactccctgatagaggaatcatagcctccaataatctcatcaagccacttgttcacatcctttgctgcagcacttccaccaacatgggggccaggaataggttgacaacacaacacatggaagtaactaagtgtgctaccattaacacagggttcagtatacaagatataatttgagtaagaaggaaaatatcaaaaagtaagctgtgcatagcatgggcttgaacacagcctttggggatggaggacgatgttacttgccacagaggaaggaaaccgatttaatgtcacatatgtgtgagataatcagacatatgggaaaactaacatttctgcatatgtttggctcatccagggacaacagttttcctgttcagctgttgtaaagcttgtggttggaaaacaactccaacaaaaatacagaagccaaatattccagttttccactgatcaactgattgagcaacaatttctaagagtcaatccaactgtaaccaggattctttgtaattcttctctcatacatcatactccttatttctgctgatttagtccaatcccctagagaagcaagcccactggacagttgcacatacaagctgggatgtgacgattccatctccatcagcttcttcgccaccttccgcatcatggcctcattgccctgagctttgcatccaccaataacagttgtccagctaaccgcatcagcttcaaagggcatattttcaatgaattcaactgattcctctagccgacctgcgcggactaagagatcagtcacacatgcgtaatgctcagctgatggactcacactgaagtccgcttgcatccggtgaaaccatgtcagtccctctttcacgagtccagagtggcagcatgcagaaaggacagcaataaatgttcgttcacttggttttatgcccttagttttcatcaactccaagagttccaatgcttcatgtccatacccattggaagcatgaccaatcagcattgagttccataagacctcgtctggcttatcgatttcttcaaagatcctgcacccatttgctaggcttccacatttgcaatacagatcaatgagtgaagacgcaacaacatgatcagattgcaaaccaagaacagtggctagagaaaagatctgctctccaaaactgatagagcaaatgctgctcgatgcactcagagcactggctatagcaaccttgtcaagccgcaaaccaagccgatgcatctcacagaataacccaagtgcatccctagcatgcccattctggctcaacccaaccaccatagaattccatgagatcacactcttaccagtgatcatatcaaaaattcttctcgcctcttctatctgcccacagtttgagtaaacagtgatcattgagttgagcactatggtatcatgaaacctaagctctctaaaagctctgcaagcatcctcccagaggccacattttgagtagaaatcaatgagtgcacttgctactattatgtcattgactgctccacattttagaccacacccatgaatctgttgcccaggattcaccatgactgaaaaaccacatacattcaaaatgctggcataagttgaagaatcaggtaacacatctgatcgcatcatccttgcaaaaagagcaaaagcatcatttccacaacaggcaaatgcacagccactgataagagaattccacatagcaatgcttggttcctcctttctgtcaaaaagtcgtatcgcctcatgcaaatgtccacaagaagcatagccatatatgagtgcagaaagtgagaactcatcaacctgagttaaaccattaaggacatagcgagcagaatccaaatccccacatttgcagtacatgttaactaatgcgcaactcaacaccaaatcctgttcaatcttggaaaccaccatccgagcatgagcctgcctcccaaaatcatacttcatccaatcagcacaagcaccaacaattgtcgcaagcacaaaagggtcattccatggagaagaggcatctgcaccactgcattgaccaaccgtcctgagtaatgcaaacgcctcatccgcccggccacgccggacatacctatgcaaaacagcattgcaagccacaggatccttgacaggcatttcaatcagcagtgaacgggccatgtcgagattgcctgtggacacaatgccagttatgattgtattccatgagaaggtgttcctctcgggcatggatcggaagatattaagcgctgcatggtggtctctggaattgaggtgggaggtgataacagagttgtaggagaagcagttcttgacgggcatttcgtcaaacaggcggcgggcgtcgtgctggtggagtggggagcagcgcgcatacatgaggagcaaggagttagagggcggcagcgatgatgggacatggccagacttgagaaggagctggtgcagctgctggccggccacggcactgcaggagcggaggagttggatgcagttgcggacgtcgatgatgacagacatggagaaactgaacaggacaggaggccctggaagcaagctgttgttctgccttcactgaatcaccatatccttagccactggccaccaccttgtcgagatcatagctgccatggaggacctaggacaaaacattacttatgatggactcttgcagtggggaagtgcactaagggtgtgtttagttcctgaaaaaagttgaaagtttgaagaaagttgggagtatgaaaaaaaagttgaaagtttatgtgtgtaggaaagtttttgatgtgatatgatatgatggaaagttgggaatatgggggaaactaaacacggcctaatgcattatccctcgctctctgacccctctcgccaacagagtccctacacacagagaaaaaaaaggaaagcaattgccttatgtccacaaattatatatcaaaaccacagtaagaaagtaagttggaactgatcagcatattaccaagtcctaaagtattatcaactcaagaaattaaaatattagagcccagtgccacatttcattttaaaaaaggtacttgataattgataacccattattttgttctgatagtattcctaaatatctactcacaatgaaaaagaaagtaaacacatagctttgattagttttcaagtttataatattaacttcccaaatgccaggcttactgtccatatttgatctgaatatctgagaattgataatgtttaggagaatacatacagctctaaggagcagtggcgtggccaaggaatttttggttgggtagtcctacttcacatcacatgccagaattttcaaacaccgcaaatcccatatatgagaataaatttagttaaaaagttatacaaatatagcaataacatcttataaaatcaataatcgactaaatttgacaagcaggttcaaaatgtgcaaacattacaatatacatagttcgatagcaatatccctattcctcaaactacaatggcagcaaatcaacagcacattcagtaactacaaattggcaaatagtaaaggcaagtggcagaaagttcaaacacaataactcaatgagaataatgaagctatgagctagactgctagaggtataacctgcaagagctgggtcgtcgtcttcccaagaggacaggacttgacagtgacaggaacagcaggtcggcagccaatggcgacgccgcgacagccaggggcaggaccctcctggtatttgggttgaggcagaagtggagagggaggagaaccctgtgggctgtgagggagacggtgcaggatgaggatttgagagccggagggcacggtaggccttgatctgtgcttgtcaaggacattgtcctcatccttccatgcctgcttctttccaaccttttgttctcgtcaagtgtatggttcttcgatctttattcaattcgattgaaattcaacttgtgtgtttccatcgagtccaatctcacatctatgtatatggttcttcaatttttatatctattttattctgttttcattgggacatattggaatgtgcacaggatactaacgatggtctcgcgtagtagagtccgttttgctcgaacaaaaaatcgcgtactgtgcggatgacaaagactacggatgaaaaatctcccagaaggcttacgcattttttaattaggtatagattgtttaattttttgaactaaaacacgaagttagtagttagtactatctatgatgcttgtcacatttcagccaatagagcaatattactcaaccaagtaatactaaacatttcttgagttggacaagggtaaaactctagtctgggctgctcctcatcatgaatcaaacttgggctagccttgtaggttggcccttaatcaaaatttgtcttggcaggagctatattgggggctcaggttgctatgaatttagcggggcttaaactgaattgaacataggcccaatttggtccctaaaaagatcaagtctgaatgattgcactataatatttacaatcagattagttatcctttgtttaggcgctctacctcaagataggtaatgtatccagtcagacagtttataattgtctcaaaagttgcatttctgctcattgcaacgcaaatcagtatcatataagagatgtattatcccatatgggccccaaaaagaaaacgctattgtcctacaaagcaaaagagtgtcccagttaactgaacttcacataacatcattgcacaaaaactcgcactcgatcgcacgaaacacatatatggtatgatgggtttcctaacacaagcagtcaagcacaatgccatcaacacaacagaaccatcagaagctttataaagctaaaagatcaatgatttacagaataacaagggcaaaaacaagtattgctcaatccaacaactgaaacctccccgaaacaaagcatacagatatgcaggaagtacaaggaactgtattacaaaatcacataaaagatttataaatatctaaccacagcaacagcttatgaactgactaagaaaaagtctggcaattaacagcataataaaaaatgtaacgctaaaattaggtttccacaagtccacccacaaattcgaacaagcattctaaagctacaaactaacggaacaactgcaaactgaaagaccgtcatatcaaatgtccccctccccacaaatcccctaccataaattccccaaactaaagctcacccagctgaaatgagcaacgagaaagcccctaaatttccgcgaaatcagcaaccgaacacagattagtcggggaagaagaagaagaagacgggagggagcccgcaggtgcgcacctcgactgtccagatgaagaaatccccttcctctgcacacgcatacgattccctcaaaacaagaaccaacaacgaaagctaccgtttcttggatccaaccagcgaccccgacctccccgagcagggaaggtaaggaggagcgccaccgtggggagcttgggagggtgactgaggcgagcggcggcgggcacggctgggtggcacccctgcgtgcggcaacaaacggcccataatttcaagcccacgaagagaaccgggtcggcccataaaactagcaggccaaagcccgaatagaaagcggcgcgcgcgagcccacctcggcgtcggtttcttcactctccacccatccccagtagaggaggaagcgccagatctccacacccacccgcgccgcagatccagccagagccatggcggatctcgccgtggcggcgccgccgccgacggacctcttcggcgagcccatcgaggcgcacccgccgtggttcaagcccgactccttcctccgccccgacttcgacccggacgcctacgtcgccgacctccgctcctacgtgcccctcgacagcctcgccgccgagctccgctcccacctcgcctccctccgcgccgagctcgtcggcctcatcaaccgcgactacgccgacttcgtcggcctcagcgcccgcctcaagggcgtcgatgccgccgccgcgcgcatgcggcccccgctcgccgagctcagggacaaggtcgcctccttccgcgccgcagcagccgccgggctcgccgcactccgctccggactcgagcagcgcgcggctgccacggctgcacgggagcttctcgagctgctgctcgacacctcccacgtcgtctctaaggttcgatcctactccgccgctcctggttaaacgcgaatgtagcttattcctattagctaaatttccccatcagcactgcattggtagatccgactttatatgggatctgtgacatctgtctggaggtcaaccatcaaccttctgaaactgtgcccttccagtccccttcccatcgatgttcgcctgttcattttcatgaatcatatgaaagcttatagtgtttgactctagttcaaactaggaaattggagaggtttagcacttccattttaatgcagcaatagtacatcatattattgctgtgaacatttttttgtccctgtatgcggatgatccatatgctaactctgagtattattttatccatgaatgtagatgcaatgatgcatgtacatgaagaaattggcgtgattaaacctgtcatagtgctattttctaccatgttagaaaaattgccctatcttatgactgatggtcttctcagattattttgtcaaggtttccattggttcacaatttgcaacatcattcaattgtataaaccatcacctaaaggtgttactgtcaaggcacctgaaatccacattttcctgttgttcctccaggttgagaaactgatcaaggaactaccatccgccccatctgattcatcaaatgttgaggctgtttctggtgataagggctactcaggcaacgttgccacaccaccaaacatggatgatgggacagatgttagggagacacaaagcattctcttagaaagaatcgccagtgagatgaaccggctcaaattctacatcagtcatgcacaggtttgtgacactaactcaccaataaatactggtccatttgcacctctcactcacataccttctctttttctgttccgttgctgagaaaaaccattagggaaaaattgtaacacaaaaatgacattagttgtttctccggaaaggtttatttctgtgtcacaattgaccattgaaagtgtagtatacacagcaatacaacgatgtgatataacatcttgattaataactataagaaaaatgtctacccacatgtcatagatttggttgtcgcaaactgctgaagtgtcaacatggtttcatattggtagcttttgttttattgctacctgatgctaccttttgcatctcagtgccacttatatttatgattcttatcctgttacattatggcagtacagaacctcccttttattgaaaacatggagaagagggcccaaggtgctacaaaactacttgatggtagcttggagcgttgctttgtggatggtctagaacatcgtgatgacaaagtaatatacaactgtttgcgtgcttatgctgctattgacaacacatcttcagctgaagagatattccgtacaacagtggtgtcgccgttgatccagaagattgttcctcaaaactatgcaaaagtggttgctggggtatcttctgatgacctagaagatgattatgagcagataatgcaatgcgtagaaaaagattgcaaatttattttggagatatcctcgttgggtaattatgatagacgaatttcattaaaaagctgcatcattgcttagtattttttaagttgaatactaaatgctgcataaggacttagattgacacatcatctaattttctatcgattgatttgcagcaaactctgggcttcatgtttttgattttctggccaattcaatactcaaagaagtccatttggcaatccagaagggaaagcccggggcgacctctcctggaaaacctaaacagttcctcaaaaactacaaagcaagcttaagattccttgattttctggaaggtattgctaaattatgttgcattgtgattattgttttgtatttaaccagctaagcctactacaataaatactatgcttgctcgcaagttatgctggtttatacatttgggacagccattatataggactaacaaggaatgtggttagactgggttaaagatatacatatatgactattgggagttgctattgattgaatatttggtcctgtaggttactgttcatctaagcctgctgtaacaaagttccgctccgagcctgcttatgccgatttcatgcgacagtggcatgttgctgtctacttcacattgaagtaagcataaatatttaggctatgctgctgtcaaatgctcttcagaacttcatttctaacttgacttcaactggttcaatcataagatttcaggacattgctggtggtcttgattctgtgcttacagccacaattactcctgctggaatgcatgacaatcaagcgaagccgcagacactgttgttgaaacaaagcgttaagctcttagaaagtttgcaggcctgctggagtgacgatgttcttgttttctcccactctgataagttcctccgcttgtctttgcagcttatttcaaggtatagctactgcagaggattctttgccttatcttttatgatttaacctatggtgattgaccctttttgtattctacattttacaataaggtatacaacatggctttcttctggtttggctgcacggaaagcttctgatgggggctcaagttctcctgcggatgctgaatgggcactatctgtacctgtggaggatttcatttatgtatgtcatgtctacaatactccttgaattccaagtgtgttatttcagtcatctgaacctactgcttttcatccttcatcatgaactttttggcttaagactgaaatagtattgtcatcttagccagtgacattgagatggttgcatagattagcaataatttgagactcacactaaggtttaagactataagtgcttaggagggcatcccaaagatgacaccttgcacttctagcccaacaaacattccaggaacacatatactgtggttactggttagttagaaagtctacagttggtagcggtgtagcatatcaggtatgacttgtcccttttttttcatgtgtaaactggaaatagttgttcggcttgttcttcatgatgtgctctagattggaagctagtcaatattgattattacgtaatcttacccattattttgggccctgattctcatatttcttataaaatttgaaacatagaagattatggccatcaggcatattttgtgaattgcatttaaattctgtatttgatgcacaggtaatgcatgatgtaaatgctgtaataagcgagcttttggaatcaggccaatttgtggaacatgtaaaccaattgctagcatcatgcccaaccgaagtacttgctctcgtgaaacacagtatactgcaagctgttgagcctttaaaggagttgttgcctgctataatgaatgtcatgattatggtgatagttaaaaggtctaatgaggtgagtacacctaagtcagcagaagagaagcaatgtcatcatttcttactgtatctgtggttcatcactcgtatggtacaataagacaattttgagtcatggtccttctgttcttaccaactatatttctggttgattgtaggacttgaagcacctaaagggaataacagcaacatatagaatgaccaataagcttccagtaaggcattctccatatgtatctgggattttgcatccacttaaggtgaatggacatcctgttttacttctctgctttatgatttatgtttctcaaaagtgaagcatcaaaagttaactacttaactggtagcgtctatgtcctaatggctgcattcagtatgtgttcttggcgatttttaagtgccatggtcagtatctagtacccattagtctgatcgttatcaccctcaagaataacttatgttttgccattttgcaggccccgatatttagaaacatgtgtttatgctctttttgcctccatatttcatatgtgatgttcctctgttcttgtaggtttttcttgaaggtgaccgtattcactatttatcagaagatgataaagcaaagctgcgccgtggatcgacagataagatcacttcaatttattatgacatggtgtctgaagtagtcactgtggtaagtaaggaatgcttaactgcttatgagagctcatatctgcttattggtgaattaaaccatttttattgaatataaaggcaaggaaaactgaatcatcattgcaaagactacgtcaaggtgcacaaagacgagtaggagctaataccgatacctcggataacatcatttctgatactgacaagatctgcatgcagctatttcttgacattcaggtttgatatctgtcctttaattttatgctgataagggacatattatatataacggatataagatttattttagggtgtaaattttgcatcaaatgattttttttaagagggtcattgccttttggtttcatcaaagacccaactagtgcttatggttggcttattcaaccttaccattttctgtggaaaacaactttagcatgtaatctgaatgtttctatgttggccatccaatacattttttttttgcaaggaccaatgggtattagttatatgatcaaacatgatacctgtttatgatggatgcactgcaccacatctgacatttctttttttttttttggtttttcttattatgcaggaatatgcacggaatcttcgtgcaataggaatagatgcaagggaaatcgaaacattcagagctttatggcagtgtgttgctcctagagacaaacaggataacatccagttttgatgtaaagatcaatttgagtacatagaagaaaattgccttaggtccctcaatatccgtagatacgtctcgtgttgttcgtttaggatggatgttggaatgatttttatacatagagctctggattttgattgtttcattttggacggtctcctccggattatacaagggtcaagggtacatccaaaatttgagaagtgtatcaaacctcatgttgttggaaacacaccgattctgttgaaagattgttttagtgtcttggtatctaacctttttcttgttcacgcatatctgaagagaacatctattcctttatttttcttattaggcccttgcagttaccaccgtctttttgagtggctgcgtgttcatataggctcgcttcttctcaagtgaattcgataagatgcacatagataattccatcaaccgatctggatcaacagaagacaaatttctaattcagattctagagttcatgacagcagagcaggacactacttgacagaggactgacagaaatttttatttgagattacgagagtacatcgagaagctcagccccgagggagagtatgggttagcgagggatgcggtttgggcggctcagcgcatttccggcggtccggcggcggagggaaggcgcggttcgggcagcaaatcgcaaatgcggcaagggcggcacggctccctccaggtccggtacgcttcaaacctcttcatccccgccgccggcagtcttgtcgataatgctggtgcatggctagtcgtcatctcggtattggaatccggctaattcagatcctgcaatttgacataataatatattactccctccatatatttttatagtaatatttccaaatctgacaaatttatttttgataggtatatttcaatccaacaacctatcatcttaatgactttctcggatttaatgcatgactctctattcttccacacaagatgggcattgagaaatgtaaatattaataaatcgcttgtttacgaggaatgactagtagcatgtttaaatggatgataagtagaattatttatccttgatctgtgtgtcaagataaaaatatgactatcaaaagcagataaagggagtaactagcatggtgcctcgcgtggctagcgttcgtcgaatttttaatttcgtattttagttatttctaaattatattttttataagctttaaactctacttttaattttattattttctaattcaaaattcaaatagttctaaattgtaaccggtgtgaactttaatctcctctcccattattacttattttttaattacgaatttcagttatttttaaattagatttttatatgtactctattgttttatttttctccgattaatatgataatttcaagactgtgagaaccaaacgtgtagacttatttttctattgttttaataaaataataataatagatactccctccatctatttttgatatttatattttcaaatctaaaaaatttattttttgataggcatatttcaatccaacaatttatcatcttaatggctttcttaattaaatgcgtgactcttcattcttccacacaagattggctatatgagcattgagaaatgtaaatattaatgaatcgtttgtttacgaggaatgactagtggcatatttaaatggatgataagtagaatcacttatctttagtctgtgtgctaagataaaatatgactatcaaaagtagatggagggagtagtatattaatagggcaccccaaaatgtccccgatactacctgcgctgcgctcgtctcacataaacaattactcccgattgctgagtaggactgtaggactagttgacttctagtatcgatttagaccctgtttagatgggactaaaacttttaaatccctatcacatcgaatgtttggacattaattataaatattaaacgtagactattgataaaacctatctataatcttggactaattcgcgagacgaatctattgagcctaattaatccatgattagcctatgtgatgctatagtaaacattctctaattatagattaattaggcttaaaaaaattgtctcgtgaattagctttcgtctatataattagttttataaatagtctatatttaatactttaaattagtgtctaaatacagggactaaaagttaagtccatggatccaaacaccatcttaagaactttacagaacaagatctacaaatctattatataattaaaggaatagaaaaaggagcctccacgttcgctctcatggcctagaaattctcacattaatcggagaaaaagaaaaaacagagtccatatagaaatacaatttacaaatagctgaaattcggaattaaaaataaggaatattagaagaggggactagagtccatatagaaatacaatttacaaatagctgaaattcggaattaaaaaataaggaatattagaagaggagactagagtccatatagaaatacaattagaaaataactgaaattcggaattaaaaataagaaatattagaagtagagtatagactccatatagaaatacaattaggaaataactgaaattcggaattaaaaataaggaatattagaagtagactatatagtccatatagaaatacaattaggaaaaaatagaaattcagaattaaatatataatttaaggaatagaaaaaggagcctccacgttcgctctcatggcctagaaattctcacattaatcggagaaaaagaaaatacagagtccatatagaaatacaatttaaaaatagctgaaattcggaattaaaaataagaaatattagaagaggagactagagtccatatagaaatacaatttacaaagaaatttggaattaaatatataattaaaggaatagaaaaaggaacctccaagttcgctctcatggcctagaaattctcacattaatcggagaaaaagaaaagacagagtccatatagaaatacaatttaaaaatagctgaaattcggaattaaaaaataaggaatattagaagaggagactagagtccatatagaaatacaatttagaaatagttgaaattcagaattaaaaaaaggaatattagaagaggagactagagtctgtctatatagaaatacaattaggaaataactgaaattcggaatgaaaaaaaggaatattagaagaggagactagagtccatatagaaatacaattaggaaataactgaaattcagaattaaaaaaaaaagaaatattagaagtagagtatagagttcatatagaaatacaattaggaaataactgaaattcggaattaaaaataaggaatattagaagtagagtatagagtacatatagaaatacaattaggaaataatataaattcggaattaaaaataaggaatattagaagtaaagtatagagtatatatagaaatacaatttagaaaaaaaaatagaaattcggaattaaaaaaataaggaatattagaagtagagtatagagtccatataggaatttaaaactaactaaaatttggaataaacataataaaattaaaagtagagtttagagtctgtataaaaatacaatttacaaataactaaaattcaaaattaagaaaaacattggaagaagaatttaaggtcaatataggaatacaaatattggaatataatttagaagcaactgaaattcgaaattaaaaattaaagaatattgaaagatgagtttagagtccacatagaaatacaattagaaataataaaaattcataaataaaaatgaattaaaaaaagaaatattaaaagacgagtctagagtccatataggaatatatataatttacaaataactaaaatttgatattaaaaataattaataactaacacgtatataaaatataatataaatattacacattagtagttttgtaaagttattgcaaaatttaaaattatgttgtcattttaatatatttgaataatataatgagaaaacatatatgctaaattaataataaagtgaggagtatattgtagcaatcgatgcaaccaatcaaacccatccacttagatccagaaagtcaaatagtacttacattcagtctccattttgcacaaaagcatttgctcatactccttgccttctccacccccacccagcaactttgcttccccctgtgttcttccttagctcgttccttccgatggcggagctaatggccaccatggtggtcgggccactggtgtccatggtgaaggagaaggcctccagctatctcatggagcagtacaaggtcatggagggtatggaggagcagcacaagatcctcaaacgcaagctgccggccatcctcgacgtcatcgccgacgccgaggagcaggcggcaaaacacagagaaggggcgaaagcatggctggaggagctccggaaggtggcctaccaggccaatgatgtcttcgacgaattcaagtacgaggccctccgccgcaaagccaaggccaattggcagtataagatgctcggcatggatgtaataaagctctttcctactcacaaccgtattgtgttccgttacaggatgggcaacaagctcaggatgatcctgaatgcaattgaggtcctaattacagagatgaatgcctttaggtttaaattccgaccagagccaccaatgtcgtccatgaaatggaggaagacggattctaaaatttctgaacattctatggacattgccaacagatcaagagaggaagacagacagaagattgtcaagtcattgctttctcaagccagcaatggggatctcactgttattcccattgtaggaatgggggggatgggcaagaccaccttagcgcagctcatttacaatgaccctcaaattcagaagcattttcagttgctcctgtgggtgtgtgtctctgacaacttcgatgtggattcgctggccaaaagcatagttgaagcagctcgcaaacagaagaactgtaatgaaagggctgaatttaaagaagttgtgaatgggcagaggttcctcctcgtattggatgacgtctggaaccgtgaggctagtaagtgggaagcgctcaagtcctacgttcagcatggtggcagcggtagctcagttttgacaacaacccgtgataaaacagttgctgaaataatggctccacctaaagaagttcatcatctcaaggacttgaatgaaaactttataaaggaaattatcgagagaagtgctttcaattcagaagaagagaaaaggcaatctgagctactcgaaatggttggtgatattgccaagaaatgttctggttcccctttagctgcaacagcattgggctctacactgcgtacaaagaccaccaagaaagaatgggaggctatattaaggagaagcacaatttgtgatgaggaaaatggaattttaccaatactaaagcttagttacaattgcttgccatcatatatgcggcagtgctttgctttctgtgctatttttcccaaggatcatgtgattgatgtggaaatgttgatccaattatggatggccaattgttttatcccagagcaacaaggagagtgccctgaaatcagtggtaaaagaattttcagtgagttggtgtcaaggtcattttttcaggatgtgaaggggatcccatttgagttccatgatataaaggactctaagattactgctaagatccatgatcttatgcatgatgttgcacaatcttccatgggaaaagaatgtgctgccatagattcagaaagtattggaagtgaggacttcccttattccgctcgccatttatttttgtcaggtgatagaccagaagttattcttaattcttccctagagaaaggatatcccggtatccaaacattgatatattcctcgcaaaatgaagatttacagaatttatcaaaatacaggtcattgcgagcattagagatctggggaggtataatcctgaaaccaaaatatcatcatcacctgaggtatcttgatctctcatgcagtgaaattaaagcacttcctgaagacataagcatcctatatcatctgcaaacgctgaacctttcccactgtagcaatcttcatcgacttccaaagggaacgaagtacatgactgccctccgtcacctgtacactcacggatgtgagaggttaaaaagcatgcctccgaacctcggacacctcacttgcctacagacgcttacatgctttgtagctggtgcttgctctggctgcagtgatttgggagagctgcggcagtcggaccttggtggtcgactagagctaacacaactggaaaatgtgacaaaagctgatgcaaaagcagcaaatctcggaaagaagaaaaaactgaccgaattgagcttaggatgggctgatcaggagtacaaggaggcacagagataatcataaagaggtgctggaaggtctcacgcctcacgaggggctcaaggttctgagtatatatagctgtgggagcagtacatgtccaacttggatgaataaactacgagacatggtaaagcttgtgttagatggttgcaaaaatctcgagaagcttcctccactgtggcagctgccagctctacaagttctttgccttgaaggactggatagtttaaattgcttgttcaacagtgacacacacacacccttcgcattttgcaaactgaaggagctaaccttgtcttttttttttgccgggtcggccgaaaggttcggtcgaccaaatttcattaaggaaaaggggaacaaattacaaatgggctttatatcgacaataggatgtcgagattaggctggggacaggtcccccccaatcaaagccatacacaaaagcccgaaggctacaaagaaagtatgatgtctctattacataatctgaaaatagcctccagacttccacatccaaacttcttctttgatgtcttccagtaactgctccacggtctgctgcttgtgctgaaaaattctggcattgcgctccttccaaatcagccaacaggtcaaggcgaaaacgctgtcaaagttgctcctgtagctgcttcgaaaatggcatcgtgccaccatccaccagcctatcagcccctctcccgcttgtcctggcagagggaaatccacattgacccatgctcgcagcagctgccatactcgcctggagaaatcacaggtgacgaacaagtgtaggcaatcctcctattcgcgttggcagagtacacagtgatcttcatggggccatcctctcttcgccaagttgtccgccgtcaagcatttgccctttgttgctagccaaagaaaaaatctgaccttcgacggagcttttgtctgccaaattagctgtccgcaaggagaaatctcacgagccatgaaaaagagatcataagctgaggacactgagaaagaaccatccggagtgagcttccagcgaattgtgtcctcctcctgactgagattgatttgttggatttcgtcccaaagctgaaaatactgcatcattgctatatccgagagagatccttgcaaatctctcacccatcgatgtcccaggagtccctgttctactgtgagcttagttctaccaataaaagtcgcaagggtgggccatctccaggcaatgcttcctccacctagccaattgtccgaccaaaatttagtgtctctaccattgcccacacagaattcagatgcagattggaagattttctcgtcatctgcgctcagtctgaagtcaacaagggtccagggcctatccttctgatgtaagcgattggctggccatttcaggcgcagcgctttgccgaagagctccaggtttcgaatgcccaagccgccattttccactggtgtacagacatctttccaggctacaaggcaatgtccaccactcacctcctgctgtcccttccaaagaaatccccgacatttccgctcgatgtccttgattgcccactttggaagttgcaatacagacatgaagtgaactgggagggccatgagaacggatttaatcaagcagagccggccatcaggggacaacaacttgggcttccaacctgccactttgtttgcaagcttgtcgagaattggttgcacctcagcttttgttggctttcttgtggacagtggtaatcccaggtagatgatagggaataattgaatattgcattgcaactcattagccaccacctgaagttgttcctgactgcattgaattggagtgattgcacttttattgtagttggtcattaatccactggctgcaccaaaaatctgtagaattgccttgactaccttggcttcttgttgacttggtttgaaaaataatactgcatcatcagcatatattgatatacttggaactgggcgtcttggtgctggttcagatatcagtccacttgctttcgcttgagctacaactgcttgcagtgcatccattgccagaacgaataacagtggcgataaagggtctccctgccgcaatcccctagccggcttaaaagggtttgattcattcccgttgataaggatgctggtttcagccgtgaggaacagagataccaaccataatctccacttggcaccgaaacctctccacttcagcatatccaatagaaaacaccaagacactgtgtcaaaggctttggagatgtcgagtttgagtagaatcatttccttgtgttgcctgtggtattgctgaacgagccctttaacaaagatgaagttttcatgaatagatcgacctcttatgaatgcattctgtgtgtagggcacaagttcattcattcttggggctagcctctgtgccatgacctttgctgctaacttggcgaagctatgtatgaggcttataggcctatagtctttcagcagtgtaggggagtctttcttggggatcagagtgatcaccgctgtgtttaacatttcaaggagccatggtgggacacaaatgaggtaaaaggagaagagctgatatttcctgaggttgaaaagctgtttatcgaaagttgccctaggctaactgccttaccaaaagcgtcaaatgtgatttcagaatcgtctagcggagttagcaccgtgtgtcgttctgcatttccagcattgaaggaaatggaattagatgatttggatatctttcagaaatgggaggcagtcgatggaactctaaaggaggaggtagcatttcctcagcttgacaaattaacaatcaacgagtgcccagagctgactactctacctgaagcaccaaaactaagtgtcttaaacatacatgaaggcaatcaacaaatatccctacaggcagctagcagatatactacttcattgtccagtctccatctgcatttgtcaactgatggcacagaaacaacatcggtggccaagcaacaagattcgagtgaattggtgattgaggatgagaaatggaatcataaatctccccttgaacttatgaacttaaatgggtgcaaccttttattctctcacccaagtgcgctggctctctggacatgttttgttcagctcatagatctgaatattcggaaagtcgatgcgcttctctactggccagaaaaggtgttccagggcttggtttccttgaggaagttaggtacagtatttatcaatgcaagaatctgacaggacacacacaagctcgtgggcaatctacaccagcaccaagtgaactcctgccacgtttagagtccctacagataagctgttgtggttcttttgtagaagtccccaacctacctgcgtctctcaagctattagacattagggggtgccgtggcctggagtccatcatattcaatcagcagcaggataggacgatgttggtgaatgcagaaagctttgcacagccggataagtcatcattaatatcaggctccaccagcgagaccaacaatcgcacccttccacgcctagaatctctagtaatatggaactgtgatcgtttggaggttctccatcttcctccgtccatcaagaaattggatatttcttgctgcgaagaacttcagtccctctcaggaaagctggatgccgttcaagaattaaatatagaatcgtgccagagcttgaaatcactggaatcttgcttaggagagctcccgtcgctgcaacaactcaccctttttgattgcgagagcctggtatccttgccgaaggggcctcaagcatactcatctcttacatctcttacagttagttattgttctggtataaaggtgcttccaccgagcctgcagcaacgtctggatgacatcgaggagaaagagctagatgcctgctacgaaggtaatctccactttcttcatttcttttaataataagaactagctgggtggtccgcgcaattgcgcgactagcacccgtataaaatcatatatttttttaatatgattttacttaaaatttattaaaagttatctcaccgtcttaagattttgaaagaccaaacattatcatcctcgggtttctaattttgtagtttttaaaagtcacatcagttgctaccccttacttttatcatattattttttattagctttttcgatctaccattgtttctattcattctcattgaaacctttaaaaattggattaaaaaattatagtttttagagtttatttgtcctgttgggctttttttataatttctagaagtctcgtcagagctgccattatactcctctacaaccatccattgcatcttctctttattgtcattgctattttaaaagtcgaatataattattatttaggtttttttttactttctagaagttccgccaaaacgtcagcgactttgtcactatactcctctacggctcgcccactgccgcccttctttattatcattgagattttaaaatctaacatgattattattggggtttattttctttactttttagaagcccgaacctttaaaaattgtaccttatagtttttagagtttattgtcttgttgggtttcatgttttttataatttttagaaatcatgtcaaacgctgtcaaaatactcctctacgacccgtccgccgcataatctttattgtcattgggattctaaaaattgaacataactatcgttggaattcattttttactttctaaaagacgcaacaaccatcgacgactctgccattgtactcctatacgacccacccgctgcctctcatttttattataattgagattttaaaaatcaaatatgattatcattggggtttatgtttttactttctagaagtccccgacaaccgccttgaccgattgcttcacgatctgcccatcatcctttcttttaatcgtcattaggattctatttactgttttattaatagtttttagatgtctcatcaaccgccacaactctgctcctccataggcctgttacttaattaatctcgtcatgtgttttagatggtcttttctttcaatagtcttatttttttatcaccaattttagttatttataaattgtattcctagttgaaatctttttttctctttctaatttcagaatttattttatttattattatgttcttttgatatttttattttttattttcaatttcagttgtttcaaatctttttaatttgcctaatttcggattttattttattttttattctgaattttaattaatctactattgggttcttacatgtactcttatttcaatattttttatatttaattccgaatttaagttaattttaaattgtattcctacttgaactcttatttttttctaatttcgatttttttatttttttattccaatttttaatttatctcgtattggattcttgtatgcactcttctttcaataatttttatttttaattctgaattttagttatttataaattgtattcctactgtcggtgacatgggatcaggagtatcatgactagaggtttgaggcagacacaatcgcccacgtggcctggcaccctcgggggacgtcgggcccgagggtgatgtgttcgccctcctcttagtccccccgagggggtcgggccgcacccgcctcggccccgagggccgaggcgccccgacccctcgtggatttttgctccgcgtgtatgggttaggtgagcacagcggggctcacctaaccacatttattgtggtttggctgagcgtgtcacgccgcatgtaacgcagtgcagtgcactcgtttatccggtttgtgaccagtcacagaccggtcagatcgcgggttaggtggcgacaggcgatctgacgcacgcctcgccccatcccgtcaggacgagggcttctaggcgcttgtccccagctggagctagcgtgttacctcccagagatggcacgttagtcctggttagatatatgccaggcttcatcctaaccattacaggcaagatgttgtgtgaagaagggccaacatgtagattgctaaactgacacgtggtggacaagaatgagcgatttgtgaccagtctgacactggtcatgtcgtcagcagacagccataatcccacgtcgcacctgcttccggcggaagtggaggtaggtatgggccgtcctatcagaaggtcattcggacggcaactatacaaatctccgtccatttatgaaaaggtagagtaagtccccacagaagagagggagatggtgcatgtggtatccccttaagatataaaaggaggaccttgcccacttagaggaggactggacttttccagattcggaacccagaacaagggaggggctggctcatactttgtagctccttcatacacagatcccccaaaacacaggagtagggtattacgcttctcagcggcccgaacctgtatacatcgcccgtgtcttatgctctttcgacggtcgcgaaccttccacatacagagagcttagaatttcaccctgagtccccggccgaaccggcaaaggggggcctgcgcggtctcccggtgaggagccccacgctccgtcacctacgtactcgaactcttctttttttgtttttctaattttggaatttattttattattattccaaattttaattaatcacgtattgggttcctatatggactcatctatcaatattgcatatttttaattccgaatttcagttatttttagattgactcttcttttctttttctccgattaatatgggaatttcgagcatccacagcaaacgtggtgcctcctttcatagctgttttgataatataatagatagccaggagctcaatttaatttggtgggtgccctaaaaggcaactctcggcttaagcatgtaccgcgatttattgctaaaagtttgcagtgtggtgtatagaatctctagtcaaccattaatacgattatatgtacagagtacaatgcacatcgataactcacttgtgcagtggtgtgacctaaacacttcaaatttttgaattgcatttgggggtacaaaagaatttagttatatctactgtagccattactattatgcaagctgaatgcacgtgctttactacgaataaataataaattataatattatctaaaataaataaaaaaatatatattaatgcgtctgatatggacagcagcttaaatttgtagaactaactgtcgcggtacttgaattgtattaacatttctctggaaactcatagctccattgcatgtagtttgagtatacgtagttccttctaatcatcttatgccaaacttgactatggaatgctgtggtctacatattatccaaccaatacataacattttttattactattatcttttgtttgctagaaccaaaggcccatcaatctgcagtcgctaggctgctgtgcttaaagtaacagattcaggaccagatgagtcatcatggtttgtaacatcattatacatgattgatttcgaatgaaatgctaaccactatccttatgctgactctctctgtggtgtgacttccttgcaggatcgttaccaaatctgcaactgatgggttattaattgtgtgatttgtgtctcatggtagaatgtattacctacctaccctttctcaagataaactccagtaaagtcgatcgtccggttggtgtgagctgctacaagaaggatgaagccgatgatccaaggccttgactttaagcagaaagctagtcccaggttgtaagctaaagaataacatgctggagcttaaactgcttcacttttttaaaatcctttttattttcgtgtgaactgcgatgtctttgatctcgttcatgctccatcataagagaatcacagctagcacttccatttcaatgatgtttttcctacatgacatgactgcagaggatacttgtgattgatcaacaacattttgcagcaacgttatctctcccattgttgatcaatggaattgatcaattgatgttcctacttattggaatgaatttcccattgtggaaaaaatggaaagactggtacaagctgctgaaaaataaactgtcgctactcaagttgaaacatgtgtgtaattatctgtcagctgctgcagttagaaccttaaatctgtaaatataattgtgtgttatgaaaatagatgcacaacggagacacgaatttttacgtggaaaacccttgcgggaaaaaaccacgggcgccgaccggcaatgatcactattgaggagttgattacaaacgtaggggaatcacaatgggaacgtcaccccttcccgtatggcttacaagagtatatataggggataatagaaggacacataataggatagacatgaagtcctactaggaaactaatccgaatatattgtgggcccaaaattcggatcacatatttaacaatctccaccttgagacgaatttcctcttgtagcataaaaacatcaatcaccaaagatacctcatgtaggtaaaatcaccgcgcgccaaatagtctctaagactatactgtaacaccaaccaaacttgagcaaagctcaaacttagtagtaggaactggctttgtcatcatatcagctgggttatcatgagtacttatcttgcataccttgacatcaccttcagcaatcacacctcgaataaagtgatttctcacatcaatatgctttgttctctcatggaacatctgatactttgtaaggcatattgcactttgactatcacaaaatatattaatgcaagacgtaactccacaaagctcagtgtacaaacctctaagccaaatagcttttttacaagcttcagaaatagccatatactctgcttcagtagtagataaggcaacagttgcttgcaaacttgccttccaactaacagcacatcctccaatagtgaaaacataacctgtgagcgatcttctcctatccaaatctccagcaaaatctgaatccacataaccaacaagtccatctctagatctcccaaactacaaacaagcactagatgtaccacgtaggtatctgaaaattcattgaacagctttccaatgctctttgccaggattagccatgtatctactgacaacactcaatgcatgtgataagtcaggacgagaacataccatggcatacataagtgaaccaactgcacttgaataaggaactctagacatgtactcaatatcataatctgactgtggatataaatctgaagataatctgaaatgtgcagctaaaggagtactcactggttttgcatcatgcatattgaaacgacgaagaactttttcaatataacctttctgactaagatataacttgccagaatgtctttctctagtaatttccataccgagaattttcttcgctgcacctaaatccttcatatcaaattcactactcaattgtgccttcaactttgctatctctgatttgtcttttgcagcaatcaacatatcatcgacataaagaagcaaatatatagctgaaccatcaacaattttgagataaacacagctatcataattggatcttctaaacttctgagaaagcatgaaagagtcaaatctcttataccactatctaggtgactgctttagcccataaagagatttcttcaacctacagactaggttctcttttccaggaacaacaaaaccttcaggttgctccatataaatgtcctcttctaactccccatataaaaatgcagtcttaacatccatttgctctagttcataatcatgcattgcaacaatactgagtaaagtgcaaattgaactgtgcttcacaacaggggaaaagacatcattgaaatcaatacctggaatctggctataacctttagcaactaaccttgctttgtatcttgcctcatcacttggagatataccttcctttcttttgaagatccacttgcaacggataggtttcttctcctttggcaacttcaccaatttccaagtatgattcttttcaagtgactccatttcatcatgcatagcagttatccatctattgcaatcatcagaaacaatagcctcaaaatatgtagaaggttctgcattaccttcaatttcttctgccacactcaaagcataagcaactatgttcgcttcttcaatatatcttcgaggaggtttaatatttcttttgggcttatcttttgcaatagaacgttttggagactgctgaatagtagaagaatatgaatcttcaatcacaggtgcatcttggtagatagaggcatgttcatattttggcgcatgccgtgaagtgatctagtgctccacgagcacactggatttgtcatgactctcaccaggaacattagtagaaggtttgttatgtaacattactgattgcatggaagacaacatttctactaatcgcatcctttttggtttcaggacaccataacttatagcctttcaccccagccggataaccaagaaaaatgctcttaacagctataggctccaattcaccattatcaacat

SEQ ID NO: 70502 - DNA, 1681 bp, Oryza sativa
cgcaacggcgggtagattgaccgcatgcatcttcattcagtcgtgccctagtaatcgttaagactaaatgaagatgtgcttagtcttaatgttccttctattatgtactgtgatgccctcctatgatgtaatcctatatacctatacaaatcatccccactactagaattctctgcttcctggtgcttccacgtcccccattttctccccaccgttcgatctcaatcaagcggtcgcatcgctcctctcctctcccacatctcgctgcttcaccggccccacgcgcatcaacccctctctcccgcatcgctcctctcctctcctctcccctcgcacgctcgcatcgattccctctcccgcatctcgctccgccgcccccttcgtatcaatctcgccgtgatcctctccatctcccacatcgtgctcgcccgtaccggcgctggcatgtcatccgcctcccgtgccacacagaggcaggatgagggtgtggcgcttcccttcccgtcgcccccatggcagctcgtgcgctgcttccccttcctctcccatgtctaaggttgttcgcctctttaggttgccatgattaatgaaaaccgttgacaaccaccgaggaaaacacttcacggctgttatcaagtaaatccattaatggcttaatgcgttttcttctcctcttatccctttatcagttctgcatctatatccaatttatcatctcgcttattcgtcgatctaccacactctaccaggctgctggcattttactaccgttcttgcaactctgcttgctggattcatatgcagccctcacctgtcgatcctctccaattacttcaatgatctaacacaggttacctaccgatttcccctttccttatgttcaataaatctgatacccagcagagaattttattgttgttgtatcctctttttccaggtttcaggttcttggctactgatttagttgattcatattctttatttatcctgaattatagaccacttctcattcttaagtggttgaagacgtggcaaatatgcatctattggttgatttgtcgtcacccgatcagatctaagaactcatcgagctaagtaacaatcatatgggctgctaagcggatggagctttcttcttttggtattttaattatggtctttaactggtgaagctatatatatctcggtacatctatgtcgttgatgtgcttttcacttttgataaggtccttatcaagaatgatgtcagattctccacacacagacacacaggtttgctcttaaatagattaggttgtcttccgtctcaaagttcattttattttctgatcatgtatactctagatatgtttttaagtatcttttgtcactcttgaattagcttggtgatataaatatttttggagttttctgaaagctaaaatcactccaaagagttaatcaaggatgagtacttaattatatatatgaggtaataatccttttcccaacttcccatatcttactcaagcatgaaaattttctaccattattatataatagtttgacaccttagttatgatttccttgctatcagtgataattggactatatttgtagatgtttaaaaatataaaatattgatgtttcagttatggttattatcagttttgtaattgtaaagtagtcatcactcatcacc

SEQ ID NO: 70503 - DNA, 2614 bp, Oryza sativa
  unsure (1)..(2614): unsure at all n locations
agtcaagcaccagctgcagtgacacacctacttcaaccgtcgatacagcatcgtaatatacctatgccgtccgtttagccaaccgttcatatttcaaatggcgccgtgcctttataacgcgaaggcaaggaatttgtttcccaggaaaggtgatacgagcatatgtacctggcaatgacggcggaggctgctgttggcgacggcgcctcttgccgatgaagaagtagatcagcccggccgcgagaccgatcacgaccaccgcggcgacagccacgcccacacccactgtggtcccgctgcttttggatgatgaaggtgagggtgacgtcgttggcgcttcgacagcctgtggtggtgggggtgatggcggcggaggtgaaagttttggacctcgggtggtgaagggcttgcaataggcgaaggtgaagacggtgttgcactcggcctcggtctggatggtggtggtggtgaagggttcacgggagaaagaggtgaagggctcacggaagaaggtggtgagggaacccccgaagaagaagaagaaggaggtgggaattgcggattaggcctaggatttggggaaggtaccggattcggagtaggggccggaccaggtgctgggactggggcaatcactggagaagcgggtggtgaaaaaggtggtgaaggtggtggtggtgnaaatactggaggaggcataggggggtccaccggaggtggagnacgtggagctggagcaggcgtggggggaatcaccgaaggaggagatgggggatttcctggaggaggcggcggtgggttctccggaggaggtggtgtagggttccctggaggaggttgtggtggaataaccggaggagacggtgaaggtgttgttggagtagacggcggaggtgttgttggtgacgattggggcggatttgctgaagaaggtggctgtggaggccgatcagggggagctggtggcgattggggcggatttgctgaagcaggtggctgtggaggccgatcagggggagctggtggcgattggggcggatttgctgaagtaggtgcctgtgtagtccgattagcggaagcaggaggggtcggcgacgggctggacatggttgcgcggcgtgcaagtgcaacgtacgtgcagctcccagcgtgatcgctaaccgaccaataggtccaatgctaatgggcaagaagaggagagagcatcaagagcttatatatacctatgagctgtacgcagttcgccacgaggtggttttctctttggccgtgcagatcttcgtgtcgcttgcttgcttcaattttcaagcgacgtaagcaacagacgcacaggcgaaacttggtagtatccatgaaaagactaggctactcttcttatttcttttgccgtagtagctatcagtgttagataagattgaccgtgcaaagtcagagttcgattggattgtgcgaggaatagaaatggcactaaacttgctaatcatgaacttagtcatggatttttttatgcaagtgtagcattaaccacgaggaatagaaatggcactaaaccgctaaacatgaacttagtcatggattttttttttatgcaagtgtagcattaaccaggtagacctggtcagataccggcagagcacttgcgagccaatgatataggttgacagcttaatacacaaaatgagggtgacctctgtttttttctgggcagtggcttcgatacttgtatcaccattcatcactagacaagtatggccagcaatcaacctgcaatattcagaaacaacgtgtccgctcatgttttttctgctcggaagttcgtcagtcgtagctatgagagagagattcaggattttgacatatgaggcagattttattttcatttgggtgccactatgatgacatatcaacctagactgacatgtcaaaagcaatttatgtgattatttggtactaagcataagaaccgcatgtaacatcagaaggaaagagtaaacccagccacatcagttatgttaattccattttagaagctcagaacaaaataaaggaggcagcccatgaatgatgaaggttcttaagaacttcgaagagacaactaaagatcaagcaaaaaatgcactaaaataaaacacggtcactgtgaagttatccacaactggtaaattgaaatagcaatttggtcactccatcacccatagactttttgagtccatacttcattatacacgccagcagtaagcaggaacacatcttggaagcaaaaaactaaacaagaactagcaagtttcatacaacgcagtagctattggagtggatgagacggtgacagtttagttatataaaagaaattaaagatatcaaatgttcaagttgagatggttacaatggttttctaataattggtgcatggggtgacatccaaatacacgatgttttaaaacaatactctagccttattaagtctaatctaacatatatacccagtagtttgaaggaggctataggtacatatgatatgataatggtgcatcagcaaatcgaccgggtgatcaaatgcaaatatatatactccatatataagcagcaaagattttgaagttgctagcataccatc

SEQ ID NO: 70504 - DNA, 600 bp, Oryza sativa
gatcttccgaaaggttctgataaacaacgatttgggcagagtcgcgacacaaatcgatccggcttcttgaacgcgcacgctcttgagccccgcaatcgcaacaccacgtcttctctggttatcacccgtgtcgaaacacggatgacctcgccgagaaggctaatccctgtttgccaatcgaagaacacaaacaagagcgagatagaaaacaaccaaaattgcagatgaatgattaagctcacgagttggggtcttacaaaccgatctagcggcgaaactattctcgacagattaatctaagcaaaacccgactttaaacgatgacggctactgaataaatatgattaggaacgtcctaaggtttccatagggcgcacacccccttgggctaagcccacgacacaattacaaggcccaaaactcaaaatcagattcggactggatgaggtgcatgacttgttttgcagattcccggcagctcggtaggagttttgatgtggaaccaaaaccatctgaaagtagacttcataagctttccaacaagtactcatgggccccgaaatttcttctagatcagcggctaggtccgtttgaagttga

SEQ ID NO: 70505 - DNA, 1443 bp, Oryza sativa
gtttagcatgccgcacatctgcccttcttcatacagtgacttccttgcaatggttgcgatgaagcctggcatgaatcgagtcgggactgacgtgctaactccaggagttaccacgccggctccagctagggacgagtgtcaaaaggctctcatcattccgacgggacggggcaaggcgtgtgacaggccgcatgctgccacctaacccgcgatctgaccggtctgtgaccggtcacacactgcgaccggtcacggaccggatatgcgtgcgccgtgctgcattaaatgcggcgtggcgcgcttgtccattccgcaataaaagtggtttggtgagcgccgctgtgcccacctaacccacacccgtggcgccaataccacagggggtcagggcgccccagccctcggggccgaaacaggagcggctcgacccctcggggagacagaggagggggtgggcacgtccccctcgggcccgaccccccgagggggtcaggccacgtgggtgaccgcggctgcccaagcctctagtcatgatactcccggtcccatgtcaccgacagcgacacgaataaccattggggatggcgcaatagcacgcttttgggagtcaacctgaaagtgtggacgccaaccaaaggacgtgttgccacaggtttacgctatctccaaaagaaagaacagaaccttaagagaggcgattgcagatgatacctagtcgcaagacctatacctcttgatcctaggagcaatgataaccgagcttctagactagctagtgaccctctagacaacagtggatagtgtgtagctaaccctagatgtggtagatgaaatcacctggaaactcacaagtcccggagagtacatggtaggctcagcctagaaagcatagttcctcgaagccatcaacacgaactacaatgcgaacatctagaagccatggggaccaaacaaatgtaaaattttcgcttggctggctatccaaaatagagtctgaacttcaaacaggcctacgacttggggatagcatactgcacttgtgcagagacgcacccttgagacggcggttcatctcctcatggagtacagatacacctggataatttggggcatcctaacgaattggatggcacaggagtatagcaagccgaccagctagaacgccgccacattagtccatagctggtggacaacgatggctagcaacctgggacgcccaggaaaggaatccgcattcttctcttactgagcatatgggagatatagaaagaaaggaacctgatagtgtttcaacacaaagaattctcaacactaacccacgtgagaggctgccaaaactttaagctctgataggagtgaaatacctagcacagatcatcccataggtttttctttttctgtaaagttttgacttttgcacattttttctcatcctatattcaa

SEQ ID NO: 70506 - DNA, 583 bp, Oryza sativa
gattaaagttaatcaaacaaatcattctcaagcagtacagtctaaataaaagaaagtgtcataaaggaatgtgtattatgtgcatgagcaaggaatatgccaactaaaaagattaccaaaatcacaaatttttgccggcttccaagctgtactcctgggcaacacctccggcgaacatcaacagcacggatgccaggtttattttttgttctatccagtaaagcctcatggtgactcctcgtatcctcttcatcttcatcgtttgtctggtgacacaggtcaaccctgtaagaccattattttagagaaatatagagtgaaaaaagcaactatgaaaaggaaaaagaaggcagaaaaacatatgcataataataacatgattcatgagaaagcaaaaaattgacaatacaaggttcatggcatatgttatctcatagaaatcgttaaatcatgaccatcatcttccccctttttgtttcaccctaacatctctaatgcaatcctctcaaacgtcgcgtggtaaaccaatgcataacactgaacttatacaggtttggtcctcaagatgagaccttactatttc

SEQ ID NO: 70507 - DNA, 1225 bp, Oryza sativa
gaaaacaataactgcgttaacctcgcatttctgtactacgccctaagttacattctctacaatattgttctctaaatttctaaaagtaggttacattctccagatcaaactaaactacatcttacaattaacactattgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctttcgtttttttggatttttagtgaatataatgaaatttcacaggggaggggctgggctttataggggggaggcaaaaatcgccctcccccagggcggcaagggggccgcctgcaaaattccatgccccctcgccgcccatttgcaggcggccccccgcacagtagaaaatcgccctcgcggagggcggcaagggggccgcctgcaaatttcgttgacggccgtcgcccgagagcgaacggccgtctgccacgtcattttcgccgccctctgggagggcgatttttaaaatcgccctcccagagggcggtaggcgactatttccgttaattttcaaaatggaaaattatttttgtaaaacttttaataaaaaaaattataaataaaaaaaattccttgacgagaagggcaccatcgtgatcaatcatctgtctggtgggcccaccaccatagactcgggaggcccaagttgatcccaagccgcacgatcaaagccgatgcgcgtcatgattggatttttgcctttgcccctgccccctcgctcctcgtggtggggtgcacatgacacgactgcttccgcgtttcttctcggcgacgcaccccacacacgcacacacacacctccattcgctccccgccacacaacacgagaaaccccccgccttcgctcgccgccgccgccgccgccttccgccgcctcgaaccggaccaaccaacgacggctcgcttccctccgaggcggtaggccacctcctcccggcggctcccccatctggccgcccggcgccgagctggggatccatccgcccgcgattcctctcgccggtaacgactccctatcttcgctgcttggatttgcg

SEQ ID NO: 70508 - DNA, 1304 bp, Oryza sativa
acccccacccctcccaacccacccccgtgcaccccaaccaccggcgccccctacccctcccaaatatactagtaaattgtttactatcgaatctacatgctatatatatatagactagcaaaagtgaccgtgcgttgcaccgggtgtttacggagtgtgtatagcgatcaaaaagtattgtttggtttagagaactaatctgctcaaaaaaaattgtttgtttttagataaataatatgctctatatttgcgcacagagtgatgtcacgatggataaaatttaactgaacaattttttaaacagtctagtatttcaataataatcacaaagttttttttaaaatattccactttacatgtgtatgatatgagcgatgttcctgacgcgttagcgtaacgattgtactacggtggataaatttaactgatcgatttttaagcagtttagtattaaaaaataataatcacaaatgtttttttacagttattccacgtatacgtggatgatataaatgttgtacctgatgcattggcgtaatctctaatttcgaaatctctgccgattcgcgtgcaaacaacccctccacgtggcacaatacgattccagcgttagtcctctccctcagccgtcggatcgatgatcaacggtgtggaatagctgcggtggacctctttgtaatatgtgaggttttaggggtctttttgaaaaagttataccctgctatgcccttctctccgccggcagccccgcccccgcttcctccgcctcattcgtcggaggtcgacctacgccgatgtcgccgcctcttcctcctcctcacgctccagctccagctccacctccgcccctccggcgcccgaggccgaccctcccacgcgccggcgcgctgttctgtgcgtctctcccctcaagctcggcggcagtggcacagattcacctcgtcgctggatgtggcgatgaattcggttgccgtgcttggggatggggagggtgaaatcacgtgcatcgctacgtccgtctttgcctgccttttgattcgccagccgcctctctccccaagccgcggcaccgaggggatcttggacggaggccactggccgtgccgcaaagggcgtggctgaggaccgcgctaccgctgccggatgacgtcatgcaggagcaggagctccctcccctgcttccctatgtgttcacaccacaggtgattaattccacctgtaaacggaatcggaatcggaatatataaagcggcgcacatggggcgagcgaagaggggtgccacgtaaggattttgctacagtat

SEQ ID NO: 70509 - DNA, 1061 bp, Oryza sativa
cgacgctcccccgtccgaccgagcggaggacctcgccgcgaccgatcttggcggcggatctcgcgaatgtttttttttttctttttcttttttttcgagaggaactcgcatgaacctaaaccctaggaggcggcggcgtttggtttgaatggtggagttggctcgagtggaatggcatgacctagtagggtagtaggtgcgaggaggcgactgcagtctactgaagtcggcctgtgggctgtggtccgaacggaccaagacggcccgcgtcttggactacggagtgttcagttgagctgcaagttttacaggatttttttattattgtttttctaaagatttataaaaattactctaatataaattatcgttccaaagttttgcaaaaatactctccttcggcatataaatcaccctacaataagaccatctatgtgacgtggcaccccgtagaaggggcacatcgcgacaattttgcaggcctcccgttgggcgatttatcgtcgggaggggccacctgcaaaattgtgaaactttgaaatgattttttttacaatagggtgggaggagtatatttctataaaacttcaaaatgaaataaatataaatattaaaaaaatgttttacaaagagtaaattttacctagactcatgtattattatactttaagttacacaagaccacactattgatcatttcgacttttatttatcacagttttgaattctacaataacatctcaaatttatgtgttctttattcatcatataaatgatctacatccatgtaactatagccttttaaaattttgatatgtgaatatgtcaaactgattagtgacgtggttttatggaacttggaccattaatatcttaagttatatgtcacgtgccaaattttatgtggttttgtgcaactttgaccattataggtgaggttttgtaaaatttactcttacaatctagccttctaagaaaaacttactccgtatttcatgaaaataccattagtaagacttatttctggaaatgtgttgatacctcggtgccaacgttggtat

SEQ ID NO: 70510 - DNA, 1702 bp, Oryza sativa
atgaataaatgtgcgcacagcattttcaagattcttctgaatcctgcaaaaaatatagaaattaagacactgactctcatatgaagatgatctaggacaagaaagtcaccttgggtagcattggcacaagtcatgtgcgagttcagagcataactccaaatatgatcgaaatgtatgtgcatctcaggagagctcagggtcttcatagaatcaacaattgctccataatatggtatattgttccgctcgaagctgattaaaaaacagatcagatgctgctttgatttcataagccataaaacatatttcctaagaatgatagatttttaccttcttaaaaagtcgaggaacatgtgttccagcttttggtcttttccactcatgaaataagacgcaaaatccgctctcactgttccaggagagggaggcctggtttctagctgcgcattggtgggtgatggccttggcttaacactggagctgctaccatgttctcctgccatacgggaatgccgtactggaggaggaccttggcttgactcaagtgacgagcttacgctctagaacagagaaaaaaaaatgatgaaggcattttgctagatcaaatcaactagatgaatatattacatggttatagcaatatgagtgtttacaggtaacatcaaaaagaccgtgacaatagaagtggctttgaacacagtagatttgccactaaaatcctacaatcaaaggaatgcatatttctagcaacatgctgaagtagacatggcaattctacatttagaacaacaatgtgctaagcatgggatagcagttaacatttaaggcaacaaaaacgtacatgatgctgggtttgcctggcactggaggcttcttcttaaagctttgcttagcaccttcaaaataattgccacttttcaacacagaatgttggtcccttgagattgtgatatcatgaaccaacacaccgctttcaccaggctaattatttttaaacaaaaaaggtcagtaattaaaaaaatgcactgcttaacaaagaaagtggcagaattactaagggcttacagaatcaacagatcgccaaatattttggtagttccggaagcccacatctgattccagaacaaaaaatcttccatggtactgaaaagaagaaaatagaatgaaaactagcataccaagcttatttaaaaaaaggcaggtatcacaactcgtaaattacaataccttgtatacaacgttgaagtgctcgttttgaaagaaaatgaacaacttcctatcaggagttgctgctttcaaagtgtgtaaactgtgattttaaaaaaaaatgtcaatagaagaaacaaaatgacaattgtatttacctatagctagcatgcatacccaaactctgtgacttgtccaggattatctttcaagaacgtgtgaatcaactcatctacaaataaacaatttaaaaacagagcattagcgatcaaagaaagaaacatatttgcatccgtaaatagttgacaggtgaaaaatgtaagatcgttacatcttctagtttcagcagcatctatcataaaatcagcatctttctttgagttgtatttagccctatcgatattcagctgattgtatgaacgtccatcaactgcattcaataaaatggtgtcttcctgttcacaaacataccacagaagaaaaaattaggcaaaac

SEQ ID NO: 70511 - DNA, 679 bp, Oryza sativa
gaatatatgaccatttattcaattaatttaatattgtatacgatcattattagtttgctttctcatgattttacaaaatacaatacatgcagcaaatgataaagcagtagagagatgcaatccacaaattgaatgattctgcaagagttataccttccgcttctcagatgatccagtttcacaacgcactttgctcatctttgaaaatagtattgcacctttaaatgatcataaaaaataaaagaaaagggcatgtcaagaacatgttgaatgagaggattactggtagcagatgaaggtcaaaatatttagtaaggcggatgtgaaactagatataaagtgaaataggactgtgagactcattcaatatttaatctactgcgagggattagaaacaagataatatgagtttatcttaggttgaaacaattgactagaaaacatcatgcctaatattgcgacataattatggtatggtatagatgagtatacataggctatgcttaccataacatgccagcgcaccaccaagtacaagaacaactactgagaatacattcaagtaaacctacaaaataaaatatttggctaaacaatcaagtcacaacacaataggtgattaaataactattgatgaaattggtgagcttgtaaatttatcaagtaaactaatgtgaaa

SEQ ID NO: 70512 - DNA, 635 bp, Oryza sativa
aaaaacccatgaggggtcggggctcctcggacctcagggccgacgggggtgcggtccgaccccctcggggggactaaaaggagggcgaacgcatcaccctcgggcccgacgtccctcgggggtaccaggccacgtgtgcgattgtgtctgcctcaaacctctagtcatgatactcctgatcccatgtcaccgacagtagcccccggcgttatgccagggcgatcgccctctttaagggaaacggtcgggcgtgacgccactcctaagacctggtgacaggtgggaccggtctccacaattgggcagaaacccaacggtcacaaaccacgcacatcggcaatggtaactcggctgtcaacaatgagcggtctcttcaagactgccacattacttgagtagcacacgaatctggacatggcgattcgtttcgtctggagatatggtaacgtcgcttcggtcggcgagcgtaattaacgcgcgcacgatatgatctatctcgactgccacaaccgcatatccacctcatgcgccgcaagcgggcgaatgggattagtgaaagcgtgggcgcgagaaacgagggggcgaaatagtgggcgcgagaagcgagtagccgggcacagcgttggcaagagtat

SEQ ID NO: 70513 - DNA, 727 bp, Oryza sativa
ctaaacggtgtgtttttgtaaaaaatttatatacgaaagttgcttaaaaaatcaaattaatctatttttaaaaaaaatagctaatacttaattaatcacgtgctaatggattgctccgttttccgtgcgggatatttgggttgggaacctggggtgctgaactgagccttaaagctcccaccaacatattttgcaaagataaatacagcaaagtatcgtattttctgtttcccagtttcatgcggcggcaaacactataggcatgaaacattaatctttagggcaagaactggacgttaaagcaaatggagttatctcggggagatcttgtatccgtaaagatggtgacaacctgaccgcctaagtctgagtacaccgctgatgctgcggtggtgcttcaacctcctcttccatacgctacaacctgagataagataagacgggggaatgagatccgtcagagatgcacatgcacagtactctgacttgggatatttttagccgttcgatctgcagcgaacaaacgagatcgattgctacattatgttacaataatatccaaacagtaactttgaacagtatatttcaatactacgccttttctactgtaacgcgtgactcaggatactgtgctcctctgacgtgactcaggatactgtggcgacgtaccatcccaaagtcacaggagttgatcattagcagtagtcgagttaagattttggaaatg

SEQ ID NO: 70514 - DNA, 1625 bp, Oryza sativa
atcatattttacaaagcagtcggtatatcactcggatcatgttattcagggattcatactgcatatgctatatattaatattaagtcacttgtttgactacgattatcaaaaccactcagttggtgcatctattaggtacatctactcgatgcacctgactttatttttcagccctccacagtcttcatatttggtaaaagtactcgggagatcatggcgaggatgattgaagcactcggctttggagtaatctagttcgagagaagattatctttccgactgtgaaggtctcaggggctactgtggagattatgggtaccccatacccacacggcatggttatccgactagtcataggggatagcttatatctatggaatatttaaccgatcatgacttgggtattacgtttccttttatattatgaagcagcctaaagtcctgatttgataatattgtaaaatagatttaggaaaccgataccgtattggttaaggtttctatcttgtaatcctgccccccatcctatataaggtggacaggaggccctctagggggcatgacacaaactgatcgtcagatcaatatacacccggcgaattcaaatccccaaacaggagtagggtattacctctcatcgagagggcctgaacctgtctaaatcctttgtctccgcatccatccacttttaggtctcgtatgctacccccttttcatattgccgaaaatttgtttcgacaatgagcttatccagcaacccatgatgggctgtgttgtcgacgacatggaaatcatgcaagttagctgtgcagtcagggcgccagtcctcccatgaagtgaccgggataggcatggtccatgtagtgagcctccactggccaggccgccggacggaggagcgctgccgtgtcgtcggctgaggctgaggttctctgctccggcgaacccattcgaggaacgaatcaggaggatcatctgcaggcatggtgcgatcaccggaggatattatggttttggtcacaactcttggcatggtgatttccatctcggcgtacttgatgaagtccttgtgttggctgacggtgatgtcccgatagaaggactcgctgtcactgaggtatcttgtccagttgcccttggccggccatggcagcggcatgtcgcggagctttgggggagacatttcgtcgagcaggtcgcagaggaggatgccacgccagagatcgacccagccgacggtgcccttcgcgcctccgagcgcgatggtcttggtggtgatgtggtacacgggcctctcagctgagtcagggatcgggcacaccctgtccctcaccgcctcctccacaaacacctcctcgcacgtccaatttccggcgatctcatcaccatcgccaccaccagaagaagatttgtaccggtgcagcgcgaattgactgggcaggttgatcatctcgagggcggcaacgacgtactgctgcttgtcgccgcagatgctaacgatggcgaaatcgtcgtcgcgtaagcaatattgctggcacggcctggggagcagatctagcctggcgggttgatggtgatggtagacgaagtagtcgtcctgacggaagagactcttgccgccggg

SEQ ID NO: 70515 - DNA, 502 bp, Oryza sativa
tcctcctcctccacaaaccctaccacttcccctccaagctccgccatggccgcctgcaagaaccccgcgtcatggcgtccccgcaggcgcctcccctcccgctttcgtcgctccaagaatcgagaagcgctcgtatccgtatcccccgcgacgagccgaggccgacgccgcccgcgcgcagcagcagcagggaggagccccggttcgtcgcggagaccaaactcatcaccgtgcattcctgcgcggggcggctcggggacgcacgggaggtgttcgacggaatgggccgcagggacctgctcgcctggtcggccatgatcggcgcgtacgccatcaggggaatgtacagtgacgtcctcgcgctcgcggtgaccatggtcgaggaaggggtgctcccggacaggttcctgatcacgcggattttacaggcgtgcgcatatgccgaggaccttgagcttggtagggcgctccattccatggctatcaggagagggttcatggg

SEQ ID NO: 70516 - DNA, 508 bp, Oryza sativa
ctgaactaaacacagcccgtcttctggctgcaaacagtaacattttaccgtattagttatgacctctgtaaaatagaacagcacagactgcctattcagaacagccagtgaattatctctaaattaccttcttggcttcaggatccttcttcttctttggaggaagattatcacaatcaccatagatgcttccagttcgcttctcagtgttatcaatcagaatgctgtatttggcgtcaggacggatgatcaaggtgtagacgtgtgtcagttgatcggtctcgcatggcacgtccttcttgatcagatggttattgccgttcttaggctgcgttcgtttggagaacaaagggagtgagtttgtttctgttttccgcgcgcacgcttcccaaactactaaatggtgtgttttttgcaaaaaaaaaaaaattctataggaaagttgctttaaaaaatcatattaatccatttttaaagtttaaaatagttaatactcaattaatcatgc

SEQ ID NO: 70517 - DNA, 1032 bp, Oryza sativa
aaaaaaagttaaaatacattataatataaattggggttaataaaatatatgtgcatttcacttcacgggccacttttaaagcccatgtatgtcgaccaaaacgtcatggcctacttctaaagcccatataatctatgtgataaaaagcataccattggaaattatgtgtaccttttaagcgtttttttactttaattaaaaaaaacagtactccaaacgaatgcaactcattgcttattaatttcgatttttagaatcattaaattataaagataatactaaattgagacccccacataagaccaaatttgtagtgattaacttcgaattttagaattattaaaccaaaaaaaaaagctatagttgaaaattgaaaccaagcattagctcaatatttattaattacgaattcataactattgaatcaatacgatttaattgaaactccaaactgagtacagcttgatatatttattaattataaattttaaaattatcatatcaaaaggagctaaaatttaaactccaaactgaaaacaatttgaaatttatcgattacgaatttcagaattatattgatactcatgaaaaaagatgaagttgcatcttcaaaccgagtataattaggtactgatttattccaaatactatatcgattatgtgctgtttattgatgatttttttttcttgcgcgatgattcgggaatactggtgggcatcgaaaacgtgcgtgctgatcaccccagttagttgctttcgcctaccaaaacttgattgatgcatacacagcaaaaacatgcatccaacttgccaatatgtatagacagtatatagtatagaattggtcgtgacgctgtgacgtaaccaatctcttgacagccctttcccctcatgaaacagtcaaggaaaatttctggttttgcatgtgcgataggcggcggattttcttaaccaaaaccacttttcggcaagttgccaaaaagaacaatattctcccctcgatggatcgggacagtcacaaaacttttatca

SEQ ID NO: 70518 - DNA, 1703 bp, Oryza sativa
  unsure (1)..(1703): unsure at all n locations
catagtgaacccgctaatcaggaaatgtgttgttctgtataactttcagacattaagctttgtagtaggttagtaatactcgtattctcctatttgcaatgttgcattgatgtttaagcactgttcaaatgacacggtgttgataaaatgcgtttttgatagatattaacatgaagcgataatttatatgtcaacattatatgcttatagcacagatagctggagtgtaaatcacacaactgaacatcggaatgtgaatatggtctaacacatgtgtaactcttgctctttcagaaggtcatttatctttgtcttattttgtagttgttgtcatctgaatataaagacactccaaacttggctgtacaatttgaagacttgagaatactgtcagtgagcttggatttctcaaatgaaagagaactcatcttccttctgaagctgcttgagagttgccccaacctgcaacagttgactctttcggtatgcaatatcacccattcactcttgcattcacattagcatctttactatattgagtttcatcagtaagtttaccactaatttatctacctgccattcatgcttaggctgttgatgcaaaagacgacactgcattgccaaattttgctgatcatgaggagaggctttcaaagttatcatgcctaactaagagtttggagcagctcaagtttcttggattcaggcctcaacggtaccagaaggaactctttatctttctgctaactcaagcaacgaacctgaagaagatggcggtggagttcccgaaagaccaagaagctgctgtgaggagaattttgtcagtgaggaaagcccccactcagaagaaaactaccaagtacaaacaatactacttggagttagagtatcctgtggagcccaactgctcatagggctctcaagtcgctacatgactggtctctcttggacatacattcactccctagactttaacccttaagttgcaattctctntacagagatcacacgccggaaaagttcttattcattggcttcaggatgtaacaaaacatttgagatgctttattgcttcgtgcggtatgtaattttcaattttttgtgttacaatgttatacagggaagtatgagaatacatggggttacgagtacttaaaacatgcttgtgaggatgatgaacatctatttctgctgccaattactctgaagttctgccatagactgtgtgctcaaatttgccactccatctgtgcattgtccatgtcaaaattggaaatagtgcagatgattaggatacactgttgtttgtgtgaagggcagagaaaagaaatggattttggagcaattgttcacctgttggaatcgtcagatgggacttggagctccttttctgaactgaatggttcgaaaagacggtcgatgtcctcgttcttgacctcctcaagggtagcaggactccactgtatcgcaacaaaaattaaaaaacagtatgaaaaataaaaatttctagacatgtttaagagtgtgtatgagagaaccttaggggcattgtctttgtcgatgctgagagctctaattccctgccaagttttaggtgcaaatattatgatgaatgacatcttagtcttgcctgtatcaagaatcaccgttacttattcatatagtggcaaatcacagtacctcatagacatcgccagtaacta

SEQ ID NO: 70519 - DNA, 1325 bp, Oryza sativa
cccctcatagaaatcaattacctgccattgttatgagcatatatatgctgctgtaaattttttatgtacaaagaagaggatgttagaccaccctagcagcttaccatcctggtattatggaagccaacttgaccgacatccatggatggggacttcttgagattggaccagggcgtgtagaccacctcaacattgttcatcttgtttcctgcacgacaagcacatgcaagctgcaaatatcatccagtgatccaagacacatactcgtcacgttctaattatcacacaatcccctcacataggccaaatcaacccaagcggataattgatccaaggggcccactgtagctagtgccaataatacaagaagctaaaagttgctgaaaagaaaaaggccggggtggaaaagcaaaaacaaaattaagattcctgtctgtaaccagcaatataatgtgatgctgcagctttgtagaattgtaggccacacgaatatccgacaggtcacaccatgctctatttcctctatccgtggataacataattggaggtgcaaatgattatcattatttgcaagtaaacgtttccttttcttttgagaacctgcatctatccatgataaattcttcgtaactgcagaatcttttgtggtaaactgtatctaccctacttttttgcacgagtgaaaatttactagttgatcgttagaaaccaaaagaatctagccacaagcacacaaagcagatggtggaaaagaaagctaattaagctatgcgctacctctacactcaaatgttgtctgaaatgagtgcgtaccttgaatggaatgagcctttacaagctgtgcacagtcctccagcagaccgtcgcagatgctatctatcgactcgcctttcttgagcctcaaatagacgtgcgccgaggataccttgtccacgtggaacctgacgggacaaaagcaattttccttgtcgaaattagaagggaagaatccactttaaaccgacctttccatcaaaacaaccagccggacgtctatatatatcttagatcttacttctaagaaaattcctacagcactatatagttcatcttaacatggatcggaataaatatctctacatgtttcagatgaggcgtaatttgacgaattaagcagaaaagtacttttaagcattggaaacccaaggagatcgaggtgaggtcccctagatggaggaagcaaacaaaaggctgcggtagtggccacagtagtagttctgtagtagtactagtgcggatggcaggcgatggctacagacagagttgcaacttgttgctgagcatga

SEQ ID NO: 70520 - DNA, 1228 bp, Oryza sativa
acccaacatcgtgttgacccgagtaattcccctgtaacacaccgccccgcccgattggtggtgcggaaaagccccgtacttttgcgaaaacgacgtccgtttcgacccaaacccgtcgcgtgcgcgcggctctttgttctctcggtgatttccgtgcggaagtcgcggttagttcgttgtaggtgacgacggggttttcgcgcaagaccgccgagacgaagtaggagatgggccacgggaatatttgggctgtgcgctcgcgagcgcggccgaaagatgcatgcgaaaagcgggggcccggcccgcgtatcgaaccggagaaaaacgaccggacaggaggagacgtcgacgagagagaggatcatctatctgaagctgactcatcataaggcgaccggcacgcaacgggacaccaccgaccggccgtctttacgcgagcggctgatatcccctagatccgtgtgagctgctttatccgctgccaggcttagcttcgtcaatagagaacatatttttctcattttttttagacaataacttatttttctcatgtcgtgggaaaattatgggaacgggaaagacaagagaatcgcgtgccagtagctcagaagatcggccatcaattgcgtgatccacgttcaacgggggggaaatcagaaaagaggagaaacaatcgcgacaaagagggggcgccaaaagctaatccattatggactcctcatccattggcgctgctgatccagcacaatcagtgacaaactgacgatgatcgtgacatacagtggagcttccatggcgtcgcatcttaacccatattcggtgattacataatatctcatgataaaatatagcaatgttttttgcgtgctattgcaaaagtcagcataatactaaaatattagcttctgcgagtgcaatggagacttggagagtaggacatggacactcatgctaattcaagtcattttgtcaatttgatccttcgtatgcagggaaacttcgaactgttcttacttatatatcttgatatctgtacagctatactgattgtcattatgtaaaaaaacccatgttaatcaaataaatagtaaataaataaatctagtcatccatttaggcgggatcaaattacaaaggcttagattagatgaagagtatatgccactagcaaatggctagttactgcgaagtattacaaagtttgggattaaattagtaaggttccaaa

SEQ ID NO: 70521 - DNA, 546 bp, Oryza sativa
acctcgcaagtggcaatcatttctaccaacacgttattcggcactcggcagtgacgactacagttgacaagtactacgtgacagtttcctctccgacaagctagcgatctgaacgaaggacaacccacaaattatggaagtggtgtaaatcttgatcaactctgaatttatattgcaatctagttatgcggtctgcacttctctatacagtactattgtgaatacttttgcattggcgtgaattctcgatcttttttccccggcctgttagagtttctgggcctcaagaagcccatccacgcgcaacgggagccctcaactcttgacctcaagtccaacatcgtccgggggcagcacatccattccctcggcctcgtagcggcagcgccgctcgtcgccttccccctcaccgccagcgcgccgcagttcgagaaaatagacatttagccactttcaaaaagcggtttcgctggaatgccattctgaaaatgcgtttcgctaaaatgccaatacgaagcgtgaactcaccgccactttgccatgttt

SEQ ID NO: 70522 - DNA, 743 bp, Oryza sativa
ctactagctttaaaatttgacatctcatttgtagctaatccaatagcctaatgtatactacatcattaatatttggtcacctcatgtacaaacatcattaatatttggtcacctcatgtacaaacactattttggagtctttgctgcagcaaatctatagaccgttttcatctctttttctcctttacacgtgcttatagctttcggataggtgttctatccagtatccactgaataattcagatcaaatgaaacataaattaaactgtttcatctggaacttttgacaaattttctacaaaattcatgtgtccaaatgggtagcagttctatactcaaaagcttgttgcatttactggaactatttctcatgaacttttcatcacaatcttcaggcttttgattgcggtaaatctaattggagaggcctctccaattattcttaaccagagacacccacgtgctagtactttagaagtttttgttgctattaatccattgagcaagtagtggaaatatccctatcatctatgcttcaaataaaattttctcttaaattactcatccgatttacaatccgattacaccgttgtgttcgtaataattaaatctttacaacaagatctcacatgattatattttgatgaaaaatcacaaattacttttatgatatgtctaaattacttttagatttcactaagttacttcttatacatataaaagtaaattcagtaaagcctaaa

SEQ ID NO: 70523 - DNA, 939 bp, Oryza sativa
acgggggtggccggagacgccggggacatcggcgacgagggggaggaggggcctatctggacgggcgcgagatcggccatgctgagcgtggggtagagcggcggagcggagggagcagggctagggttagggttagggttagggttggaggtgttgccgtagtagcagtaggaagccatgggagcgcgccacgggggggaatatacgccgccggggacggtggaggggcggcggctcgccggcgacgtggcgcttgtatagggagagccggccgcgtacgtggcgacggagcccggtgggacccacgcggtttgggggaggtgggtcccgcatggctgtgtttaactaattgggtggttagttttcccatttatggcgatgcttctcgtcaatgacttgtggggtccgttgaaagtgttaactggtggaccatgttttcctggacccacctgtcggtgggtagctttgggtgaagagtaaccggcccacgaggaggtcacgctacccgatgccgatatcggcggagggagctgacgagaagctacgctatttatctttctgacgtgtgggcccatattggccgtcctatccacagcagctttcctccatgagtaagcaacctcgcggccatagcaacagcatccaatccatccatgcccaatgcggtaagtaatctggttaatgatctagtagtaggcttcgtttggaatatgattactacgtgtaacaacttttagttggatggaatgtatcccaataatataaatctggatataccatgtctagatttacagtaatacgttccatccaagcaaaatttactatattttgatatggagggagtagcttttttaatgtaattttcagcttccatatagttcaaattcagaaaataagctaccctttagaaccggaggactgaaaatctagctttttgca

SEQ ID NO: 70524 - DNA, 750 bp, Oryza sativa
tcctgcagcctgcaacttaagttgcacgtatttataactaaagttgtgcatatttataacttaagttgcacatgattgcattttttttattcttagaaaaatcacaaaaataggtaaaatacctagaggaaaatttcctagatacacaacagtggcaagtattcaagggtgcggaaataaaaaaaattactctaggtacctagatacacaatgcagcaagcattcaagggtggcaaaataaaaaaaaagaaaacaaaatgcaaaaagcacaagcagttcggaactggccctacagccatttttctgatatataacattactgagaacattcaaatttttagttttcgaaaacttgcagctaaatcctaaaaagttgcaaaagtttttgctaaaaatttgcacattccaaaaaagcaatgggtataaaaatcgactgacagattgaagattttcaatcacctgcaaaataacaaagcagtttttttctgtatgttaagttttccttataaattataatgttttccagttctattttgatctaaggtatagctagcatgtttatatatacccaatataatgcctcctaaatttcttatcatcaaatttgctaacagaagttttataccaattcccgcagcaacgcgcaggaaatcatctgtttaagtatggtgacctcatggtcaccgtcaccgaggcaacgtatggtgacctcatggtcaccgtcaccgaggcaacgggtagacgggttca

SEQ ID NO: 70525 - DNA, 3740 bp, Oryza sativa
gtcggcccatttggttggagggagtttttagtagggattgggagtttagagggatggggctattaagtgtcttgtttggttgggagacataagaattttggtgagatggagatgaggaattgaggaaggaactcctccttttcaatagctgggtaggggcaggtaattgggaggaaattcctcctttactttgtctaagcaaatctcgaccatccgtttttattaatgatctaatctccaactaaactccttatcaatttccatcacctctaccaaacaagatattgggattaaaaatcaaattcccatcttaatctcatcatcaattccctcgtgtaaacaagccgagtgtgttagaggttagtgaaacagaaaataaagagtcagcgggttagtgagttagtgcaacagaacaacaaagggttagatgttaggggttagacgtccaaaagttagtcgttctcaggtcattcaatggcgcggcggccttcctgtcctcttgctcaactgaggcccagccggagccggctgtggcggagcaagcggagaggtggcaggcagcttgtgcgcgagatggaggagtggcaatggcagagctcgagttgggagaagggagaagaaatggagaggagccgagctgctgctgtctttggtagggtttatatagctttgctggctgcctgagcatgggaggcaatgtgagggtgggcagggagcagtgccgaaacgtcgacatcgccacagtaccaggtacgcatggcccattgtacttggctttgccacttttcggtgtgaacttggtgttgctcttctcagtgaacttggttctgtggtggcatgtatttagtggagggttttgtggattgggttcatggtgaatgtgttgctgctgttgtggagggacccctgtcatttggtagctgcaaaagtaggttcaattcactgtggtggcttgtggtcaattgatcgaacacgttctgtgcatgcaggtgttcggctgagggaataggacagcaatacatgcatgtttttttcggtgaactcggtttatcatcttagtgtggatttgtgtctcctgtgttgttggtgctttggggagggtcctgtgaattgggatcatgggtgcatgggatgttgtttgggagggaccctggtatttattagctactgttgtgagccggcaaaggtgggtgcaaagtgctgtagtgtcttgtgggcttatgtagagcacctcctgtgcatgtctgttggttgttttgggcagggcaggcaaagcagactttgggtggttgactgagcaagcgcacaggggtgggctgtcagtcggctgggggaggaataatggacttgtgtggtgaaatgggctgtgctagcagagggggagatggcccaagtgtaataggagcttttgtattttgtagggattcgaaaggaatggcgtctgtatttgagctggcacacatcagtgtatttgtaatgggactgtaatttgaacatttattttggctctgtactcagactgtatatatggaactgtacaattggactggacttggatcggtattagaaatagaatatgcacaaggattggattattgaactgcaatacgagatttggtttgcttggatgatacaccgcatcttcgaacagggaattagggatacgcccgataaacaattccatcggcagtcttaggatttcgtcgtgagcgctttgcacgaacgggcgacggaaacaaaacagtgatttttgggacgacgcatggcatacaaatctaatcgtcgcggtaggaatagaattgaatatatttgaattgacacacaataaataaatacgccgatcaattgtagacattcgaaggatttattgagttgaattaatagaacggtttgaaataaccggagggtaagaattgagaaagatatatcgtgctgcgacataagggaagattttcaggttaaatattctgtgatttggtagcacttaataaatcagaccgtgaagataagggaaagaaaggacgttggactgagggcgtccctttaggagatatgatttaatcgagatctttagcacacaacctaaatacacacaaatgcataataaatcccagcatgcaaaaaggttttaaaaagatttttgattattctgagtttttaattccgtatttcagaatcgaaattttcgggatgttacaaccttcttcgccagccgcgttttgggaagaaaagagaagaaagaggaggatagctgtcatgtgggctcccacgtattttttttgttatctttatttgctgagtaggatgtcaaatcaacgaaactggacatatatgttagagtatatggtagttagagtcatattaggatatgattgatttgtgtagactccttccatatctgtaattcttccttatctcctctccatgtactcttatatataccagccccctgaggctcaatacagtcaatccacgattcgcaatatcctctctccctatactatccaacatggtatcagagcttcggcttccacttcgtcgttctaccccgcgcatcatcggcttgatcacccgttcaaacggccggctacgacgacaccttgctgctaatcatcttcgactacgcgtctacgccatcaagcttcgggctgccgctgcgtcgcccccctcgggccgcagttccgctgcctgtggtccacacctccactggttgttgcagtgctgacaggcgccctccttagcatggctacatcaccggtggacttctcgccgctgcatcgacatggaactgcagttgtgttgtcttctcgaaccacaactttgccgctttcgtcgttttcatcgtcgttagcgcttcgacaccctcgtcgtccgcattggtcatcgtcagccactcggatcttctttgtctacttcgagcatcgccgccgcgtctccaagttgccaccgtcgccgctctaggccggtagtccagctacctctacatggctactgacgttgccgtccaggccgttggttccgctacttcgccttctttttcgtccatcatgattcatcgccagtgtcgccgtatcttcctcgactacactttgctcttctccgacaactacgtgctgctccggcaattctccctctacgtcgttctcgcgttgcgaccgtccagaggtcttctctgctagtctccttcaacattcggcttatgattcatggtggtcccctgcctcgcccacgcggtattggaaacactggcgtgcgcgttcgtcctgagttgtcccggggtctggcaaaccctgtgtgacgtctcgtccttcacggttcgactacattggcttttcggcgtcatcttcctcaacgattgccgtgattgtgtcaccgtcttcgtctccagtgcatcctcacgcaccttggtccatgacgcccctcccatgtgtccatgaccactctacggcgccctatgcgcgtcctgcggctcggctacctcgacatcagcttcctgacttcggctacaacgaccacggctactctacacacggcttcatcgactacggctcccttgcacccttcgctttggctacattgactacggcacacagggctatcatccgtattgagtactcttgccggtttcttctccagtccaagtgtccacgctgctcacgcttggactgtgggggatgttagagtcatattaggatatgattgatttgtgtagactcctatatctgtaatccttccttatc

SEQ ID NO: 70526 - DNA, 719 bp, Oryza sativa
aacgaagtcactataagcgtgactaaaagcacaaagccgttaaatcctggaaaattcactctcacgggaagtcgaacccaggacctaagatgctactgagactcttgtaaccaatagactatagattataaatcacaaaacttattaacaacttaaaataatattttacaggtaaatttttatatatagcgagttaatatatagaaaaaaaccataatgaaaacatcaaaactaacaacaaaataaattttaaattttaagttttaggtgagattaataaactaacaacaacataattagcagtcattgcctcatcggtcacggttaggtatgtattcaggtcaggtcaggtcaggtgtgagctcagcaggtgtaaaaactggactactccgtagacagtaaacaatcgggtgaaagagaaaggggaaacacagaaattttggcagctcactcgcttgcttcttccgtcagccatggcggccatgaccacgcatttcgtgtacggaccagtattttatttgtgtggctaatggtctggtttatttctcatggtacctggcagaaacgcgctaactccaaacaggagtcaggtttcgattgtgattgtttcttgcctaattaaaacacttgactttcactcgctgttaattacacccctccgtccaagaacatttaatttctggttacgtacttagacaaggcgaaaataagttatttta

SEQ ID NO: 70527 - DNA, 615 bp, Oryza sativa
caaacgtttttttagaagggattactatgcgcgaggagtgctctgttttttcctttttaagaacagagtactgcgatacaggctgcgtgcagttggcatttgtgtctatcacaacctcacaagctgtccaccctttctcactgacagtaggccccacggtccccacacgcccatcccggtcacactttctgtctgcatgcgaccacggtccagccgacgcgcactccgcccgtcactgccaggtgggccccacccccagctcacctcatccgtcacttcacttcactcctctccccgaaccccgtggagtaatcaaaaccccagcaacaacccaaccatctcatcttaaatgcacgccaaaaatctcgaaattttacgggggttttaattaccaatcaaccgctaaaccccggagtagagtagagtgatacgcgagcggattcgatttacttcacgctcacgcttgcgggtttctcatcctcgctggggccacgtcctttccttgcccggttgattcttgcaagccctctcattcagcttgtgctggtagctaccaggtcggctttggcggtggcggggggccgcctctgaatccaaggcgatttggtgtctgac

SEQ ID NO: 70528 - DNA, 529 bp, Oryza sativa
agtagagtaaattaagcaagtggtatccttctcaatttcattctacccctgcccctgaacttaacgagagtgacatctttatcgaaaccctcggtgatctattggcacttataaataaaaaccatatatagaattaaaggtgaattaagggttcgaccatggcggtgagctgattttcactaacaatatacttccattcttcatctaagttgacattgtttaggatatgattatacagtatcgaagcacattcatattattttttattgaagttattaataagatataactacacgcaagcatattaatgttgtttttagatattgttaacgccagaatttggtaagcccaaagtaatcatcgggctagagttagtatcggcttcagagtcttggaatcagccgatgggaatcgtcaaatcgccagcagttgtgttcttggtggagtcggatcaattaaagaaaatttatctagaagagtccgagtttaaggaggatacagcacgtgtaacgccctgattttcgttcgg

SEQ ID NO: 70529 - DNA, 692 bp, Oryza sativa
actagagagcaagttcaggatatcgttagtttcctctacaggcttgtgaggaggcttatgatcttactctggaagagggaggacgacgaattcggggagaggaaggactcggcggcggatccggttgccggcggcacgggaggcgcggtggccggcgcctttccctggagtttgattgtggccgtagcgacgactgtactcggcatcgcctgtgcctgtgcggctgcttactaccactacaggcggcgtcgcccagtgtctcgtcctcgtcaggcgcagccgccgcagtacgtggtgtcgacccgtgcccccccgacgcaggcgccaccacctgggctcctccagctcctcgacgacatcccggaggctgctgctgtgatcggtacgcaatcccgtctccctctccaacacctcctgaatcctgattttgtggttgctgagtttggatcgaattggtgtctgttcgccacgaatcggttatgtgttttcgagatttgttcgccgtgtctattcgccgggatttgttcgccgtgatttgctgtttgaatttccctttcaattcgtaggtagttcagatggattccatttgtttggaatttgttcagactttgattgttaaccagcgcatattcatgcagcagctgagccaccggatacaggcagcagacgccgtcctggacgcgcacgcaccc

SEQ ID NO: 70530 - DNA, 968 bp, Oryza sativa
agtactcaaagttcactcgttcacattttgaacacttccatcaattcccgatcgttttctgtccaccttagtcgctattgacccatccacgcacaccatataacctttctacccctcattgcctgcattctacttggacctctctcgccggttcggagacagcgacggagccccacgcggcgccgttgtcctcagccggcagtgtaggttccgggagggcggggtggagcacgaggcggcggtgcacgccacccgcggcagtgacaacggtggcgagggggaggtgcgggtcagcatcgatgggaagagagtggctgaggtgagctgtgtagggtggggtttccgcagcaaccgcgccaccgtgctcactgacgttgagatgatggacgtgttgtgggacgtgcacttcagagacatcccagtaagaacaagatgagagatggagagagatgggtgaagggattgactgacatgtgggccccacctgtcagtgggtcctacaatctttttaatgacaaatgggtcccatgtatattttttaattctgatattataaatgggtcccacttatgtgatgtctgatatacaagtgattatatagtgataatgcagtaatgtagtggagtcatgaaattggtgctttttaggttttgattgagccaatggggtgggcagtttttggtgcacccatgggttgccactactgttatttctatgatgcactgcatattacaatttgattagtttgtgctaagttaatgaaaacaattattttttaatgttcattatgcaatgaacggtttttttccggcacaattaaaattaagttcacccattgcaaagcacatgactcatactagatatcttaaagcgcctgcgtttgccgctcccaaagcgatttggctcctgttgactaatccgcttgagacacctcgctaatatggattgaatatggttgggttttagat

SEQ ID NO: 70531 - DNA, 909 bp, Oryza sativa
  unsure (1)..(909): unsure at all n locations
ctcgcgttatcactgttttatttagccatgcctatttacctttgttatgaccttattattattgttattgttattattaccttgttcaccctagaataaacaaaactccaactagtgggtactctatttatggttccactagtatgaacttaagtagatgcttcgctggttaattatgcaacattaggtggttttacaactctaaactttgggaatgttcttatcacctggacactatggaatggtaggattattgtggaattggattcacaccgccccctttattcaaaatcctcaaaatggttttaggctgggttcggggtgcatggttttgatagtagcaccttggccatataaggaccggtcttcaggcctttattgcaaagcactaccatacttccacatgtctagtgggtaaggtttagtttgtggctcagtctggttataaacaaaagtacaccgatggagatggacgaagttgggggtcgatggacatttctaggacaaatgaaggctacactagctgcggcccggtagtcgagatgtcatggcacagggccggtgtcctgctgctaggggctcagtcgtgcctacctgtcccgggggttcccgtcgtaagtggggttgggtcggtactcttgtctatgactaggatgggttggaaactatgtcacgtcttccgtccgtataccgtggtggtatgtggcacgtggctacacgtgaagaagatgtgttttgtgggtaaagatgtacacctnttgatcagagtataatctatacgaatagccgcgccctttgttatgggcaagccgatcactgtacccaagttagtgttgtaattcttaaaacctgcttaactactaaaagggggaacggatggcctgggttggctcgggacgagctgggacc

SEQ ID NO: 70532 - DNA, 593 bp, Oryza sativa
tgcctttaaggtctgagctacaaacttgctagatcaggaaggatctaatatacaacgagttcggtcgaaaggcttagttctagaagacgatttgtttggaacaacgaatgaacaaaaaaaggaaggagatacaggggtggtgaaaaaaggatagtaggagagccggtgatcctccctctctaaaatagccggtcaaatctgtctagttaaagaaagaaccagcaatgtaccaaacagtctccagcaaaaggcaaaaaaaaaagatcccgctctgtatttctatactgaaacactctcattgcaaagagccttcaatcctctagccctctgcaaaaagtttttccttgaattagcaaccatcaaactaaaatttggacaaggagctaaaaggaaaataacaacaaagctagggttacctttatagcgcacattctttctctaacatcaaacctctcatgagacaaaatagacagccatgctcctggacttaccatctacaacaagcccaacaatgaaacagaatatggaaggggtaaaaaaaagcgagcatgagcacataaaagaacaaaatttggcagtaatctttgggaaag

SEQ ID NO: 70533 - DNA, 615 bp, Oryza sativa
aaatgatgccctgtgtgtttatctgtttagcctctttatcataactggacaaacctgccagggtggctcactgagagaaacagcgaaccatgtgatataacggctttgaattgtgattgtgcccatgactcctctactgttcttacctggtatgcattcctgtgtccaaggctaaagctgacgtgtaatgggtttccttatccccaacttgtagcctgctttgtactttgtcccccatgccctgatgctaaccgatcagcccccatgcatgtatccacgtataattgttcgtatccatcttggtgcgtgtgtgttgctagtacacaagctgcatttttgcacatcctcagtgcgttgttgagctagctatgttggataatgattcgattcttgcaccgcttgttgggaagtgaccatttgtatagaatcactggcttttggtagccttgcttcaattctttgtagtttggaaattgtacataaaggtgccccttcaacttcaagtgcttgtgcaaaaaaagccagtagaagagagatggattcctccttctctgacgtggatatatgcttttaatattcgcgggcaaattcaccttggggatgaaataaaaacta

SEQ ID NO: 70534 - DNA, 39238 bp, Oryza sativa
agggggagatgggccgagagggattcggcccatcgaacccgggggaggcaaactagacttttgcggagggatttgatttggaaggatttggattcggaaatgaacttgacgatagatcggggattgagatcttgagatggcacgaacactagacaacaagcaaagaaacaaatttcgcaattagggtttttaggagataattttcccgctaggcgccacgacggaacgggcgctacagaccaacccccctaacaagaatctcgaccccgagattcagcacctaagggagcagctccgggaactcggcgcggagaagatcttctcgctcccaggttgcctcatcttcagaatgattgctctattggactttgtagaacttgatggtcttctttcgagtctgacgttctgcctcttcaagaaccttggtcggtctttccttgtaagtcagattcttttccagctcgatattacccagagggacttgctcttctggaactcgaagacatttcttcaactgagacacgtgaaacacgttgtgcacatctgcgagaccttcaggtaactcaagctgataagccacttcgccacgtctggcggttatgaggtaggggccgatgtagcggggtgctaacttgccggacatcccaaacctcctcataccacggaggggtgatacccgcaggtatacatgatctcctttttcgaactcaaggtcacgcctccgattgtcagcgtaattcttctgacggttttgcgctgtctttaaacgttctcggattagcttaacttgttcttctgctgccttgagtatgtcaagaccgaataccagcgcttcgcccacctcattccagcacaagggagtacggcactttcttccgaacattgcctcgttcggcgacatctgtatgctagcctgataactgttgttgtatgagaactccgcatacggcaaacaacgatcccaggtgccttcgaaatccaaggcacacgcacgtagcatgtcttctaggatttggtttaccctttctgtctgaccatcagtctgcggatggtagcccgtacttaaatttagatcggttccgagggcttcatgcaactgcttccagaaccttgaggtgaactgagtgcctcgatctgacacgatcttcttgggacagccaaatctacatacgacatgggtcatgtagagttctgctagtttctttccatcaaaggtggttttcactggcacgaaatgagctgatttcgtgagtcggtccacgattacccaaatggagtcgtacccgctaggggttcttggcaaaccggtgatgaaatccatcccgatctcttcccatttccactcgggaatcggtaggggctgtagcagaccagctggcctctggtgctctgccttgactctttggcaaatgtcacacagggctacgtattctgcgacatctcgcttcattctagcccaccagaaatatgccttgatatcttggtacatcttcgtacttcttggatgaatggagtaggcggactcatgagcttcctttaggatgagatctcttaactccttcttggctggtacacagatgtgtggaccgcaccaaactgtgccttggtcgtctatggagaaattggtgtctttcttttcctgtattctttttattaactcttttatcccttcgtcatctttctgagcctcccggatttgcgattctagggtaggctgtactgtcaagctggcagggacacctgactgtaccacggtcagccttaacttctccaattctctgcacaggcgatcttggtcaggccgtatttgagctacattgcaataggccttgcgacttagcgcatcagcgaccacgttagctttaccgggatgataatgaattcccagatcgtaatccttgattagttccaaccatcttctctgcctcatgtttaactcggtctgagtgaagatgtatttaagacttttgtgatcggtgtatacttcacatctctttccgattaaatagtgcctccagattttaagagcatgaatcacggctgccaactcgagatcatgggtggggtaattgacttcatgaggcctgagctgtctggacgcataggccaccacctttcgttcttgcattaggacacatcctaagccttgtcttgatgcatcacagaagatctcaaaatctttttggatatctggcaaggtgagaactggggcagtggtcaaccttttcttcatttcttgaaaactgtcttcacaggctgcagaccattgaaatttcctttccttctttaatagctcggtcataggtctggctagcttagagaatccttcaatgaatcttcgataatatccagctaagccaaggaagctgcgaatctctgacacattcttgggcgggttccaagcaagtacagcttcaaccttgctgggatctacttcgacaccgttggaggagatcacgtgtccaagaaatgctactcggtctaaccagaattcgcatttcgagaatttagcgaatagttgatgatctctgagcttttccattatcagcctcaggtgttcagcatgttcttcctcattcttggagtatatcaggatgtcatcgatgaacaccacgacaaactggtccagctattccataaagattttgttcattaagttcatgaagaacgctggagcattagtgagtccgaaggacattactgtgaactcgtatagaccataacgcgttgagaaagcggtcttcggaatatcttcaaatctgattttcaattggtggtaacctgatcttaagtcaattttttagaaaactcttgctcctttaagttgatcaaataaatcgtcaatccgtggcaacgggtacttgttctttatagttacttcattcagggctctatagtcgattaccattctctcagagccatcctttttcttaaccagaagcactggggctccccaaggggatgagctaggtcgcacataacctttaccctccaattcttcgatttgtcttttaacttctgctaactcattagctgccattcggtagggtctttttgcaattggtgcagtgcctggcgccagttctatggcgaacacaatctctcggtctggtggcatacttgttaattcttctgggaatacgtcgggatattcacagactatgggcaccgactccaaggaggtgacttgtaaacaggttaggatagaccgacttgcggtaggggtgttagaggtaaagcggacttgctttcctccaggtccttgcaaggtgatggacttttcagcacaatctatctgtcctttgtgcttagccaaccaatccatccctagaatgatgtccaagctttgcgagtctaggactatcggtttggctaggaagtcaacttcctcaattctaaggttaactcccgggcatacttgagttgcccttatattcctcccaggggaatgtactatcattggtacacgtaaattttgggttttccaaccatttcttttcacaaaagcttgtgatatgaaagaatgggaagctcctgaatcaaacagaactattgcgggtacggagttgacagggaacatacctatcacaacgtctggagcatcctaagcggtctcagcttgaatgtggttcacccggcctcgaccaaagttgttggacgcacgagaaccttgtccacttgcctgagagctaggacgagactgagctgccgctggagtaggagttctggcagtgctgccattagcatgccctaagctggtgttggtaggattctgagggcactgtctggcatagtgacccatctggttgcaccggaaacactgaactgctgacggtccctgtggtgacttgaaagaggtaacactgtttggcgcagtattgccactaggggcacgctgctgtggctgaggtgccggacggttcatttgaggacgaggggcgtagcctggctggtggttagcctgagtgaccgactggtggtattgcatgggttgaccgtagcgagggcgaggtacgcctcgggaagaatttccctgatggttagacttgcgtttcttgtattcttcggtagcctcttttctggcatcctcaagtagaagcgccttgttgatcatatgttgaaaagtggggaaatcatgagcaagcaactggagtctcattccaactgcgattcctttcaagaatttcctgatcttcttcttgtctgtgtccacttcctcaggggcgtaccgagccaacttgttgaacatacttaggtactcattgacactgctgttgccttgcttaagtctgttgaattcttctttcttcatgtcaatagtgctttcaggcacatgagctgcacggaaagccgtagcaaactcatcccaagcaatgttagtgggttcagggtgtgcattgcagtaattctcccaccaatctgcagcaggtcctcttagctggtgagaggcgtagagcgtcttctcgaccggagtacactgcactaagttgagttttctatcaacatctttcagccaatcgtcagcctcaacgggctcgatggtctgagagaactctggcggacgtgacctcagaaaatctgtcagcttggatctattgttgctcatgtgagggtggccatttccatgcgcattatgctgaaaaccggctacggctgcggctaatccttgcaagatttgtgtctgaactgccattaagtgttgcatgttgttttccacatgaggtgggaaagggaggcgttcttctccagaattgtgactggcagtgcggtgagagcggtgagactgttccatctctgcattacgggaaactgtgcgatgcgagcggctgctgcggcggggttgctcaacttctgcgttgcgggaagcagtacggtgcgaacggttgctgtggtgagactgctcattagctgactcatgattttcttctggctcaactctaccatcttcaaaaccaaagcgggctggtgcacgagctgcacggcgggggcggctagccatctaaactcccagaagagggcggggtaatagtcagatagcacttaggagggcaaggagcaaagtaaatagcaactcagatagcacacactaggcataaactggatttttcaaatcatagaaacacctaatacaacgggtgtggacaagtcacagagctacgccgagcttgactgcgcgcgcaccacctaggagaaccagactaccaaacaacacccacaacaaacacacgcacgcactacctcgccacgactccaaaagagttggcggcggaacaaaagggcctaacacacggacggctgctgaagactgcctcctctactcctcgtcggcctggctgcctcctgtggtcggctcctcagtcgaagaaacgtcgatcggctgacgcgaagggaccggcggaacctgtcgagggctggcagcagcacgggccgctggcggtgggggagctgggtagtggaaacggaacacagtggaagaaccaacaacacgcttccgcgcagtgcggataaagcgtgggccacggcgggtggaagcaactggggtgtgtccgggggtgtaggaagggctaactgggtgtgggtagggggagtacactggtgagtacggcgcacgcgagctgggggagcgcgggccactggaaggcgtggaagctgccgaaaggcggagcccccaagacggtggctgtagtcatgggccaggcgacgaagcgcagtccaggagaggtcctggtactcgatctggagagtgggcctggccacggtgaagtggtgtggacgagggccagctccgtgtatacctccacgggggtaaaggtacacagagagctcacagtgagggggaacacggtccacggagtaccccgtgtactcgggacacgagaagccaaggaaacgggcgaggtcacgaagctaagcgacgtggtgaccctcaccaaaaccgtgggagctgaagctggcgctcactgccatctacaattttgaaaaagggagaaaggatcagtaaccatttttagaaacaaactattgaaaataaagaaaacaaaagaaaccttagcttttcgcaagtagtttggaacttagtatccttagggtcgtcctaggcgtcgggtttcgtcctagggccaagcttgtgctctgataccatctcttgtcacgccccgaactagtaccgatcggaactagcccgtgacgctccaaattaacctgttaaccgataccagtcccaggaaatagtgctggtatcacaggaagacagaatatcacagcaacagaggtctctttattatagagtagaggtacagtcatgttgggctgcggacagatcccgagctcacaactgcattacaaaagggaaacggaagccagggcttagaccaaacatcacaggcgcgacttgggaactaggccgaaaccctaaaactcaacgtagccggcttgctcctggaagaactcctcatcagccggatccgcttcatcttcttcagcaactgggggggaattatttatatagagcaagggtgagtacgggagtactcagcaagccaagggaattaagtgtttaatgcaggcttcaagggaaggctgttgtttttgcaattgattttatttgaactcttttctgaaaacaactaagtgagtgcttctcaaacgactcggatgagacagagcgtctcgtccggtcggagtatgtatcagtctttagaattgaaacaaggttggcacccggccaacagcttttcaaacggccacccaagaaggcggcccaagtgcgcgcgcgcgggaggaaaggagagagagggccggtggaccgggctcaccgtgcgcggtcccgggtgggacccgcttgtcagcggctcggctcaccgtgcggagggagcacgcggtgcggcgctagggtggggaagggacgcggtgcatgcgcgcggttcgcggtggacgcggatgcggcgggcccacgcgcagcctcacggctcgcggtggaacgcgcgcacggggagggactgaccggggtcggctcgacccggtctaggctgagctggcgccgacgtggcgcctacgtggctgccacgcgggccggcgggaggtagacgacgacgccggccggaacggacggcggtcgacagcggcgagcgacggagcaaaccatggcgatacaggcaaaagcgagtacaccgggtggttgcacgtgacgaggggagacgagccaacggctcggatttgccgggggttgctcgacggcggcggattgcggcggcggtaaccggcggcgggagaaggggaaaacggcgacgaggtcacggggggctaattcctggcggcgagagcatctatgcggctacgggaatccgatgctagcgtcggattgggcggagctacgccgtgcgaggccgacgacgagcgggtgctacggagcacgggcggcgacggcggcgagcacacggcgagcgacggcaacggtcgggacggcgccggctaactacggggaggctactcgagctactaccgaaagctaagggggggagatggagcgaggaggaagaacggagggaggcactaccgtgcgggacggggcgcagtgacgagaggccgacggcgcgggagtaatctctccggcctcaggccggggaagaggaaggagagggcgcgcccggagtccccttccgcgtcctcgaacgcaccggctctccgacacgcgcaacgacgaacggcgacggcgaacagagctcgggggcggcggcaatggcgcggaggcgatgggaggagaagagagggagggcgcccggggcttttaagggcggcaacgtcggtttgggaaccgactttgggcggtcaaggcgcgagctggcgctcggcgctcgcgtccaaatcggcggcagggcggagggaggaggatgacgctggcggtgacggaaaaaggggaaaagagggagagaaaagggggcttgcctccttgccgcttttggaaaaggaggaggggagcgggggcgtcgcggcagagggaggagggaggctctgcctccgtcccttggagactagcgcgggagtggcggggccgaggcggtgacgacggcgatgacggcggggcggtgtggagcggagtggcgacacgggcgacaggcgcgggcaggcgtggcagagggtgacggcggcggcgaccaggcggtcggccaccacggcacgcgcgcgcgggttgcaacgggaggcgcggcggtttgagtggcgcggctcgggcacgcgcgctggctgcggggccgagcggctgcgcggctgcaggcgcggcagggcagcggggccgggcggcgcagacggcgcaggcgcgacacgggcgacgaccacgcgggcgcgcgcgcgaacaacgacgcgcggggccgattccgcgggcggggagctcgccagggatggaggcggggagaaggagatcgagggaaagggagggcactcggcgcgggcggctcacgcgcacgcgcgcgggcagagcggaggtagagagggagagagcgggggcgcgtcggggaagagcgagagagtgagggagccgggagggagggggagatgggccgagagggattcggcccatcgaacccgggggaggcaaactagacttttgcggagggatttgatttggaaggatttggattcggaaatgaacttgacgatagatcggggattgagatattgagatggcacggacactagacaacaagcaaagaaacaaatttcgcaattagggtttttaggagataattttcccgctaggcgccacgacggaacaggcgctacaatagcttgagctctagaggaagcacagctagggtttcccaggagctcaagatctcttgtaagaactccactataattcctcgcacaggagtaggttgttacgcttcccagcggcccgaacctgtataatccctcatcttccacacatattcgcaagcgatctagtagccagaccctaagcgaagatacgctcttgatcatcgcgccttatcccccggccgaactcacaaagggggggtctcacgacctcccgctagagaggatcactcctcgacacccttgtttcatattataagtcgtttaatttttttactagtcaaactttgttagatttgaccaaatttataaacaaaatttagtaacacttaaaatattaaattagtttcattaaatctaacattgaatatattttgataatatgtatgatttgtgttgaaaatactgctatatttttctataaatttggtcaaagttaaagaagtttgacttgaaaaagtcaaatgatttataatatgaaatcgaggtagtaatatgtttaactacacatgtgttgcatgcaatgatttccataatatgtacaaacttgaaaaggactatttggagtgggaaggattgggccagttgttagtcgggatcagggtttcccaaaccgccggggacggggttaccgcgccccggcggtaagcacggttaccgcgcagttaccgcggtaaccgtgaaaaaccgttcaaaatttatcaaaaattcaaattattttttaaatttatttaaatttaaggaggttaccgcggtatttatattactgtatcccgcggtaagcctggtaaccgtggtaaccacgcggttaccggctgtaaggtgaaccctggctgggatatccttatctcatgaggaggatatgatcctatggcccctggaaaaaaacagaagctattctacaaaatctttgtatgatatgctctcttttcattgtgttagggaccttagagggatgaaaaaaaaaacacaaatattaggaaaatacctaatattaaataaatagaaagggtgagacttcgaacactggccggctagcccaccatcttgtggagctagctaaaagatcccttggcgtttctctaaccttagagggatggacatatggaaatcgccaatttcactgaaagtgaatcactttgtgtgtcttgcttgcttagatagaattcaaactaaaaagaactaggaaggctctgagagatgtgttgtatgtaatgaggtggaaactgttgatcacataatctttgcttatcctattaatctcaatttcaaattattgtcctagtttaccgaccgtttatgataatcgaattttacaaacgaacatattattcacttgtcagcatggacatagtcctcgaataggtgttttcgactaagttggcgagccagcgggaggcagtgaagcacagataaagcaaacatatataagtgctctcttatacagccatgtcatcctaccctgaatcatttttctcaaaaattttgttatctcagctttgtatctcctttaatagacaaattctcaattggtcagtaggggaacgaaagaatgcacggctagcttctttgataattcagtattcaacaagaaattctagaatcatatatattctttttttttcaattcgtgtttatcgagatttatatcatagcgcaatgtcaccagggtaaaccatgagatttaatttcttgaacacatcgatcatttattagcaactatggttggaaatttacaaatagacttcaataattgtgatctccttacgttaggctgctttttttgtttttctagtgttctattcttttagatttacactacgttcatgaaaactactatataataattggctgtaactcttttgagtaaagaccgagatattatattccattatcttaaaaaaaaattagcaactacgagaagagacacacaccaatatatatcacttgtcagcgaggacatagtcctcgaaatagaaggtcttctcgatgaagccggcgagccagcgggaggcggcgaagcacagcaccgccgcagccacgacggcggctctctgaacacccgacgtgaccaccgtccccttgccggcggcgaggaacccgacgacggcgaccgaagccacctgcagggcgacctccagagctctcatccacttcagtgcagcgctgcagctcgtgcactgcatgacatgcgaccagtacctgttcatatctattttagattcaagaaattttacggtccttaaaaagtatctccaggtacaagtacaaccctttagattaacactgaattctcctatggaaattctatatgttttaggtcgatcagtgtgactgtgtgaagatcagcagactagcttgttaatttacctctcgtagacctcaactctggtagaagctggtggcagctgattaaccattggggttaaccagccaacctgattgttacagtacttcttgaaccagtttctgaaggcgatgatcaagttgtcagatgatgtgggcacgtagcatgctttatgccagttatcaaggccaaacgcggcgtaattacgctcctgcagaagcatatatattgttcaggtcaagtaagatctgagataatcgattgcatccatgcaaccacatacatagctcgaatcattcagtttgagctgaaaagagaattaaccggtcacctcaatatgaaggacagacgagtctgaatccaggacttggttcgtcttaatatgcaaccaccaacgtggtatcatcttgtcgaaccagccatcaagattatacccgttcgcccagatgaccctgcatcttcccggagacaccgggatgcagaagaacactgtcgtgacctcaggctgcttcttgttgttggtgttgttgttgtcctgatcaacctgcagctagcacaaagtgtaatcttttcaacatgattctttgagcttgtaacagtggctgcaatatggcgaagtgatcagaggcagataccactggcttagcacgaaatggcgagcctatgagagtaaccggcgcgatgaacttgaagtagccccagttctcctctgggttggaatggaaccctgcgatgttgagctcctctatattcatcttgatcgggaggccaccttcctggtcaaattcaactgtggagaggagatcaaatgtttcagaatcagtaacgcagcttagcattgagaaattgagattaacacggcattggctcaattaacagatcgtgtcaacgcagatgatgaggaacatatctgcctatatcttcctccctggggacatgagggaattggcccctgtgcgcgtagggaacgtgagcagggtccatgaaattctccaccaacaactcgtatctgcattggttcgattcggatttcagaatccatggcacatacatacatacatacatacatacatacatacatacatacatacatacatacatacatacatacatatacacacacacacacacacacacacacacatacacacacatacatcgaggcatcgagctgcttgtgaatagcttgtaaataatttctgtacccgtataagaggtctctgacgccggagttgatgacggacgacgggtcgtcgagctcccggatgtacggcggccgcttcctctgcaggatctccttgtactccggctccgatctcgggtagaaccacaggatgttgttctgcaccacgctcgggtacgacgccacgcacgccttgctattcttgtgcacctgccattagttgatccaagaactcggttaattaatcttgagaaaatgttgatgtttttttaaaaaaatttgttttacaggagggcctagggcgggggcctgggggatgaactggcaggagccgtggccatcgaagcaccagccatggtaggcgcactggaggcagcccttgccgtcgacgcgtccctcggagagcggcgcgaggcggtgcgggcacgcgtcgtccaccacgcgccactcgccgccgccgccgtcgaaccacacgacgacgctgatgcccatcaccatcttcccgtgcggcttgcgcttgtcgaggtcgcgcaccggagccaccgggtaccactggtccagccagtcgaaccgctcctcccctgccgccggcgtctccttctcatccacggctcgtgggagcggcgcctcggccgccactgccgacaccggcattgacagccgccgccgccgcgcgtcggtggggctgatccactgccggcgccatggtggtattcttggtgtgctcgggttggttacagtgtcgcggaagggaagcgaaaggcgggtgagcgagagcaggtggagggagacaggagccatggatgattcggagtgtggagtgtttagttaatacacgtgagtaggaaaacagatccctgactctgtgtctgtgcagtgtgcagtcgtgccactgacatgtaggccccatctaagatccatatatcagtgatacaactatacactgtataatttcaggggagtctcatccacggagtagtgactaagcaagacatagaccggaaacataaacgaatgcactgtatattttttcgggaaacggaaatggggacctacagcccatattgctctacacctgctacaatggttaacactggcgtagggtctatatattttttttataatactatttctgaagtagacaaacaacttttgaaagcgtgctaaacatcccaccgtagcaaattttttaaaagttgtgatagcaaaaagcttttcttactaaattcttactaacgctgataagtcatgttatgaatgcatctatattttttataatttctatatatctaaatcaaacggttgagataattgttagtacaaatttagtaagaaaaaattataacagtgctctttaagatactagcgtactactccttttcaaaatagttatctttttattcaaaatttattctaaaatatttgttactacttaatccatttatcacctctcattcaaatttccctctattttacccttaactgccactctaatcccaatcatgtatcatttaatgaaggatagtatgtcttttatttaaataaaaaaattaccaagaataacaagtatttcagatggagggctagttagttctcttaaaataattgtagattttaagccgtgtttgatgtctaactcggaatctggctgaggcaggagctgttgcctcaaccacaatgttattgtaccttacgtaacgtgcttttctttcgtttttagtaaaaaccggccagtgtttcttccgctaacccaagaaaaaaagttaatttaattataattttcatgtcattgagtgcattaaatttacgtatttttttactcatataatggctatgtgcatacgtgtccttaaatttcaagactattaccctataaggcagtagtaaggaaaacaaaaacaaaacactaccaccacacacactcacaacaactacacacgaccaagaaaagagctaacaccacatcggtcacagctagacccaacaaaggagctatagctaaatcgcccaaaatcaatccctaaaaaatgagtaccaagccagcaaggtgacaacggacgaaaaggtagtagagggagatagcgagagagaagaaatatccctttccctcgctcgaacccgtcgactcgttgccacttaccagattcgcacaaactgtctgagcacggttttggcaaaagagagtctcctagacgacatctccatggagaaaagcgatgaagagcaccaccgctatccatcgaggtctctaggagatccaaggcaaggttctcacccggcaaccccactaaggagggagagggatgtctcaacaatgccccaaagaggataaacgacgcccaaagcgtcgtagttgtcagcctcgtaaaactgggctaggcttacacctgttgcctatccctgttgacctgcaattgtagttccattgctccaccaccaaccacccaacattgttttcaattatgatctatctatcctgccaagttctacgcgagaacaacaatagcagcctatcctctatcttaaaatgttgcaatctagaatgagatttgacacatcctaaaacaacgaatctggacaaaattctatccagattcgttgtcctaggatggattaaataaaatctcattctaaattacaatatttgggatggaggtattaatatccaacatgtttgtacgattatattgacacgtactatatgcacacattttattggatttcaatgacacgatatataatccaaatttacatataattatgaattgacccatgtgacatttctctaggattattgagattgtgtcctcaccttacttgacgtgtaacattggatctatttcgttttatttccatatctcaaactcttttattgccaagtattctaactctacaaattcataattttgaagctgtgattgcatccatttataacataatgtttcaactaattgtttcgttctaatatttgaggaaatataaaattttaagaacattataatctaagttttaaatccaggaccttaggagctaaaagtgggggcattcaatgttatgacatccttaaccgtgaataacatacaatttaccattctaacccatattcaataatttaaatggtcccactcggtgacggagccaaaatggtttttaagctcagacaaactttaatataaattgtatttgctataaaagttttatcattaatttactcattaatattaaaatttaatggagttttggtcggtgagtcctggcagccgtccgagctaaccggacgatgtctccgccactagtcccactgtcccacaaaactaatcagatcgctgccacgcgtcggtgctgatctaccaccgactccatggcccatggcactagtctgattgaatgtgctcgatcggcgtggtgtcattgtgcaatttgtgccctattttttgtgcatggtggagtaacagtcaccgccagaaaccttcaaaagcgtgtacagaagcaccctgggtactgtacccaccccaccacatcgtgagcttttcaaaagttgtgatagccgacttatccttgcgaacttccaaaacagatacatagttggtaaattttaattgtattttttatgccatttagttcattgtttatataattttgcgttgatgacttattttgatgaccatccgaatatgagcaattttaccattcaacatttagtacttcgaggtaccaaattttacattagatagtactttgagaactaaaaaattgtggtacctcgaggtaccaaatgttgaatgataaaattgctcatcggaatatatataatttaatgaactgacacttggatatcataatatatcatttttatacgtcactagcaaaaatgtttatgtgttaaaacaggtgaagataattttcacgattgataaatttttttgtcaaacaatagcaaaacaaatttagaaatcatatataacattgaatccggttccgctcccttcatgcatcatcacacgaagaatagcttatatacacatttccaatagcctcacaaattgatcggatggttattccataagttgacacatgtggattttattatacctcatggtccaaagattaaaattttgagtattcaattagtaaaagttttttcccgtaaaatttttttactgtagatggaaggcatttgcaaagtaccaaacttaatgcatacaccttaacaatgataaattcaataggaaaataattgtgaggagagaaatttggaagagaaaaaagagaaaagaaggagatggagagaatcatgattattgagggaaaagaaaaggagaaaaagaaaatgaaaaaagagagaaaaaaaaaagaagccaatcgaggaagggtgtacgcagcgccgtctagtggaggcgtgcgggatggtgtgggccatttgggttgggctaggagggagagagaatgaactgggatatgggtgcataataattattctagactcacgtcaaattggatacgtgtgacatataactaactcatcaaacacagacgacgtatcaaagcgccgaagaaaatattttcaatttttgtaatattaaagatagacatagagataaatattgtactctttgaccgtgtcatatggagcctttttcatattaactagctgggtggcccgcgcaattgcgcggctagcaccgatataaaattatctattttttaatatagttttacttagaattttgttaaatagatatctcgttgtcttaagactttgaaaaaccaaaccttatcatccttgtgtttctaattttatattttttaaaagttatgtcagttgctactcctaaatattttgtcacccctcgtttatttgcttcctcgatctaccactacttctatttgttctcactaaaacctctaaaaattagaccttatagtttttagagtttattgtctcgtttgggttttgtttttataattttcagaagtctcgtcaaatgttgccaccatactactctacggtcaatccactgcctcttctctttatttttattgggattttaaaaatcaaacgtaattatcatttaggttctttttttactttctagaagttccaccaaactgtcagcgactttaccactgtactcatgtacagctcacccgctgccccctctttattgtctttgagattttaaaattcgaacatgattatcattagggttttttttttttactttttagaagtcccgccaaccgttgtgaccatgctgcttaatgacccgtccatcgtccctccttttaatcatcattgggattctatttgggggttttgtttatagtttttagatattccatcaaccgccaccactctaatcctttacattcatgttgcttctcctatatttgttgtcatttgtcatctttttataatttttagaagtcatgtcaaaccctatcaccatacttctcttcggcctgtccactacctcttctttttattgtcattaggattttaaaaatcgaacataattattattttggttcatattttactttctataagtcctgccaaccgccatgaccgggctgcttaacggcccatccgtcgtccctccttttaatcgtcattgggattctatttaaggttttgttaatagtttttagatgtcctatcaaccgtcaccattctacttctttataaacctgttgcttctccccctctttattattatttgtcatcatttgtgttctagatggagttttttttagaagtccatatttttcattctgatatttttatttataaattatatttctacttgaactcttataattatttttatatttacagaatttatttttttgttatttcaaattttagttaatctcgtcatatgttctaaatggtctcttatttcaatagtttttactttttatgacgaatttaagttatttataaattgtattcctagttgaactattatttttatttttctatttttggaatttattttaatttttatttagaattttagttaatatcgtattatgtcttatatgaattatttttttatgttttttaattttcaattttatagttgtttcatcctactcaaactatcttttttatttatctaatttcagattttattttatttttattttaaattttagttaatatcgtattgaattcttatatggactcttcttttaatatttcttatttttaattctgtattcctacatggactcttctttttaagattttattttatttttattctgaattttaattaatctcgtattggattcttatacggacttttctttcaatattgcttatttgtaattccgaatttcagctatttttaaattgtatttctacttggactcttcttttctttttctccgattaatgtgggaatttctagcccccgcagcaaacgtggtgccttcttttcgagctgttttaataatataatataatagatagatagatagatagatagatagatagatagatagatagatagatagatagatagatagatagatacttgtttttcttttgtaagctagcatatatagggatcgaactccactcccagattttcttagacactgtcacttgtaagcatggacgtagtcctggaagtagaagctcttctcaatgaagctcgcgagccagcgggaggcggcgaagcacagcacggcggtagacacggcggcggctcgccggacaaccgacggtgctagactccccttggcgacggcgaggaatccgacgatggcgaccgacgccacctgcagggcgacctccagcgccttcatcttcttcagtgcagcgctgcagctcgtgcactgcatgacatgcgacctgtacctgttgatggcaccagagaattaattgatcagcatcacagcagcccacaaattctgaatgaaaattttcgatgaagctgatcttgtaacgtgtttcgggtcagtgtgaagatcaacttatcacctctccaagacctgatctttggtaggagttggtggcagctgattagccattggggttgcccagccgatctgatgcttacagtactttctgaaccagtttctgaaggtgatgaccatgttgtcagatgatgtgggcacataacaagctttgtgccagttatcaaggccaaccgtggcgaagttgcgctcctagagaatgaaaatcttcaggtcaaaacatatatatgggcatagtaagtcagcaggcataatagctcacatcgccttctgtgtgtcttagaatagaaaccggatatgtaatccatttccgttatctaaaaatgtactcttttaaaaaaagagaaattttatagttcttaagaagatatcatgaggtaccactttttctattataaatttggtacctcatagtaactaggtaccaagagataccaaattttatactaaatttttttacatcatggtaccttcttatgaaccgtaaaattgctcttaaaaaaatcttgtgatgaattgtgaatctgccaccaccctcaccattaacttcctgatttttgaagttcaaaaaaaaaagagtgtgggaccaaatggtctacctattagctgaaagatacatgaatagaaaaatagataagatatgcagaatgagatggaaaaacggattgatgataatgttatttttttttaaaaaaaagtaaaaaatctgtcacaatgcatggacaatatgctagttttatcatgaatcattcagcttgagctaaacaaataggtcacctcaatatggaggaggtaggaatctgaatccaagacgatgttcgtcacaatgtggtacaaccaccgtggtattatattgtcgagccacgcatcaacattccgcgggaacgcccatatcaacctgcttcttcccggagccaccgggacgcacaagaacaccgtcatcgcctcaggttgcttcttcttctttttctccttgccctgatcaatctacacaaaatctaaccatttaatacgattatttgatcttcaagccttgaactagggacagatgtgccatgggggtggtgagggctcaagcccccactacccgtattgatactttaggagcctccactaaatccccttaattttacatcctgatactttttcaatgatgataaaattacgaacatctttcccatccttgaggaggtaccatgaggtaccaatataatctaaccgttgatttagaaggggtatgatggggctaaataaatttagggtggcgctaatccctcaccctcttgatggcgttttgcttgcttgctcgtggtggctcaaagggacccaaccatgtccgccgctggcggcggcaagagctgcatgggaggaggcgaggaggcgattgccgggctcctcgacagcggcagcggcgtctggcgagtacacgctcgtgacgacgagggcgacaagatactcgtcggcgacgtgccatgaatgaatgaatctctcgtcttctccaaatctttgccacatctccgtgccggcgtcgcatcgagtccgctgctgccgccgtcgcgtcgcatcgagtccgccgcggccgccgtcacgtcgcatcgagtccgccgcggccgccgtcacgtcgcatcgagtccgccactgccgccgccacgtcgcatcgagtccgccatcgagtccgccgtggccgccgtcgcgtcgcgtcgcatcgagtccgcagcggcagccatcgcgtcgagcttccgacgaatcgccgccgtaaccatcgtcgagctcccgatgaatggccgctgcaaccatcgccggccttaccctcttcccctctcttccctttgccgcatctccgtgccgacgtcgcatcaagttcgccgcggccaccgtcacatcgagcttccgacgaatcaccgccgcaaccatcgccgtggccgccgtcgccgatgaatcgtcgccgcaaccatcatcaagctcccgacgttgcagctatcctggtcctcccgccacccatcgccgatctgggccgccgccgggtttccgatctagggttcgggacctatatgcccctgctcccgccgccatctctcgccgccggttagttcaacgctgctcctgccctgtgagatgcagagacggaggaggaagagatgccgcgtgcgtgcgtgacgcggaataaagacgaaagtacaaaactgccctcccacccacggtaccgtttcaatgggtaggtgcggtacctcatggtaccgacgatttttgaccgtaggatgttgccagatcaacggtcacgatttggtactgcacaaccttaaagacagtaaaaaatctctaaaattacccaaaacttcatctagtttatttagcctcctctagtatttcttctttgctccgtaatggcaaagtaagagggtgctagggggcagatacctgtggttctttggtgcgaaagggcttgccatagagcgtgcagggcgcatcaaacttcatgtagcatacgtcatcctcctgtaccgacaggaagccgtcgatctttgcctgctccgtcctaatcttgaccgggtagcctccttcctgatcggactcaactgtggagaggagatgaacagttgaacactatcagtggtaggtgcagccggaacattacaaaatggcactagctcagtagcatgttcatgcgtgcagtagactgaagaattaaaactgatcatgtcatgatagatgatgaacatatctgcctggatcttctttgttctgtatgggcatcagccccttgtgcgcgtatgggacatgagcagggtccataagattctccaccaacacgtcgtacctacattacaatggagctagctaagcaaggtaaaatatgtggtggaaatgcagtggaaacctgaaagtaatagttggttcgaaaaataaacgtatgagatttgtccacgtcatcacggataaaaattttactcgcagattcactcatgagttaaaatttaactcctagtaaaattttaagattttaactcatgtagcacgttttaacttagacgtcgaattttaactcatggtgacatagatgaattccagatgtccatttttcggtccaacggtagttttcaaattttcactatatataggctttgcaactacatattttcccctaagcgaatgatcgagctgccatgctaatgggggagcaagaaattaagatttaggagaaatgcttggagatttctgtacccgtagaagaggtccctgacgccgaagactgtgttgaaggacgggtcatcgaggtctgggaagtacggcggccgcttcctctgcaggatctccttgtactccggctccgacctcgggtagaaccacaggatgttgttctgcaccacgctcgggtacgacgccacgcacgccttgctgttcttgtgcacctgccattaattgatccaagaactcggttaatcttcagaaaatgttgctgtttttttaaattttgttttgatttgttttacaggagggccgagggcgggggcctgggggatgaactggcaggagccgtggccatcgaagcaccagccatggtaggcgcactggaggcggcccttgccgtcgacgcgcccctccgacagcggcgcgaggcggtgcgggcacgcgtcgtccaccacgcgccactcgccgccgccgccgccgtcgaaccacgcgacgacgcggaggcccatcaccatcttcccgtgcggcttgcgcgggtcgaggtcgcacaccggagccacgggataccactggtccagccactcgaaccgcccctcctcgccgccgcccacggccggggcggcctcctcctcctcctcggcgcgcgcgtgtggcggcggcgtctcggccgccacggccgacgccggcattgatagccgtcgccgccgctcgccgctggtgtgtttccactgttggcgccatggaggaggtagcctgaccgtgctcagcttgacgccggcgtcgcggagcaggagaggagggcgagcgcgggagagcaggggaagggagaccggagccatggcgcttccgagggggagcttaagcgcgggacatcttttttaaagtggttacgcagaccatggccgaatgaaacgtgctacagtgggtaatattgtttcgtagggtccataagaggaatcatgctatcttttatttctgtatgtatacctattttttagctatccatgtgttgcgtgcaaatgatttctataataactagattacaaacttaaaatagtacaattctttttggaaaacgcaaacatattttagattgtgttggcaaactgagttgggaactaatagataccttccgcatgcaaaacatagtgactcattagcgtatgattaataaaatattagctatttttctaggacaacttgtcaacgaacaaaacgatctctttggacctgcactagagtaaagcaaaacgatctctttggaccttcattatttatatatcatccaaatggttatgaacaactagatagattaatatggaataaatcatttttcacaacacatgcaggttcaaatttaacttctacaagttgcaacgaaaaatacaaatttaaacgtagacatagtttaatttgtctgtttttgcaactcgtagagttgatttttaacttgcatatgcgtccagtgatatatcatatattaatctatcttgttatttttctttattttttccataaccaattagatgacatagactagctaaaaaaaatgtcgagtgttttttgaggggaaaactttcaaatctaactatagtatataatttcactagaactatactataataataataacttatatatatgtattaaaataatatatataactttatatctaatttatatagagataacaatgtagttataatgtagttacactgtagttacaatgtaattataatgtaattatagtgtaactacgatgtaactagcatgtaattggaatataacttagatgtaacttgaacaaatctaccataaacatgcgatgatgggactagcttgtaaaaaaagggtttagatccaatagtaaaatatctcagcacaaatcttagagcggaattgacggccaaaatttttttttgacagtcatctagcagttccgtataaataacggggagagacttttcgaaaacgagactacgctcagtcgttttcattctaggcctcccctaagcccactcaacatccagcgtcttcgtttctccgacacgtgtgctgccgaagacacaaaggcgatttagatttttttttataagaaaacatacatcagcaatgaaaaggaagagtgcataataacaaactggtcagactaaattagagttcaatcaaaagaagatcgaataaaatcaaacgtcagactaaattagagttcaatcaagagaagatcgaataaaaccaaacgtttgcaggtaagttctctcaatcaaaagcatcacccatttcacatatctatgttaaatcatgaaagaaaccaaagcatcgggtcaacaaaaacggttctaaatttttagttcagtggttatctgcaactttcatgtcttattttacttccaataatgcatcgaaatgtgaaaagaaaaaacaattttagtgggaacactgatacagacgctccattccccatgcaaacaaatatagagttttacatttttttttagataatgggcagcgtccggcctctacatcataagatcataaggtgaatacacacggccagatttagagttttacatatgtggttttttttttctttttcgttggacgccgatcgatcgaccaaatttattttccacagcattaaaactcacagagtttactgggcacatcgatcacttgtaagcatggacatagtcctggaagtagaagcttttctcgatgaagttggcgagccagcgggaggcagcgaagcacagcgcggccgcagccacgacggcggctctctgaaccgccgacgtgaccaccgtcgtccccttgccggcggcgaggaacccgacgacggcgaccgacgccacctgcagtgcgacctccatcgccctcatccacttcagtgcagcgctgcagctggtgcactgcatgacatgtgaccagtacctgttgatggcatcgcaagaatccaattttgatggtcactgaattctcttgtgttaattttgtgtttcagatcagtgtaaagatcactagatcagcagatttctatactacctctccatgagctgatctttggtaggagttgttggcagctgattaaccattggagttgcccagccaacctgatgcttgcagtactttctgaaccagtttctgaaggtgatgatcatgttgtcagataaagtgggaacatagcaagctttctgccatttatcaacgccaaccgccgcgaaattgcgctcctggagaaggattaattcgtcaggtcaagactgaacatatcacatatgggcatataatcaaggcagtttgatctgaagaaatgggtcacctcgatatggaggaggtacaaatccgaatccaaaacggtgttcgtcaccatgtggtgaagccaccgtggtatgaacttgtcaggccaggcgctgacgctctgtggaaacacccatatcaccctgctccttccaggagccacagggatgcacaagaacaccagcatcccctgaggctgctgctgctgcttctcctgatcaaaatctgaactttttagacggtttttttagcctgaataatgcaacggatcgagagggtggctgatgctgatacgtgccagtgtctcgaggggcaactctgaccggttgatcgtgcacggcgcgatgaacctgaagtggccccaattctccccctggattgacaggaacccgtcgatgttggcctcctctatcttcatcttgaccgggccgccgcgttcctgatcaaactcaactgtggagaggagatgaatgttctgaatcagtgacgacgcatatgagcattggagaatggcactagatgactaaactgaagaaaatttgggtagaaaattgattgatcatgtgatgagatagaacatatctgcctggatcttccttgtcttggaactgagggaagagccccttgtgtgcgtaggggacgtgagcagggtccatgaggttctccaccaacatgtcgtacctgcattgcaatggagccacggcatagtatatcaagctgcatgcctatgtgtccgtttcggagaagaatggcttgagcatttctgtacccgtaggggaagtccctgacgccgaagacggtgttgaaggacggatcatcgagatctgggaagtatggcggccgcttcctctgcagcacgtcgcggtactctggctccgttctcgggtagaaccacaggatgttgttctgtaccacgctcgggtacgacgccacgcacgccttgctgttcttgtgcacctgccattcatccaacaactcgataatcctgagaaattttgctttgagatcgacgcgggaatgtagattagatcgacgagagtagtggggctctgccttcaccctcccaatataggagcagtgtttagcatccgttatctattttttttctctcttttttttccctttcccttagcaatgggtctttcggggcggttgcgtgtaactaaaactctgcttcttctaatatattgacatgtaattctttttatgtgttcgtgaaaacaaagtttatcgttaagagaatgtagcaaaggagagtacgggagggccaagggcaggagcttgggggatgaactggcaggagccatgtccatcgaagcaccagccatggtaggcgcactggaggcggcccttgccgtcgacgcgtccctccgacagcggcgcgaggcggtgcgggcacgcgtcgtccaccacgcgccactcgccgccgccgtcgaaccacgcgacgacgcggaggcccagcaccatcttcccgtgcggcttgcgcgggtcgaggtcgcacaccggagccacgggataccactggtccagccagtcaaaccgctcctcccctgccgccggcgcccgcacctcctcggccaccggcggcgtctcggtctcggtctcggccgccgatacggccgagaccgacgtcggcagccgcagcgccacgccacggccgatccacggccgacgcggtggcgccgctaggctagctattctctgactggcggcgccatcgacacggaggggaagcgaagcaggccgcgcgccggagcggaggaggagggagaggggagccatggctttctttcacgttggcaacacagtgtgcgcgtgtgtgccagtgtgcatggctgtttggactttggatgtggcgcgcgatgttaaatatttgaagctccaggtggttcttgtagctgtagcctgtaggttgaggtggatctcgcaacaaattgtacagtctacagtaccatgtatagtaagaatctgcctgcccatccacatcatcatccaactatcctatccgtcggatgtcgggttgtatgtggcatttttttttcttggaccatatgatgcttttcttcacgtgctagctagtaggagtgaaaatgtaggaacagggtttacactttcctaaataaccgaaaattagtgaatttcggtactttcgaaactttttgtatgaaattatttaaaaatctaacaatttttttactgaatttgaattaattttgcaagttaaaaaaggtaaaattcaaaaaaattggctaggatagttgcttgccggagggggtccgaaattttaatcccttaatttgtataggaaaacaatctcaccgtgaccatacttttttctcacaagggtaaaataaaaggcaaaggtgatatcgaaactatagtgaacgaaactattcgagggggaagcacatcgatattgatcagaaactgacacttcatgagcaaagagataataagggccctttctccttattactttcatgtattaataagaagagaagaggtataacaatcaaggaagatcgttgtgttgtatgttgtcaaactttggaagatggcaggcatctttctttgaagggtagaggaataatagtgtgctactgtgttgggaatttgcaaatggaggatattggatcaaatcacctctgacctctgttaacaataaaataatagatattctagaagctgacaaacaaacaacagttaattactccctccaatctttagtgtaaaatgatattgattttaggatattacgtatgactatccatcttatttaaaattttagtgtaaatatgaaaaagtcccttctaaaaaaatatgaaaaagtataaatcatgttaaagtatttcagatgataaaacaagttacaacaaataatatttttaattagataaatgatcaaacggcttgtttaaaagttaatgacatcataccatgagacacggtattgtatttatggttgtaatgtgataagaggaacaggatatgtgagttcagagagagaaagaaagacggctacattgtcccaatgctatgtacaaactattttaaactctcgaggggacgtcccctcgttgtttacatgtcactaaaatggttatgaaaaaaactaaaaaaagttctacaacatagattaatatgcgatacatcaatccacaaatatgtaaggtaaaatttaacttttacactgattgtgaacatgtgttaactagttgtagtttgtttttttttttttgcaaagtgtagaagttcaatttaaacttgtatgtttgtgaaatgatatgccatatgataatacatgttttcaattttttattttttctataaccatttaaattacatgcaaacaacgagtgtacgtcctctcgaaagtttaaaatccactcctacacttaaaaaggcagtcctagccaacagtcaaaatggtcgctgcaggagggcaccagcaccaacctgaaggcaaatgtcatcataggataggaaggatatctagttacctctaacctctggttgttggagagtcatataactcgaaatggagctggtgaaccgacgaatatttggtagtgtagcactgtagcaagtcaatgttcactgccaaattaggacgggttattttactgtctccggtttttttcccgattccgcaagaactcccttgtccccctatcttgctatggaacctttgagaggtgatcatgtatcttttatatccttcttaatgaaattggcagagctcctatccttccccctcaaaaaaaaatatacgtatatgtgatatggaatagagctcctgtccttccccctcaaaaaaaatatacgcatacgtgatatggaattctcagggccctttctaaattgattagccgaacgttaaaaaaaagtaattatcatgtgattaatcggatatctatctatctatctattatatactaaaagttcattaaacatcttataaacactcctaagccgccaagtggcgctctaataaattagataaattcttagaaattctaagaaaaaagcaaaacatctagcccttggatttcacttaaaccggtggacccattattttacaccgtaagattagatttgtgagaaaaaaaagttaattcatctgtgatcctccttgcctgctattcgctttggatctataaaaacgtaacacactccacgattcttacacgtgatggggcatcagttaatcacaaaccaacgcactcctccaggtagcagggttctgcacgcaccatgaaacgttgactaggtacgtcaatctctttcaccggcgatcggcctgcccagctgccctagatgatcggctacaagggcagccataaccatgagtccgttgatgtcgaccagactctcgcgtcccccaacctctaccactccggcaatattttatcaattaatatttgatccaaactgaaatttgcaaactattgttgctgtttttttaaaagaaaatttccgttccaacttccaagttttttcatgtttctgatatgaaacgacatcatgaacttccaaattgtttctttccatgttaatgatatgaaacgatcgacatcgtggtcattcagtaacctaacaaatttgcactactgtatataagtaataaattgtgacactttcttattattactaattttgaagtttgcatctatttaagtggcaccaaatcataataacttactaatggttaattttaaaataagttctcaagttgataaaatattactgttgagagttacagatgagcacaattttatttttatatgttgtacttcccaaacgataaaatcatgaaaaattaaagttgtaactccaagtagagcacataccttttatgaattattttatcattagaaaaaaaatctaaaaattataactccatgcaaagatgactctagatgcattaactgttcaagtcataactctacatgtataacttgatatttactactcccaccatccttcctccatgccagtttgatctcatccaagttttttatatctccctaaaataattaacatataacaaatgacttttcgtttatttgtgtaaagagtaaataaatgggcatcgttgaataagctcatgcatgcaactaaccaaaattactttctattggtgtaaccctaaaaaaaattctcttggtgtaaactccacgaaatatttacagcgtgatgcaatcaacaccttgattgatgaaaataattttagaaccatggaggttttgttgtttttggtctcagcatcctttgcttaggtgatgatcaaattggaatagagggagtaatttctaagtcagaaatattctgtcttatttgtaagtgacaaattgcatcaatgtaaactgggctagcttgatgccaaataaaacacatgtgttagtagaaaataaacaaatttaataaaaaaaatagttagctcctaaacatttttttaaaaaaaaaccttatttttaattcacatttagtttattagatatgttttctaaatagactaagtcaacactatcttagatgatgaagaaaactatagggatgaattaaatattatacggtataaatctatcaaatagattaaacaattattgaatgcgcgggctagcttccttgttaattattaaaaacttaaaaaatagatttatttgatttttttaagcaacatgtatatagaaaagtttttgcatgaaacatataaaaacatgctaacaaaaatcaaataattagccaagctgaaattaacgtagtttagaacgcgcccgaaatttgttttctccatccatttgtttagctgcatcctatgaaatcgtcagctaactcttaagatgatcagttgtttatatacagatgctatcgatatcaagcatacttggttgtgttttctatatacatttttaagctgctaaattagaagctaaggaattcccagcaacaaagaactctctgatttcctggacgcatcgacgatcacttgtaagcatggacgtagtcctggaaatagaagttcttctcgatgaagttggcgagccagcgggaggcggcgaagcacagcacggccgcagccacgacggcggatctctgcacaaccgacgtgaccaccgtccccttggcgacggcgaggaacccgacgacggcgaccgacgccacctgcagggcgacctccagcgccttcatcttcttcagtgcaccgctgcagctcgtgcactgcatgacgtgcgaccaatacctgcagacggcatcacaagaatcatttgaattcaaaattcaaaagaagaataattgaattctcttgtgttaagttttgtgtttcaagtcagtgtgcaagagcagcagactgatgcaggtagattgtttagctgtttacctgtccaagagctgatctttgctaggagttggtggcagctgattagttattggggttgcccagccaatctgatgcttgcagtactttctgaaccagtttctgaaggtgatgatcatgttgtcagatgatgtgggcacatagcaagctttctgccagttatcaagaccaaccgtagcgaaattgcgctcctggagaaggaataataatgcttcaggtctagaatggcataacacttggcctgaatcattcagtttcagctgaagaaatagtcacctcaatgtggagcaggtagatgtctgaatccaagatggcattctgcccaatgtggtagtaccaccgtggtatgatcttgtccatccagacgccgacgttccgcgggaatgcccagaccaacctgctcctccccggagacaccgggatgcacaagaacaccagcatcactgtgggttgcttcttcttcttctccttgccctgatcatcctgtacagaatccagcagcaccaacaaggtaattgacaatactgatcttgtaagatggttctatgagcttgaacaatgcctgagatggagtctgaagtggcgagccgtagaacgtgcacggcgcgacgaacttgaagaagcccctgtctagcattgacaggaacccctcgacgttggtttcctctatctccatcttgagcggcccgccgccttccttgtcgaactcaactgtgtagaggagatgaatgttctgaatcagtgacgcagctaagcattgcaatttgcactagactgaaagaacagattaaattggggagcaaattggaaaagaaaatttgatcatgactaatgacagatgaggaacatatcttcctggatcttccttcttgcgggtgcgcatcaaccccttgtgcgcgtaggggacatgagcagggtccatgagattctccaccaacacatcgtacctgcattgcaaaatttgcaatggagctagccatgatcaacagctgcctgacaatggtgcagaaagaaagatttcagagaatggatttgggatttctgtacccataggggagatccctgacgccatagacggtgacgaaggacgggtcgtcgatctgcgggatgtatggcggccgcttcctctgcaggatctccttgtactccggctccgatctcgggtagaaccacaggatgttgttctgcaccacgcatgggtatgatgccacgcacgccttgctgttcttgtgcacctgccattgatgcgaaagctcgattaatcttgattgatttgagatggaggagaggggatgaagaagaagaggaggaggagagtaccgcggggccgagggcgggggcctgggggatgaactggcaggcgccgcggccgtcgaagcaccagccatggtagacgcactggaggcggcccttgtcgtcgacgcggccctcggacagcggcgcgaggcggtgcgggcacgagtcgtcgaacacccgccactcgccgccgccgccgtcggcggcggcggtggtgcggtcgaaccaggcgacgatgcggaggcccagcaccgtcttcccgtgcggcgcgcccgggtcgaggtcgcagacgggcgccaccgggtaccactggtccagccagtcgaaccgctcctccttacccgacgccgacggcgcgtcctccgcccgcggcgtctcggccgccacggccgcaaccgacgtcgacaacagccgcctcgccacggcgcggctccacggcagccgaggcggcgggacgcgggcggcggcggcggcggcggcggcgtcgcggaggtggagcgcggggcgcgcggggcgcgcggcggggaggaggaggagggagagggcatccatggctactcgcgtggtgggggaggggggcgcgagcggcccgcaacgaacttgtggcgcgcgcgcgcgcggttacgttgggtggggcccggcacaaacttatcggcgccgcaggtgattagctggacgctcgccacttggccaaattggagacgggagaggccgatgccgatgcaccggttttacagggtacatttaattatttgccatttttaaaatatgccaattaataatttgctacttttataacatgtggttccttatgtgcctataacatatggattcagagccaaattcttttgaaccactcgtaaaagtggcaaaaagttaatatttcgttttctagtatcacttgtcgagtcgtcgccaacgagccgccagaaactgtccgtgcaacttgtgccgatttttttattgaaagtacaaacagcaaggtagaaccatcactctttggatgataagacagttggttggttttatcggctaaatgccggttaactaaagaagggataaatcccctttatctgtttctaataaaattgaatatgtgatagagttaattttgtgatcggtaaaactaatctctaaaactgtattcgagataaaccctagagcccctccagcgtctataaaatagaagttgaacacaaaggagaagggacgccaaattctctatctaaacttcaaaaccctaaattgcccgaccaactagaaaaggtttgtgaggcgatctcggtgaaattttacattggcgcataagaagaaaagaaacagaagaataagagaaggaagaaactaaaggagaataattaacatcgatggcatattatgtgggtattgaagcataggtgattatgtataagctaaatcattgagatcgtaaatttatattccaacacagacatgctagatttttcattaacgaatcggttcgcgccaattccattaagtagagcaggaaaaaaatgttagaaaaaaatatcgaaaggtatataggaatgaatggaagctgccagtttctaggcacccgaaaggttcaagttttggcatgataaaatactaataagggtgtgttagatccaattttacaccccatcacatcgaacgtttgaacacatgtatgaagtattaaatatatgctaaaaaaataactaattgcacatattgctactactttgcaagatgacttttaaacataattgctccatgatttgacaatatggtgctacattaaacatctgctaatgacggattaattaggcttaagtctcgcggtttagtgatggatactataattagttttttcgttagtgcagaataccctatacgacacctatataatacctgatgtgacacataaaaactttacaccctgatctaaataacccgtaagaatgtactacctccgttttgttttttaatagataacgccgttgactttttttcacatgtttgaccattcatcttattcaaaaaatttacgtaattataatttattttgttatgagttgttttattactcatagtattttaagtatgatttatatcttatacatttgtataaaatttttaaaaaagacgaatggtcaaacatgtgagaaaaagttaacggcgtcgtgtattaaaaaacggagagagtattttgctatagccgtttttacttatggaagagtgacgacatctgagacagatcgaagagcatcgccattgtcacgatggcgacccaatcacaaacatggcagaattgcagagagtctagtaaggcagaagctgaggctgagcttaccaaacacaagcacacgcacacgcacaccacacagtctacctatacctactactacctgtcatcttctccttcttaatcccaactaaatgcgcacataaacgaagaagatttgcactgatacccgcgctgatacaagcaagcatccggcgatggcggcggcggcggcggcaagggggagcgtgtgggagatccagcagcgggacgtggaggccgcggggctggccgacgccgacgcgggcgccttcgtcgcggcgcttcgctccgccgccgccgttgcgacgggtgggcctgacgccgcgtgggaggccgtggcggcgggggtgctgcggccggagcacccgcacgcgctccaccagctcgtctactactccgtctacgccggctgggatcgcgccgcccggggcccgccgccgtactggttcccgtcacagtaagtcacctcgccggagacgaccagactggcaaactgacagtggctggtttcagtgtatgcaaagttcaagcttatgttgatagcgtcctagtactacttaatttctagtgtgatatcatcagtgataagatttccttgtgttaatttccacttgtcatgtcaagtaacctatttgaagtacaatgatcagtgcatgatttctctacgtagtgatttagtgtttgaaatgtgacaggattgacactaaacaaacaaatcttggtagactgatggaagcacatggtcctaggttgttaggatcatcatataaggacccagtttcaagttttcacctcttccacaagttctccgtagagcatcaagaggtcagtcggttgctctaaactagtcagctccagctaagcaaccaaacaagtttgaagtcatttctttacaaccattggagtggctatatgaatgttatttcttgaatggacagtttaagtttccacaggcattttgatcctactcccagtctatcctttgttaggtctactggtcaatggtgctgaaggagatctcaatcaagttccaacaagaaccaaagtcaattctagatacatcagataaatcaaggaaagggggaacatggctccaaggtgctgtgcttaatattgctgaatgttgtctgttaccttggccttcccaaaacaggacagatgacagcacagctattgtttggagggatgagggtcttgacaatcacccagtgaaccgtatgtcactgaaggagcttcacaatcaagtgatgtatgtatatgttatcagactaacagtaagaatcatgctaaagcgtattaagctttgccataacttattctgaatcatcaccattgttttgctgcttttggtgttttcagtacagttgctactgcgcttgataccatgttccaaaagggggatcgaattgcaatagacatgcctatgacatgcaatgcagtcatcatatatttggctattgtccttggtggttttgttgttgtgtcgatagcagacagttttgcacctcaggagattggtacacgcatgagtgtgtcaaaggcgaaagctatttttactcaggtaggaaattagtgaatctttcatgacatagtcattaacactaaagtagggcttcatctaaatttcacgagatttcaggatttcataattagaggagggaagaaggttccactatacaggtacgaacggatgattgatcagttcatttcagtttgtctattctgatagtataatgcacttagcattttgtttttttaaaaaaatgcattttcttcatatatttttctaatttatgacatttgcttagtttgaagttaagtaggagtgtaggacgttatcatgtgaacactgaaaacattctctttcattgattttagaattcagcttagatttttcctgtgaatctaaaaaataggagtacttaagtaccagatagttcatagtacatttcaatcagaaagacaatttgcagaacagataaatatttcataataattccattcttcagccgtgttgtgcaagggacttcatctaaagctgttgtaattcctgcaactggaggctttcttggggtttcactaaggaatggtgatatgtcctggaaagatttcctttcttgtgctgctggaaggtatattatacagaaataaatcttagatggctttggataagtgtattgtctttccattgaagaaaaaaggaacatgcaattgttttttttttctttactaatttcatgatatgagtgacaatatatgttggatttgcaggtcgtccatttatcccacagtttatcaaccttcagacgctctaactaatatactattttcttcagggacaactggtatattaacactatttcattgcttcccctgattttagtatttcttttgtccacccctgatttttgtctgttttatttacttgtgcaggagaaccaaaagctatcccatggtcacaactttctccaataagatgcacatgtgatacatgggcgcatttggatatccagccacaggacatattttgttggcctactaatcttggatgggttatggggcctatactcttgtactcatgctttttaagtggtgcaacgttggctttgtatcatgggtcaccacttggtcgtggtttttgcaagtttgtacaggtacatctgatgtactttgcaccgtcacttgctttggaatgttaaagaagatttatattttatcattgcttcttgtgtgcactgtaaactgtactaattatgtaggatttgagaccctgcttggttgagcttcaggttataatctaaagctgattttgaattttagaatttgattttaggattaatcttaggggtttcctttgttacttttgtcatctagctctcttctcacaattactataacaagacaagtaaaaatcctaactaaattattcttaaaaattaaacctcaaagttccaaattgcttttgatttttcttaaaaattaaaaatctgattattctttgtttattcattctgatttcatatttggttatggcacatctctactgggtagtgagtactaacaacgtgtttcacctcaaaaactgtttttgctctcagatcctgtttctttgagccccctttccccccacaaatcaggaagagttttgccaaatgcttatgtttgaagataaatatgaactgaacttacttaatcatcatgctctgtgaaatattttgcaggatgctggtgtcactatattaggaagtgtacctagcttagtgaagtcatggaaagctgggaattttactgaagggcttcactggaccaaaatcaggtgagtcatccttccactatcagaaggctcacagcttcatcacaatcagaaaggaagttaaaagtagtattataattgcagggtactctccacgacaggagaggcttctgatattgatg

SEQ ID NO: 70535 - DNA, 30816 bp, Oryza sativa
gggaggaaggggatgagggtggggccccacccgtcagcgagggtggcgggcgggcccgcccgtcaggacgcgcgcgcggggaggaggagagagagggaaggagatgggccgagccggcccaagagggggaggggggaaaagactttttaggatttttctttttataaaatcattttaactttgtttattttaataattattatttgtgctctgaaaattccactaaaatttatttacgcattttaggcttttaggaaatatacaaaaatcctccaagccttatttgacttttaactttgcacattttaattgtgggaggctttcacaaggattttaattattctaggcataatttctaggatgtattttagagtcattttgggacgcgacagttctacatcgtacacgtcgaagagggagtacaagatgatagaatgcgaagtctgctccacattacaaggggctactgccaagatgaaatggtccaagcacaagattgagttctcagaggcggaccacccaaagatcgcgaccacacccggcagatatccgatcgtggttgaacccaccattcggaacatcaaggtggcaccggttccgatcgatggcggtagctctatcaacctgcttttcgccaataccttagatgcaatggcgattccacgaagcgagttgatgcctatcaacccttcgatgggatcactccagaatcatcatctaagccattgggtaaaatcacattaccagttactttcggataagccgacaacttccgaacagagcagatcacctttgatgtcgcggaattcaataccgcacatgacgccatcattgggagaactgtgctcgtgaagttcatggcagcatcccactacgcttatcaagtactcaaaatgccaggaccaaaatggacaatcactacccagggagacgccaagttggcggtgcagtgcggcaagcggagcctcgacatggtcaagcatactcccaacccatccaccacgactgagctgcccaagaaagtgagcaagcccaacaagatgccaaaaccagacggcgcaatcaagatcatctcgctgaccagttccaaccccaacaaaaccatcaagattggggcagcgctggacaacaaataggaactcgcattcatcatcttcctctgcgacaatgtagacgtgttcgcttggcaaccgttagacatgccgggagttcccagggtggtgattaagcacaagcttatggtgcgaccccatgctaagccagttaagcaaaaactgcgaagattcgcacccgatcgaaaacaagccatacgagaagaacttgacaaacttctcaaagctggcttcattagagaagttctccatccagagtggcttgctaacccagtaatggtacgcaaagccaacgggaagtggagaatgaacgtagatttcactgatctgaacaaggtgtgtcccaagtatcacttccctctacctcgaatataccaacttgtagattcgacagccagctatgagttcttgagttttcttgacacttactccagctaccaccagatcagcatagccaaagaggacgaggagaagacggcattcatcactcccttaggtgtgttctgctataccaagatgccatttggactaataagcgcagacaacacatatcagcgtaggatccagggggcacttggcgatcaactcagacgaaccgtcgaggcctacgtcgacgacattgtcgtcaaaactaaaacaagagactcgttgatcgatgaccaaagggaaacgtttgataacctccgacgatatcaaatgaagctccacccggagaagtgcacgttcggagtaccatcagggaaactactcggcttcctagtctcgagacgaggaatcgaggccaacgctaagaaaatcaaagcaatcgaaaacatgaagtcacccacaagactcaataaggtccagagattgaccagatgcatggcttcgctaagttgtttcgtcacaaggatgggagaacgaggacagccttttttcgccctgctcaagaagccggacaaattcgagtggacccaagaggccgagaacgcgttcatcgcgctcaggcactacttgtcaaacccccctatactcgttgctccacaacttgataaagaattatttctatatatcgctaccatgtcttattttgtgagtacggttattgtcattgagaaggaaagagtacaacacccagtgcactacatcagtgaggccctccatgatgcaaaaactagatacccacagattcaaaagctgctctgcgttgtgaccatgacgtcaagaaagctatgccactactttcaggcccacaaagtaacggtcatctcttcttttccttagggagaagtcatcaggaacaaagacgttgtgatccgtatcgccaaatgggtagtcgagttatgccaattcaatgtccattttgtcccaagaacaaccattaagtcacaagtcctcgccgactttgtagccgattagactatcccagaagatagaccagacgatcaaacagataacgaaacttggactatggcgttcgatggcgcactcaacagccaaggagcaggagcagtattcgttttgacatttcccacgggagttcagttcaaacatgcaatccacctcaatttccgggcaacaaacaacacggttgagtatgaaggacttctcacaggaatacgagtagcttccgcactcggcatcaagcgactgattgtgaaaggggatttagaattagtcgcgaatcaagtgcataaagactacaaatgctctaatccagagttggccaagtatctcaccgaggtcgacttgatcgaagttcaacatgtctaccgcaaagacaacatcgaaccaaacaacctcgcacgacacgcgtcaagatgagaaccactggagcctggaacttttctggaaaaaggattgcgggtgtaaggttaaatcaactcttgttgttagagaaggaatggaaactattggtaataaacccattaaacaaattcacaaatattaatactacttttttaatgcatctaaagtagatattttctaagcaatgcaatacacaatatctatgtttctatttccttcacctaataaatttcgatccttttgcatagagatgggcattgggtgtggaccaaccttaaactggagtgaggaagtactacctacaattcagcccacaccttctaaaagtgctatgagtggtcggtctccccatgtgatctttttaatttttccatcttttttcccctctttccttttttggcaccatagtaagttttatctaccttgggtttatacgttgaaagtttatatacccgtttcaattcgaatttagattctaatctttttatatttctaaatcaaaagttcacatactattttcaaattcgaatttggtttccaacattttttacacaatgtttctacacataaagtactttatatgtgcaaagtttataatgcatatattttttgtgtataaaatctatacacaaatactccctctgggctgataatacttgtcgttttagacaagggtgaggtcaaattttagaatctttgattataaattatttttaaaatatttatctttcaaatatggtgactacatgtatagattagtcttgaaaagtactttaataaaacaatatatttgttaacactttttgtcagggttacgggtaaggtataccctttacccttcgatatatgccgcgtatcggtatggtatacctgcgcatatacggacactctctgcatacattaagggaatccatcatggagttcacagatggaaagagtcctactcggacaagactgggtcgtcagtgcatcgtgcagggtccgatgtctccgagttctacttggaaacggcgtgacctgcgatataaaagggatcccctgggaggacctaaagggggaatctaatagccaacatcaccaccacagcctacgaagtcggagcctgcggaagccagattgccgagaggtgtagtcggattaacccgatacgatctcgtcggtttcatcgagttccatctttccctttgtaacttgtgatttccatcatataatcccataccaactggatcagggctattacctatcaaggggcctgaaccagtataatcttcgtcttctgtttgcttgatgtcgtactacgtagacccttgtaccagcgtaccccaatactctctatatccggtctacgggtatcacccgtcgacagtggcgcgccaggtagggggacttggtgctcaaggttctactactatgtcatccagcctcgtcgacaacagcgtcaacaccaacctcaactacgggcttcctgcctcaacaatgctagcgtggactcaagtcggcgaaattgtctttccggtttacaccacgatgccgatctcagctgggccatcgatgaccagaaacgagaacgcagtggctgtaacccaagacggctccacgtcgaaagttcctcccggcgaagtagagaacggaacatcgacgacatccgaactcaagaagaattctaatgcggccaaaccttgtcgttccgacaagaaacacaagctgacgagaataacttccaaagcgacagggtcctggtgccctattcagaaatccaggaaacatactttgcaagcctgctgggttttcctcaacgcccgcaccaagattcgcgcctgcaaggagcgtggaattcagcgtgtttctccaactcgtggtgtgtattgtcctattcacaagacaaagaaccacgacctctcgagctgtaaattttttctcagcgtcacaaagatgccatctcccaaggttcagcagccaggcaagacccttagagacgaagacaaagaacgaggaatgacgctgaccccagattgtttcatcgatgttatcgacatcggttcttccgaaccgttagtcctgcacctacttgaggactacgactcctcgtcgacaagtacgcgacgtgaggtattggctatcgacgagacaggcacattggcacgcgctaacaccggggcggaaaatatgacgtctacaccggctcagcacatcaggaccctcaacgcaatactgagggagaccccttatgaccccgttctacacgatgacctcacacaatagacggaacggttacgggagtcagtgaccaacctcagcaacgcgttcgaagaggccgccgctgcaacccacccggaacagcaaccaactgctggtgccaatggcgaaaaccccgaacagcgggaatcaccctatcgagccagccctccacctcacggcaccagcaatctctgtgatcacccaaacggtaaccgagaagctcgtcgcacacgggaaaacgagaaccgtccccggcatcacgtttcttcacgacatcacgacaatgaagaacgaggacgccactcgaacgaagaccgagactgtgatcaccaccacaaccgtcatattcgcgacgatcgtgagcgacggacgccggccgataccagtcgagggcgccgccatcatgacgaagacgacagagaacggcgccgggacaacaacggagggcgacgacaggattctcgagaacacggccggcgttctcgtaatcctacaccagaaccaagcgacccatcgtcgtcctcatcttcttcctcctccacatcgtcagacagacatccacgaaggacatacgatcgccgacaacccactgcccccagtgctgggtgtagggctttcggtcgttcgttgcacgatgtccgatggcctaagaggttccgaccgggagcagtagagaagtacgatgggagcactgacccagaagaatttcttcaagtctactccacagtactctatgctgtcggatcggacgacaacgcgttggcgaattatttgccaactgcgttaaaaggctctgcgcgttcatggttgatgcaccttccgccctactcgatttcttcgtgggcagacctatggcagcagttcgtcgccaacttccagggaacctacaaacgccacgcgattgaagacgacttacacgcattgacacagagctcgggtgaatccttgagggaatatgttcggcactttaatgagtgcagaaatacaatccccgaaatcaccgatgcttctgtaattcgcgccttcaagtccggtgtcagagatcgctacactacccaggagttagcaacgagacgcatcacaactactcggagactgttctagattgttgagcgatgcgcccacgttgacgatgcacttagacgcaagaacgacaagccgaagaccggggtcgagaagaaatcaaccacggacacacctgagtcaagcaaaaaaaaaaattgcaagaacgcggaaaggaaagctcaagcagaagtactcgcagcagaatatgctaaccctcccaagcgcccagacccacaaggtagtgacgcaaggaaagcatggtgtcccatacacaaattgaacagacattctttggaagactgccttgttttcaaaaaatcgctcgagaagcacatgacatcggaacaaggaaaacgagtacgcgtggtcaagaaggatacagagatgaccgctcaggagtcggacccagcgtatccagactctgacctccacgtctcacacattttcggaggctctagagcgtactcctccaagtgagagtatgagaaaatggagagagaagtctgctcgacgtggcagggggctgcacccaagatgaagtggtctgaacagaagatacaattttcggaagatgaccatcccaagaccgccgttatcccaggacgctatccgatcgtggtcgaacccactattcggaacatcaaggtcgcgcgggttctcatcgacggtggcagctcaatcaacctcctcttcgccagcacattggacgccatgggaataccacgaagcgagttgacacccactgatcaacctttccatggaattactccccagtcttcgtccaaaccaatgggcaaaatcacgctgcctatgactttcggccaagcaaacaacttccggacagagcagatcacctttgatgtcgctaaattcgatacagcgtataacgccatcatcgggagaactgcacttgtgaagttcatggccgcatctcactacgcgtatcaagtgctcaagatgccagggccgaagggaacaatcatcatccaagggaacgcaaagcgggcggtacaatgtgacaagtggagcctcgacatggtcgagcaaacaccaagtccacccgccacaaccgagccacccaagaaaatgagcaagacaaacaagacgctgaaaccggacggcgcaatcacgaccgttcctctctctagtgccaaccccgacaagaccgtcaagatcggggcctcactaaacgagaaataggaactcgcgctcatcaccttcctccgcgacaatgctgacgtgttcgcttggcagccgtctgatatgccgggggtccccagggaggtgatcgaacacaaactcatggtgcgacccgatgccaagctagtaaagcaaagactgcgaagatttgcaccagaccgaagataagccatacgagaagagctcgacaaacttctcaaagctggctttatcagagaagtacttcatccagagtggctagccaacccagtcatggtgcggaaggccaacgggaaatggagaatgtgtgtcgacttcaccgacctcaacaaggtgtgccccaaggatcacttccctcttcctcgaatagaccaactggtggactcaacagccggctatgagctgctgagcttcctcgacgcttactccggctaccaccaaatcagcatggcgagagaggatgaagagaagacagcattcatcacactgttcgaggcatacgtggatgacattgttgtcaagaccaagaaaagcgactcattgattgatgacctacgggaaatgatggacaacctccgacgatatttccccatgctcaatccagagaagtgcaccttcggagtaccgtcgggcaagctgctcggcttcctcgtctctggtagaggaatagaagtgaatcccgagaagatcaaggcaatcgagaacatgaagtcgcccacaagactcaaggaagaacagaagctaaccggatgcacggcagcactaagcagattcgtcgctaggatgggagaacaaggacaacccttcttcgctctgctgaagaagcaagataaatttgtatggacacaggaagccgaagaggcatttattgcactcaagcgctacctatcaaatccccctgtactcgttgctccccaacctaatgaagaattattcctttatattgccgccacgccatactccgtcagcactgtaattgtcgtcgagagagagaaagtccaacgaccagtatactatgtcagcgaagctctccacgatgcaaagaccagatatccacagatccaaaagctgctctacgcagtaatcatgacatcaagaaagctacgacactacttccaagcccacagagtcacagttgtctcctcattccccctcggtgaagtggtgagaaacaaagacgttgtcggtcatattgcgaaatgggtagtcgagctaagtcagtttgatgtccactttgtaccacgaacagccatcaagtcccaagtactcgccgattttgtagctaactggaccatgcctgataatcaatcaaacaaccagatcaacaacgaaacgtggacaatggcgttcaacggtgcactcaacagccaaggagcaggggcaggattcatcttgacatctccttctggagatcaattcaagcacgtgatccacctcaacttcagggcgtccaataacacagccgagtacgaaggactactcgccgggataagagcagcagccgcacttggggtcaaacgactgatcgtgaaaggggactccgagctagtcgcgaaccaggtacacaaagattataaatgctctaaccctgagttatctaagtacctcgcaaaagtcaggaagctggagaaaaggctcaatgggatcgaggtccgacacgtataccgtaaggacaacatcgagccagatgacctagcgcgacgtgcatccagacgagaaccactcgagcccggcacttttctggacatcctgacgaagccatcagtgaaagaggcaatcagcgagatcaacacagccgcccccgacatcagctcggaggccacagaggcggaacgcgccatcgccgatatcgagaccacagacgacttgcacaccccaccgatcaaattcatcaacagcaaagagttgcccgaggacgacgcagaggctgagaaaataacccgtaaagcaaaaatctactacatgatcggcaacgatctatacaagaaagcgccaaatggagtacttctcaagtgcgtctcgtccgacgacggcagacaactcctcctcgatatacatgaaggcatctgtgggtcacatgccgtcggtcgcacattggtcgggaaagcctttcgacaagggtttttctggccaaccaccctcaaagacgcatttgacatagtccagcggtgtgaagcctgtcaattccacagcaagcacagaaagctacctacacaagcgctccagaccatccctcttacttggccgttctcgtgctgggggctagatatacacgggccattcccacgaggacagggcggctacaagttccaattcgtggcgatcgacaaattcactaaatggatcgaagcggtacccacgggggaaatcaaggccgccaacgccatcaagttcatcaaggggatattttgcagatacagactactgcatcgcatcattaccgacaacggctcccagttcatcagtgccgacttccaggatgactgcatcgggctgggagagtcaaaatatgcttcacttcggtttcccatcctcaaagcaacagacaagtcgagagggcaaacggcatagtactacaagggatcaagacccgtgtctacgacaggctcatgtcacatgacaacaaatgggtcgaagaactcccatcagtactatgggccatacgcaccacaccgacaacgtctaacaaggaaacacccttcttcctcgtgcacggctctgaggccatgctccccagcaagctacgacatcagagtacacgagcacagaagtattccgacgaggaacaggaggagcagcgaaacgacgatgtaaatctactcgaggaacatcgcaaacgagttgccgttcgagcagccgcctaccaacaagcccttcaccgctaccacgagaagcgcattcaagcacgcatactttcgatcggcgactacgtcctccgaagggttcaaagccaagcagggcgaaacaagctctcacccaaatgggaaggaccatacacaatcacacaagtcttcgaccaggcgcattcaaaattgcagacggtgatagccgcgagttgttaaactcatggaacattgaccaactacgtgaattctatgtatgagtcaataccatccatacctgtaagacaacttacatcatcaataaagcctattttcaggcgcatattacaatcacagtgtgcctacctgacgatccctcacccagatgacacctagcgttgaaacctatcctcatgtccctttacgccatgctgacaaggcgtccgaggaacctaagggatcttcggctggggacgcccagagccgataaggccttgtcggattctgtagagacgaaagaccatgtcagacctggttgtgtaagagttctccccgcgcgtattaaccaagccgcgtaatcggaaatgaactttccaacttcgcggctgggggctaggatcagtgcttgttcaaccgaggcaggtcaaaggtccaagagccttgtcctccaagaaccattcttcgacgacaaggctgggggctagggagagtgtacaactcaaacgatgcccaaagtcaagaactgaggaggcactcttacacactacatccagagtaagaaggactcattacgatagatttcttttctatttcataagatacttcttacaattccgcacaagtccaaaattatattacatttttccctaagatgtctattgcagggtacaaaggctaccaggaaggccaacaccagtccatcgactggaaaacttcctccgcaagcggcgccatcgacttcgccaggtggtctatctccgccgaagtcctccgagaatgagcgaacccttcacggagaaactcgaggtgcagctgcggacgatgatctcgtatgcaagccaacacatgccctccggcatatcggctcaaccgacggcattcctgctttagggcttcgtcaatgcgcttgccgatgccttcgagctgagtacatgccccattcagccacgagatgtagccggccgccgattcctcgggatctcctcggggcacccggagctccctacaaacatgggccatgaacgtgcagcaactctttagataagagtcgaaccacacctcgcgacccctaagtgcctatacggcctggtcttttttcacctccaccatcgccctctcgagttccacgacttcacacttcgtcttccaatattggatgcgacggtcttggtcggcaagtctactctcgaggtctgctcttctattccgagaacacaaaaaccaagttactccgggaagaagaatgaaggagatgaaaaaaagatcaccaacctaaggaggtcatcaccacgcccgtttccacgggtgagttttgtcccatatcgtcctgcgacacaggcgtttggagggtaatcgccggggcgaccaccggtaacttgggctgcccacgctgctggacatcctcgacatcgacatccctacaaacgacaaccaaaagtactcaggaccagggtgccaacagagatcaaggcaacgattgcacgaataaaggcagttgaagccgacaactgttatacaaagtgtagtcgattacaaatgatctgaggccctactcttcaaaaagcgggagaatagactctcccagttcgccaacctcctccatcacacccttacgagcgtcgttggcggccccccggtccaagatctgccgaagatcgcgttcggggtgcgccagtcggacacacgctaggacgtgataggccccagtgtaaatcccgtttgacgcctcctccacgatgctggctgcatgcttggagggtatcgcctccatcgccgtagccagttccgcaagtgaagacgtcagcgagaactcgtcggggttcgctgggatggttgtcgtgacgccacactccccggcgagctgatgaagactggtgtaggtgacccgcagcgacccacggatctccgacaggttgttctcgagttccgacatccggtcttcgagtccccgccgttgccgctcgttaccggccaccagctccctcatcttctggaggtcctcatgaacctcccccaggtcgcgttccagcttgtcagcacgctcgttcgccgacgacgctgccgctgtcttcgcctcctcgatctcgcgactcacgccgcaagtgccagcctcgaggatgcgttgcatctcagcttggagctccccccaggtgaggacattggcagatggcccgcgagcaggtccgagggcactggacagaccgcttggcgtcacttcacggctccttggcgcgacaacaacatcggttgaggttgccgcaggagacgctccggaggccccttcggacttgtcctgcgccgctctcgcctgcgccacccttgcctgtgccgacctgcagaagatcctcaaatcaagccgccagaagataaatgaggagaggatctcgacttctgcttactcacttctcgcctagcgtcaccagtttcctccgccgcggaggtggcgaagacgcgtccacgacctgggtaaatcaagcgcgagttgagggtgacatctcttgaatacgagattaacgagccaagggacttaccggtggggaggatgctctccggcggctgccgagaacggaggtgaatgtccttcccgttttcgggacacgaccgccactagtcgtggcagcagcagcgacggccacgtcgggcgtctcccgagcgatgctctcctttagtgaggccaccgcctggtggtccgcgagcggtccaataacgtcagtcagagggagagcctacaccgcatgaaatcattttccgacccgggaagcaataatagcaaggttaccgagtacactcatgttgattgcggcttcgcgcttagtcgcctccttatcacaaagaggcatggggacgtcgcttgccgttgtcgggccgctgatcatcaattggccgacgcggcgctccacggtggcgtcactcaagcctgcagatcgagaacaaaattcgataaattagggagaacatgcacagaaggggatcaaattaaacacaagaaaaataccccgaggagaaacccaggtcgcgtcctccggcccagagtagtcaaaggctgggtgggcgcgaacctggagcggctggatccgcctactaatgaagtcggtagcgacttcataccccgacaaacctcgcgctcggaggtcatcgatggcatcgatgaacgactgaaaagcaggggtcaaggcgggttttgcggtccaagatgggattttgtctggttgttcctcaggaatgacaaagatcggatctgaatcctctatctgaagatagaacaaccttgcccgccacttgctatgacaagaagggcactggaaggggatatatcgtgacttcaggccatctcgaagtcggaaacccacacatccagataccctggtagattccatccaacgcaactcgtagtagaagcgaaagaggtcgagaaacggctctaccccaatgtaggcctcacaaagatgtgaaaagatgctgaggaaggcaatggaattggggttcaaatggagcagagaaaggccgtagaaattcaagaccaagagaagaaactcagaaggcggaggaagaaagccacagagaatatagtcctcgatcgcaactatacggcccaggacaggttcaggttcagtacctcctggttccctctccatggctccgcggccggggatggcgccatcctcctgtagctttttaagcgacgtgctggtggaggtagacttgccgagatccatcgccgccggagatcgccggagaaggggccgagatgaacaagctaggactttgcaggagcggaggagacaaggaacgcctggaggctggagagcttttttcacaacgggtggacttcaaaatggatcctcaaaatcctcttaaatagacgcatttccgacggtgtgaattccaagggaaggagagagagattaccgccggaaatttctaggtccgttacgcgcggcagtttttcagacttcagtttaaattcactcatgaccgttcggcttcacatggtgttgtcgattgcatcctatctctatggttcgcacaccgagaacgacaacagcctcgacaccagaagtcacgatcggttacacgagtccatttaagcagaagtcgggggctactgtcagggttacgggtaaggtataccctttatccttcgatacatgccgtgtatcggtatggtatacctgcgcgtatacggacgctctctgcatacattaaaggaatccatcatggagttcacagatcgaaagagtcctactcggacaagactgggtcgtcagtgcatcgtgcagggtccgatgtctccgaattctacttggaaaccgcgtgacctacgatataaaagggaccccctgggaggacctaaagggggaatctgatagccaacatcaccaccacagcctacgaagtcggagcctgcggaagccagattgccgagaggtctagttggattaactcgatacgatctcgtcggtttcatcgagttccatctttccctttgtaacctgtgatttccatcatataatcccataccaactggattagggctattacctatcaaggggcctgaaccagtataatcttcgtcttctgtttgcttgatgtcatactacgtagacccttgtaccagcgtaccccaatactctctttatccggcctaagggtatgacccgtcgacacttttatatatattataataaaaataatagtcaaagttgtttttttgaagactgtgcccttgtccaaaacgacaagtattatcaacccggagggagtatttctgcaatgcattagatttttctctattttatttctattttatagtacttatgttttgaattggtttgaaattatgaaggtgcagtgagaacagaagttgggcggttggcacgtgtgcctctggggctcactggcacaaaattgcgtggcgaccacccacacatttggtaaccctaacatcggcgtcaccctaattccacacatacactactgaagaaaccctcttctctcccggtttacagccccttgtaatcctgggttacaaaccgggagaaagaatccggatctttagtcctggttgaaatacccgagatctttagtcccggtagttatttttttttcattgttttttgcagttttgcgtatctcagccgacatccccaaatcataacaacaaaatattatctcccgacatcacaattcatcagcaacaaaataccatctcccgacatcacaaattatccacaacaacaaaatcatccttaagttatagatcaaatgaacaaattatccttaacaaaaatcatccacaaattaagagcaaaagaatagaaaaataaaagaaaatctggctagctatgtgctgcccggccgcctcccctcccggatccggcggaggggaggctgccgctgcccctcccgcttcctctgcagcgtgtgctagagagaggagcgcaggtagagatagaggagagaggaggagagatagaggagagagcgtgtggagagatagaagagagaggatgaggagttgtttgcgaggatgggaggagaggacatatcctacggattatataccatgtttgatcagcgtgggctctgatcttttttgaaccgggactgaaaatgatctttagtcctggtttgtattatcaaccaggactaatgatcatccagtcccatgaaatttttaaaccgggactaaaacatttttagtcctagttcttttcgaaaccgggactattctggttttggccgacccagcaaagatcagttctgcagtagtgatatcactaccaccatgtatcaatgtctgaaattttgtttcagatgattgtcgggaaaaattggcatttaatgtcaaatgttctttacttgttttggcaatgctttctgatagataatctgtcggtaattctttatacgacgacaaatgttctgtgggtaataatattgaccaataaaaacaaacgatctgtcggtattatatttgtgggtcaatctgtctgtttggtaaaagttggtttgccgctaatttttagaggccggcatgaaaaattggtaaatcgcctactgtaatcttatttgtcgttgggctgtagttatggctaatgatagcccgtggaactgggctggtcggattatccctttgctgttggggctcatgctgtcgggaatcatgtgggctttttcagcttttctttggtaggctttgctggggaataaccccatacttaggttgttgaataaactaatatataaaagaactaaaatatctctaagaggatgttgaatatatacagcaaattaagggtaaagatgtaatttcccgttacatacgaataacaaagagaggggacctctcccctattccactcattttcatcctctctcattcactcttgtggtcctcacgggaccaaacttgcactggtggagaagggggtttttactcccggttcgtaaccctcctatagttccggttttttaaccgggactatgaatccgggactaaagatcgctatctttagtcccgggtgaaaaaaccgggagtaaaatatatttttagtcccggttggtaacaccaactgggactaaagatagagcctttttagtcccggttggtaacaccaaccgggactaaagatagagctagattagctagatccggttgctccattattattttcttttcttcattgtgtttttaatatattgttatcactccatccccgtcccaaaatcccaaataaattatccccaaatcctcaaatccccgaatcggccatatccaaatacattacaaaatcttaaaaaaaattacatcacaactttgcaaaattcatcacactatatcacatattcacatctcacatatcacacaaatcaaatacatagatccgaatcataaattccaaaaaaacgcctactgccggccgtcggccgccggcacgccgcccgccgcgaggccaccaggcccgccgccgcgccgcccgcggacgcgccgccatgaggccgcccgggcctacgcccgccggcgtgccgctgcgaggcctccgcccacccaggccgacgcgctgcctggtcgcccgggtccgccccgccgcgccactgccccggctcatgggatgatgggggagggaaaggacgagaggagttagaggagaggaggaggaggaagagaaagagatgaggctagggagaagagataagggaggaagtgataaggctgcctgtctcgcagatgtctcgtactcttcacgcacatgccgatctacatcaaccgggactaaaaatagatctttagtccaaagataaaaaaagtagctataaacttttgaaccgagactaaagatatctttagtcccgatttttattgtaactgggactattgtggattttggctgaccgactaaagatggtttctccatcaatgttgggacttcctcccattggaggaatgccctagccatgcatgttgattttgttccaacaggcttcatttcttagctgggtttcgctgctgctgttctttcttctttggacggtttcgtgccggctgcggctagtaaggcagtaaaaaaccttgtaaaatgtttgacaaaattgttattcccattagagtgggtgcatatgccacgatactgagcttgtggcaagattgcatgagtgcccgtttaaatcatcatggagggcgacgatggtagaaacgaagggaataatacaatgttttcgcgtgtcgagtacacaacataaagaaagtggtaaatacggttgctcatgttcttcgtaatcagttcgatgatctctatcgcgtagttggagattgtgggctcccgctggaattatcgacttgttgaactgtaacactttattctatcgttaatatagtacttcatccgtttcatattataagactttctagcattgctcatattcatatatatgttaatgaatccagacatatatgtatacctagattcattaacatctatataaatatgggcaatgctagaaaatcttataacctgaaacggaggtagcactacataacatgatataggtatcagttcgcaagtgttcataggtaccaatttgacgacactaataaaagatatcaacatctatcagaaaaatagaacgggcacctttagatttgcatgagccaaaaaaaatgagagctggctcgaattgagccgaactcaccaaccatgcccccgccattgtcatcctgctagatcagtcttcatccgccgtcgtctctgtcgatcctggtctccggcgccaccatcattccctatcagatctgacggtggaaatgaagaggccgagggggagagggatcgcggcgtcatcactgctgttgccacaccgtgctgtcctcccgcctataacaccccggtaaccacgtacatagagtgctacaccaaaatacacttaaaaacactaactcctaaaattattagaaatttcagcagagtctcccctataaatacggacatccacaacagacagttataagattaatcaataacgaaataattcacacatttccataccatactagttccataaattctacataaaaaacgaaccagaacattaattgacctttacaagttctacgcaaaacttatgctaagcagaatcataatctaaaaccaaattttaatagtgcaataaaatgtgtaatccaagggtattacttcccgcccatgcatgccgatctcaatgtgtacctaaaatcaaataaacacaagagtgagtacagcaatactcaacaagtacatataaaactagaaagcacatacacacatgatttgaaataaagaatgagcagaaagttttctttctttgaaaagaaataacaaggttaaagaaaatagtagttcccatcccgggcatacatgaaatgacgaagtagtttctatcccagacagttatgaatacatcctagcatttgccggtaaagccaagtaagcgtcatcaatgcttacccacaggagcatgaataaaaaaatagatagcacatccatgactcgcatggaacatgaataattgaaaccggaaacaaagaacgagattgaaaccatattacacatctatggcaagcatggaacttaaattatttaaccaaaatcagaatcctgaatattcaaacaagaataacatcgtaaacacaagataaacttgaaatctaaatggtatgaacaacagcctaaacataagcagtcacatatcacatagaagtataacgaaataaatagataggacaaacaatctatgaatcatataattagttcgtcatacacttgcttttaaccttaacggtaacccaacaaaaccggctccacaccagatctctccgcacctgtgaagtaaagctataggtaaaacctctatcaaggaatcattgagactaacaatacatatccaaaacatcatgaaagatcaaaacctaaatttggtttttatctatcgacccgcacaagacaaactatactagtccataccctgttatgtatacatctttcaaaccacctaacgaaaaagtagcaaaggataccacttcggacatctacagaaaattatctacaactttcatgtttagcataaaaccagattaccctctatcatactcagattaacgaaaactagttgttgtaccagtttctgagccaataagcactactatttttagcgtttctcctgaaccatataccggaattgaacgaaaccagcgccattagaaaaatatcgacgatgactacaaatcttattcaggtcgccaaacttgaatctctatgaataattagcagaattgaaaatacggtttcagtctagcggccgataaaataaagtggagctgccggaaacggatcatcatatatataaattagaaacaactaggatctaaaacaaaatacctagcagtactagtttgtatgaaaaaaatgaatttggaaatattcaccaaattccctaatttttcccttcttctatcggaggcagaaaatagcatgagtgggggctaagaatctaccgcttagatagactaaggaagtaaaaagtgtaagggggcatttgtccccactcgctgtaaaattgagtaggggccaaggcccacgcttgttacactctagatccgccccctgcctatttccccttctctccctccttgttcttctcttcttccctggtgcagcaacaagcaacagcacccaatcagcaagcagcagtatctatcggcaagcaggcaaggataggcagcagtagcaagaggagaacgacgcagcagcagcatcaaacagaggagaaggggaaaaaggaatccaaacctaccactaggaataggagaaacacagcagcggcggcggcgacgacgaccggcgacgctcggcgataatggtgacgtccggcgatggtggcgccctaaacagaaaagacggctagggctgggatcgatccatctctttgccttttttttctgttggttatacaaagtctaggaaggagatcaatggcccacatcgattcaacccctggagcttcgttcggactccgattactacaaacttatagtctacttcgcactacatgatgagccctacgcatccacggttcctgatcgactattcgaacaacgatttaaaagttgaacttttgcgtgtttgttctaatatttctcgaaatacactaattcaaaactaggggtattacactgccatcaccgtgtcatgcgccatatcgtgcgccctctccctaccatcgacgcgctccaccatgcccctgccattgatgtgctgtgccggcgatgggggaaggcaagggggagaaagcagcgggcctgcgatgtgggagggtgagggtgagggggagaaagtgacgggccaccgatggggacggggttgtcactgatggttgatgggaagaaagcggtggtgatgagggtggggatgtcactgatggttaagggggagaaagcggcgggcaataggaggaggggggaaggaatgcgaggtgataggatttggaggagatgggcggccgcgatttctatgtgtggcgcgttaggattggctcgggtgccgcagttttaaaaaccaggacctattgtttattatggatgatccttttgttaaaaaaacggttgccatcttttatatagaatcggcactattatattatataagtacagatttcggttttttaaaaaaaactggcacctatatattggtgtcggtttttatttaaatttttcatcctataaagttacgaaatggtaatagctgccggttttaaataaaccggtacctatgagccggtacacataaggtgttttgtagtggtgatataagctctctctttatcctaaaaggaaaattttttattgccattgacatcgattcatttgagaaaattagaacaggtgattctacctcagaatacacagcatattgataacttctgtgatccgttgctgttattattaacagtttaaaatacccacgggactaaggctgtgtttgagaaaggggagatagagaagattgagaagatacgcaaaacgagatgagctattagtgcatgattaattgagtattaattattataaatttcaaaaatgaactaatatgattttttaaagcatctttcctatagaaatttttttaaaaaaacgcaccgtttaatagtttgagaaacgtgcacgcggaaaacgatgtgcaatctatctccaatctccccgaacgaacactgcctaacttcccttctgacatgtaattgcccgtctctttctccccccccccccccccttctgccaaatcctatcacctctgctacggacagatttggttcataaacttctctgtgcttttgcagcagtcgttacgcttccttttggagctttttgctcttgaaatcagccagatatgctagtacaatgggcttgacgtgttcttgacaaaataactccaaattgtcgtgtttatcaatatgcttttcgagtgtcacaaagaaaaaaaacattttgcattgggtatcatccaaccgatttggtgctccttatatataggatgcgtacaactgtgcaaggcgtgccgtgtgcacgactcttactatttggtattctggcggcaattaagaaacacgcaggcggtacaaaaccctggtgcaagaactgagctaaattcgacaattcgttcatattatttgaggacaaacagaaatatggaaccgagtgacattagaattactgtctctatgtcaaaatttagctacttagactgttcagattgttgtactaggtagctatcttttgaacgtaaggagtttatttttggaagtctgtatgtcatcatctctgaagcgttctcgccgtcattaactcggtggagccgtggagggtgcattagttctcataaaaaattaattcctctaagactgtgttcgctccagccagttcctgacctagacagtagtacggaaaacggagcagtccattagcacgtgattaattacatatttgttattttttttcaaaaatggattagtatgatttttttaagtaactttcgtataaaaactttttacaaaaaacgtactacgtactgttaaacagtttgaaaagcatgcgcgcagaaaacgaaatagaaaacgaaagtatggagttgggaaatagctcttgccaacaaaatcaacgctgcatcacatacactagaattctgcagctatcgaaattttggttgtatttcggaaaaacaatgttttcctaataaaagtggcaagtgtagctttctgaacaaaggctcatcaatcgattttgagaagaaaaggtgttacaaaatccaattctaaataaacatctgacttaattaaatgccaccacaagtataataggccacaatgtggtgggtggaaataggaaattgtggaagatgctaatttaaaaatacatcatcagtttgtcctgctaactgttccttttgttgtagcatgctagatttccttttcttctggatggtaagtatacatctaagcaagaactttacactttcagttaacatatttttctgaaagctgcccttgcgctacccatcactattcattagtgatgaccccgtacttgtaaatgaactccaagtgttctgctacacatagagctggtttctctcctcgtattttttttacatgaacttaatcttgctgtccaactttattctgtaactgtctctcaaactcaattatgtatctttctatctactaagtagaaacttcctagaaaatatgctaaagtttcctaaattaattaaatcacacctagaaaatagcatattgctagtgttacaaaagaatttttaaaaaagaacattatcattgatctgtttttgccaccgcgtcctatatatgtcaacattttaaaatttctgcatgtacttccctatatatgtcctttgatcccacactcgtctatttttttcataaaaaaagttagtagtatacttaattagtggcagacagaggtggttgattcatcactcattccacgccactactttttaaaactagtataagtaaaaaaaataatcctaacaatccaatacactagttggtgtattgtatagatgcctctaattcatacattgagtttcaattaaattttatttaaatctctacaatccgcactatggtaaaacaagaaaatacaatccaaacacaaggcacacacacgttagactactggtagtgagactataagatgatgacaataactgttctcgcgttgaagaaacactgcacatttatactacatcggtcgacaaatataagaatcttagtacagatacataactaaaaatatttatactagtttaggtgctgaaaaatcctttattttatgtcagaggtagtacatcatagatcaataaacagttaggatctattttccatcaaatattcaagatgaatcaatacaaacatattttagaaaaaaaatgaatttctgatgtacctatgctaaaaaatatcgaagcagttgtcattcaaacgttgcacatgctttatgaaaaatgaggttagttgttcatcaattccactaactacaacgtctaatcttttattcaaattaagaaagttaacctgaaaatattacatgccactaattaatccactttcagagccttcagaaattaattgttgctattcagttcacttttctattgcctccactttgttgccgtcttccgttccaccttggcccaagtacgcaacctcgtactcaaaggatccgctctccatataaataaaaaaaatgaaagaaaagtagaatctattcccataggaatacggaaggctacgccccggcatggatagtttgtatattcgactaatttgttttgttattcaaagtattgtttccaaagagtatttttcaaacaatttttcattaggcagctgaaatacataacaagatatagatgaaatacatatagttcatatatataatacacatactgttgtttgctaggttcaccctagaagctgcacatattttggctcctgggtccattgcggccaaaccagggaggtaagttgacccatgaaaattgacccatagggtggcatagtaagaccagaggtagtgcattaaaaaggccaataacccaacactacattcatattaatgcgattgtactccttcttcaatgaaattggccagaatatcattgatttggaaggtctagatgaacttcatgcaaaaattgtgaaaacctatgtgtcgacggggcttatccataaccatgacactatgtatcatcaattgtgaactaagacacctcggatcaccgaatacctcgtattcatcattttattgataatttcaacaatgtatcatcaaatgggggggtgctttgggtcacaaggtatctaacacacttagacaccttggggccccgagcacctcgtattctagaaattgcttatttcgtaagttttcttgtggttagttcattgattatcaaatcatcacaagatatgaggtgctcagggtccgaaagttgtttgcacgagtcagtacatatacttacagactaagacaccttcttcggtcctagagaacctcgtattctatctttttttcataatttgagatagtttacaaaaatatatatttagtaacttatttgtagttagttccttggttatgaagtcatcacaaaatgaaaggagctaaggatcctaagtttgtttggttggattagtgcatacagaaccttgtattctgttttttttttaacaatttgaggtagtttgccaaattatattatcataaaaaatgaacaatatatcatcaaaattcattattatgccttgtatctacttattacttactaaattgttccattcaattgttttatccccttttttaaatgacaagtcgccgttcttcttcaaaaagcattgtcttcgagtaatttgggtaagtttgtggtttcacgagcttagaagaaatttggtaagtttgtggcttcataggctcaaatgaaatgtgaggtagccatgtgcattggaaatatgtgattgtgaatgtaactttgtgtgggattttgaaatgaatgtttattatgttaattttgtgatgcatttgcgatgaattgggaaaaaaaactatgatatctgtgcatctgtttttttcataaggcatggctaataattcctgaggctaaccaaattttagattttttttaaaaacctaatcactaacgagtgaataaatacaccagtcatagatagcatcacctgtgacggcaatttgttaacagtgaaatttggtaagcccaaagttaccatcggtttaaaatcattatcggctgcagcatctcggaatcagccgatgggagttatcaagtcgccaatagtcggattcctgctatattcggttaaggaaatcaatctactaaaggaagcttatccctaagtgaccgagtttaaagagaatgtggcatggaagtttatctattaattaagaatagtttgttagtttccttttatctttaggaaagtgtctttagtgtcctataaggactttatcttttcctttttagtttctttcttatccgacaaggactagtatctccctatgggtataaataagtacacccggggacattgtaatctatcttcacgatcaatacaattcggcgcatcgccaccctttttacttctacttttgtttttacgttccggtgggacttggcacccgacgcggggctacatcgtcttcgatctccggcaaagggataagtccaatgttccgccggtccaggcaattgtatcgtctacgtcggcgtcgttcaaggctgcaacagtacattcgacctctcggattgcactggtttggatgatatatttgcctacctattttatcatatgtctctgttaatctagtcttagcatgtcaatttagctcaatcggctgcttctcgttttagggtttttgccggtatcggctaaatcgcgttgctagattagattagcttagacatctaccaccctaaaaactcagtcaatggcttgattgtctaggtattatgtttcttttcatacttagtgttgcatcagttaagtttgatctactaagtcgggattagaaccataatctctagcctgcttcttgattgccaataagggtttcatcggggtttcagccagtgagtaatctggatgttgcatcggctcataatgattgcatatacatataagttggatttagccgatgacaacaaaggtttcactatttaatctaatcttgtggatttcatgatatcggacctccagccgatgtgtactttaacctttgaatcgatgcttacttatcatatcattgctagccgattggtttatataggactatattgttattttattatatcatcatcagccgattgccattatatcattatctatattggatatatagccgattgcttcaaccctatcgctatcggctggtatcggcatcggctgttatcggctattggctgaaactactccatcggcttgtcagccgatcggctgttttgatctgctatttgcatatcttgtcagttgcaggatcaaactgactggcacgcccgcatctcatcatatttggacctgcactggagctaagcagatctcccaggccggtgtgttcgattttttcgtcaacataattgtatattagttcgtcagagaagattcacctgacacaggtgtggagtaagtttcccacctctaatgggacgcaaactttccgcccgtcagaggtgaccgctgacgagttgcaaaccatcttggtttggtggtattttgagggctatcagaggtggcagttacctctgcccgtcgaaagtgagtggagtcatcactaaccacccatgtctgatcagggccaatcccgtcagagatgagggtttaggtccatcatagttgacttgaccaggagtagtgccgaacgagtaaacgatgtactactaatatagatggccatgtgggctgcccaacacggcacggcccaggctcggccgtgcctgggccgaggcttttcgggccggcacggcccggccgacgcaccgggccgtgccgtgctggcccacgtgccgcactcacggcccaggcacggcccaacacgcctcgggccgtgccaggctggcccgaaggcacgatgggccgtcgtgcttttcctcagaataagtctaaatttcctccctcctattgggctgtgacatatgtatagctaaaaaagtctattttacctccctcttctttgggatgtggtatataaatagctagaataagtctatttaaggtccctattctttagatagtgacatttatatgtctattttttgtccctatactttgtgtaccgggcctggcctgctggcccatcgtgccgggccagcccagcgtgctgatggggaggcccaggaacggcctgacggtcgggccgtgccgtgcttgggccgggccaaaaaggcgtgccgtgggctgggccttcagacctcgggccttatggccaactataactactaagaattacatttgtggcatgcagaagttctttaccgagcccttagttatccctaaatatacgaaggacaaggcgagcatcctacatttaggattaatacatgactacagatttgattagattccatctttacataacgacattattctactaactaaaacgtaatcttgaagtaacgatatattttactaattaaaatgtaccgtgactaagcaacactacggtctatatatgggccattcctagcaggtgcacatcatctgcaggtaatcaggatactgcatctccatcatttatttttttttttggttacagaaaatcgaacctacattgtatataagctactctactgttacaagcatgacattttaacaaattctagtatgttttaaatacgattatgccggattgtttttatgctagttgaaaataaacaatattaatatgtataaatacgtatatgttacagtaagcacgcctctttctcaatcattgtataggaatgtttgtttatgtactaaatgtcttttatagctaccaccactgattgagttgggtcaggtcgaacttctctctatataactccttcactttggactcgtaaagctcacacaattgctacaattgtttgtagtcgatctccattcccccagtaattaggccacaaatcaaatctctcttgtgccctaataacctcctgttataattagccaattgatgatatacattagcatgactcttcactggtctcttctgctgttcattgccattgctttggtttcttcagttgctcaggctgctgttgtggagcacaccttcaatgtaattaagctgactcacactactcgtatatgtgcacgcaattccttccttcagtttgtcattttgttcatgcattagatgtatatatttaatttcatgtcattcgtttacatttatattcatgtgatattaggatgctaacattagttcatgcatgtgataatatcttgtcgttacactaatctatactttagtttatatctacttgttgtttaattaattactctctgtccaccgagctacgtacaggtacgtgccaaccgttcttttttcatttttagattagtagtacagaatactatacagtggtgtatcactcattcatattttcatatgcactattctaaaaaaaaaatttcatatgcactgacacatctgtagttacaaagtcatattttgtttacaagcaaatgcaaaatccttactgttaattactcaacaaatcaccactagctgatgaactaataaacagtaataattctagttagtagagtttttacaatgctccatttcatctgcaggttggcaacttctccatcagccaactttgccagccgccgctgatcatcaccgccgtcaatggccagctgcccggcccgacgatctacgctcgcgagggcgacacggtggtcgtacacctcgtcaacacctcgccatacagcatgaccctccactggtaaatattcaactcatcaaactcgtcacatcatcgatcgtttatgaaggtagtagaatattactagtcagggttttcaatttccatttcggctaaagtttcggccatttctctagaaccggtattttttcggccgaatctttctgaaattttttaaaaaataactgaatttgactaaattcacaaaaatttgagaaaagcctaaaattttggtcgagatattgacttgctggggatccgaaattatggaaatttcagacatttcgaaacttattaattattgcattaatgtaggcatggtgtgctccaacgtggcacgccgtgggcggacggtccggcgatggtgacgcagtgcccggtgcagcccggcggcaactacacgtaccggttcaacgtcgacgggcaggagggcacgctgtggtggcacgcccacgtctcgttccaccgcgccaccgtctacggcgcactcgtcatcaggccccgcggcggcgccaaggcctacccgttccccaagcccgacaaggagcacgtcgtcatcctcggcgagtggtggaacgccaccgtctacgacatggagcgcatggcgttcctcaccggcatcccggcgccccacgccgacgcctacaccatcaacggcaagcccggcgacttctacaactgctccgcccctaatcgtacgtcgacattgctgttggtgaaaagcttggcatgatcagccatggtgtttgacatggtgattgtgtttgcttgcttgcgcagagacggccaagttcgaggtgaggcagaacgggacgtacttgctccggatcatcaacgccgggatgaacacgccgc

SEQ ID NO: 70536 - DNA, 513 bp, Oryza sativa
tacatggtcataggcgtataaatccaggaagtttggcttatcatcagttacactatttaaaaagaaagattattgcaatgaaataccaaataagtggccattactcaccagggaggtgaagggtgagagtttggcgcccagggtttccgtttttctaagcacccagggaagatgagcaaaacaggtgcgacggaagcagaagaggcataggggggggggtgagattatggtgctggcttgctgcgtgaggaaggacggcaagcggggaaggagagcgaacagttggggcagggcaatgggatgggccttgctcatcagttgggctttttgcaatgatttggctatgctcatcaggataactcgacatctcactagggaccttctcatccaatggtttatacgcgatctcatccaccgattgaacgactgagaattagtgatgacgtggcacgctgaggttttagctttgagtcgtaactttatagaaagaagggatgtcaccatgcttattta

SEQ ID NO: 70537 - DNA, 3493 bp, Oryza sativa
aagtcatcatcaatgtgtgactgcgtatgaacatttgcaggagatggttcaaaatcggtgtgtgtccaataccaagttcttccaagcacaaaagctgtatgtaatctttgattagtactaatctgatgatccgagattctgaatcatcaaaccaaacctggtctaggtactactacacgtagtctttgtagggactaatatgtaattaaatttttatccagggtcatttatgaaacttcccacaactttttctcccttcatttatgacatccaacgccagcgcgagccgcgaatccgccgccggtgatccgccgacgagtcagcgccgcctcacgccggccgccggttcgttcgtccccggcggtgctggtcggagagagagagagagagagggatttccccttggctccgcgtcgatacgatccgagaggaggcggattcgggtcggatcggaggcgggtagggaaaaaaaacccgatccgcttaccctaccctcctcctccggtattttttcccctcacttccgcgactaattttcctcccttggtttggacacagattgagagcaagcagcgtggcgacgcccaaatcgcgcgattcgatcgaggcaaccctccccaattccctcaaatcccctatccgaaatccgccaattggccgcgtccgccacgccaagaggtgcgaatttctcgcttttggatttgggagggggctttccctctccctttattgatccgaatttagtgtgatttatgcctagtgattttggcgttcttgggcgtttgggggggggggggggatcgtttggttctgtatgcgggtgtggagttcgtggatcggggggtatgaaatggtaattccgagcgagtcttttgatttggtggactgtccttcgcttgcgacttggggggagaagaggcgcccgcgctaattggagggaggaattgcggatatgattgggggaattaatgtgaggatcatggtgtgcaattctactcgttagctcgaggataaggtgtgagtgtgtccgcttgttcttaggttgggggaaggtgtttgattttgattccaccaattcacactttctgtttatccaagtgaaggatagtagggggggagaaaaactgtatttgcaaagtaggagtaagttttttcagaatattgtactaagttttagctttgatcggttggttgctgtgaggatgggagatggaaaaaaaaaagtgttggccatgctatgtttctcgagtaataagagatatagtgaaaaaacgatgatcagttgggtcttctgctgccttctccctttctctttgatataaaagttgcatactaaggcgttatagaatgctacagaatgtggtatattgttttgctataccccacagcaaggatatttgttacacaagacaagtttgcttggacttaaagttatcattggtcttattgttatcgggaaggatatttctttgatattttggctttcctgttgtagaaaaagcaactttattaacttcaatttgtataacactagatgttatagaaagcatacacaccaaaggaaatgaatgaaaaataaaagatgatatcctttaaaatgcttccaaactaggcacatacaatggtcttgagttccattaataatccatacttctgtttcatatatgtatgcatgcttttttccagaataaaggaaaacatcggcgtatcaacaagtgaagctgcattttcttagagctcagatgaagcggcctcgaaggcgtctgtggtgggatgactgatgagggatgatagtgacattgatgaacttgttacgggcatgctggagaccatcatccaaccagcatgcccgggcaggctcagatgttgccggcaggcaggatggacttctatggtacaaggacactggtcagcatgtaaatggggaattctctatggctgtggtccaggccaacaacttacttgaggatcagtgccagattgaatcgggtccattgagctttcttgactctggtccatacggaactttcgtcggggtttatgatggacatggtggcccagagacggcttgctatatcaacgatcacctattccaccatctgaaaagtaattgatactgacagtatgcactagtgttgttttgcactacttccatactgtgttttagagcaattccatgaccatttcattcttccatggcttatattgcagggtttgcatctgaacagaattcgatatctgctgatgtgctgaagaaagcatatgaagctacagaagatgggttcttctctgttgtcaccaagcaatggcctgtgaagcctcaaatagctgctgttggctcgtgctgcctggttggtgtaatctgtggtggcattctttatgttgctaatgttggggattcccgtgttgttttaggcagacatgtcaaagccacgggagaagttctggctgtccaactctcagcagagcataacgtaagcattgagtcagtgagaaaagaattgcagtcaatgcacccggaagataggcatattgttgttctcaagcacaacgtttggcgtgtaaaaggtctaattcaggtgagttctctatcactatgaacacagttttgctttgaagaagtttgattgaaggatcatttcatattgcctcctgcatctgccattattcccatcatcaccttccggatggtaatcggcttattaaactcatctgcatttgtaatgttaagacaaaaccaagtagattcgaggtggttacaccattggaaataaatgcaataaagtcttcttctgctcatggatgagagatgtcatctgtgattgatgattgtgatatcactcctatattttgtgccagtgaggagcttgagaataatcgaaggttttgcattgtctgttgtttaattgcatgttcatctacttaattgagagattttttttttcgtggtacagatagctgctggttgaagaaatactttgtttgctatttatctgttaggttcatgccatccctcaaataaccatttgttagtgaaaaacattttatgaatatccctccaatctccactcttcagagcttgatacacccttcactaggctaccatgataaggcatccaaatgtttgatgagtttttattgtacagtttacaaatctggcaatacttgctgctttatttatgtttcttccaaggtctaagtgaagattgttgggttttcctttaatttgttatatattttgcaggtctgcagatcaattggtgatgcctatctcaaaagatcagagttcaaccgggaacctttgtatgcaaaattccgcctccgggaaccttttcacaagcccatactagttcagaaccatcgattagtgtgcaacccctacaaccacatgatcaatttctcatatttgcatctgatggtctatgggagcacttaaccaatcaagaggccgttgacattgttcacagtagccctcgcaatgtaagtgcttgct

SEQ ID NO: 70538 - DNA, 939 bp, Oryza sativa
aatgtgatgattgttagtggatgatgatgtggcatcttgttaattagtgaatgatgatgtggcatcttgtcagtggatgatgatgtggcatctttgcatgttaagcttaaggagttagtgggggataactttatagtaagacaggatgcctatcgagccatcgcgaacctgagcggcctacctctatgctcgggtcaccgacatgtgggacccacttgtcagctccatctccttccgacctgtccgtcccatctatctactctactagcttgccatcattcatggcggacatgcgccggtttcttctcgctggtagcgcattgaagcctctccgcaggtaacaaagatgctactagatggatttcttgattgccgatcgaatctctatccttcccgatcgattcgagtcgggttcaaaatatgataaaccctatcccttgttaagttgttgttacactctgtccaggtttctcccttccccgtctctcctctactgctactgctaacctgcgtctccctcgctccccctgcagcgtatggaatggagtatccgacgaccaccaaggtgaggaggttggagcaccaccgcagtgtcagcgactcactcaggccgccgccatctttccagatacaagacctccctgaggtaaaactctaaattggggcgccgggggagacgatctggcacaggcgtggtgtccgtcagggggatcctatctcccctatgatcttcatcctcgccatggattctctgagctccctctttgttaaggtagaagagttggggctcctccagccgctggggatccctcactgggtctccctctatgctgatgacgtggtcgctttcgtcaggccgacggttgccgatttggaggccgccacaacagtgccgcgcatctttggcgaagcttccggtctccacacgaacttcaacaa

SEQ ID NO: 70539 - DNA, 2811 bp, Oryza sativa
aattacatagggctcgggtctatttatactcgagaattacaagatatgtccataccggacacgactattatctctaacaaactctaagataccataagtctttgcggcagacttttgcccaagcatatctctaaggaaattacataaaatatcataattaatagatacaattgccttctctggactctatgcatgtgcggcaatcatcttgaagcacctcaattcaacccgatgtcatacaccaagttgtattgtcggaatcggccgcatcggcttacctagtccgactcagacccagccaatcctaatcgtagccgatctggactccagccgattcctgctctattcttgaattcgatctccgcctttgacttcacttcgatctaatcttctttcccgatgccgatattaccaaatttggttgttaacacatgccccccaagtccggaatattttgtaatgtttcggatttgctgtaaatcgactccgagcaagtttcgcactttgccattttctgaccgttactgtcgtgctttaaatactaaccgttaccctcgagaagtctcacaccgtcctcctccgttttcaccgctgaaaccaactttgttctcactctctccggcgatccccccgacgcacaaggctatccccaggcgattttgtttctgatcagatctccgcctgcggcgatgtcgtcttccaccagcccgtctactgcgccatcggctgagtacgctgaggtaagttctcaccggctagatcccttttcctcgcatgacatcgatttctccttttcttatcatgttttctgcttcccggttcctttggatttgcagcacctttccaacctagtcgcgattcccagcctatcgcacaaaaaccactattttcttggcccaatcggcaatcttgaccccactgatttcatcatcggtgaaaccaacagaatcccctttagactagccaaccctaacctgggtcactggaagaataccttcaagtcttggccatctctcgaaaaacttaccccctgataagagctggaccacctggtacctacgcgtatcggctagtaagaaagttcactgggatgagattgggatcggccaagcgcttgctctcaccatagccaattctgctaaggatgaacctctgatggctgccgccacctatttctggtccaacaccatcaatgccttcttattcaaccaagggccgatgactccaactttgatcgacatcatcatgattactggattagatgtaacttcatcggctaaccctatgagtatgaacaccaagaacctatttgacttcaagaccaaaagcataggagggtggtctggttatgtagcggcatacatgggcaaagggcctgtcactcctcgggagcacgtagctttcttgctaatgtggctagaaaagtttctcttctgtggatccagctgtggtcccacaaccaattggcaatttgtagccgaagccttagaatcaaagaaataattccccttgggaaaaatccttctcggctatctataccaaatgttgaacaatgcatcggctaaaatagccgtaggctcaatagttggagcaggtggatcatggtggctgctgcagacttggttaaacctgatagtcatgaaggttgtcaatcgaccctctgtgacagaagctgaattaccattgccagagccgattgtaggagacgatggagaagaacgcactcatcgcagatgcacatcatacggagaatatgcatccacaccaaccgatgctggagcgaagctatcggctgagctgctcaaggactggttctgcagcttctacgaaggttttaagaaagatgcacggatctggtttccttatgaagacttagtaaatcttgaacttccatcagactttagatttgaagacattaatcatgaaaaattccaaaaatccagagaagttcttatagctgcaatcagcccatgcatccttcctatcggtattcaccaagggagaaacatccaagtctcctacgagttttatcacccaatgagctcggccagacaacttggattgggccaactcccaatcggcttattatttgccgacaagattcagtgccgaggaaaaatcacatccactctaatgatggatcggctacttaacctaccaggaccacctctgagcagcattgataatattgagttggcaggatttagaagcaaaaactttgacagatggtggggtgtatggaagctgcatctatttcatcaatcggcctcaatgtacatgacagatctattccctgatgtcataccctaggtaaactttgtcattactaaattgcataatggttaaccgattcattccttgactaatcttttgctcctattctgcagacaacagagtcctcccctccacatcaaagtaatagtggcaggaacattgaatatgctacaggtctaattccgaatggaggtggactatctccctgcgttatcggctaccatgcccccaagacttcaactctccttcacgacctaaccagggaaccagccgatgcaggcaagaaaaggaaaaccagatcatcggccgtgagtaccttggccttagctccaaacaaaaaggccaaattcaagaaaactaaaccgactgataagccgactaatgatctgcccgccttggatccatctattgaacaagctctagatgaagaggaaattggtgaagatgttgaccaggctgtagccgaaatgagtgacacagaaagaacaccatcggcttcacccaagcaaacgcctccaactccttctgcccccgttc

SEQ ID NO: 70540 - DNA, 12217 bp, Oryza sativa
  unsure (1)..(12217): unsure at all n locations
aaggaaagcgcgtcccagcgtccagccaaggggtcgtaggcggcaaacgagacgccggcgtcggcatccgcgtcgtcgaggagcgcgtacagagacaaaaacggcgggaacgacggcgcgtacatgagccgtctccacggccggcaaacggcgtgcaggagtcgcggcgggagcggcgagaggcaaaactgcgccaggtggtccggcaacccggggagcaacggctgcggcggcgtggtggtcgtcatcgtcggcgggggggcggcgccaccgcctcctattccatgccgccgtccatgggagcagcagctggtagcgaagggcggagccgcttgtgattctggccggagaagaaagtgatcgccgtcgtggtcgtcgtcggcggcggcggcttgcagtaggggcgcttagccgcggccatcatggtcgcaatactactatatcagaggaggaacccgagttgcttcagcgagcacggcggtagcaggagcagtattatattgggggcgaacgcatgtgcgtaggcgaggtggtacaattaatccggaaaggttggggggtgcagtgcaggggagggggaaggcttgaccacctcccccatacggccatagatatgggaacatgagaggagaggtcactggtcagcttgtgtttgtgtggtgctaagcgaagctaacacagcagcaacatgtatgtacagccaggctgcaacgcgggtagccgcgacgttgggtcgccgttgcctccacacaatgtacagagcacagctgcacaggcccatgcggctagcttttaggcacgtacgtgtacacatgcatcaggggactcaggatcactcatcgaactagctggaaattattatagcgttggtcgtcgttgcaaaaagcaaaagaaaacgaggattttttttccgtgaacgcttaaaagaattacatgttaatatattataaaaaaaatctgttgcaaaacgcaatcagccagattggcttttgccaagggaagagaaaaaaacacaaccaagaaaaagggaagagaatactatgacagctaaacgcaactctaatcagttgggagagagacagagtcacactatactcccaagaaatttctaaaagaagcaacgccaactaacgaccacagatgacccttcgagagaatggactctacaaccactgagaccgaagagagcgcagagtcgaagagcctagaggaagaacatttagtattacctttcttccaaaatatatttttttatattataaatctaagatacatatagttgtttagatttatagttagatataattatattctgggatggagggggtagtacttgttagttttagttttcactatttacgtctacaatgcgagatcgagacattcagctgtgattaagtcatctatatctataaatataagtattttctagcatccaaaatttatttataaattcaaatatttctctattactattttcccagtccaacatctcccaataattccatgtatttattgatgtgtccctgagcatgatcacttctaggcaggcaaacttctatgagcatcaaagtgatttcacttttaaccttagtgcagaggaaccttatattgattgatggatagaggaagtgcgtcattagtgcagactgcaacaaaattaacccgtacgtcagctgtgattaacaaattaaggataacaaagctagtgcacaactgtgcaatgatggatccactttatgacaacataaaacgaactacacgtcagttaacttgcgtggtcaccatccaccagaaaggaagaaaaaaaatgctgtaaaacgatcgagttgacgaactctagctagcagctggtacacatatacaatctcatttggctgctgctgatgctttttcattctgtgactcaaaagctgcacgatcgggatctcccctgtatcttctcttctgctcttgcactttggacctctcgttgtgctatcatcatacagcaaattttcaacgctgggaaagtactattagaattctatgagtctgatttctttgacaaattacacacttacctacgactcgagattgcaatgcaggtgcagaaagatttttggagaaatcataccttgagaaaacgggcatgaataatttgcatataatctatcagctataataatcttataatctaaaaggaatgaatgaattatagtagaacaggccgctgactggcatataatcataacaatcttgggatcattttaggccaaaaataattggcaggccaccctttggaatttggaaaagaattcacggtaaagcataggaacacaatctgattcgacatatctgagttgggatattcgatggtggagcagatcccattcaaagcaactttctgctctctgaatttggacattcacattctttcctccttttgtttttcccttctcgtttgatatatacggctccctccatccctttattttttaaaaaataaaataaaatttgtgctacaaaaattggcactctaaagtacttgtctcatcaattatctctcattcatatttctcctaaccccatccttaccacatgtcatttaataaaatgttttatattatttctcatgaaactttaatctatgataaccaatttaaaacggtaaccttttagactgggagagtatactatctactcctccctcagtttaatacaacgaatcaagctcaggtatgtgaaatggtcgggtgtgtttagcgattacacatagactttttagttaatcacacatagacttttccgccggccgacggagggacgatgagaattgatggatgatgtatgtgcgaaaaagtagggagcaaccagccaaccgacgaaccaatgggggaggagtcaatgtgtaaaggcagggatatgcatacacttgcaaatcagatcagatcagatcagattgattattgcctgctcctttttggatgctactgtagcaaacctaccagcaaaaaacccaatacctccatttatggaagaggagtacacttgccttttcaagtatttggacttttgcactgttgctttgcctgcaatttgcaaaaaagcttttgtttgattatgggttgtggcacaggcactaaacatcctcaaatatagtgctactccttttgatttaaatctgtagataatactaggtcggcatggttcaaacttatggaatcatgatgccactgaaattttttttggatggaagttgtaaaagttgaaactttatcagtggtgtatgagcaaagagatgtttcagtggtatctttcggaatggttgtaccagtccaattttctctttgctttgcccttatcaagttgatcggagcgaaattatgctcaaacatattataggctatattttaaggccatgtttagatcccaccctaaaatttttcaccctgtcacatcgaacgttcaaacacctgcattaagtattaaatataggcttaaaaaataactaattgcatagattgtgactaatttgtgagacgaatattttaagcctaattgctccatgatttgataatgtgatgctacagtaaacatttgctaatgatagattaattaagcttaataaattcgtctcgcggtttactgacggattctgtaattagtttttttattagtgcccgaacatcccatacgacaccctatataatatccgatgtgacacgccaaaactttacaccactggatctaaacatcccctaagctaaaaaaattcactcgaaacaattcagtttatttttggttgaataaatatcaactttctatgtactgtatcatttaggtaaacagctcttttgaagaaatgaatagcaaccagatatctcaggataggaaacagatcccctgactttgtgcagtttgcagttgtgccactgacatgtgagggcataactgcaaactgcacaaagttaggggatcctcattcctcaggataggagggccatgacgtacggtacagaaagcacagctggaaatggcatgaaaaacattgggaaaaaaaagagagaatggcatacgtgaggcattatgggatagagagagaaagagatggaagaggacgacaagttgttttggccatttgctcaattgctccaaatttttttttttttttgcgtgttgttggttattgaattgaatatttgaatggtgcgtgtagacgtacgtagtgggcaggccactagcagacggtcacatgcgtacattgcgtcaccgcggaaaaggcaccgttcgtccgcatttttcaaactacatatacgtacatcagagttagctaggagtatttgccgactacattcacctcagttatttccgggttttcttattttttgtcttggttttctttaatcattgggggccatgggcgaaggacacgctgaacgcttttaagaagattgctaaatttcgaatgattaaaattgctagaaattctagtcatatttattttatttatttatcttatttaacataaagctagctgaaaggatagctagatttgcacataagcccctaaaaaatgggtacgttataacttgagaacaaaataagcagataaggactacaaaagataagaaaaaagcaatcagggtcttagtcttgcttcttcctctgcatcggttcctcgatcgatgacaacaacgacaacaagtttgcaagaaccatggcaaactgcagaatgtattgccaaatagaaaacccaggtggggcatcttggagatggagattacagttgccttagcaccatataagagcgcttcagttgctgcttcaagacctgtcgcgggagacaaagaagaggaccgaagacaacaggaagatcgccgaagaaagagaggacgttcggcgctacctgttagatgttgggattgaggatgaagccacccacccaaacaaatcaactgctcatttagttgctgacatcttggagggacccaacaaatcacagacaagacgacctcactggaaagaagcctagcaagtacctccatggccagagttgttgagacaagggagatcggatgccgatgacctccttgcattgcacaagagtagaaacatgatgtactcgaaaaagggaaaagcctgactaaacctaggactacctagtagagaagaaatgttgatccctccccctctcttcattggcagcgaaccaccaaattggaggtggaagagggagaggagaggattttgtttatctgcagttgcctggtttcgcgagagctctctcgaaccctcaaattttagtcatctttagcctactaattctctttgggagcggactggagggagagggacaaggggaggctgggacttaccagcggtggtgacaacagtcttcttctatggcgacgagagggaaactagtgagacctagtggctagcagcattgtcggtaaccaactaccctaaattcgattcctcccttctaaaaatatattcgggggatgtctctcccctcgaatctcttttttttccctagcaacagtgagctccttctcttttctagcgcgctgatgacacgccaactctattggagaacatatgaataagggtttagagttggggttaggatgaatggggtgttggtaaaggaggagagtggtttcagcaggcttagaattgatggccgtggtcagcggtggacagcggccacatgtagggcacaaaggtcgagtgggcattaccggatccaccaggttgtaagaagacgcgacgtggatgctaaatatgaagtggataagcagcatgggtgcaagagaagatgtatgataagatggggggcactttgtctaatgcctggcttgcgaaggagaatagggcgggatgaatagaatgacgactgggttgcccttgccagcactagtggcgcggcggggcacaaaaacttcaatatatgtttttttggtttcaattttaacccaacttttatgacatatttgtccacacaaacctgaaaaatttcataaccaacataccctcctaattgctacttacaatactacacaaataggagtattcctgggggcagaatgatcacaattaaatccagtaaaagatctactactactcctagttgggtagttttgtgtggttttagtagtaaaggtagggggagaacttgtatggaggaaaagagctgcatggccattgggggagcaacaccaacaccaacatgttgtcaagttggttgttggtccgatggatcctactggtatggtacagctgcccacgcgctcgagagcgatccaaagaaaagaaaacagaaaacagtcggtgtgattgtgatttttttcccctttttttttgggtttaaataattcagtggtatttaagaggttgctgtgcgtccaaaaggtagcttttggcctttatgcacgcccaggggccatcacgccaccactcatctgattgcgattggttttgtgttatttatattagcctaaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctctgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaacaaacacattcacacacacacacccatgcatgcttaattaatactccattaatcttgtttgtttaatttagtcgatgtgcaacagtccatggaacgccttttcgcccggattcgttggcacatggctgctgcctcctgctgttcgatcctgcttccttcgtatcgtacgatcgcatctcttcgtttttatctttttaataaaatttatttaagtggaattaaatttgtaaaaaaaatagtaatattatcaaattagatttattaaatgtaagattgatacattttgataatatgtttattttgtatcaaaagtgttgatattttttataaagttgattcactaggaaaaaaatcaaaacagaaggagtagtaaaaacatattccctccctccgataaaaaactatctagtattagatagtacgttttctggtgcaacgaatttggacaggttcaaaaaaaatgtttcatccaatttcagattagttttttttttttagaaacggaggaagtacacagtatggtacactgtatatggatccaagacagcttgcagagttgttgcagctgaaacgtcgccaccaagtctcacgtgctataaataatcaaaaccactaggggcatgatatgaattatggaatggaagcatttgcttttctaggtaaccatttgttgtacggcactagcacaattttattttgggtttttggtttatgttgagcgataaaaactttaacagccaattggatgtcctatttgatttacattattgagagaactattgttgcaaagtactatccatttaatctagtaaaaaatgaatttaacaagtggtctaagcaaaacatcataagagcattttttttacaaaaaaaaacatatattttttaagtatagagaaataatccattgatagattcagattaaacagttttccacaatcaaataaatagttgtatgtaggtgtcgtggaagattctgatggtcgggacgtgagcgacgatcctgtggaggagaaaggaagaaggatcatgattatgggagtttaattagcagcgttgacgataccgacgtgttcttcaatcaaaccaatgaggtgggcttaatcaattcgctagccaaccctattttgacgatcatgttgatccaggttattcgtacgtagattttcctgaagcttccccagattaagtgtgggggcaaatcagtctcaaacatgtcaagatcaaacaatgcaaatttaatttcctcgagcgaatccgacttgaaatttgactgtgttcttgtcccaaattaaaaggaataagaagacggtttcttaactctaatcaaattctgatgatgaaactagacatgatgatcatgttcagatttatcctcaggatttgaattattattattgttttttataaaaggagtacattgtagagaagggatagaaatgaaactgaaaaattatttttttcctttaaaaataaacaaaagggaaaaaaggcagatctttcggggatgaggaccatgtggatgaatgtgacgatgttggtcatgaggcttatcaccttttttatcatgacaggatacccgaaagaaacagctaattagctagcaaatcgatgcggtcctgtccccagaacatgccaaaattagcttttcggcaacttgccccacatgtcaaacagttgatgagctaggcgtacttaacaagttaaccactaattaataattaggcagatgtgtttgaccaatcatatatttgtttgcctttttttttgggagcatgtacatcatcacctcctatcttgtttgagagattaattagtagtcaaagctcaatggtctgcttaatttgtttggaaccacggtgctatatatgcctgctgctgtaaaaaacagcctgcaaaaagtctgatgtgcttggtaactccatcatacatattgtgtgggcgcgtgcttttttttttctagatagcatgcgttaagctgaaagctagaatatttgtttgtcatcagatgattaagagccaaacgcataaacaaatattgaaaaattatcagtaaagcaagattaccatgattcaattcactgcaatgtcaaaattaaagaaagtcaagcatacagaattcattttctgccatctcctaagctcagggaacttaattagagaacagctaccctgtgccatcaacaacctcaactattgacaagctaggggaatgctgtttgtatatgccaacacacacacaaccaagctaaagacccgtgtgttgcaacgggtattgtaaaaccaaaaaacaaaaacaaaaatgacaagtttaatttatagcatagttagttggttagtcatataatgccatatccaaagaaaaagctatatgggccactttggattgatgccaaaatgtgtcatgccaattttttggtagtttgaatagtaaatatgatggtttggtttgaagccaaatgaatggtaatgaccatgcttaatttggtacaattctagaactttcttcaccataatataaaatttggcttccaattggtattaatccaaacacattacctagtattctaccctaccaaaatattggtagtgccaaaatatgcctaggttttggcactaccaatgttttggtatggccctaaaccaaacaagcactataattacaagtttatagcatagttaattgattagatactacacatcagctcgtggcattgaaggcagactcgtacaccacaccactagtatcatttaaaatagaatagataagtacatgcgcggatgcgcctagctagaacctaggtaccatatattagctgttatataaacgatgccggccgcatatgctattaacaaatgcagcccatgatcgtaatgctcaacaaacaaacaacaaaaacggtccaccactccacattatttgcaagggatgattcagtgaagaaaacctgaaagatcaccagtgctagggttatcaaaactgagtggtttcgtaaaatccgcctggttttttgaaaccattgttggtcagtttgtagaaaccggatggtaagttatcagtttttacaagttttcggttagatttcggtaaactgattaggagaggtttttaattaaaaatcaaaaggtaaaccctgagtagtgctgattgatcagtcaatccacaaacaatataatgtgcaggccggccagaccatgcatagataggggggatttgtaattataacactgcaaacattaatctttgctataatgataggataatagtagtgttattatatcgtaaatcctggccggccaacaaataaattcgtcgtgatgcatggtgcattcaccctgtacgccacagtgctggtaattacaccatgcacgccacagtgcatatatattcacaggcctgtttgaaacagaattttacacaatttttttacgcgttgtttacttgattaacgtgataaatcaataaatagtataaccaatagaatataataattttttcaagaactgcggaacaaataatccgtggcaaaaatgaaaaaaaaggtttaaaggaacaggagcttaaagcgacattttctctgaactccccttgtccatattggccggcgtctcactatcatgtcgcacgaatagctcattatcataccattatctaaaaaggtgataatattattgtggggctattcgatatggctagatggctgcctgcaaatacagtaacaaacatacaatctctacggtaaccgctgcagcaacagcgttggagagcactgcagttgggtaaccgaacaccccgtatgtaatgtgttaccggctttagtcctttaaatctcttttcacgggtttttgtgctagtttttttttcttgttgtacctcccgctttcggcgtacgttgcattgtgtatcttaaattctgttttcttctaatatattgatatgtaattttttttcgtgtttacgaaaggtatgtaatgtggatcatgtacaaaaggtacatgtcaatcaattttggcctgctctgtatgggccagcccataggagaagaagacgactagtatgtttgggcctttcggacggcctagttgccaacctgcatctgcaccggcaaggctggcccgctgcacaggcaggagcgggcttaagaattcaacaaaataaggccgggctaaatatctcattgtccaaaaggcccaataataagaaaaagaaaaaggaaaagaaagagcgcctccctcccatgtcggccatggacagaatcctgcaattccagatgtgtgctgcagaaagccggccggccaacatgcatcatgccatcatccagctgagttggcagatgttaactgcacgtggccacctaagcctgccacgtcgggtcccacatggtagtaagtagtaacactaacatacacataatctttgtgctcctttcaaacgcaatattctcaaaccatagtggccattcagattatagccaaaataaatcttaccaaatttttgtaagatttattatatatttactaaagtttggtacttcttttgtcctaaaatgttgctacctatgatgggatttgacctatcataggacaacgaatctagacagagcttcgttgtcctaggatgacccatcctaggtagcaacattttgggacggatgaagtaagaaactaaatggatgcacatatttggcaactctataaaaaaataatatggtttgaaatggcatcaatttgaacaagcctatagaaataagaaaagcgggattcaaatgtcattgaaccttgaagatacagaaaaactacatagacaaccgtttggatgaagtacaggaaaaacacagtatgtagaagagagagaaaaaaatccaaagcaaaaaaaggaattccattaaacatgtcattccaaagcaattttagggatataatcctttcttccagaggtcctcatatgaattgctcccataggattcaaatttttcctgtagaattcatctatttgtcctttgtttcaaaggagacttatgtacaagctgcgcggcgccactgtcaatccatctaaaatgcaaaaatgctccctcatcagtctccctgtaagtattttaccctcacctaccagtaacaatgcacgctttgcttaatcagcatcagaccgatcatggcaacgggaatccgagaagaatgctgacacaaaggtcccatttatttgggcatactactgttcttctgcgagggattattcagagatttaatctaaaatttagataaggncgtcggaagcgagtagcattcaaatnnncaccac

SEQ ID NO: 70541 - DNA, 7856 bp, Oryza sativa
  unsure (1)..(7856): unsure at all n locations
ttgcagcggtagagctcgaggatgctggccatggcggcctcccgctccccggtgcactccccggtctcctcgtcatccgcgtcaagctccttcaccgcgaacacatgttccgacgaggaggagctcgcctcgggcgcgggagacgaacacctcgtgcgcgtgcgcgtgcatcgcggcgtccatgtggggcggaagagccatgagcgccgaccgcccgtctgcccgtccccgcgccgccatgagcgcccatccgcgccgtttgcgtcgaccgctcgcatgcccacccctgcccaccgcccgtcccgcgccgccgctgccgcttgacccgcgcgcccctgccgaccacctgccgtctgcaccgccgctgccgcttgcctccgccaccagcgagagagaggatgagtgagagagagaggagagagagatgagagactatgacaggtgggtcccacatttttttaataaataaaatgctgactggactgccacgtgtacgccacgtagaccaaaaccaccgcggattgggtcgaggggggtaattcgtccggtttgcatagttgagggtgaagaatgcccggttttatggttcaggggggtaattcggacgaccgtgatagttccgggggtaattcgtactttttttgtggttcaggggggtaattcggacgaccgtgatggagtatttcagttcactgcaacattagatctatacatagtgaaacattgtgaatgcactagatgaaacatttttttttgaaaaaaaaccaaatttccttaatagaggatttccaaaatatgtgggttttttttttgcaatagagctgtttgtgtgtggacacgtggtgggctaggtggagcgcaggcatgcgcgcacgcgcgggggggggggggaagcgcccgaattttcctcccccgcccggtggcccgaacggaatcattatccatgttttcttatttatgtttcgcaacaggatcttaaattcttaggcatagggtagtgacggtacttctacattcagttcgtcgaagaattggcatagaatttgcaattttcaagatttcggagaggaattgaacttttgctcaagttctttgggagttttggacctggatcctttattttcgcatatataggtggtgttcttttcttccgaagatgaagactaagttttttacacaaaacgaggtggtattaacgtatgattgattaagttttaattattacaaacttgaaaattagattaatatgatattttagagcaactttcatatagaaagttttcgcacgaaacgctgtttagcagtttgaaaaacgtgccacagaaattttaattttcattcaacttttgttagagaaaagaacaacttttgctagagaaaagaacagaaccatatagtctactgtttttttacaccaaccatagagtctcctcttgctagactttgagctgaacgccatccgactactccgcaatccgggggggggggagatggtgacacgtgggctctactgtttgttttgtcgcgtagacaccacgtcgattttgctatatatttgtcgacaaatttttcccctaaaatttgacagatataattacagtacaatcgtagtgtaattacactgtaacttgcatgtaattacactgtaactatagtgtaacttgtatgtaatttttaaaaatctctccgtaacatgttatttcggtaaaatggaggtcgtgggaacaaattctttcatatatgtatgtgctatgatttgttttcttcctcaccaaaacaaatcttgtaatagatctaacgattcaaaattatgtgaaacttacatataagttacgctgtagttacacgcaagtcacaatctaattacactacgattgtgctataattacatttgtcaaatttttgaggaaaaatttatcgacaaatgtataggcagtcccaaaatctctctcaaaacggtgtggggaggtaaattgattcgctgtgctcgattttgccaattagagacgaaaatcaaactcagccaatggttgagggatccgaaataaacttttttccttctgtaggagttgatcgttggaccaaagagaaagtatcttaggcctttgaactaactcctgggtctcatgggctggctgcgatgcggaatgcatgggccttgggaaatgggtgggccaatgtctcttcggcccggtttgaagcccaccacaccaccttatcttgccgacgccgcatcgtcttctcaatccccaattcgcacgcggagctaattctcttctagggttccgacgaatcccgagctcggaggccgatggcgtcgtcgtcgtcggcggcgtctgggaagtcgcggccggagtgcatcaactcgtcgaacccgttccacgagtgctccgactactgccttcgcaagatcgccgaggccaatgagcgcatcgaggacgagcagcggcccccggtggaccgcaccgtccaccccgactgtatcaacgccttcaacccctaccacgtctgctccgagtactgcttcaagaggatcgccgacgccaaatcaggtgctagccccgcctcctcctctcgcttctgtacgtattttctgatcggagcaatttgcgccatgggtgatgtccatgaatccatactatagtggtaattctaattcgaggctaggagtaattcgattcgtcctgagcctgtattgggtgcttatggagtgattcattggcttcgatttagggttggagcgtgcggagcaagaaccgccttctgcagacgctggcaaatccgacgctgcccaagctgagggtggtggtggtgatgatgatgcggagcaggaggacgccggctcagacgacggttacccgcagatgacagagaagcagaagaagctatttgagttgcggctgaagatggtgcggtcatcggcaattccattgttttgtcatagctgttgtctgtgcagtcttgggtattcatctctttgctgtttctcgtgctgcagaatgaagctaggaaggcaaatcagcaagcgatggtggcagagaagaagaggatggagcctcgcgctgagagtagaggtgtttctaaacaaaagtggctggaagacagaaaaaagaagatcggaaagcttcttgactcaaatggcctggacatgacaaagtcttacatgctcgatacacaggagtcggccgaagcaaaatacaagaagtgggaaaaggaacctgcaccatatggttgggatggtgagttccatctctcgaatttcttcattcaatttatattcagaggcatattctgtagctttggtgaatttcgacacatccgtattcatattgctgtctctcatggccggttgtcgttgtggtgtttattatacgtgttttaagctaattccaaatgaattttctgaagttacttgaataattgtttgtcagtttgttacctagtagtatatggcatgttgttcctttcccatcagggtctaggttgtcatatcagtttctttgttttataagtttaacctgtgctttgcaaactttaccaacatatgtttctgtttttcctgcatttaaatattaaacctgcaagtgtaaattactgatgttcttaaacaagattatatgttatatatgctcttgacaaatgctccctataatttttgcgtctagccttcagcaatgcaacatctggttagcatttcttgttacatagtgcattgaatgtctggcaccatgagatgtctacttacatgattctttatatctggaaatccctgatgcttatgttatagtcagaaatcagaaagcatcaaggtagccgccataggcccatggttatagcttgttgtttgaaacaatttgagtttggccatgaactccctttgatctttttaatttaaacctcgtacctctatataaatgggggtgttctcacttgcagttttcaaccagaagaccttatatgatgcatacaaaaagaggaccaagaacattgaggttgacatggaggcatacaacaaagcaaaggaagccgatcctgaattttatcgggacgcttcaagtctccaatatgggaaggtacttgccatcgtaccaaactttgtactaattgaatttaaggcccttctgtcatggagtccttatcgatggcttgtgcgttgaacaggtgtctaaggtcccggaagaaaacatagacaggatggttaatgagcttaaggaacgggatgagaaacggaaagcattcagcaggaggcgcaagttccatgaagacaaggacattgactcgatcaatgaccggaacgaacacttcaacaagaaggttgagagggcatttggcaagtatactcttgagatcaagaacaatcttgaaagggggactgccttgccagattagaaactctgcacactctgctggtagagagtggacatgttgtctgtttccccagctgtcttttgcttgtaagttgtaacctatcaacaatttgcttggaaactgtaactgtaagaaagccaactcggatgtaatgtcgtgagaatatagcatattcgagaagttgtgtatccaaaatgagcggaatcattaactatagtgattttgcaatgtattcaaatgagcataatcattaactgtagtggggtgctggtgccccaaatgtcttgcaataagccgcacgtccgaattccaattataacgccggtctgtctagggatggacgagactacaaacttgtccagacagtctagaagatgccttaattgtagctaattgctacaattaaggttgatctagacaaggtcacgaacaagttgctgagcaagagaaattatcggtttgtctgttgccattgctatatggagtatatgttggtagtatactgctatcggtcaagcaagccagtgggtgtaaccgtgtaagaaagtgactgttcctaaccttaattttgatttggatgatggtaattcaagaacgctaattaggccggttgaggtagcagcatcgtgcggcagtgttgggaaatgatttgccttagcatatattggttggctgttcagtcacagttgagacttgagccaggtgaggatttcattttcaggctttagtgtcttgcttactcttcactactataacagtttagtctttttttgagtgtcctgttagaaatatcactctcttgttacagttcttgcgttcacctttttctaggtgatagctaacaaaatgaagatttcactttctaggtttattttacttgatggcacatggtctaagcaagcactgtactctctgcaagctaccaacatactcctacacagcaagcagctcaagttgttctctgagaaacgcctgaaatctgattgaaatcaagttggcacttaactggccaagaaaccggtcatgatagttggagtagtaccattgcttagtttctgtcacacaattgtctgaaaagctttctcctttttggaaggaaatgaaagggaaaaaaaaaagaagtcttgtctgaaagtgtgtgagaatcaggccgtcctgaagccatcactttcagagcatctgggacttgaagaatttggcaagtgaaaaaggatgtagagggatgtggattttcatccctcgaggggatatcccctcattatttacatgtcatttaaatttaaatagttatcaaaaaattttaaaaacaattaacaacatagattaatacgaaatatatcactccacaaacatgcaagaccaaattcaacttatacaagttgtaacaaaaataacaaattaactgaaaatagttatcgcacattcgcaattatattgttatttttgttacaacttatagaagttatatatttcatattaatctatgttgccaattttttcatattttttattgactatttaggtggcatgcacgaaacgagcagatatcccatggagggataaaatcactttcccgatgtaaagataaccagaaagaagaaatgacatcaggcgtgagcgaaacttgccggacgagtggccatcgcaattagttaccagtaacacacaaggaatcatcgcatctcgccgcaattaagggtcgcccgtttttggctcgtttccaccgtccgctagctttgttccatcctgaccgacggcggggaagagctataaacacgcaaatagctcgttggccaccgcgcgcgcgtcgctctcccgcctttcgtaaatgaatgagctataaactttctcacacccagatttttattttttttgccccctactcttctttctctctcttgggttgcgtgtgaccatgcaagcgagagcaagttggcatggacgacaggtgcctacttttcgagctatcggtgcggcgttatttataaccgacaacaagacaaagaggacaccagagccagccaatgtcgccgtcaccatgacggcgaataggactcggtccgtgtggacagccgggtccttctccggtggaaccacggcaaccacaccctatctgcagtggccgatctagaaaaataattcattggtatcataacgtgtctatcgatattataattatagtattgtaatatatgaacaagcagtttaaccataacttttatcgaaagtcgtcggtatcgtttgacaccgatgttaatactgtagattcgcccatacctgccaccgccggtggcgaccaaccaaaaaaagttcgccggatcgatcgatcgatcgacgcatggcccacgagcggatcgatatgatgatcacagacagcatccacacaaaaagggagatgaaaagatgcgaggttctttcgcgcgcgcgcgcgcatggccggagatcgacggcgaaagcagcaaatcggtcattcgccgccgccgttgccatcgcccacggggatccctaccactttggtcatggcttttgggacgaatagaatagaacctaattttggagctaaagcagtaacaacataaaatggaccacggtatccaaaaacgctacgaacattcacattcagattttttgtgtgtgtgtgtgtgtggatcgacaaaaacaaattcttcgctccatcgatccatctcttcttcttcttttgttgattgaaatgaacagaagcatgcatgattcaaagcttttggggggaatttactccaaaaatcaatataaaaaaataatcgagcttcaatctgcggcaaaatcaaaagagctctcgtttttgtacagtgctgtgctgtgttacgtgtaccgaatcgcatatccatgcggagacgagcttcgcctactcggggcgtgtcatcctgggcagcacgtgcagcgacaccacccgcttcccgcccggcgccgccacctcccacatgcgcggcggcggcggcggcgccgcccacgattccctcctcgctgctggtggcggcggcggcggtggcgttacgtccacgatcaacaccttcccaccgccgggggccaccacgcaggccttcccgccggcgacggtcatctccgccgcccccttgaggcggtcggactcggctaccgtcctccagcggtcggcgccccagtcgtaggcggtgagcgcgccgcgctcctcgtcaacgacgtagatggtctcgccgtcgtccgggggcgacgccgccgcggggcccttccagccggcgagcatgccgggcggcatgtcctcccagcggccggcgcggaggtcgaacacggcgccctccttggcgccgggggtgcggaggtttcttcatgcgcaactctgatgcgctctactttgaaaaccacctgttggcgctggcccacggcaaagtcgcttcgggtgggggagctatatttcgtgatgtcaaagncgatgctcgctcagggaacgagctcgtctaaccnngggacat

SEQ ID NO: 70542 - DNA, 1586 bp, Oryza sativa
ccatgtcgaagtgcggccgcggcgggttgcaccagccgccgtcgtcgctggggagcgcgtagttgggcgggcagaagttggtggccgtcaccgtcaccgacgcccccgcgcggcaccaccgcgggtccgccctcgcgtcgcaggtcagcgcgtagcactgcccgcacgacgcgccgtcgtcgaacagcgccgtgctcagcgccgccgtccgcgtcccgtacccttgcgtgtacaggttgccgtacccgcacgcaccgcctgcaatgcacgcacaccgcactctgtcagtcagtccaagcacgcgtcgcgacgcgacgcaacggacgaacacataggtacgtacccatggtgccggaggcgtcgctgccgccgtagaaggtggcggtgcccttgctccagcccgacgccgcgaacgcctccaccgtcgtcgaggcggcggcgagcagcgcgtagctgacgaacgccaccacggcgaacacatggccacggcgcgccatctccgaattccgatcgatttcgcctagctctctgctcgttgcaacctgtgctagcttagctactatggtgaactgaatctgattgctgcatacgtgagctgtatatatacacgcgagagatagctttgcacatgcagagccatggcttgcgggcgaaattaaaatttgtcatgtcacgatcaatccgtcccatattctgctcgatacatccatctcgcccaagaagaacagggaggacgtacggtcgtacgtacgctttctatctcgctttaattcgagccaagttattacggctttctctgctgcttctgcaccgaccatgcatgcctctgccgtcatcaggttcagagctagctgcaccattaaacttgaagatgttaaagtcggtgccaaccttgttaggttagctatatagtccatgctcaggagattgagagacagacatgctgatttccttggagaggcattcgtaatactgccattaaacaggttgcaaacactgccgctagctctgcttcagaggcagcaagccgatttagattaggcaccttccgaaatctgcctgtgtttctttcttcagtatggcaaggaagcatacaactatagtagaagatatcaagagcacaaaaatggccggtatatttgcaaatctgcctgacaactaactgcagattaacaagcattaattgcttcagaaagaacacgcactgtgtggttggttgggtgcagtaatactagcagagcagctgcagatcactgcagtatggtccggacactgaagtgaaggaggccagccgagcacatggacaatctgagactgagacgggagatgaattgagcggtgcacatggtctccttccaaatctttctgcatctgctgccaccacaaaacagtaaactccaaaaatgatattacacatcaatttgtttaggatatcttgcttttatattttatttttaacctcatctcaatttgagggcatgatgaactgcctgcaaagacaagaaacagcagaacatctagacaaattcttcagttgcagtgcagtgtggattggttcgtgttgagtgaggctgcgtttgagtgtg

SEQ ID NO: 70543 - DNA, 1684 bp, Oryza sativa
tcgccattgattacatgtcaagctcaacatatatttgatgttatgttactcaaacactacacaccacagttacatgccaacaaaataataaagaagatatatagccacatatctgtggtgcaaattgtaaggttgtgtgcatattgctattgctcgatggatcgctttcgtgttccttgtgatgtgttgctttatcttttctcctttccagtgtgtgccagaaagaggacacctttctcttcttggcttttggatcttgtttcttgccttgcaagagctagcttcccctaataatctctctctctctctccattgctagctatatagctacattcctgggtcgatccctatataagaggagaggcatgaactcaaatgaaatttccaataagctccacatgtcgtgagagcagagcaccggccggttgatcgagataacacagttggagagttttttctccttttctttttttctgtttaattcatccggcgagtcagatgaggtcttcgtcgtcaccttcgttggctaaatccatatttagcctcggaactcgtaagtagacacttgctatacatgtatagcatctttgaattcaacagttttatactggaagcttattataaaattctgccaatgtttaaactttttttaagtagcaacatgcatgcatgacctcataataaaatccatatttgtcagctcttgtgtgtttcggttttggtcagtttgcgcaaatcgttttgaaagatcaaactacctacaatgttccactcgccttaattcatactcgttaaataatccctacatttgcatcagaacaaaagttatggtaggcaagcctgcagctagctagaatcaaactttaatcaagaagcacacacacaattattcacttaaaataactatggtgggtaagccaattagtcctgtgtaatttagattattgagtaggttgttgctacggattattcacttgattatatataaaaagtataaaaattttgagatacaaacttagcaaataacttaatacaattggtataagcaatacaacagagattttttttcttttcttcagaaatgtattttctgaagcgtagagcaaataatctgtttcaataatcggacaaataatctgaaaactaaacagggtacatttaggccggttaaccgacctacaaatgcatgcttttcctcaagtttcatctgctagctaagctatagccaatagcttgtacacgttgcacactagagagtcaatggtagtgtagctaaattgcacacttgcatcacaagcaacagcaagctatagagatagctgtgctcccaaagagactcatctccatttcttgacgctttcgcgctctcatgcttgctcttccgcgttgtttgccgccttaatttaattaatttgctgctttaactaactactaataacttactaacttggtcgtcgtcttcctcatcttcgcgccaatgctgcagagggagccatgatcgagagaagcaactccaccccttccgccactccggcgaggccaccgctcgcgtcgacgaggagtacaaccaggccttccgctccaagtccttcctcgacctatggtctcacgcccaccaccacctcacccacaccttctcctccttcaagctctccacctccaccccctgcgccggccgcggcgg

SEQ ID NO: 70544 - DNA, 722 bp, Oryza sativa
cacttttggagaggtgagtggctatctcgacctgttgcatcaactctttgggtaaaaaattgatcccagttagacagggcattgacaattcgaagaaacaaaggcttattcatccgaaacctcctccgaaactgctcatcagtatagataggatttgctgaaaaataattagcaactaaatcttcatgtcccttttctcttggcctaggtatgtaccttctaggtccactttgacgctggcgacgacgaggtggaccagaagaagatccttcgattttggccttcaatttatcgccaatcttccttcgaaatgattccattatttcatcttcggcgagaaaatcttcaagtgtatatacttccgctggatcgatttcttcaaggacagtatcttcatcgcctccatctccaccagaggcgaagaactcgccaccagacccctcatcgtcgccaccaggatgctcgccaccagaggcaccagaggcctccatcgccacaattgtgatgcatacaagtcacagagcagttgattttatatacaaatgcatacacggcattgccttatcatttcacattccatttcacatcatatcagttcacattgcaatgacccatcagttcacattccattgacacgtttcagttcacaaaaaacagttcacaatagccaaaaaaaaaacaatcccagaaacagaacatagcaaaacagagactacttccaa

SEQ ID NO: 70545 - DNA, 666 bp, Oryza sativa
agaatcactgaatatcacatgggcacgaacattcagcaccagaaacaagcattctcttcatgtattttataatatccatctatgattcgacatcagtatgaagatgtcgttcagaaagcgcagataacagaggacacaagtgacaggatcaagtgattactacaaccagcagcaagatatgatccatcaaatgaaaagtgattactacaatcagcagcaagatatgatccatcaaacgagggacactgattaatttattgtcagaggactagagtactgaacaaaacaaactttcctgcacattacagcatgtgacaagcatatcatattttgaaaaagggcgagggttctaagactgttttctgttttcctacaaggcctggataaatgttagtactctacagatcaagtatgataaagtcatctatttctacatggaattctcagagaacatttccatcatgcaaaaatccagagtggtcttcaaagattggtgaagcacttgaataccttatgcataaggtatgaaacccaccaaacattgaagttcactggcaaagtataaatagactggcatataaggtggtactgacgtcgttgtaacaaaataatcacccccattgtttccatgacgaaataggcaagaattgcaagggctgcaggaat

SEQ ID NO: 70546 - DNA, 744 bp, Oryza sativa
ggcggctggcaaagttggctgatggagaagtgccaacctgcagatgaaatggagcattgtaaaaactctactaactagaattattactgtttattagttcatcagctagtggtgatttgttgagtaattaacagtaaggattttgcatttgcttgtaaacaaaatatgactttgtaactacagatgtgtcagtgcatatgaaattttttttttagaatagtgcatatgaaaatatgaatgagtgatacaccactgtatagtattctgtactactaatctaaaaatgaaaaaagaacggttggcacgtacctgtacgtagctcggtggacagagagtaattaattaaacaacaagtagatataaactaaagtatagattagtgtaacgacaagatattatcacatgcatgaactaatgttagcatcctaatatcacatgaatataaatgtaaacgaatgacatgaaattaaatatatacatctaatgcatgaacaaaatgacaaactgaaggaaggaattgcgtgcacatatacgagtagtgtgagtcagcttaattacattgaaggtgtgctccacaacagcagcctgagcaactgaagaaaccaaagcaatggcaatgaacagcagaagagaccagtgaagagtcatgctaatgtatatcatcaattggctaattataacaggaggttattagggcacaagagagatttgatttgtggcctaattactgggggaatggagatc

SEQ ID NO: 70547 - DNA, 2379 bp, Oryza sativa
acgtcctttgttgtcataccagctcggtacccaacggcgtcatacattaaaatacgttaaaatacggagggattacagcttgcttgcattgcaggttctgtacatagccaagaaaaactcaaactgcaatgagcgagaagtgagaacatagcttagctagctataggggaatggtcagctgcgctacttattgcggagattgaggtatatatcagggctcttgaatgaatcttgattcccggcgccgcgagttcgttcgtcaaagcgtgatactaatccagaatcctaagtaaagaaccaactgataaacaaatcacacggcatacctaagaaaaaggtatggccatgtatcttctgtagtaaaagctagctcaacgcatgtaaaagtacatgctttagggcttgtttgatttagtgtcctaccaaagtattggtagtgccaaaacttacgtatgttttggcactaccaatattttggtaggatagcattttaggtgaatggatttggattgataccaattggaagccaaatttatattatactcaggaaagttctagaattataccaaattaatcatggtcattaccattcatttggcttcaaaccaaacctttacattcactatttcaaactacgaaccaaactggtagggcacattttggcatcaatccaaaatggcccataatgcttatacagtaatatagaatagttctttttttagatcataatatagttattttctgaaactttgatgctttcacttcgatcatggccatgtttagttcacccccaactactctaaacttccaactttccatcatatcacatcacattcaaaactttcctacacatataaacttttaacttttttccaaacttttaacttttcccaaacttccaacttttttcaggaactaaacacagcccatatatcatgtactaaagaactgtgttcggatgctacttttcccaacctctctctctcgtttccgcacgcacgcttttcaaattgttaaacggtgtgtttttttaaatagtttctatacgaaagttgcttaaaaaatcaaattaatctatttttttaaaaaaataacaaatacttaattaatcgcgtgctaatggatcgtcccttttccgtgcatactgtacaccgtttccatccaccggtagcgaacacaccctccttcaagaaagtatagaaggaatctacatgtaacatgctgttagttggcagatcagcatacatactttggaggaattctgtacggaacattttacttggctaaatgctgacacaataactgatattttaacgaactcagcctaaactgaaggaaagaatgtgagtcaaaaggagggttgaaaatcacaaaaaggtgtaggagaccaaacccagaatggtagtgagtggagtggaccagatattaggcccatgtccaactccaaccattgcataattcaagcttttgcacatgcatgtgcatgtacctacgtaccacaattatttgaacaggttttcaaacctcatttaatatcttctttcccatcaaaatgaataagtgtactcctcaccctcaaattaacctcatcatgtcattgcaaaaaatatccattattcagaaaacatcacacatgatctcattccgatccaatgctctctgcataaatgtatcttacttatactatgatttgatttgcgatagttcaaattttgaaacataaacaaatatgtgccaattggagttcattaggaagatgagtgtgatgtggatggcatcacatgaggtggaggtccaccagagcacgggagtaggccggatcccatcgcttgcactgcacccgactcgatcagcttcagctcgcttcccacggagacaaccacacgagatttcctctctttctcactagacactagtctcctcctgctcatggcccatcacgtgatcgcacctcttcttttgtggacatcttctctcatttttactcctcctgattctggaattttctgtttaggtcccattcttgtcacaaatgtaaccccttgccatgctctagttatgctcggccatgttttgtaataattctggttaggtcccatgttttgtaatttttttaaataaaatcataaatataaagttttaatagaaaatgtaccgtttaatagattgaaaaatgcatattcatgcatcatttctcactcttccagctaggatattgataacgtggatagctattcaacctgctgaatgttattgtacatgctcttaagagagaataaaagcctatcggtaaaaaagaagtaatgggggtaaagtagtttatcaaatttttttcacactgagctgatgcatgttgtggtccctttaacaaggtagata

SEQ ID NO: 70548 - DNA, 1163 bp, Oryza sativa
  unsure (1)..(1163): unsure at all n locations
agctgccattgaaatcatgatcgacaatcccgcaagccngcaggttgactctagaggatccccatgagcaattaaccactttgtatcttcagcaacacagattagcagttgataacacgggagcacaagcaccaaaccacaaattgcatcgttgctacatgcatcctagtggagttatatgtagtaatttctgtaactgaccagtgtgcatttcttgatttacttactaattaactctagggtacatgaaccctgtactcattaactttaggttgcatgagtttgtactaaagctataaatagtccatagggcatgtaatgggggattcaaaattccacaaatcaatacacattgttttacttttcactgtgtgaaccacgtctttcgacgtacacagttgtcaatcgacaataatattatcaagatatattcttagttaaatataatgaaactaatttgatattgaaaatattgctaattttttctataaacttagttaaatctaatactttctccatctactcccttaatctttatatttcatcttagcagacggaggaaacggaggatttttgtgtcagcgaggccgccaactcgcctggatcgtcgcatggccttgtcgccgcatgcacgcacgcagctgggatcatagtctcaactgtacacactcttttaatttgccggctgcagtagcatgagtcctgttttatgtgctcgtttcatgtgaacacacacatccagtatatgctctccagttatgctcctctaactagcatgagttctgttcagattgcaacctgcatatccaaagatgcactgttattaatgggagccgtctatgtcagagctataataatttcttaattaaagtctacctatacttccatttggtggtgcttaatctcaagttaatgcacgcagctgcttctgtcctttggagtccccactatatatgtatactcctatcaagttaggtttggttcacatttgctgtaatcaactaatcttgcatcaaacttacacagttacacataacacatcagttgctagagctatcagctatgtgattcagatcaatatccattgcgtgccatggtaatggcagttcagagctagctaggggtacaaggtgaattncaggtttgccaatcaancggaccca

SEQ ID NO: 70549 - DNA, 2278 bp, Oryza sativa
cacagtatcaagcctttccctttttttcactcgcaccacccagaaccaacacaagagcaatattgcattccacaaatgcccaatccaaacataacccagtttgccacacaattccccaaccgcataggccagttcgcatcagcacaatcctattttcaaccggcgagagcaatcgatacctagagccccctgagccaaaatctgcaaatggcaccttggccaatacatctcaagttatcaaacatcacaaagtacaaaggtgatacagatccaaatgagtatttgagggtgtatgagacgccggtagaagcggccggaggagatgacacaacgaaagcaaagatacttccaaccatgctagaaggagtggcattgtcgtggtataccaccattccacctatgtcaatctactcgtgggagcatatgagagatacttttcgagcaggtttcattggtgtatatgaagagccaaaaaaagcagatgacctatacgcactgaagcagatgccgggagaaaccttgagaagttttatggtaaaattttcaagaataaggtgtcagatcaggcaggtagatgatgagatgctcatagcatcagcaaaaagagctttgttgcctggccctctccgtttcgatcttgcaaggaataggccaaagacagcaaaggacctgtttgaaagaatggaaagttttgcaagagaagaagaagataagctaagggtgcaagcagaaaaggctgcattattggaaaagaaccagacaaagaacaagcaagtttctttaggagaaaaccaaaaaccagaaaccactgcaaaaccatggaaaaaattcaagaacgattccaagcaagttcagaaaaaccaagtaaacttcattgaagatgactcaaataatgtagaaggaaaagggaagagacatttgggggcaatctgcaaaaggccaaggacaatggtggaattctagcaaaggtagaggacgatagtggaataatgccagaagcggaggacaagaatatcagcttgatcataccaagttttgtaaagcacatggtccaggtggtcattctacggaagaatgttatagcaagttttgccaaattcatggtccaggagccctttccactcaggaatgtaggcccatggccttcttagtgaaaaagcatgccagtctatatgagaacaagtatgagggggcccgagatcagcgagggcaaaatgctattgaagcaccacaagtcataaaaatctataagcaatcgaagaagctccaaaaagggtgataaatgccataacaggaggctcttctttgggaattgagtcaaaaagacaaagaaaagcatatgtgagacaagtaaatcatgtagggacaagctatcagtcaaatccaccagttcattccaagacagtaatttcctttgggcctgaagatgcggaaggaatactttttccccaccaagaccctttggtgatctcagtggaaatagcacaatgcgaaattcaaagaagtttggttgatggaggaagctcagcggatgtgttattctatgatgctttcaaaaagatgcaaatacccgaagacagattgacaagtgcaggagtgcctctgcaaggttttggtggacaacaagtacatgcaattgggaaaatacgtttgcaaatagtttttgggaaaggcaacaatgcaaggaaggaggaaatagtgtttgatgtggtagacatgccgtatcaatataatgcgatactcggaagatcagcaatcaatatcttcgaggcaataatacatcacaattatatatgcatgaaacttcctggaccaagaggagtgataacagtccgaggtggccagttgggggcaagaaagtttgagctttagggaatgccaaatgtcaaaggagtccatgtcgttgatcaaaagcatggagaatactctaagttgcagaaaccagttcctgaaggcaaaactaggaaaagtccagttagatgatgatgatcctggaaaatacattttgttaggagaaaatctggaaaagcatgttaaggaggaaatcttgaaagtagtgaaaagcaacatggatgtctttgcttggtcaccagaagaactgaaaggggtagatagaagcctgattgaacataacttggcaatcaagcaagagtccaagccaaaaaatcaaaagttaagaagaatgtcaacagacaggcagcaagcagcaaaagtggagctcgagaaattgctcaaagccaaagtgataaaagagtgatgcttcctgattgtttgctta

SEQ ID NO: 70550 - DNA, 628 bp, Oryza sativa
tcctgtccggcgagaatctcctttaatggccccaaataaatatgactagtacgttagtggagcagtaccaaagatttattcagtgaggttctagcttgtaattcgtagattaatttgttctgaacatgttttgaaggtcaacgccaactttatgtgtgtgaggtcgtcgaacgttttaatttcaagattctctgcttcctttttatgctaccagtacaagatcaatgcgtctcatcgatatatcaatgtatctcgactagaaattaatcgcaccaatcatgcactttggtcatgcacggtccatcgtcgaattattgcgttttagaggtcgatcggctttcgtcaccatgcacgtactagcaggccaccaccacgtacaccaccatcttcttattgtgtggggctactgactactcactccgtattttaattaatgtacgacgtcgttgtctttttaagtaatgtttgactattcgttttattcaattttttaaaaaaaatatgaaaatgtttatgttatgcttaaagaacatttgatgatgaatcaaatacaataaaataaatgataattacataaattttttgcataagacgaacggtcaaacgttgaacaaaaagtcaactgtgt

SEQ ID NO: 70551 - DNA, 5381 bp, Oryza sativa
agagggcaatgagagaaaacagatttatgtgcgaccccttcccagcgttcgggttcaacgggataacaatcctcgcaagaaaacgttacttgcagcaaccataacaaaactccactcattcctacttggcgagacgggaaaaaacttaacccagaggggtttcaacgtagggggtattgtgcagtttataagagagggcacgtcctgttgtcgttttggtaaccatcggggtccgacgtttatgtaactccacggccctcgttgtgtgcgtcacctagggtggctcgagcgccatcggcggagtcggctcgaggctgaactcggggggatccacctccacggcgccggacgagcgcgcggaggtcggaaggtgaggctggtcggtggacatgcaggagaggacggatggatccctcgcgcgatcgccgggggtgggggtcgccggaaccctaaccctaggtggcgtggatggcgtcgcgcgcggtggtcgccaccgcgaagggaggaggaggcgcgcgtgcgtgcgtgcgttgcggtggtggatcagacgacgggagaaacaaagcgagaaaaaaagagaaggaatgaggaatagaatacgagacagtgggtgtgggtacaagtaaactgcagattatgtcgttgtttttttttcccgattcggtccccgtagttgcacgaattgtgtttttttcattcttaatctttgtctaacagcatactagtgattgtactttgtgctagtgagcatttgaattttgaagtagacgaaagatttcgaaaccgatatggggttgctgtttgcaatccttttttttacataaaatttgtggcagttgaatctcaactgttaatttgcaacgttgacatgtaaacaaagtagtgtgggaatattttctttacgaaaagtcaacttctttgttcgaatttaaaaagtgatccagactaaccttaggaattatttttcttaataatggaaatagtttaatctccggtttctggcaacttatgaattatttccaacagaaacattaaatgaacatagataaaattaacgggagacgtttggtttctacttatttgaaaacttttgtcgcattctgaaagtgtccttacataatcctgtatatgcaaactgataacgcataaccactctatcgacgtcaaaagcatatttattaagcagatataacaataatgaaatgtagatagagacatatagctcgaattggtaaataagtacatatgtatatacacatagccacataggacatggacacaacacatgataccctcttaaaaatagataatatgacatgatataacagctgaatatgacatgcactcgttgtcgcgttcaatttcttcgtaaccgtcgaacaacgcacacgcacacattcgttttcggatagattctcaatacttcgcatggaagtaacacggcacgcgtttacttggagtggttcgttggattagcgcgttaattaattacctcctttccctccttgtattaaccgacgcttctgccctctagttgtaaataggagagatcataggtagcatagtgcaaaagtaccagtggatctctcatctcagccgtccgatggccggccaccacacgatccggccgtcgagccaaagagtacagcacttagcacgtgaccacccctttttcaatttcttttccaccacgcgatctcgatgcgtcgttctagcagcaagtaaaataatcaaatttcctttttgtgtgtgattaaaataaccaaattatcgtcgaattgaccggcaacacgagcagtcaaattactaaaccagccattttttgtttgatgggagaaatgaagcaaccactccaacggtaattaagttaagccacactcacacacctaaccacatgaccgaaccgacaatcgcagcaggcagcttggaatgattaatagattagctccaaacaagttgctaaagatttaatcacacgcactcgtaacagaaagttcaagtcgacacctcagctaagcttaaggcttcgtttttttaaaactataattttctaattgttcgttagcatgtttttaaactattaaatatagtatattttaaaaacttttttataaaagtttctttaaataattaaataaacttatttttaaaaaaatataataatcagtactaaattatgtatgtgctaatgatctatcttttttgtggggcgctgataagttaaattaagttagtaattaacacaagcccttaatgtgtaccccggtttcctcccgtgtagctgtgctcagtgacaacgatggcgctgacacggcgtccttcttcatgcgcaactctgatgcgctctactttgaaaaccacctgttggcgctggcccacggcaaagtcgcttcgggtgggggagctatatttcgtgatgtcaaaggcgatgctcgctcagccactgtcgagcatcaacatgggcaggttggctgttcgtgcgagtgtggcacttgccggtgagaggccacaatgaggttcgttttaggtagaaccgacagacgaggttcgttgcgatagaactggcagacgacgacgacgacgctgactgcggctttgcatatatggtggcatgttggggaggaggaggagattggacagggagacatgggtccattgtatttttttttaaaaaaaattaaccagaccgtcactgatacatgggtcccatagttttttttagtttaaatgtcacgtcaaatgttacatagatgccacatcagctgaaacaaccatctaaaccatcttgagatcttattttggttttggaagttgagtaacgcgtcatttaggtattgcggtttaaggttgaatttgaaagtcgacgacaaattgagtgagcgacctaaagtgagaacttattcctttcccctgcaattgaaatgggcctaattgtcggtcacataccgagtaaatgggcttttaagcaggcctggagcatggttaggcccaatggcccatggaacgaaacccgcacacagaaacagaatgcagttcacccctggctggcaggcacactcgcagtccccactccaaaagccggaggaggaggaggcgattcaccgacatcccggagcggatcgcggagcgcgacccctcctccctccgccaccgccgccgccgccgatctacctccgccgccgcgccctcccctcgccggtccgtcgatttcagccctggccgtgcttgatttccgccgattgtgtgggcaatctcgttttaatctcgtgcgtgtttttttacttacgattttgttttcgttttggggccagtgcgtggctggtctcgtggattttgagctagattgggccgggaatggcgggggctcgcgcgatggctttcgtcgcgctctgcgccctcgccgccttccctgtcgccgtcaccggaggtgaggagtttcgtttttttctttctttccagcgtttgtttctctagatgagatgctcagattaacacctacagtgatgctgctgcacttttatcttgctccttgtggaatgtggaaatttttggctttcgattgtcaggctagggtgaattcgcgttttatgtgcatgtgttgatctgtccgcagctcagctactctaatttttaacagctgccaaatgcgaccgtatattgagaatatcttgaaatttaagtggagactggagagcggaaaatttttgtcatgcaatatctgttgatagacataatgtgattaccattctctctgtcatgcatgggaaacacttggtattaattgtatttttactcggtatcttgtgtataaagtgatacagtacatattgaactagctgtagtagtttacacttcacacgcaacattttagatatacgttactgtgctctggaagtgacggttgatgacatttgcacaatggctaggaagagccatttgtgtccatcaacatggctgtgtcataagtaagcctttataaattgggtatccaaatggtgcctacattgttgtttcaccaggtggattgcattttacccagccatccggcattgcctagataatttagtgaaagcacctactgaatatttggccttaccaattgattatatgggtctactagacctttttctagaacagcatgctctgacaagttttagggtccatacccgtcaggccatcactgtttccaacgagaacatgatatttatagggaaaataactactggtgtcatcttcgtaatgcctaggaacattttgctggaatttcaggcatataattttatcctagacataagtgtttgttatactccacgcaatttatagttttcatgttgcatcccagtgacatatgctgacaaagttcagggtttatatatatgctcgcgttttcttgtgttcagagttaaagttaatcagtttactcaaacatataggattcgtgtatgacctgaccacattaccttatcattacattttttctgtacggcattgcttgccatttagttttggaagcaatcaattctctcagtttttgaatattgctctcacctgttaagaagataatgtcccttcatcattctattaagttctctgtttaaagtttaacttactttggggttggacttggaagtgattgataaataaactttaccccttctgttcacaatttatacgcttgtgttagcttgttaggaacaattttctcatgaaatgtttcctcattatacctaagccatccaatcaccttctggacactcgtgatggttttagagcatatcccatcaagtcattctaataagtgttcctgctttgtgcagcccaagtggacccactttattctagtaaacaggtttgaagacttatccttcatttctacatctttaattggtgttattgaagcatgttttcttactgccacaattttgtgatactaggtactggactggagtagtcaagccaacattaaactacagaatttctccttaactgaagaaggtgataattagtgaacaatgacagatctataattctatatgattgcatctactaagatcaatccattcaatgtgggtgctttatttctcaatgcagatggacttcagctgctggtaagaccagaagaagtaactcacagggtaactttcttctacttaaagcccttgcaaattaactagggatattctagcttttcttgtattacaattccgaacagaagtgtccatcctttttatgccatttcttttagcattactacttgtttccaaatgagaccttatgtttcttaagcatttttttatatttccttactacagaaattgcgggagagaaccagaataaagaagaagattgaaccagtacagcaggatgatgaagcactagtt

SEQ ID NO: 70552 - DNA, 6032 bp, Oryza sativa
  unsure (1)..(6032): unsure at all n locations
gtggcntaannattgagattcacttttnacccgcgatggcggaggagggggggacccgttcgcgttcctatcggaggatcggccggcgtggtggtcgccgcggggggtgttcccggccgacccgttccgcaacgggacgccggggtggtgcggggcgtacgagctcgtgagggcgctcgtgtgcgcgccggtggcggcggcgaggctggtgctgttcgggctctccatcgcggtggggtacgccgccacgtgggtggcgctccgcgggtgggtcgacgtgcgggagcgggcggcgcaagagggcgccgggcccatgccggcgtggcgccgccgcctcatgtggatcacgcggatctccgcgcgctgcatccttttctccttcgggtgagttctagtttccgctgttcgtcgctcggattagcatccctctcaccaaacgcgcactcagaatcgagtctggatcgatgacagatcagaaattagaacaaaaaaactttaatccgatctgcatcggatgatggattagccgctgttaagtttatagaatgaaattgaggtgattagattcgggtggtgagacgaagcactcgaaatctgtggatggattgattcggtggcgcgattggtttcgcggaattttggggtttggtgatttttggggcacgtgtgtgtgggcgtggctttgctgcaatcatttgttaggtgggcgcaacgtagcgtatggaaggtgaagtgaagggtccgtgtgtgagatatgttgtttgtttcgttttctctgcactaattgcggctgggaagagaccgacaacgaggggagggtaccacggtggttcagaagaggttagagactgatctctgcacggcgcctttggttagcttcactacaattgtggatcgaaacgagatggactagcgatgaatgatgatgccttgtctactaggtggtttgggaagatagtgagaaagagtaagaaagccttcctgaaagtattctgaaaattgttggcctttggcgctgataattaattaagttgaggcactaatcaggtgggctgttgtgtggttggatcgaaaatgtggctgctacttagttcaaattggattgctgttcacctgggaattgctcaattggacactctgcacacaaattttgagacgtttgaagtttcaattgttgtgaaaagaatggtgaaaactgcgagcgaatgttgagtggtcaatgctgagaaagcacacacatagcttatcatctctgccaatagttcttctatgcagtaaaatgagaacttgagaagggaactgcccagtgttggtggtcgtgttctgtaagcagttgcagaaatgaacgttttgttcaaacttcaggggacgaagaccacttggatgtggattttgttttatactaaagttttcctttgggccatgatctggagttttggtttttaatctcacatatggattttaatgggaaattttgaaacaactcacttttgctccttgtctatgctgggatatcctgactgagtgcctactgtttgtcattttttcttcttgcaatacaactgtttactgtctgatctttgctaaccacttgttttctactgtcagataccattggataaggaggaaaggaaaacccgcgcctagagagcttgcacctatagttgtctcaaatcatgtatcatacatagaacccatatacttcttctatgagctgttcccgacaatcgtttcttcagattctcatgattccataccatttgttggaacaattatccgagcaatgcaggtatatccattatgttttaaaagccctttttcccagttactttctttgacactattttgcaagttactttcaagtttcaaatttacaacaaatgcataggttatatatgttgacagattctcgccagcttcaaggaagtctgctgtaaatgaaataaaggttagaatgattcctcttgaccccactgttgctctgcatacttttaattaactgcatcaaattacatgtgctttttccttaataaagtgatggtctcatggtgtcaggcatcttttaattggtgatatgcaagttatcctgttgctttctgttgcctatagctgttaggctgtcaaattatcattactgcacacagtggacttctggggtagaaagaataataggcagaaaagaacaaagacaaacttgtgcttgcagccaccatttctgtagcttcctctttcatctacaatatgcaaatacaccacagttgatttcaggaagcaatgccatgcaactcatcctagaatagtgcaaagcatgattttctgttttgttatcttgttcatatggtacatactctctaggatgtgatttcagagaaaggcggcttgcaatagcttcccacgtgtcttgttattcccggaaggcacgacaacaaatggaagatttctgatttctttccaacatggtgcattcatacctggctaccctgttcaacctgttattgtgcgctatccacatgtgcactttgatcaatcatggtaagttatctggacagaaataaatccttatttgttgcctcaatgctttatttatgttcattttctgcttcaggggaaatatatcattaggaaagctcatgttcaagatgtttacccagtttcacaatttcatggaggtgcacactctcattccattcagcctagaatgtaaaatcttcatgtctttggtaataactacttacacaataaggtccttacatgaaccatactttttacaggtagagtacctccctgttgtttacccacctgagatcaagcaagagaatgcccttcattttgcagagaacgtaatccttcttgactcaaaataattacatatttggcatatttttgcgttccataccaatgtaatggacaaagtactttattacaactattgaattttgcagactagctatgctatggcacatgcacttaatgttattccaacctcttattcatatggggattcaatgatcatggctcgagcagtggaagatggaaaggtaaaaagggcaatgtcgtagtgtgatcttcatgctgaattcatgtccattgttttgactgtgtttgctggattccatataatggaacgttgcatagtgcatagatatatattaacaaatagctgccattaggctgtcttccatcatctatgaatttgatctctaataggctgggtttaacatttgcaggtgaactgctcaaattatatggtggagatggcttgggtaaaagaagtaagtcttccacattcgcactgttggtatatgcatatcaatatgggacctggtctacagatatactccctccgtccctaaatatttgacgccgttgacttttttaaacgtgtttgaccgttcgtcttattcaaaaactttgaaattgtattgttgttgaagaaaatgttgtagtaggacttggtttgtgcatgatttatatgcgaactatttagaggtgtcccacccactatatagataaagcataatcatagccgtgttactgtgtttttttcttttgccatgcatggttttcttttgctcattggtgcttttgaggcattatagttgctgctccatcaattatggtacctgatgttttttgttctttttcagacatatggtgtgagcacatcagaagcaatggcactcttggaaggctttttgtgtatgagcccagacaacgagtaagtttctcatcctcacactgacaaatatgtgctctatggcagagcacataatttggtcgcgaagtctaaaaagatgtcctccatttcctaaaagctggtatcatgatttcacagaatcatgacaaatgacattacttaactggttaacccttgcagcggacgtgtgaatgcgcaagatttttgggctcattttggccttaattgcacccctctttgcaagaaggtactggcattctcctcgcgtaaatactgccacccttaattggagttacagtacacccttcgctgaacttgtgcatctgtttttcagatatttcagtacttcgattttgaagccaaggaatccatcacattccgtcaggtatcaacttgaatacaatcaacataataactgatgccttgcgcttactaacattcaaggacgtgatgtatgcagttcttgattggatgtgcgcacctcaggaagcagccatcgtttcaggacgcctgcgaaaccgcgtttgagaggtgtaggaatcccctaacatctcacatcggcagggagcagctcgccgatgtcctgcggtcaagcatgcttgagctgatgaccgataatggggtaagtcgccagtttgcttcatgcaacatatctaatcacctatcttccaacgccatcacccagtttcgactcatctgtcattgcctaccgtttacattacagatgatgaagctgttcaagacgttggacgtcgacgatgacacggaatcagcaaggatgacctgatggcatcccttaggaagctccccttcatgatcgcgctcttcgcgggccggatcaacggggaagtctacatcgagatagtttgatcgactggattgatcgcaggggagagcaaaaatggtggatgggagtttgtaacgcggtgggagacgacagacctccgtctgtttttagagggatggtttccaacgctttcaccgtccatgtagctttctcaggcgtgttggactaaagtggctaaccggtatagtgcgcaattttgtttcatatcgtaaaaatatatatttatatccatagaaaagctgtcgcgtgatggcacgctggattgtgcaatgtggatatgatactgtacaacattggtccaactgggcgtgcacatagaaactctttttttggtttggtttggtttggctaactggatggatgattacaaactcctttttggctaactggatggaagtatctgtttcgtatcgtccatcccaatatcaatcaatatatgtctttaatttctttctttttctttattttttgagacggaaccaaatgtgtcgaactttgaggctatcgaccatcagtccatcaccatcgctacgcgtagtcagaaagtcggaatgagtctctaggaaaaagagaaaataacagccgccgggctttctactgtattattattgtgatgacgaggagggtgagatgtactatacgatgaaccaatcacatcgcgttggagggctatcatttgacagcatctgtttacgttttatgacttctttgaaggttatttacaccagggaagaaaaaacacgcaaaatgaagagcgctcaagattgggaaaagtggctaaaaaaacaacaggctgctgctatgccgcggcactaaagaagaagagtagacaagaagattctttacagtatactatgtgatgctccttgtccccctcccttttcctttctcctgtcccgtctccgatatgttgtatctttacatcacgatgcacttctctttcttcggcgtcgtcggctgtggagcaggtggcctctgaacaaagatcaaaccactccatattcagatccatcaaacagggtatactagttgtataatacggattggaacaagtaaaaccacgtgtcctcggttctgacacgatcaagggatcaagcaatagatgaaaataaggggaaaagaacgaaaacgaaaagttcaaccccatgatctgcttgctccttagaacatgttagtattaactctattttcctcttgatataacatcataacgacagtttgtgcagtaaattagcttgttggttgggttcaggtgtatactagagacaaaacaggtgattttctgatattttagccgcaggatgcaggtttcatgagtttttaaccttgcataaaagtatacggagaacatatgttctgcttcaaaaagactaatcatatttgtggataattcggcaatcctaaaaccaaattgcatatgccagtccaaagcaagtttaaccttataaactaaaagcccagaagtacagagtgaattcaaagggacca

SEQ ID NO: 70553 - DNA, 4549 bp, Oryza sativa
accaaatttttttcacagattgattactgtgtgttattgttgaataaaaaatgaaaggtccatctttcctcgtcagcttaatttttggattaaactgttcggtgcatgcaatttaatatgatatcaaagtaaaaggtaaagtaaaaggtttcgagtccaatttatggctggtgtgcaactaaataaaaattatagtccatttttatttcacgctaaaggctaatccacttttatatcacactaaaggcttgaaagggcctcgcgtaaagagaagtgttggaatataaaagaattaccatctcttctcaatttaaccttttcccaacgttatttcttgctgatgaactgatgcctcctttcatggttgattgaatctacgagaagttgacaacgttgcttgtgtcgtggctcctgagtcctgacgcggtgcgcgtgacagcgatcatcgtgtcggcgagtgggacgtgggcggttgttttgctcgccgtctcgcgcgaaatctggtggtcgcgccgcccgcccacggcgttttggtcggctaaacaaaacacgtcatgaacaggtgctaactgctaagccaagcgttagccaagtcgctgtacgataaaaacatgtacactgtttctgaaatggaaataaaggttatgggttattaataaaaaaaagtcgctgtacgatactaatacgaccgattattcatcggattattacggtggcggtgccttcatcgggttcaattcctcttccttttccgcgacctgttcacgccaagaacactagcaattcttctatacgctgaagaagaatggagaatctgtccggtcagccaaccacggctctcaaaaccagataaccgggcaaaaattttgaagagattacgccatcgagatcctgccaattgagacctcaagaacaacagctcaaaccaacgtgaccacgtccaaagagagccaaggggaacgtgcaatttcagtggactacctgtccgaaacggcgagaattttgttacttaattacacagtacgacttaaaaaagattaaacatcactcaaactagtaccccagtggatccagcaaggataccgtcgtgtgcacagcaaagccagatcctgatcttacacaaatacagtagaatatcccccggcgttcatgtgagggtagctagctttaggcacatgcagaatcaacgcctctcgtaattaaaacaagaataattatcagattcagtttgagtgtgaaataacgcaagatctgcccatttgatagtcaaaaaagcgtcatatacaatcgttttcaaaatattagaagggcgtgccatataatcaacattctatgtatacggccacgcaagctagagaaccgaacaagtgggagggagagaacattttgaccgttgcttaaaaatttaattagcaatttaaatattggtgaacaggagatttaggcgtgagttgacagggagggttttatatcaaattaccaattcacgtgaaaaccatgggcgaattttatataagaaaaccgctaatgacaattccaaaatctccataagagataggagtgttgtattaggttgtgatcggaggattaaggcgatgcttgtgatacattaaaatggaaatgaagtgagcgcacgcaaaacaagaaatttgttagcacatggattagttgagttttaattattataaatttaaaaattatatttgtttgatattttaaaacaacttgtacaggaaacataacatttggtggtttaaaagatatgctaatagaagttaagataaaatctgtattttaattagaagagatggtagattttttatttttaaattttaaaaataaaccatttgaaatgttatttctaagatatgagcattgatcacgccagtagaattggtatggtaaaataacactaccacgccaatctagctggcatgacaacattatttggtcacaccggtctggctggtgtcagtgttatttggccataccaccttggatgacgtggcaagacaaaactatcacgtcgatctggttggcatgacaacgttattcggccacgtcactctaaccatcatagcaatacaaaactgtaatgccccgcgatgtgcggcgttagtattattttgccacgctaggtgggttagcatgatcaaaatgttttgaaaataagtttcaaaagtatttatttttaaaattaaaaaaaataaataatcaagaaggaaggcgtccaattacccgagcctcgtcagcatagcatgagaccatgagtccagcgcaatgcagtgcagtggactgtagtgcaggacgaggagctagaagagatagatagtggtcgaccagatcagaatcagacaggctggtgcacaagggaagctagtggtgggctggtggcagacgacgattggacacggccgcacttgcatcgcttcggcgcgcgggtcgccgtcgtcgtcgtctctcgtcgcggcgggccttgcactcgtagcgtagcgagcgtcccacccgaaggccggaggcccacgtcgtctgtcacgccaccgcacgaaacataattttttttcatttttattttttttaatatttacaaaaatattatacgggtgaaaatattcatagaaatagatccgcgctcctcgagagcggcagggtgacgtgtgtgagcaagcgctagaggtcgctgagcgggcatgggaattttgcatgcggcgaaaattgcattttgacatcggcgccgtgtgccatgtcaccttgctgccctctacttggacaacagggtcttttttttcaaaatatttttgtcggtataatattttttgtaaatattaaaaaaaattaaaaatgaaaaaaattccacgaaacacgcgtttttgcggagtggcgccaggtgggctcaggagttgtggggccgcatgtcagcgagtgggtgccaggtcgcgggtgcggtggaggagcccccacgtaccgcaatccgagtgtccgactactggactgcttgttgtcttgtgattttgctgtttggtgcccggcccggtggtaaatagcaccaacaccccttgctctattttccttccaagtactacaagtttgaaaaagattattgacctgattatcatagtggattatgtaggcgaagtaaacttggcaaatagtttagatctaagctaagcaatgcagaagataaaatctggtggagtacagctgaaaagaacatagccgactccactgatcttttggaataataaagagaaacccatcagagcatcgcattagaatgacaataaacacttacacatatattctttttgcatgctgttgcttgtgctttataagtcttcttttaagtgtacgtatatatcttgtaaaatttggaatacggaaaatgcaatctgaaatacaatcgtaagattaaatatattgtcctctagaatatggaactcagtgacaaaaataaagtggttaattttgaaattttttgaaccgtagaagcacgtatagcatatgtattattctcttttttaccaggcacgttagcattcttactattccaccctttgtcacatttgattattcccacatttagagttaatctagcatgtcacatcgaaaacttcctgatttactccatgttataaactgcacaaaaatctacaaacggcaacgttgcagtaattggtaaaacaacaggctctatcatataatgtcagctttcaaaggctattaggattacgtgttgaaagactaatttcatctaaattaatcctttagcatacaagagggaagactagagcatccacgtccacacaatcaaagctaattcaaccttcacatataagcattctttaaacctctcaattcaacttaataaggacctcaattatttatttataaacacatgtgaagagaagaaaaaacttttataaatcagttaagaaaagagaccaataattttcttttaaaaaatagtactagcagccaccgaccactcccttgactataggcaacgcgagaagaaaaaaacccagaaatgcgagggatagaacgcaaaaataaataaaggatttatttgaagacgattaaagaaataaattaaatagatttacgaccacaaaaaaggaacgtctccttcctcctcttgctataagctttcgctttcataaaagccattactccctctcctccattgctggcctcccgcctccgcctcctttcgcctcgcctccgccacccatggcttttcgaaaccctagccccgcctccctctccacgccgctcctctccgactccatctcgcccacgcccaccaccaacggccacgcggggcaccataaccacgacgacgacgacgaggagtcgccattaaaaacaaggaatattagaagaggagactagagtccatatagaaatacaattaagaaataactgaaattcggaattaaaaacaaggaatattagaagaggagtatagagtccatatagaaatacaattagaaaatgggtaccgagctcgaattcggcctaagataagcggatcatcaaaggggcacca

SEQ ID NO: 70554 - DNA, 1598 bp, Oryza sativa
  unsure (1)..(1598): unsure at all n locations
ccttgcgttgttcctaaatgctttcggccgtaaaccccttccccatcggcaaaattcttttcaacggcattttctaatcccaaatagaacgccgcgacggggtaccttttcagcgccccggcgtttgcgcctacttcacggttaacaagggtggggccccccgcgctcacctccaaagaggacaatcccgagtcgtccccgccgtttccgctacctcgtgggcctcgtggacgacgaccgggaggaaagcccgagcgcctctcctcccaaccgcccgcacgcgcgccgccctttcttgccgcccgcccgccgctccacccaccgccgtcgcgtcggccgtccccgccatcaccgtcgccgcaacgcccgtccccggccgccggccacaaacgccctcctcctcccgccagttgactcagaagggagagagagggatgaggaagggacagaagggagagagagaggaggctaacgtggcagcctgacatgtggggcctacgtgggtccatgctaattcagccgccacgtagcataaaaccggggtcaaaaccacttaggccaagtgctatggtagatgtgactaccatctttaaatttatctattttattcactcatgaattaagaggcaacacatacaatgtatcacctctaacacacaaataccaatatctctaatactctcacacacttcttgaaatttgtgtggaggttgcctcttgatttaggggtggctcatcttctctctctccacttctctcctccacctcatcacccaatccaatgtggcattcttaggggcaacatatgagatattatagtacttgtcctaaagtacttattgtgtccggttttggttagttaagggacgttagatacctatttttgcgcttggaggacgattttgtaactcgatgacaagttgagggaccttcggtgtactttcctatggcccatactcgcacttgggccgtaggacgcggccttgggtggctggtggaaatttctccacgtgacgcaacgcgatcccttctcttccccatttgcgttcgtagcgaatcgcgattccacccaccaccaccaccaccaccactgagagaggcggaggcgctgaccaatcgcgatgcggccgccgtcgccgccgcggccgctggccttcccgacgctggactcgctggcggcgttcctcggctcgcgcctgccggcgtcggcgctggcgtcctggggcacggcgccgggaaccaagaccctcctcaacctctttctcgagctctcacagggggagtgcgtnctcatctncgccgccgccgncggggggccggcatcgcagcagcagcaacagcattccgtcgtccgcgccgtccacgtcgccagcgttcggatccgcaacgggcgcggcgcgctgctgatggagaccgggcagctcctctccgacggcacgctccgctcccgcggcgggctccgcccgctgtcggagaagatgcgccccggcgagacccccgaggccgcggccgtccgcgccgtccgggaggagctcggcgagcgcgtccgcgtccggatcctgggcggcgaggaggcccgcgtggaggagcgggactcg

SEQ ID NO: 70555 - DNA, 2986 bp, Oryza sativa
  unsure (1)..(2986): unsure at all n locations
cgcggtgnnnanagtaggacaanctgcctcgnacccggcgccgnggtggcgttgaggtagccgccgcaggggaccagcttcgacgcgcacgacggcacccccgcggccgcccccgtgtccaccgccgtctgcgccgccgccgagctcgaggctgcgcccacgaataaggccgcgacgacgaccaccaccacggggacgaacgcccgcgccgccataggtgatcagagcgatcgagtgaggtcgcggtgatcgagcgagcgagtgagcgaggtggtgtgggtagagtgtacgtagaggcgtttgtgtgtgggttgggttggcggttggtgcatgatatatgggacgtgtcagtgtgacactgccagggaggtttagttggcggcttgtacgtcggctagctggagtacgtttctttctttccacagctaattaagctagttagatactccctccgtttcaagttataaactttgataaaagtaaaactattttaagtttgattaaatttatagagaagagtagtaatatatttttaacccaagacaaatttagggcatgttcactttgacgtcaaaaaaaaccttaccaaattttagcaacttgccaaattttggtaggatttcttatatagttaccaaaatttggcaacaaactaaatgtagccacttttttgacaactttatcaaaatttagtaaggttgaaaatgacatcaaagtgaacaggcccttaatataaaaatatattcaattattgatttgattaaattaatttagtattataaatactattatatttatttataaacttagtcaaacataaaacagtctaactttgaccaaagtaaaaatatattataacctaaaacggaggtaatagaactcatgcgacgagtaagttataggcattacgctgccaaataaatatttcaaactaaatttaaaatttattgatagttaaagttttacccatttgattttagtcattttttaaaaagtcaataaattatggaaatataatatattattgtactctctctaaagttgaaagtatttaacccatcttgtcgaccgacctgtgtgtttggaaaaatcttaaaaaaaaggtcgatcggaatcggaatggactccggattgggcttagctggatcatcacagaaaaaagcccaccttgttgctccaggcgaacgtggtagagattgtgcagtttttacggccggcgagcagttgaaacttgaaagttgcagggcctcgctcgtactttcctctattctaaaataagctcatttctcagcttacctacacatatcaataaaaaagtaaaaaagataaaaatatcattactgtatttaatcttaatgtaatgattcctttctttatctactttctctgcatttattcagtacttatacaaattctaatataatgattactaaaataaaattatttaggacaaacggtataggctaaaagaacttaggatgggggagtataccgcgggtagccactaaaggacctgttgaggttgtagctaaaatgaaccttactaaatttttgacattgctaaaattttagcaatttaataatattgctatgttttggtgggattttttatgtatttttcaaagtttagtaaaaaaaattaaatgggtgtgcatatttgacaattttattaaaagttgataaagtttatttcggcttgatcaggcccctaaagctgcatattcgtttggtcgcaggctactcgcgcgtgccgggcggtcgtattgctgtccagtacagtgcgacgatctcgatcactgataagatgagcatgcatgtacagtagaggatggttcgagaaacaccacacgcatgcatatgatcgatcgatagcgtcgagggcacgcgcgtaggacgtactctgatcatgcatgcatcccctatcggaaggacaacacagaccagctacggcatcacatcggaatccaatgcaaaactggagtgagtacacctcggcggtctcctctgcagtcctgtatgaactctctctctcttctataatataatggattttagaagaatgtgatacatcctaatcaataacggacacacccattagacagggtgggtcggctggtccagctatggtctatgtagtcccacatctccaaaccttattttagtcctatttctaacacattagttgctagtctactattgaataatcaggtaaatcaagtattttaagtaggaacaaaaatatttatgaaaattcgtgtataagtagtaggatgtgtctattcattgtactaggatatgtcacatctacccaaaatttgttatattataggaccgaacagatggagtataatattgttcgacgaaacatggatatgtgaggatctgtagtaccttttccgtttcatattatacttcttctgttctaaaatattgttcgatgatacatggatatgtgagaatctgaagtactccttccgattcatattatactacttccatttcatattacacatccggtcaaaatctcttatattttaagacagagggagtaagtcatttgattttttccaaactttattaagtttgatcaaatatataggaaaatacagtaatattttcaataataaataaatatatttgttgaaggcatatcatgagaaccttcgaccaaggctgccaaaacctggtgggctcgatcgggcgaagcatagggggttcactaaaggccaagacacttttgccacctgagggcccataacaaagcccatcaaggagcccaaggcacaatagactctagttaccctcacaaatgcccatatcataagggtattcatgtaaattctccttactaattaactctagggtacatgaaccctgtactcattaactttaggttgcatgagtttgtactaaagctataaatagtccatagggcatgtaatgggggattcaaaattccacaaatcaatacaccctgttttacttt

SEQ ID NO: 70556 - DNA, 1136 bp, Oryza sativa
agcgacggcgaagcacggctggaacggcggcggcgacagcggagttagggcgcacggcgctagaacgattccgccaccaaaagccaaagccaagggtgccgccgggtagcgaaaagcacgggaaagcttttaaaggggctcggagacgacgcggaggcccacggcgacggcaccggcgaaggaaacctcggcttggagagagggaacccgatccgaatcgaactcgattccaacgctttccaaagcgatttagccgatgattccaaagggaaaaagatagaggagatcccggagatggtttcccctcaatcaattcggccggagaaggaaagaggcggccggattggaaggaaacagcggcggcggcgcgagctagggtttcggcggcgatggcgcgaggaggacgaaggtcctgacaggcgggacccacctgtcagcggcagcgggcgcgcgcgcgcggcagcggactgggccggctgggccgagaagagagagaaggcggttttgggccgactttcggcccaaagccaaaagaagactttttttaaaactttttcaatttaaattatttcttaaatgcaattccatttattaaaaatacttccttagctcaaataaatcccagaaaaatctaggaattatagaattaagcaaagtatttaatgaaattttatctggccactttttagattggaatttattaattaaacttagattttcttttcaaacctttttaaaataaattctagaaattccatttaaacaacaatttatataatttgaatttttagggtgtgacatcctacctgtcggagagagagggagggagaggccgactggggaggcagaacggacttgagggagagagagagccgagcgggccgagggaggaggccggcccgagagggagagaaagggggcgcgcgggccgcgggagagaaaggagggattgggccgaaaggggcccaaagagaggaaggaggattttatttgttttctttttattttaattgatgcaatgatctttgtgctattaaaattatttctcgagctccgaaaattcacggaaaatttcggagagtacattagggcccaaagaatattacaaaatattcccggccaataatttttaaagg

SEQ ID NO: 70557 - DNA, 734 bp, Oryza sativa
cgagctcggtacccctcatattcttcttgatttcttgaatatcagaatcattaatttgggcttttctaacttgatcaattagagtgggcttcacttctagggctgcaacgaaacctctactgacaattcccaaatttaatctttcaaattccttgcataattccaatggcaactgtcgtccttccgtaacattgcaatagcctttcctgctaagagcgtctgctacaacattagcctttcctgggtggtaatgaattcccatgtcataatccttaattaattaatgtgccaactaaaacctgataatggtgggttgtgagcacatggttttgatggtcgtgctcatgacaattaaggaccggttcacgagtttcggttgtgaaacattaaccgtgccaaccacaagccagcatgggcaacggctttatcttttgtatcgcatggttcattgcggagcaccagactgagaagtggcggtgataagcccacgggggtcgctggggaggtcatgccttgtttataagggggtgattatgatccaggaaggtgcgctgcagtggattgtgttgtataaggggtattgtcacaacttctttccgatgtaccgtggtggtattgaggcacatggtgacatgatgtggggttgtgtcttgtgggtacagtggtacacctctgatcaaaataaaactattcgaatagccgtgcccccggttatgggcgggtctaacaatgtc

SEQ ID NO: 70558 - DNA, 712 bp, Oryza sativa
agtattagatcatagatcgttaccactcgacgcgctgcgcagcggaagaagacgctgagaagtcgaaggaactctcgcgaagtagcgcgcgtcgatgtagaggaagtagtcgatcgcaccggctcgaccttctcctcctcgtgcgttttcctcgccgtactcccacgccgatcagcaccgcaaaccagcgacgcctctaccggtatccacacgtacagggacggaacgccacgcgcagatgtgctagcacccgcgtgcggctagggttttgctcggggagggaagtgacggctagggtttctcacgtgatgcaatacctccgctggtcacacccctcacgaatatataggatccatcactcgggcctccaaggcccctaggactcctatttggatccctatccgaattaagctcatattggatctccatccaatccccttattccggcccattaagcatgcgaccctgtaggttcatgtatactcggctatagcccgaaaactccttttcggtccacgcatcaacagcggtccctagcagaacgtattaacccaccggacatacataaagatcatatcggctgaacctctagtgtatacttgtatgaacccctttgcctcacgatatcgattaagctaaaggctagatatgtgccatcctctaatagctcaatcattcactcgagcctgtggatagattatataatttgtga

SEQ ID NO: 70559 - DNA, 546 bp, Oryza sativa
gcggcgctccgacagtcggcgggcgaaacgaaggggtggacgaggttggcgaggacgcggcgaagccgaaggaggtgacgccgagtcgggaggaagtccggagcgacgacggcgacgaaccggagctcgtcggcgacggcggagagagaggaagacggtgcgggcacgattccgacggggagagtgagcggcgagtggcggaaacggaggagagaggcacggggaacaattatatagcgccgggagggggagaaagcggccggaggggaaggaaaccggcgcggaggtctcgggcgccattgatggcgccggcgaggtttgcgggagcgattccggacggatccgagggagagagagagggaaaagagggggatcgggagagggaaacgcggggaataattcccccctcattaaggcgcgcggggaaggcgggatgcggcggattcagcggcggcggcggcgctagggcacggcggcgacggacgcggcgggaggaggaagatgacaggtgggccccacccgtcagcgagagtggcgggcgggccc

SEQ ID NO: 70560 - DNA, 20909 bp, Oryza sativa
ttttcatacaggggaactggatattgaacgtttaaatcgtggagtgataacgttagtgccaaaatgcaaagaagcaattcaaatccaaaaatttcgactaatctgcttgctcaatgttagttttaaaattatcaccgaaatcctaatgaacaggctaacagaggttatataaaacattatatctaggaaccaggctgctttcataaaacacagatatataaaggaaggggtggtagccattcatgaaattttgaactcattgcacactacaaatggaaaaggagtgctattcaaagtggatttcgagaaagcttataataagattaagtgaccctttgtatatcaaatgctacaagttaatgaattccctgatagatggaatgactggataatgaaaacagtgaggggggggggggtcgagtatgtgtgaaagttaatatgtggaggggccatattttgaaacaaataaggggttaagacagcgtgaccccttctcacctcttttgtttaatattgcagttgaagctcttattgccctaaccaataatgcacaaaaacatggttttatctctggtttaaaggtggggagattaggggaggaaatctctatattacattatgttgatgacacaatattcttgttggataattctttgggaagcactaagaatttgaaatttatcttgtgcctatttgagaacatgtctggactgaaaataaatttccacaaaaatgaggtttttagtgtgggtttatccatgaaagaggaagaggatttatgtgcaatactaacatgtaaaaaaggggaccttcctatgagctatttggggatccccgtggataagataagaatacacaacagagtggaaacctactgaaaacaaaatagataagaggttgagctgttggcaggggaaactactagctacaggagggagattaacccttataaactccagtctcagcagtactatacctctatatatgatgtccttcaatgactacctaaaggagtgaaaaaataagaatggattactttagaactcatttcatatggcaagagatcaaggcattagaaagtatcacttggtccaatggccagagatatgcaaaccaaaagaccaagggtgattggggatccttgatctagatataatgaacattgctctactaggaaaaaggctttggaagttagaaaatgaaccagtactgtgcaggaaaatcctgagaaccaagtatttaaaaaaacaagcctctagctttgatcaaacacaaacaaggagactctcatatttttgtctggccttttagagattaaagacattttcctagctttttgtaggaaacaagttgggaatggaatgaggactcatttttggcaagatgagtgggtggggaacagtacaattgctgaacaatttatattacatttacaaaaaaaaaaattatagtagcaaaggcctttgagaaaggttgggatttctttaaatttaggagaattttgattgaggatatatatagctaagaaatgggaaacagttaaaaaaaatgtgtgcaatgatcactttgaaggcagaaaatgataaactgatctggactttaactaaaaatggacttttcactgtaaaatctttctaccatgctctaaaattatagacaagtgggtttccttttaaagagatgtggaagttcaaaattactttaaaagtcaaaggttttatctggttagccctcagaaatagcattctcaccaaggacaatctgatcaaaaggggtggaaaaaagggacaaacaaatgtcagttctgtaacaatacaaaaagtattgcacaagcttctttggttgtagtatggcaagatttgtttggagcacagttagatgtgtgtttgattgtgagatacctgatgggattcaaaatctaatgggaccttggttgaaagaattcgctaagaaaaccagaaagatggtagctgttggaatttctgctatcatatagataatatggaagatcagaaataaatcttgttttgacaatatactacctaatgatcctatagaaataatcaggcaggtggctaactgtatgtctgactgggcaattttacagaccaaggaggaagaaacaagaatactactggaaggggacaactgctaagacgggtggcaaatgagatctacaacgctaagtatggatggagcttcaaggcaggaagactgatgggatgaacgctgcagctccctcttgtgaattgattctggaagacctgtttctcttttgatgtggataaacaaaacctctgtctcgctttggtagtctgaagcctgttggttaaccttctggaagcgttgcaactatgtttttgtttttgtgtgtgaaaactctacccacttagtggatgtctctatgtaatattggagccagagtaactgttgggatacacgtaggctacgatagtataaatcaaaattttctatcacgtaaaccaggaaccatgcaagtattagatcatagatcgttaccactcgacgcgctgcgcagcggaagaagacgctgagaagtcgaaggaactctcgcgaagtagcgcgcgtcgatgtagaggaagtagtcgatcgcaccggctcgaccttctcctcctcgtgcgttttcctcgccgtactcccacgccgatcagcaccgcaaaccagcgacgcctctaccggtatccacacgtacagggacggaacgccacgcgcagatgtgctagcacccgcgtgcggctagggttttgctcggggagggaagtgacggctagggtttctcacgtgatgcaatacctccgctggtcacacccctcacgaatatataggatccatcactcgggcctccaaggcccctaggactcctatttggatccctatccgaattaagctcatattggatctccatccaatccccttattccggcccattaagcatgcgaccctgtaggttcatgtatactcggctatagcccgaaaactccttttcggtccacgcatcaacagcggcccctagcagaacgtattaacccaccggacatacataaagatcatatcggctgaacctctagtgtatacttgtatgaacccctttgcctcacgatatcgattaagctaaaggctagatatgtgccatcctctaatagctcaatcattcactcgaacctgttgatagattatataatttgtgattgactcctcaatcacctttggcatggccatgcacttccataatctacaacatcgaggggcccagagatatctctccataggaggggcaaatcccatcttgattattcatatcccactacatgtttcatagcatacccaaaaactacttttataactacccaattacggagtagcgtttagcagttactaagtaagctactacacatgttgggaaccataataatctcaggtctaaggattcaacacttacaataaatgagatcactgatgacacaacacatatggctcttgtagtgtctcatgttgggtctatccaacaacatgttcaccaacatgtgtccacattattaatttggtatctctataccatgatccatgagatatgatcatcaattaatacatgtgctgatcatataaacatatttattccacatatgatatttgatcagggatcctttagaaatagtaacaaacaacataaagagtctcatgaaagaatcacatattcattaaccaataataagttatctatttcaaggaacaatgtcggataaatatgtaaatatagtatgtgatacaatcatctctatgattgcctctagggcatatcactaacagtaacctcctcttccagatcgttatatattcatatcgagatatgatatgaatgatgtgtccgcatatggaagatcatcattttgaagaagggaaagtgagccgattatatgatcattctttccaaggattgatatataggaaagcaacaacgtaatcttgcaatcaattcttcattggaaatctgaaaaaaggatttgtttttcttcaccaagttaattccgagacgctgcacacacgaatttaacttggtgagggggtggggcaattttgttggatgagaatttgtgcatattttctaaaatgattttaaatgtagtgtgtatacacaaacgtatatgtaggatggggctgatgtaaatctctaaaccggcttagctagcttgtagcctcatcttttcgtttatatttatacttatcaactaaagttggaattttcaaccttaaatttagagttgattttggggttttttcatcaaagtttatttttcactctttacttttagattactaagaacacatatataaaaattttattcacaaattatttttcgtttgtaaatatgtcgtttggtttattcctcgatggagccattgttttgttattttctaaacttttcttgtttaggaacttttataaattaaggtggttagcaatttcgttccaccataaatctttcgggtagtacgtgtgttgatagaaaaaagcgccaaaagatgtaaacatgcttgtttttttacggttaaaacagcataaataatatatgtacaaggaggaacatgatacagaggggaggaaaaaagaaattccaaaaccaaaaccaaattatctaatcgattgaatccatgattgccagctaggtttgcttgcatcctttactctatgcatatgctcaataaaatcctccctgaaatctgagatccattaattcctgaagttgatggggattccattaaagatgagatcatttcttctaacccaaatattccagcacccaatgccaaggacttccatgaagaaagaatgagggaaaagtcctcttgcagccatgatcatgttcatgaattctgtattcagattccatgatatatataccaatgtgattccaatattgctgagcaaaagagcatgaaaaaaaaatagatgaatgttgtcctctgtgatgtaaacatgcttgtggttgtgtacactgtcaaaaagttttccttgaaatctttaggcttcaaattctatactatacatcatgcttatatatgctcctgtattaattgcatgcatgtcaatttttttcttgcaatatgtgttataaaaccgatccgaaaccaccgtcgaaaatcaaatatggaagaaacaccatagaagatccaaacacgatgataacactgagacactatatttattattgaggttcaaacatctcgggatcactgattacaggcactcctctccgatccaacataattacagcgcatcatatttacattgaccctcggccgactaatgctggcagccgcttcctcccgtctatatatgctaagtcatcatgtggttacaacatgattgtgtctctatttaagagagagtttagaaatagttcgattttaactctatcctgcatctgttataatttcaagttctaaactgtgaccgactacgtacatatatttaacacaaattctaatgataaacacagttgagcctcccaaaattcttggagtacagagaagacgtctgcagccatgttccacacacttgaaactcgcagattcctgccttgattagcatgtcacacatcgatgtcagcagctaatgcggcagctgcaaaactcacaaaacaacgctatttggagaacctagtacttgtctaaaccactacgccacaagaatgcaccataaaacctgccaaaactagcttcaaacataaagtatattgttcgatcgtcgcatgcacaagcatatggcgccaaaccatccaccggccatggaggcggcgccggagcacggtggacgttcgtcgtcgtcgtcgacggatccagagctggatcagcataacaagggcatactggagaagatgcacaagagcctccttctcctcgccatcctcgccgccaccgtcacctacaacgccggcctcgccccgcccggcggcgtctgggccgacgacgccgacggccacgtcgccggcgactccgttctccaggtgtgcgcgcccaaacatcaactaatttgtgtgcacatgatcaactgtcgttggactgaatttaatctagctcatgctcatctgacacacacaggcgcactacccggtgcggtacagcgtgttcttctactgcaacgcgacggcgttcgtggcgtctctggtgatcaccatgctgctgctgagcagcaccttcagcttccacgggtacagggtgcgggcgctgcaggcggccatggcgctcgacctgatcggcctcctgggcgccttcgcggcggggggatgccggagcgtgaggacgtcggcgttcgtgctggccctcgtggccgtcatcgccgcctacctcgtcgcccacctgctgctccacttctggatccggagcagccggtgcccctcccaccgccgggagctcgtcgagcttctgaatcttcaccggtgccattcttgctgcgtcggcgccgccgccgccaaggacgacgcgacgacggtggcgcaagcgggcactgaagcacctgctgctcctaagcgcgcgtccagcgtgtaactgcttgcgcctttgcctcccgcgggcaaagaattaccttccgtcgtcgtaaaggcagtaaacgcagacgtccaacaggaaattgctcagttttctttaaaaaaatctggatgcatatgagtagcatcgagcgagagattactcagtatccacatcaattattgggtgcattatcaattattgggtggatatatgagtcttgtttgtgttttctggttttatataggttgagaaaatatctgtatcctacttggccatatattcttattcttggaatctatatataattcctaggttgtaattactgagccatgtaattgtatctcactctatttaggcttcaatccttccccgtgcgcttcaaaaagactgatgattggaaaacagtggcaggaaaaaatcgggcccaccaaaaaacagcgacagaaaaaatcgccacccactgagaaaaaaatcggacggacaaaaaaaggacaggtggagatgggaaaaatttgggcaaaaaaccgcagcaaaaataacggcgacaaaatctgcttgcggaaaaaaatgatgacgaaaaaaaactatcggaaggattacttatttttttaattaagtataaattagaatagaaaaaaatacccgtgcgttacaacggataaatgttattttaattttattattgctataagatttagattaggtgaaattcactataagaactcacttagatatttttttataaaatcgagctataattaggagtccaacttttgtctcacgttcacattcgattctccaactgggcttgttagatattaatggcatgctttttaaactgctaaatgatgcgtttcgtgcgaaaattttctatatgaaagttgttctaaaatatcagattaatcattttccaagtttgtaataattgaaacttaattaattatacttttttaccaccttattttacgtgaaacacttaatcttcatctttaagagattcaaacatcacctaaagagatttcttatcctactccttttgtatttttaaagcaaatgaagttaaaaactaactcaaacacgcggatacgtagaacttaaacattaacttaaacaaggatgacgtaccaaaacaccgataaaaaatattcaatttttataatagtagtagagatatactgtatacctaataaaaaattaattccttagattccgtatttgtttcgtcgtctttttttttccgctttttttttccgcctttttttctttttccgttattttcgctgctttttccttttttccgttcctttcgcttgttttcttggtttccacacgagaatgacagggctcgggcccccgacggtggtggagccgatcgggcgctcccccgtgcgcccctccacccacgcgcgtgtatgcaggccctgagccccaccgcgttctctgctcctacctgccattgtaacaaatcacccacatattttaaaaaccctctattaaaggaatttggtttatttttttttccaccgaaaatgtttcactcagtgtactcacaatgtttcactatgtatagatttagtgttacagtgaactgaaatattccattacaacaaaaaaaatccacatattttagaaaccccctattaagggaattcgttttattttttttccaccgaacgatgtttcactgtgtatggatcaaatattgcagtgaactgaaacattctttcgctatttgctgaaacattgtttttatataaggtgaaacaacatccgatttaaacgagtgaaacatttttgatctacttggtgaaacaattccgatatacctgatggaacatcgtgcaacatttaaaaataatttaataataaactaattttttttgtcggaatacatccatgtgtgatcttgttttgaagatttaattgcaacgaatttaacggtgtaatcggatcatgatttggataagtaatttaagagaaagatcagtttaaaatagttttgcacgtaaattgggcgctgatgtccgatttttctctaaaccgatcgggcgcccgacccgtagactcgtccgccttttattcctcttttttccgttcttttttgtatttttttcgtcgtatctttttcgcctttctttctttttctcgccttttttttctccgttccgtccacttctctttttttctttttttattgccctgttttctttttctccgttcggtgggtttttttctttgtttttttgttttttccggtctattttttcgccgttttttctcgtcacctttttccttttttttttcatccgctcgtttttcgttgcaattttttaaatttgctcttttacacactttggtatggattcggttttattttttgtcgctggccggacccgcaccgtcgccacgttgatctgcctcttcatgcgttaccttctccaattgattgtaaaaatcgattcctcactacccgttatcatttttcccatgatttttccaatcaattctgctttaatttaccagatctaatctccttttaaatgtagtcgtttttatctcgagctttatggattcactcagattttgataaaaacagaaatagtagatcaagtgtatcaaaaagtcatcaaccaattttaggatcgagaatgattcgatctgatttaatgaggaggatccgattttctgaggtttgaaaacgcagtcggctatgtgagctgggcctacactcccacttgggactaacgatgctgatggcatttttaggacaaaattgcttgtacaatggcatttcatggaactcacacctgtcaatgctatttcttggaattgggcgcttatcaatggcatttcatggaattgggcgcttatcaacggtatttcttggtttttttctcatgataatgatacacttgttggactgttctaatgtttgatattttgtaccaaataatttgagttgttagatcttcatctatggctaaaaaactgacagtggcatttttttttctatcaattgtatatagataatcccaattatttattggtacctaagaaagaatacccgcgaataaaaaattgctatggattgttgaggaaagttttaccctggcatgtttggcaagagtagggaaggggaatgggagtttagagaaatgagtttacgtggcattagtcatgggagttggatttttagtccccatccccttgtttggattaatatgaagattattgtcagggtcatggataccacatacccaatagtaatcgactaagctcggtggggcctaccatataccaagtcttataaggaatcatacctcgtttatagaaggagtagcagataaggaaggacaattagagttcgatatggaaactagaaggactactcgaatcgtatcaatacttgtctccctagctctacttggacaagggatatctaatgggtattggtataaatacaagaccccctaggaggagaggggacacaaaacaacgagacataaagatcgacacacaagccaacacactctactagacatcgatatcagatattagcctagacgaacccaatatagtacctacggaggccgacaagagggatctaacgccatctctgatctcgacaagttcatattcgaggaggaagactaccatgtcgtcgactacgtgttggttatccatgccgccaagtcgacgacagctagataggttatcccaattattgtacttgtgtgagattcagatgaataaagagcaacactggcttcggccaacaggagtagggctattacttgtcagataaggggcctgaacctgtataaaaacccttgtctccatctcttttacttcaatctggcatataccctggtaccaacgatccacataccatgcaaataccatagtcgagacctcaaacatcgacattggtgtgccaagtagggagcttttggtgcatcaagatttcgacgagatgggttcaagagatggattctccaacaataaactactcgacgacttcggctgtggggtgatatgacctgaacgaagtgcgttctctgatggctcgggaccctcgtcatctcaagtcatcgtcaagtcaaagatttattgttcctatcatttgtatggtcaagtatattacgagattaactatgcttattaattaagttgtccccttaccatggaaaccttaaaaccatttggtcttgataaataatcatgtactacccttccatctactgcagacccttcccaacccagtaatacataactgaattgcatgtcgggtgcacatacaccaagaacattggttgcaacaacattttttcttgaacagtatcttggtttgtcaattgcgggcacatgaacttgtatgtatgtcccatctaaggcacctagacaggtataaaaaacagtaaatatgtgttgaaatatgaacaacttcaatctaaaatgtttgtggttagagttagaatattggtttgtactttaaaccacttccacctttcatctttatgatttccactaattggtttaggcttatttagcaacaccttccaaagctttaggactacacttagcactttgaaaattccaacttactgtcccaggtgatcgttgaaaatcaaaatgtattgcccagtccttcggatcatgtccaagattgtgcaaaaacatggctaccatttcttccaacttcatattgctagtatgtcccacaaaattctctaaccaaagaacacaccattctaaaataatgtctatccatccatagatatctaatgaattctttatcacttacacatatgatgttattcaaattttgtgatcgagtaatcgggtcataccaagaaggttccgaacttcgacaatgttgcattgacaccttctaatttaatatgccaatatatggatcaacagatacaatgtcatcacttttttcactctatgtgttgtagccacgatcatggtcttcatcttgttaagggttggcgtcacatgagccggtgccttaggaagaagggtatcgagaagagtgattgatctaatgacgttatgctatggtgtgagaaacatgatggtatcgttgaagtcaccaaagtcgacaatgtcggtgatggcgtagaagttgtcttcagaggaattaaggtagtcggcaatctcggtagatgaacatgaaccaagtggttgaagcattacgccaaccttcctgaagctagatccaatctcggccgacgctagatcaaatcgggtcctatgggggaaggcaaccttgagccgaacattgcagtgacgtcggccgggagtcgcatggtgatcggtggatacgttggcacgtcttgagcagaacttggtgaagaaagagaggtctttgcgatttcacccgaatggtttgaggccacctcgtgggatagaactttggagtagatcacagacgcgttcggtaaactgaacggggcagagtggttgtcccttcctgactggttcgaatcgagtcgagaagagagatcttaccgaagctgtcggtgataaagttgaggctgctaaaacagtacgcctgccctaggggtaaggtgaagtcatcgatgcctgatgtagatcccatcgcactagtcggcgagaaacatgacgcaagcccctacctagcgcgccaactgtcgaactagttttcagcaatactagaagggggtagcgaacaagcaggaaagtggatgagttgtgagacaagggatttatataggtttaggccttttcaatgagaagtaataccctactcatgtccggggaattaatccgctgattgtgatattgatatgatgatctcaagtatggttatgccccctaagaggcgccctgccctccaaaactgaacagattggttctgcttgaactgacccagactaggactgcggatgctcgtgaaactttcttatcttgggatgaactgttgatgctagcaacttgataacctgacagttcaccaagttggctagagaaggatggagttgttcctgaatcttgcatctggcatttgtaactcattgatcctacgtccgcttgaactggtcctggctcgaatgacaagtaattccaggaaacctgcttgacctgtcttttgtctgaactgcaaccatctgcttgacctgtctaagctaagcggttgaactggcctcatgggtgtaccttagaattcaatcggttgcccggggatcggcttaattcttctgataccttgcaacatgcttcttcaagtgctaccctgattgcggcactggttgagccttcaactaaaacagcgacgaagtgaggcaaaactcttctccgagacctaccccccttacagggagtagtcttactttcgcgtggctgggatcggttgaactgttgtccttcaaatataaccaacacttctctgttttgcgaagagccctgactttgaaaactaaaaacttcgccgatcgatcaaaatagagtaacaacgatgcactttcatcccattaagatttggaacttaaccctcagttgctgataggaaattccacataaagaaattctcatttagcatatgatcttactaactcttgactacttccccatcagttctacggctggcataactagcatgcttctggactgacgtcggtgtcgtatgcttggacatattgcatagtcgacattctttgaagcacacattgaccacttaacggatcaaaatcaagagtccttctcatgacataaccccacacgtcaattttttttttgactcttcctggattgatgaactgtaaagcctgcaactgctttcgcaaaaatactgtagtctgcacgactgccggaaattgactttgatgctgccgagagttcctgttctttgatcataacaacttcgccttcatatgttcggtaaagatgttccgttgaaaagtgtcataccctgattttcgtcttaggatttataaattatttaataaattattaatagaatttatattaaatgttcattaatttacaagtgaagttaaatgtgggaaataaaatttcctaaatataaagcatggatggatttaatttttattaaattctccatggttaattatactctctggaattttctcggatttttcggagctcaattattaatttttaatcatacaaagagcatttcagtaattatccacatattaaattaatcattaaatggtctaattataattttgttaagtacttttagtgtccaagtattttcaagatttttcttggaattatttgagcattggaagtatttttaacaattgaaagatcatttaagtgattattttaattggaaaaagtttttaaatccttccctaagtcgttgggccgatttcggcccaactctttctctctccgcgcagccaaaccggcccaatcggcccagctgcagccgcccgccccctcctctctctctgtcaaagtctagtttgcctccctgctacagtgtcgtccctaacctccagccggctgcctagctgagcccgagccgcgcgccgcgtcgcctttccgcctccaaatccgctccaatccgaccccgtttcttccggatttttgaggggttttgatcctctcgttctcctctatcttttcccccaagaatcggagcaaatcgttgggtattttatccgaatcaaactcgttttcgagtttatctccaaaaccgagtttttgatttctcgaagcgattcctctcgtttggagtccaatctcttcaatccaagcctatataaagcaccccctagtcctcctctttcgtttgccccctctcccgtggtctctcgtgcctcgtagctcgccgtcgacgccgcttagtccgccgccgccgccggccgaactccggtcgcgccgccgcgccgtctccgccgtcgccgccgcttgccgtcgccgcccgtgggtgcgccaaggggtggagaagcccggccgccgcttccccttcgccgccggccaccggagagccgccgccgccggtgaaccgagccgccgccaccgttcctctcgtcgccggtcgtcgtcgtttgtcgttgtggtgagtaccgttgggttcgtctcgtcgtcctctacgtgtacatgtcctccaaagtcgcagccgaccatccaatctccggcgtggtcgtcatcttggttcggccgccattgatgacgtcatcatgacgtcaccagttttcctttttcccgtttttctaatagattaaatcttcggaaaatcataactaaataaccatagatccgtttcgagtggttcaagttgctaaatttttctaaaataaagatctacatattaaaattgtccataaattgaattaaatttatttaattctttttaaatgggctttaattagatttaatcttgtaaaattcataataaattcatttgaagtcagaatgaggccgttcaagtctcataattcaactaaaattatgatctacgtgtttgtttactttatatgtattgtttatttggtttttattagtctttttcttcgttttgcgtgttagcttgtcgtttccgtcgttgcgaaggttcgtgagtgcgtcggaagtgatcaagaagattaattgaagaccgattattgcaaggcaagtcacacagatcctaaacactatcctttgagtatgttgatcctatatttaaattctctatttatttcaactgtgcatttattttcaaatgtcatcgggtggtgtgaacctatttctttgttatggccaatttgcattaaatgccctattccttgataccttgggtaataaattgattagcttgaaccttatgtattggtttggttcagctaaatgttatatatataattgcttagcaatgcttagaaacattagctcactaatgggatgaatcatatatactacattattatttatggttacatttaatggtagctcacgatggtaaatcgtgtgattttaattaattgataattaaaacctggttaaggtgggttgtgagcatatggttttgatggttgtgctcatgacaattaaggaccggttcgcgagctactgttgtgaaacattaactgtaccaaccacaagccagcatgggcaacggctttatcttttgtatagcgtgattcattatagtgcgccagactgagaagtggcgagaagtccacgggggtcgctggggagtccatgccttgtttataagggggtgactatgatccgggaacggtgcactgttttgagttgtgttgtgcaaagggtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgagttgagcaatgtttttcgtgattagtctcacgcctctcacaataattatagatgttataactggtaataatttgcttagctcctggtttggagttagatctgtacagccgggtgtggttgttcaggatggttgggcctgagcagcatgggtgtgctgttcagtgttgattaaaattgatgattaattacttcactgttttacttctcttaaatgttttgctaaatgctgcttttgcaaatgagcctatattatgccatcctttggaatccctgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagccagagcttcgctagattttattttccgctgcagttttcttcttggtgaggactaagtgcctcttaagtaagtacttatcgttttagttaatgtgatggatttgtatattaaattgtcagtttgtgtacctcggctgattcctggacgaggattttatgcacaaatcagttcggaaattactagtgaatttccgggcgtgacaaaaagggattctctaccatataccctactgactacacacttctggactcgactctatatacttctgacccatgtattggaacaatttctctttcaacttctgggaaacctcatgagaattttttttttctggaacttatagcggttgccttgaactatggaaaccattcttgtttcataatcacaccactagggtgtaattgccgcttaccattctctaacagtttccaaggctatagattccttgtatgatgttacttctgaatatttttttttcgttactccttacacttgaatacccttggtactgcctttagagagatttcatagtgtcgagcgccatggatccaaccattgtcactttcaaatattccatccctcttttcatttgagtaccactgatgctgcctttagagagacctcatcatgtcgagtgttgagggtctaaccattttcactccgttggttaaccattcctctattggctcgcaaacaggttttggagctcaacaaaattgcgatgagttagaagagaaactcttggtttcttgtggcactggcagatacacatgttaaattgcttctacatgctcaagatgaatcataaaaggagaggaactggctgactcatattttattcaatatttccttttcattacatggctgccataaacatatatgtacaatgagaagtactacaaaatcaaaccattgtagactgctgctgattagaactgccttttagacctgaaaagtagaggtcttgactggaactgttgttgcttccatcattcaaacctgactgacttgtccctttagttcctactagctgaagtctcaccgggaacgttgctctgcttgttggtcttcgatggtggagtaacaactctcttgactgccgtagcaggtgggacttcttactcgcgggattgccgagcggtggtttgtcgatgggcctccggattggagcaatacgaggtgcattgctagaactgacaacagtcgagcgacctggtgctgacgacacttgctgcgggtgctgatgaaggagcatactgcctctttgtaactgtagcgagctgttgttctccttgcattgcttaccctgctggcgctggtgctgtaggcttgaaacgatggccggtggaacaatgcggcctcttacggtgcccttgacgatgatccgttgaggcggaggttgcacattcaggtgtcgattggggtcgtgggcagtgctgataacttgtgaatcacgacgaactgcctttgctgctcttggaagaggacaatcactgaaacaatgtcctggcttacgacagttgcgacagaatcgacttgcttggtcctggggtgcaggcttctgattatgcactttggcagctgaaactggaacaagcagcgatttatgaacatccctagcgacgttgcttcttccatggttggcgtccaccggggctagaattggaggaagagcagaaggattgtgactgatgtcgtcgactgccattggttgatgaaagggttgcacggttgtcccttgttctttcttggtcataactaggaccgagttccgctgataatccttaggcacatgatcagttccctcacacaggaaacatttgaccttcctcaaaggtcatgcatctgagtaatgggtgtattcaccacagcgacatgtggggaggcataaactagcagtttgtccgactatcccacatctagtacatgctttgaactccaatcctctttccatgaaactgttaagggttgtatcatcatcgtcatcagtatcatcatcatcgtcatcagcagaaaaccgctctcctgattcatcatcttcgggtctgggcggaccgtactttatgagatgtcgggttagctggcgtgctccacggaaggtatttcttcctctctgacgcttgggtatcttgctgcatcatcaggagtaaattctgaactagtgatgatcatggtcctgccattatccatcttccatatcaccttcctattcgctccagagctgtgctgcagagtaccatctttcttgttagtagactgacttggagcttggttacttcctgggcactgcttctcgtccttttcaggtgacctggtgaacaccttccatggacagttccttatataatgaccttgctcaccacaatcataacaggtagcacttacttccctttggtctgacggtaacttggctgcagttatcttcagggatctagacaatattttggcaggggtcttcggtgccgatattgggaactcctgactttgattctgattccggtttcgggctggcatctagacttgcgcttgtggctggtgaccttgacgcggctcttgacattgctgttgcatctgctgcatcagatagatctagtaccgatgtcgcatctgccgtaacaactcttccactgtctgagtctgattagccatgacttgggattgtggctgatctttgagaggttgacgtgggaagcttatagaattgagctgagttgatccatgaaactgacgggatcctgatccgttgaaattgtccctcatgctgaccaattgctgtgggcacaagagagggagggggagatgagaggggttactaaagataaggtcttaaaccgattgcctactgatctgttgtgagtagacttttattcttcaagttgcttaagcaaacaacctagtatggtcgcatccccaccaatgatgcaaaacatacccctacacacaagcaaacaatacacgatcttgctaacgaagctacccttcagggaaggattgggtttaggtgaacttcgggaaaactcttcttgatcttcgcggaacgacgactctgaactgaccttctcactctttgctgcacgaagcttgagactcgacttgacttctggacaggcatgaagctggcggtttctcctccatgtttgacaactaaaagagttggagggacagggaggaaaaattttaataaaccgtttcgcaaagaaatgccgaagggcaagaggagacacttcgcaaatagggttttcagaaaacttgtccttacggtttgaccatttggctcaacctacagtcgagttggctctgataccactttgtcacgcccagaaatttaacccaaatttccagactattttgcgtattaaatccctgtccaggaccagccagggtacacaaaacgacaagtaatatacagttccaaacgtaaataaagcataaaatacttacggaagaggcacttagtcctcacaccgaaacagaacgacagcagcggaaaaaggcaatcctagcggggcttcagctccactccacaggcaaaactcaactggggtctgagccttggtcttctaactccatcttcagctcagaagcactacacttctgaaaagggggaataatagcaagactgagtacaaccaccgtactcagcaagccacgccaacgatccagacgtgcaaggggatacaaggaggggtttgtggctatttgcataaaggcagttgtaaaacattttattgagcaaaacagtaaaactgttgagtaattaaagtaatattgaatctccactgatcaacgctacaccaaattgaacaggcccaaccaacccacctgaactacagtgtattgggtcgatttattaagatgggactaatcacggtgaatctggtcgaccgcccataaccgcgggcacggctattcgaatagttttactctgatcagaggtgtacaactttacccacaagacacagccccacgacacgttaccgtgcgccgacatgtcaccacgacataccggaaagaggccgtgacaggacccttcgcataaccccctctaaccaagcacaccacacctcaggtttcacccccgtccccagcgggcaacgggcagtcccctctcgtgcctaggtgaatccggaagcgacagaggccgtcgcagggcccgccccgatccatcacgcccacccttgcctggatgcgtcggccagaggaaagctacactacaagcccagccgttgcccacgctggcttgtggtaagtacgataagttcttccaaggcatcccgcgaaccggtccttaattgccatgggtgcgactagcaaaaccatgcacccacagcccaccattcagtcgcattttagttggataattacgaccatgaagcatggccagatgtctcgagcacgcagctcactctgatactaaaaaggtctaatactgtaattatctcatcaactgagctagtggtaattaagcatggctaagcatatagttctagctaggtcacacaagtaacatgagctagtcgattcattacccaaggttgacaaa

SEQ ID NO: 70561 - DNA, 9282 bp, Oryza sativa
  unsure (1)..(9282): unsure at all n locations
cggactgggccggctgggccgagaagaaagaaaaggcggttttgggccgactttcggcccaaagccaaaaaaagactttttttaaaactttttcaatttaaattatttcttaaatgcaattccatttattaaaaatacttccttagctcaaataaatcccagaaaaatctaggaattatagaattaagcaaagtatttaatgaaattttatctggccactttttagattggaatttattaattaaacttagattttcttttcaaacctttttaaaataaattctagaaattccatttaaacaacaatttatataatttgaatttttagggtgtgacaaacctaccccccttaaacagaatctcgtcctcgagattcggaagaactggcaaacagatacggatgagctgacttcaattcatcttctcgttcccaagttgactcttcttccgagtgattactccactggactttgcaaaagcggataactcgattcctggtccttctctcacttgtttccaagatacggattggtttctccacataggtcagatcctcttggacttctatctgttcaagattagcttcttcagtaggtacccttaaacatttcttcaattgcgacacatggaacacattatggactcctgccaaagattgaggtaactccaactgataagcaacttctcctcttctactgacaatcttataaggtcccacaaaacgcggtgccaatttgcctttggtctgaaaacgatgaactcctcgtagaggcgtgacacgaagatacacataatctccttcttcaaaactcaaatctctgcggcgattgtcggcataactcttatgacgagactgagccactcgcaatctttcttgaatgattttcaccttttcttctgcttcccttaggatatccgtcccgaaaacctgacgttctcccgtttgatcccacaaaagcggagtgcggcacttccgaccatacagtgcttcgtacggagccatctgaagactagcttgataactgttgttgtacgaaaattctgcataaggtagattcttatcccaacttccaccgaaatctaaagcacaagctctcaacatgtcttccaaaatctgattcaccctttcagtttgtccgtctgtctgcggatgataagcagtactaaagttcagcttagaacccatctcttcctgaagtttcttccaaaaatttgaagtaaactgactgcctcgatcagacactatcttcttaggaacgccatgcaaacacacgatccttgccatatacaattccgccaagcgacttccggaataagttgtctttaccggaatgaaatgagccactttggtaagtctatcgactatcacccaaatagagtcatgacttgatgatgttctgggtaaaccagtgataaagtccatatcgatttcttcccatttccattcaggaatcttcaaaggctgcaacaaaccggcgggtttctgatgttctgccttgactcgctgacaaacatcacatactgctacatattctgcaatttcacgcttcatacttgcccaccaaaatctttccttgagatcctggtacatcttagtactaccggggtgaatggagtataaagtatcatgagcttctttcagaattgcatctttcaaatctttattgtccgggacacaaattctttcacccaactatacagttccttgctcatcctccaagaaaccgatagcttttcctcttctcatattcttcttgatttcttgaatatcagaatcattaatttgggcttttctaacttgatcaattagagtgggcttcacttctagggctgcaacgaaacctctactgacaattcccaaatttaatctttcaaattccttgcataattccaatggcaactgtcgtccttccgtaacattgcaatagcctttcctgctaagagcgtctgctacaacattagcctttcctgggtggtaatgaattcccatgtcataatccttaattaattccaaccatctcctttgtctcatgttcagatccggctgagtaaagatatactttaaactcttgtgatcggtatacatctctgtacgagttccgaaaagataatgacgccaaatcttcaacgcatgaactactgcagctaactcaagatcatgagtagggtagttcttctcatgcggacgtaactgacgagatgcataggcaaccaccttcccatcttgcatcagaacacaacctaacccaagtttggatgcatcgcaatacacttggaaacccttctttggatcaggtagaatcaaaataggagctgatactaagcgattcttcaactcttgaaaactctgctcacaatcttctgaccacttgtacttcacatctttctgaagcagtcgtgtcatgggcttaacaatcttggaaaaattctctataaaactccgataatatcctgcgaggcctaagaaactgcgaatctctgaaactgtctttggttgtttccagttggttacggattccacattgctaggatcgacggcaactcctcctgctgagatgacgtgaccaaggaacttcacttcagacaaccaaaattcacacttgctaaacttagcatacagttgatgttctcgtagcttctctaatgcaaggcgaagatgttcttcatgctcttctttggttcgagagtagataagaatgtcatcaataaagaccaccacgaacttgtctaggtattccataaacaccttattcatcaagttcatgaagaaagcgggggcattcgtaagtccaaaagacataacagtacattcgaacaacccatacctagtggtaaaagctgtcttaggtatatcttcttctttgattctcaactgatgataccctgatcgaagatctatcttggagaaaacagtggcacctttaagctgatcaaacaaatcatcaattctgggtagcggatacttattcttgatagtcacatcgtttagagcacgatagtccacacacatcctttgggtatgatctttcttttccacaaaaataactggagctccccatggtgacgaactcggtctgatgtatcctttctgaagtaaatcgtcgacttgcctcttaacttctgccaactcatttgctgccattctatatggtctcttatggatcggagttgttccaggtaccaaatctattctgaactctatatcccttttaggcggcataccaggtaaatcatctgggaacacatcaggatactcccggactataggaatctctcccaaagttatctggttcagtcttgaccttaaagactcagtagacaatgcatgaacggttacaacttgaccatcatggctggtgagagttacttttctgttggcacagtctatcacaccattatgtctggctaaccagtccatccctaggatgacatcaaggtctttggattctaacaagataagattggccagaaatggtactccttgaatttctattctgacagaggggctacgatgcaaagaaagtgcttgattacttggggtactaaccatcaaaggacgtctaagatcttctacttccatcccatgatttcccgcaaaactcatagataagaatgaatgtgtagcaccagaatcgaaaagtactgttgcaggaactgagttaacagggaacgtacccaaaatcacatctggagcatcttgagcttctgcagctgcaacatgattgacacgggccttcgatgctggtacagtagagttgctctgagcaggaacaaccttcacgcgacggggcttcggacacttgtcagcataatgtcctggatctccacagttgaaacataccacaggcttgctgccttgctccctcttagcaggctgttgttgtgttggagctgcaacagggcgtggaacttgattgcggatgttgttgccaacattgttgttgaagatctgacgctgcggacgaacaacagacgaagaacctccatgtggcatagactggggtcctaaagtaagacgtggcctttgattattcccctgttgtgccttaaagtgagcaatccggtgtttcttctgctccatgcgattgtacttgtcctcctgacgaatagccttatccactaatttctggaaatcagaataatctccagtcatgagtgggtaagaaagctcatcattaagtccttccaaaaacttctcctgacgctcttcatcattgcgcacatcttccggagcataacgggctagacgattgaactcgtgcaaatactctgtaacagagcgagatccctgcgtaagcgacctgaactccttcttcttgagagacactactcctgatggtatatgcgtcttccggaaagcagcggtgaattcaagccaagtgataggttcagcagtagtcctattcaagcggaagtgatcccaccattcagaagcaggaccatgcaactggtgtgatgcaaaagagaccttctcctgatcagtgcactgaagcaaatccaacttcttctctatggcatgcagccaatcaccagcttctacaggattagtggtactagagaaaataggcggcctcacacgaagaaactctgctaacttgttctgaggaggtgcatggttatttccttggttctgctgattctgaagttgttgcatcatcatgttcattagctgagtctgttgagtaagaacttgagcaagggttggattctctccattgttgttgttattgaggttgttgaggttgggaccattcccgttgctgcgagtattcaccatctggcaaggacaggataagaaaagaaaccggagaaaaactacttaggacagagaattactttactttcattgatcttaactgggtttcattattacaaactgaaaactctcacaccactaaactcaccaacttcctaacactcaaaagcaaacaaacgcatgcacttacatcccaccactgatgtaaatcacatgcaagaccaacacacacacaagcaaacctaaaacaagcaaactaacacaacgatctaagacaacgacctaacaagtcactctagttcttccgagcataggaggtcgattgaaggctcgttcggctcatcttcctcatctttgatagctgcccactcaatcttggaattgttgcgcttggattcttcttcttcatcactacttatgatgatgaccggaggatctgcttgagctggggcaacttctttctccaccacgcggatctttggcgccaattgataacgaggaacaaataaagctctcttccttgcggtaagacgaatcctggccttctgcggcggtgcttctcccttcaacgcggctagctccttctccaaacgatccaccttgtcttctagcttgcatatcttaccacgattccaatcttcccgatcttgagccgctaacacagtctccgcacaactttcatccatagcccatagcatctcaaccaaatgccttgtagtagcatcattctcaattccttcagtctcaaggtagctgccacggtcacttccctgtggttggcgaggatggtaacgatactcagtgtcggccaactgatcactgtaacgatcacggagctctcctatggcgatccttgccacctcctgacacgcatggatgtagtttcttcctccagcttcgaacatcaccgatgggatatcttcactattactgttcaaggtgactttgactcggcacttctcttcatgacgatcatgacgaatctgtgcataaaaaggagcagtcccaaatccaatgacaaaggacatagtacgcaactcctggacaaatccttcaacaccaaacaggtactcaggcttgaagcgcggcatctaaagacaagtgaaaggagggagttaaggcatctatccaattaatagcacaagtttttggattaatttttaataaagtttagaaatcaaagtaaaaggtaaataaataaagtaaaccaagtttgctagatgagttgaaacagttggaaacaaggttacaaattttgtacttttgaataacaggtttcaaaagaaataaaagaaagagggttataaaatcatcttgctaaatttattttattgcagcaggattaaataaaacaataaaaacttctactggtaaatgagccatcagtacagtaatagatgtacagtactaataacattggaataaaatttgaatgagaaccattaaaaaagattatgaaatgcatgtgccattagtttggtttaattaaaagagaaagagaggagaacagttctacttttccaatatttttagaaggcttctatgggtaaccatttggcatatcctagggtcaaggggctctgataccaacttgtcacgcccggaatttctatccaaaattccaaacgcttacatgtgtgtaaaccctcgtccaggaatcagccgaggcacacaataacaaattgataatagagtacaattattactctaattattaagcgtataaaatgtcattacagaggtagatagttcctctcaaacaataaagatctaagcagcggaaaaagataaacggcgcagacggctccactccacaggcagcttgaccaaggctacacctaatcctccacaccatcagcttcactgtagaacccttcttctgatgaatgattgcaaggtgagtatatgacatactcagcaagccacgcagcaaatatgcaagtgcacaggataacaaaggatggcatagtagggctccatttgcaaaagcagcatttagcaaacatttgagaatttaataaaacagttaagtattaaacattattaaatcaacgctatacaacataccctgttgtataggcccaaccattctgaacaaccatcccggctgcacagttctatctccaaaccaggaatataccattccaaaccaggagctagtcaaattattaccaaatataacatcatttactatggtgagaagtgtgaaactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacatcggaaaggagttgtgacaataccccttatataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgcccacaacccaccattatcaggttttagttggcacattaattaattaactaatcacgattgaccatcgtgaactatcaataagccatcatgaaataatagtgaatcattagttatcccataagtgtactaatgtttctaagcagggctaagcaattatatctaatatctagttgaaccaatataaataaagctcaactagtcaaattaatataacccaaggtatcaaggaataaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgcgaaaacggactctccggaaacgacggaatctaagcagaaaagagcaaaatcaccaaaacagcacaaaaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaaggggatttattgcgtcagcaactagggtttgggtggaccggcgcacgggcggcggttcacacgaacggacggccgagattgatccgatccaaatcggacggccaagatcgatcggtctacgaccggctcacgggataggatcccgatgacgtcagcgatgacgtcaccgacgacggcggcgactcggcgaagaagacggctcgggcggcggacactcgccggcgaacggcggcaccacggcaccaacggagggcaccagcacgtagaggacaacgcggcgaacacaccggtgaccaaaacggcggcggaaaaggaacggacggcgacggcgacgagaaggaagcggcggctaccttcgggttgacgacggcgacgatgctccggcgggttccgacggctgcgaaggggcggacgaggacggcggcgacttggcgagcacgacgacggtcttcccgagcggcgccgacagctggagcgacggcggagcacggctgaagcggcggcggcgacggcgaagctagggcacacggcgctagagctcttccgacgacgagaggcgaaggcgagggtggcggcggaaagagaagggcatggggatccttttaaaggggctcggaggcgacggcgaaggcccacggcgacggcaacggcgaaggaaactcgcggcttggaaagagggaaaaccgatccgaatcgaactcgattccaacgctttccaaagcgatttagccgaagattccaaaggagaaaaggtagaggagatcccggagatcatttcccctctattgattcggccggagaaggaaagaggcggccggatttggaaggaaacagcggcggcggctcggcggcggcacgctagggtttcggcccgaggaagacgacgggcctgacaggtgggacccacctgtcagcggctgcaagggcgcgcgcgcgcgcggccgncttcggactgggccggctgggccgagaagagagagaaggcggttttgggccgactttcggcccaaagccaaaagaagactttttaaaactttttcaatttaaattatttcttaaatgcaattccatttattaaaaatacttccttagctcaaataaatcccagaaaaatctaggaattatagaattaagcaaagtatttaatgaaattttatctggcccaattttatattgaaatttattaattagaattagattttcttttcaa

SEQ ID NO: 70562 - DNA, 5006 bp, Oryza sativa
gtcttaaagcatcgaacacatcattcgctttgtcagacttgctagaagcattaaaagaaccccattgcagtttcagtttaaaaatttgactctttctgaatagttgagcatcagttccctcatccctgcttttcacattctcaagagatgtaatagcaagcgacccctgaagttcattcatctgcttcagcacctctagtccctgcactttactcttatcaacacagaattccccagccgctcgaagacatggcatatggctgctggcagctaaatcaacagtgcacatacgatgaacatcaatacacaaaatgctgctcaaggtgcccaagcacttaggaaaagtaacaagtcgcctgtccatgaaacatgaatgccagcgtatggacaacacaagtaaatggtgaagtttacagagtgaatttggaagcgagttttgcgtatgttgtgttagaatttcaatggttactctcattgagaagaggatggcactcgagatggggcaattttctggttttcttcattcacaaaaacacaaaagccatacctacccgagggaggttggatacatatatatagccatagctggctgctagcctattgctgcaccctcctagtctaaaattcaaaatttgaatgggatgttgtcctagaaggcatccaaactgaataaagcataaaggaggcataaaggagatgctaactgctgctgtcctactaaccgcagctgtcctagcaactgaaaaatatgctaaagggtagatgctgtcctgaaaaaggtgaaactacccaaaagcaaaaagaagaatcacgaccaaggatcacaaagacttatccaacattctccccctaagtcttgtgcgtcgtcttgtggggaagttgggccatcccgatcctggagcagagctcgaggaacttgatcctcccaagaggcttggtgagcaagtccgcaagctggtccttggtgttgatgtagctcgccttgatgctcccttcttccaagtagcttcggatgaagtggtacctcacccggatgtgcttgctccgttcgtgaaaaacggggttctttgtcagggccagagcggacttgctatccaccctgagctccaccgttccagtgtctctgccgaggagatcactaagcagtcgagcaagccagagcgcctgggtcgaagcggcggaggccgccatgtactcggcctcgcagctggacagggccaccacctgctgcttgaccgactgccagctaacgagcacttgccgaggaagaagagaatcccgctcgtgctcttgctggtgtcgatgtcgccggcgtggtcgctgtcgctgtacccgacgaagtgtgccttgccaggacaccttgggtagtagagaccgtggtcgagagtccccgcaacgtagcggatgatcctcttcacagcctgctggtgctccgtcgtcggtcgctgcatgaaccgactgacgtagccgacggagaaggccaagtccggccgtgtgtgggtgaggtagcgaaggctccccacaagacgccggtactgtgtagcatccacctcctccgccgtgctgtcgcggctcagcttcagtctctcctccatcggagtgagagctgggttgcaatcggtgagcccagccagctcaacgacgcgcttggcgtaggcggtctgtcgaagcgtgatcccggagtcgtcctggtgcacttcgatccccaggtagaaggagagaggccccagatcactcatctagaaggtggccttcatctcctccttgaacgccgcgacctccgcatccttggtgccggtgatcaccaagtcgtcgacgtagacacccaccagcaaggcatttcctccattgccccgccggtagatggccgcctcgtgtgggctttgctcgaagcccatccccttgagcgtggaatccaacttggcattccacgccctcggtgcctgccgcaagccgtagagggccttgtgcaggcgtagcaccttgccctccttgccggggatcacaaatcccggcggctggtgcacgtagacctcctccttcaagtcgccgttcagaaacgccgacttgacgtccatgtgatggacgccccagcctttctgagcagccagcgcatgaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctctaggtcgcgaggcaccagtcccggcaccggctggtcgccgagaagatcctccatcgtacggtaccgtagctgctcaccgtcgtggtatgcgatgcgctccccgtcgtgggagagcggagtagcgaactccaccgggctgcgctcaacacgagctggcgtcgaagtagacgtgcttggaggagtgactgttggtgctggagcatgtggagtcactggctggggtggtgtcgacgaagagctcgtcgtagtcgaagtcgtggcccgagggtgtgttggtgtcggagtcggtggagattcgggggctggggtagacacgctcgatgaagaagagctgcctactcccccagctccctcgaagtggacgtactcgacggtgaagtcgtcgtacatcggagtcgaaccatcgtccaccgccttgtcccatacccaccctcgcccttcgtcgaacacaacgtcgcgcgcagtgcgcacacgctgtgtctccaggtcgaggatgcggtaggccttcgagccctccgcgtagccgatgaacacccctggggtgctcctgtcgtcgagcttgccgatgtggccaagctccttggcgaacgcgaggcagccgaagacccataggtgggagaccgccggcttgcgcccatgccaagcctcgtacggtgtcctgccatcgagggccttggtaggcgagcggttgaggatgtaggcggccgtcaccaccgcctccccccaaaagatggccggcatccccctctgcttgaggagggcccgagccatccccacaaccgtctggttgcgccgctcgacgacgccgttctactgcgggctgtacggcgtggtgtagtggcgctgaatgccctcatcagcgcagtacgacgcgaactgaatttgccgccgttgtcggtgcgcagcacgcgcagcttgcggtcgcactccgcctctgcagtagcttgcgcatgcctgatggcgtccgcagcctctcccttgctgccgaggaccatcacccacatgtaacgggagaggtcgtcgacgagcagcaggaagtaacgtcgtcctcctggtgtggccgctgtcactgggccacacaagtccccgtgcacgagctcgagccgctccttggctcggaagctcgtctgctggggaaaggggagccgccgctgcttcgtcaccacgcaaacgtcgcagagctgctccacgtggtccaggcacggcatgcctcgcaccatctccttagcactgagctgcttcagggcctcgaagtggaggtgcccgaagcgctcgtgccactgccacgcctcgtcgtcccgacgagcggcgaggcaaactggttgtgcgacctgcgcgctgaggatgtagagttgattagtgcctctggttaccttggcaagaaggcgacgacggcgatcccaaatcctcatgagtccgtcctcgaccaacacgcgtgagccgttctcatccagctgtcccacgctgatgatagaattcctcaacgcggggatgtagtagactccggtgagcagcctgtgctcaccggacttggcagtgaaggtgacggagccaacacccttgatctccacgccggaggcgtccccgaacttgacggagccttggacgctggagtcgaactcggtgaagaactcccgtcagccggtcatgtgatgggtggcgccggtgtcaaagtaccacccatcagccttgtcgttgctggagccgttgcagagggagacgagtaccttcggctcatcaaggtggaggaaagccgctgcggccggtgccgctggaggtagctcgatgcttgcatgagccaggagcagagccggctcttcctcctccacccgtgcgacgtgggcctggccacgtcgtggctgtcgacagtctttggcccaatggccaagcttgccacagttgcggcaggcgttgtctcgtgccggcttgtggttgccggtggcaacgccctgggcgcctctgcgggcgccaccctcggcacgttttcgcgcccaccgtagctggacacctccccgcgccttgcgcggcttacggccgcctgtcggggaagatgactcccccttcctcccgtcaccctgagaggcctcccactgctcccgagtgagattgagcttcccgccgatggtgatgggccccgagagaggctgtggctcatcaccatcgacgaccttgaggcgacctaacgcctcctcgatcgacatcgtggagaggtccagcagagattcgatcgagcgagcgatctgcctgtacttctcagggacacagcggaagagcttctcgacagctctctcctcgtcgtaggtgtcgtcgccgtactgcaccattttctgcaagagagtgttgagacggagagcaaagtcatcaacatcctcacctggcttgaagggcaggttctcccactccttgcggagtgcctgcagtgtggacttgcgggcgcggtcgctgccgatgcgtgccgcagcgatggcgtcccaggcctccttggcagtccgcttctgggaaagcgagaactgcatctcgggcgggactgcagcgatgagggcatccagtgcccgccgatcctcgtcgtag

SEQ ID NO: 70563 - DNA, 9990 bp, Oryza sativa
gcccaccgctttgcccgctcccatgcccttcctcttgccaactcctcaagctccctgtcggcggtgatgtcgccggcgatggagccgttgatgctgctgcgcaaggtctcaacctctacctccgccgcacgtgccgcatcttccgccgcctccgcctccgcctccgccctggctgctgccaactccactgccgccagtttggccaccctcgctgctgctgctgcagcggtctgagccgttgctcgcctgcgctcttctgctgcggcgagctcggcgtcctgctgacgccaagtgctcgaggcgaccaaacgccgagaccgagcgtcggacatggcgcacctccggggggctgctgcgtggagagggggaagggaaaggggaaggaggagcaaccagtgctgctgctgctggctgagagctcaaccgagcttgggaaggggtggaacaagagatgtttagcctacaggaaagtgtggctctgataccagatgttagaatttcaatggttactctcattgagaagaggatggcactcgagatggggcaattttctggttttcttcattcacaaaaacacaaaagccatacctacccgagggaggttggatacatatatatagccagagctggctgctagcctattgctacaccctcctagtctaaaattcgaaatttgaatgggatgctgtcctagagggcatccaaactgaataaagcataaaggaggcataaagaagatgctaactgttgctgtcctactaaccgcagctgtcctagcacctgaaaaatatgctaaagggtagatgctgtcctgaaaaaggtgaaactatccaaaagcaaaaagaagaatcacaaccaaggatcacaaagacttatccaacatgttggagataaagaaatctgagatgtatcaaatgatcaatatatgtaggcagaaattctaagcaacagccacttaaatccaatactcttatgcacttgaattccttaaaaacatccgcctgcagacaaagttttgagcaaagagacctgccttcgttcagaaactattagcgtgcgcagcctttgcaagttatggaatccatggagttcatttactctttcgacaggtatagacagatgccgagttgttcctgaaatttctgcaagattaccatctctttctattctggagtactcacctctggaaatgtgagaagcaaggtcattcatgaggtcatgcataacataacgtattgtatggccatactgaagttcctgaaaaaatgatctagataatagttcattgaaataacttctaccagtttctctcatactttcatatgtgcctatatgaccatgaacaaatttatgggctatccacatattcaccaacaagtcaggctcaagagaatagcctttggggaacaggctgcaaaaagtaaaacattgctggaggtgacctggcaagcattcatagctcagacgcaaaatttgcataatgtcttccttgtttgatgaactacttttcataactcgtgtccactcttcaacgttgaggttagcattcaaatgtgcaccaacaacctttatgactaatgctgagccattcaacttttggacaatacattcaccgatagactctagttctggataatttcctggatcttcagcgccaaatgcgcagatcctgaagaggttccaactatcttcacccttcagaccctccaaatggaatggtgctgggcaacccaaaatccttgaaacaatatttgttcgagcagtaacaagaattttgcttcctttagctccatagcataaaggagcaaacaattctctccatctatcagcatttgtaagctcaccaatcttttcatcataccacacatcatctagcacaagtagaaacttctttgctgttaacttgttcttaagatcttcctggagcatgttaaaactgaaatttgttatatcactgtttctatcaattgatttcaaaatctctttggtgattttgaccttattgaagatatttgaaacatatatccatgtcctcagatcaaaaccactgactattcttctgtcattgtaaataagctgagctaatgcagttttcccaatgccaccactgccaactatggtaattatagatggtgttggtgatattgttagtcctctgcttggctctggtccatcagcttctctcagaagtcggtgcactagatcatcctgctcattttgtcggccaatgataatttggccaggagaaattgagctggtgacacgccattgaagtggctgaggaggcatatatgaattagagttttcagccccaatcactttgatgagcatgtcagcacattcttttactctaatcaggctattgaggaccctccttaacttggatctgaacttgtcttggccaaccaaacgctttactatggcaagagaactggaggccaagctacttagcttgctcttctgctgagcatttgccttcagaatcaggtaatcaaattcatccatgacgtcgtcggcatcataggcagaatctttcattttggcaaagtagagcttcttggttgcaatctagcatttgcgacctttcagcagcacccagcaccaattggatttttatcaaagtggattcgatcttttttagatcatcctccaagtcagattgccacttgtactgggttgatgtataagattggaccttctcaaagataagcttgatgataggacaaactacccacccaatgccggtggctattggtagtgtagccatgttggtcaatgtacaaacctatttccctttttttcaaaatatactgttttcttcaaatgaccattacagcttgaaactcaataatccattcacctaataaacattgaaaataattagaactaaccaaaataagaaattattgctcaaagatgcagtcaatatgggctactctactcttaaactctatcaggccatgtataagaagaccgaaatatgggcctcaaacacaaatttgcaactttaacggcaaaaattggatacacgagtaagagtaaatattgtcttcattcttcaatgatgcagtcagaaaacagaataggacaactgccagctagtgattattgaaatattgtttacctgactagtagtaagatcagaactgcagctcactcctagaagaagaggcccttgatctttcttcttgctgatcaaatgcaaggctgctttcagagagaaactaggaggagagccagattcaaacagagggaaatgggagtaaaccacaaatggatgtgcaagaaagttgacttccacctcttcaaacaaagaaaaaaggagaggttttttcaactttgagtaaagaattactccgtatcttgtatgcatcccacgttctcacacaaacaacagctggagggctttattagccgggttgaccaaagagacgaccaaccaaatcttataacagctggagagcggaggtaggtacactccacctagcagaataggtggaatcaccgtgaaattccagcggtttggcttccgatgcatcaaagcaggcagtggcagtcggtctgtggagaaagttttactaacaaattgttccgtatgagatgccaagaaaataatatacagactgttttgccacttagagtcttgaggaaggggaggagtttagatgaaagtgttggtgtgggattaaagtctatcttctattaccaatcctagctctgtgtgtaatgctgattgcgttttaccaagcaactacaatataaaatatctggttggttataaaaaaattagcttggatgtagtatcataaggagctaagatctactcatctctctgctttaaaaaaaaaggatttctctcctgtattgaaatgatggtgttgatcccttatattttccatccctgttgaattcctacatccatcaacagacaagaaaaaaaatggtattgaaatgatggtgtatcaatcccttatattttccatccctgttaaattcctacatccatccactgacaagaaaaaaaaatgttaataataacatcaaacccgctcaactcctattagtttcattccctctcaataatccactaatccactaatcattcccttaggacaacacatgattgacttcaccgatgtgcgacatttaaaaactctacggagactttaccctaagattaagaaaaagcgttaccagggcgggccagccggctctgcaaaacgaggcggtggcggcggcacggcggagccgagcggcgccaaacaagccattggtctgggggacatacttccaccgtgtgcagccacaagcgcgctctcacctcgcgccaccacccaatcggtgaattgggaggcgccgccatcgccgccgccgccttcttccctttcggcggtgcagcgctcccggatctcggttcgcgaggggaggccatgggcgaacccgccggtggaattccccagcctgcgccggccgcgacggaggcgttcgccggccgccggtggccgcgggcgatgaaatctgttgacgagacaggtggaccaaattttccagtgggctgaatttggtgacgggaattttgtggtccaaattccctcgtgggctgcatttgctgacgagaattcagtggaccaaattcattggtgggccaaattgtcgactgcaattaggtgggccatatttattcttggcccagttcgtagattggaattaaagttgggccaataatattcatgggcctaattcgttcatacgcagtagctgggccaatttcttttgtaggctgaatttgttatgggaatttaagtgggccgaattcattttagcctttattgggctgactttgttgatgggatgtttgtgggctgaattcacttctgggcccaaattgctgacatgaactaaccaagccgaattcattggaatcagtcagtggaccgaattcattgacgagaaaatagtgggctgaattcattcatgaccgccagcaagttttagacgtccaaaacatactcccccttccaagttttagcaactgataatttcgactttctcatttaaactttaaccatcaattaattacctatatattgttggatcgaaatggacttttttttatgtgtatatttaggaaataacccattttaataccataacatcatttctagcgttcataattatttaagaagaaagatgagtggttaaagtttaagagcaggtacaatagcaggctataagccagctataaacatattttaaagagataaaggaagagagagaagagcagcgggtgtcacgccctgaagttcccctttccagctttaaaatttgtaaaataaatcgtccgaagaaattgttcaatttaatctagagctaattcctcaaattaataaatgcaaataataatcgaaatcggacgcacggacttcaagacataatgtgtgtatgacatgtaggaccaggtattactagtacagtaagtaactaggggatagaattggctattacattagctatagaagatatagagctagtagtgggctatactattgtatgaattagctattacattggctatagtgaagcattcaccggttagtatcagttgttatgaaacggatgtgctagcaacttcgtagagatgtcggcatggctgtcatggcctcatgggaacaaaggctgttcttcctattttcgaaaaaaaaaatggttgttcttccgagaaggatggatacaacagtagagcaggagccaggaacagggcatggtcgcatggagcgtgtagcaacgtggaatatggcaatgctgagatctactgacaccgaggaatccaaacaaaccttactggtggataaccagcctgtattctccatacttaagaataaggaaattaaggtggtagactagactgtaaaaataatctctgtatgccaatcaccaaaatattcagaagttgaaccagaagatcaatgcaatcaaatgtttccacaagtttgtgctcggttgatgtgttcaactgtttctttatttgttgcctgatttaaccatatcctaattcatattgtaaaacatattaacagaaggaggatgtcttgccaggtgacactgatcctactaacacactatcccacggtatcacaccatcagactcctccatggccgcgaaagaaaaagtaatcgcgttgcttgcaatttgtaccgcgtgagatggatcagacgccaagtacggtttcgagcaattacatgcctggcctttgtccagaagtctagagctactagtactacgagctaagggcctgtttaatagtccaaaaaaaaaattgcccccgcatatatcagatatatgaacacactcacacacatttaaagtattaaacgtagtctaataacaaagcaaattacagattccgctaggtgcgagacgaatttattaagcctaattaatccgttattagcaaatatttactgtagcaccacattgtcaaatcatgacacgattagacttaaaaaattcgtctcgtaatttcctggcgaactgtgtaattggtttttttctatatttaatactccatacatgtgtccaaaccgcgtgaaaaattgcagctacgtgacagcgagaaaaatttcgtttgggaactaaacattccctaaagctcggatcaagatcgcagctaatcctggtgtaagtgtaactgcgctgctcagttcacaatcactgttactggctcatgctcatgctcatgctgcccccaaccccgagtccgtagcccgtaggcctgaaaaggcctagcacgaatgtagatcaatcgaaactgttgatgtgctatactccttcctctatcccataaaaattaaatttagaattgaatgtaatatatccaaatataacaaatatgaataaaaacctatccaaattcgttgttgtgtgctcctgcaggaatcatagacctaatagaccaggaatgtaatccttttctccgtgattaataaagtttccctctttaagctcaaaaaaaattcgttgtttggacaaagaaagtattttagataaatttattttacatccaatagaatgtattatatgtcacagagtttgttccagttcgacaatatactattgatgttgtttatttctgcaatatgccgatgagtttattaattcttctccaatatgccattcggctagatcatttttatgaaaaatacgcagaatacccttaaagacatcgaagttagcattaatttataggtttaatttatagttgtctttatttcttgttgattacaggatcaaatcaactggtacgctagcatacccgaagacgatttttggacctgcactggaattaagcagatctctcaggcctcgtgtttttcatcaatatttaaataagatataaaattgtctatatagcatccttacacaatatgaaagtttgcatatagattttcaagttattggggcatttttatttttttaaaagaaataattttatgtgataactgatagagaaattgcttacgtaaaatataatagcataaaattatgttgggtaggatatgaaatatgatttatattaaaaacaaagacaaaatattttatatagcataaatggataaattataatattttataaaaaatgaaatacaaaaatctttaaacttatacacaaactttcacattgtgtatagaggctaaaaaaattcataattttttttaaaaacttttaataggataaatcaatagttaatcttacatgtaaggccaacctaatgatatactcccttcatattagtaaagaaagtcgttgagtacaatgtttaagttaaatcttgagaatataagtgatgaataactctcaagttgttgagtttgaaaatgtaaaattatatgaatagatttgtcttgaaaaatactttcataaaagaatatatatatatatatatatatatatatatatatatatatatatatatatatatatatatatatatatatatatatataacttttcaataaatatttttatggaaacaagaactcaaagttgtgttttggagaccgtgctgctgtctaaaatgacttcatttacgagtacggagggagtattaatgccaattataaatcattaaactatgataaactcaatattatagagtatattctctataccgtgtcatctcgatggtaaaaaacagttgctctctccggtcatccggtcacacactcgagtcactctcactcaccacagttcttttttcttccaaccaaaaatcactctcaagttctgagtagtgatttttgccgtctaggtttgaagctaaaacttccgttaccaaaatgccggcattttgaatagtattttggctatgtttggtttcctacagcaacaagtaaatattactatcaaaatatcgataatgtcaaaagacagggtaaaaaccaaccttcgttttggtgaggtgacaagataagcagaactctcaagtctcacaatcgctctgactgcaagctggggatcttggagcttgcagaaacacggatcagcgagaggtgctactgcttttgcaaaatcacaagttgccgagggtgcaatagcaaaagaaggcaacctttgctaattgcttcgctactcgtccttaaaagggaagccgccgcgtctgcagctgctgcaaatcccaataaagcgagagcagaaaggaaggaccccttccaccactctccccctgtgttgtgcctgtgctcctctcatctttgactacccacgattccagtctcccaccacaggccaaaacactgcaacatttcagacttcacagttcacagtgagttcagaccaagaacacaagaataccaaaaagaacagcaccaagaactctcctccaatccatcacagacatttttcttccctccaagagaggcattgatcatcagagagtagagccagggcgtgtgtgtgtgtgatgagctcagtgctgctgttcttgcttctgctgctgctttctggagtgagcttgagtggctgcataaggcttggcaatggcgggtatgaggagtggaggatgggctcggcgacctacatcaaggagtccctggggcacccgctgaatgatggtatgtgcaatctgtgtgtgtgttttttaacagattaagcttctgaatctttgtcagttggtaggatcaagaacatatgccctttttctgcatttttctttggatggattcatcatggagatggtgaatgtagtttgcaaggatgaatggtgggcagatggtgtagtattgtgcagatccggcatagtgggaagtgaagttcaagttagaagtaggaaacaggagtgaagattcactgctgaaacttgttcttccctttctctttcttcagatagattgtgactcttcgaactgaacttccaatgtgtgtcctgttgttggcaggtccattttgttttaatttgtaaaaaaggttagtaaaaaggtttctttcagggttataaaagaatgttggtgccaatgctaataaagctatcattccaatcaaatattttgtctaatatcattagataaaaccttttatgtgcattagtgcactaatgctttcctagtcggacgaaaaaaacaaacgataatactacattattggactaagtgggccttaaattattggactaatgctgtcctagtagtaccagttatcttttttccttttaggtaggttatagaaaagctgaggcacattgaatgcatttgacaataatactactatagttatgacaggcaatctggtactatcatatgatatttccttgctgtttactgtccatgacgtagtacacatttaagtccttgagagtacatttgcagtaattgctccatggattattaagtgtcaaagtaacgcaacatatattgtcagatcaagattcatggcagcccaaccacactgcatttcctcacttgggatatcctgaattcaaggacatctcaacatg

SEQ ID NO: 70564 - DNA, 4355 bp, Oryza sativa
ccacggcaataatctgctcaaaactctatcttgaaacagggccttaatcttgacatcttgttggctactgtaaagctgatcatctccatctcacttgacaacggggcaaaaattatcaattttttgtctgaatgcaatgtgttgtctgaagtctgaactttgaacctgcaaatgcaaggcggtggagcctgtgggtacggcgacctggacatcttcaggtacgggaggtacaccgccggcgtgagcggcgcgctgttcgggcgcggcagcgcgtgcggcggctgctacgaggtgcggtgcgtgaaccacgtgctgtggtgcctccgcggcagcccgacggtggtggtgacggccaccgacttctgcgcgcccaacctcggactctccgacgactacgggggctggtgcaacttccccaaggagcacttcgagatgtcggaggccgcgttcctccgcgtcgccaaggccaaggccgacattgtgccggtgcagttccggaggtaaaacaataagcttctcccacacttttcttttacatcaccatagtctccaatacatgtttttgttacttatagttatatgttagtgaagtgaaacgagtagagcgacatggagatatacatttttaggacaaattcactacttgcttcgtctcaaaatatagcaagctaatactagattagatctagtgtgtgttagcttcggctctgctagtatgggttgtttatcgatcctattggtgtgagagttttgactcttgttttttttccctgtactgttctgaatgttctccttcttggtacaatgtttggtcggaaaagccggcgcggcaaaaaaaagtactagattggactcaattagttgtgttcagatttgtagtactaggttgtgtctaatctaatactactagattactgtattttaggacggagagagtactatcttagtacgattgagtagtccaagcagttttaagtttgattgcccgtattctggaacttcatctatcagagggagtattagagcaggtacaatagcagactattagccagctataaatatattttaatgagataaaagatgagagagaagagcagcgggctatagatctgtagccagctgcaacacggactccaagacgcagtgtgtgtatgacatgtgggaccatatattaatagtatagtaagcaactgctattagattgactatagatgaattggagctagtagtgggctatactattaaacttgctcttagagcaggtacaatagcaggctataagccagctataaacatattttaaagagataaaggaagagagagaagagcagtgggctatagatctgtagctagctgcaacacgggacttcaagagtcgtaatacaggcatgacagatgggaccaagtattaatagtatagtaagcaactattgtatgaattagctattacattggctataaataatttggagttagtagtgagctactattaaacttgctcttagtactgcacacatcatgttcatgatttgctcgctggtcattgatcacttgtagcgtatcattctgcaactagctgatgtgtgaattctgaccatgcaaaaagggcatggcgctatcattcttgagtagtgcatttggagtgtgtttctctaggctgaaccagtgctgcttttgcgaaagttcagaatgatgtttgatcattggagatggaacacagaatatgcggacagtgcgtgtttcctgctgctttgcatggagcaaagagcagctttaaatctttaatcactgctgctagcttccccctttttaaatctgacttgtgctttgttaattatgagcacctccacagtttcagacaattgccatgagtgtgtcccattgccccaactgctgatgcaggagtacactccaagtattccatttttctagaactgtagtagtactacaactctaacaagataaggttaaatcttactgccaatctgctgaattccgcatgagtcaaagcatcactttttttaacgactcgtattaaacagtatgaagttttataacgaactaccgcaatttgggttttcatgacattagccattgatggatgaactctagatagtactacaactccaataaaagacccaaaaatttagctgcaactactgatcagctctgcgtgaatcaagcatcaaacacatccatgggcgtcggagctagagtaagattaaggggggtgctacttgtttaattaactctgtcttatattaagtttaagctaatgcggatgtctaaatttgtattgagaatggtgcacacggggaaaataggttaggtatagctataatttttttttgaccaggttcctgggcatgccaccttaatactctagctccgccccagaacacatcggcacattgctcatatcgggttccatctaatgaatgaacgaaatgagtggtggtggtgcagggtgagctgtgacagggcaggggggatgaggttcaccatcaccggcggcgccagcttcctgcaggtgctgatcacgaacgtggcggcggacggggaggtggcggcggtgaaggtgaaagggtcgaggaccgggtggatcccgatggggaggaactggggccagaactggcagtgcgacgccgacctccgcggccagccgctgtcgttcgaggtcaccggcgggaggggccgcacggtcgtcgcctacagcgtcgcgccgccggactggatgttcgcgcagaccttcgaaggcaagcagttcgtcgagtaggtgtcgacgatgtgggtgtcattcttggaatgattgtaattattatggttataattatattatacaggtgaaaaacaactgttttggtttggttttggtttggatgttgttgtttgatctgctcagcatggcaaacgaaattattatagagttaatcagttaatgaaggattgacaaaaaaaatgtttggctaatcagagcagttatgtgctatcagtggtccagtgttggagtagcatcatctgaagaaaaaacaattgagtacggagtaccatttttttggttggtgacataatagaggtgcataaactacataaaaaagtgcatgtagagtacacaataaataacagggaaaacactgctttgtggtaggacatgtcatgggcatagtattcttgaatcaattcgcgaggcctggagtgaatgaatcattgggtgaacatgcaaatggcactggggttcacactcaccacaggcacagtgacgaaaaactacgaagagagtagcagtaaagcacacgctagtgcagtgaagaagttttctagtcatactggtgatgatcatcacacaacaatcatgctatcgaaactgtcgcgcctagcttgctgacaggctactgtacacatttcagcacctaaaagctaaagcctatatatagaacttccatgagcgaggatgcacactacttacagacgaggtcgcagtttttttttcatatataaacaagccgctacgattgatgagttgagttttgcttaagcaagcagagacaaatcgggaaccaactacaccacgggaagagctgctttggcaagagaagcatcacgcatcggcatctaaacaaaggaatctattgctagctgcagagaaaagaactaatcagaggcatgaagcagatagcaagagagaacaggcaagatttcatattacggtgagtgagactctgagaattgactccaacataacaagagagtaaatgctcaagcctcgttacagctgaaaaaaagggaaagaacaggtacctggcaattttcgttcttcatgactgcttacaacttctagcagggcccctacgtatcctcttcaaaacagggcgaggggtaccaggctgagtttgtgaggagtcgccttcagcatcatctgatagcagattgttagttcacgaaaaggagatcagcagaaaatatgcactttcattgattgtgttttcgtctacacaccatgcttatcttcgctgttgtttttgtccatcgaccgggtcccattggatgatttccttttcttgttgacaaccgttgagattagtttgacgtcctgaaggcataacaagaataatttatttccttccgttagtttaccctccaacaaattgtacaagatttggatttctagttaccttcacatcttcatcttgagtaaatttttgagactggctgtcatcggacctagtttctcttgcatttaccttagccacctcttcctgctgggtaatcctatcacgcttatcatgttcagatcgtttctcacctatcacaatgacaccacgtgccattggtgctctgcaacctcacatttccca

SEQ ID NO: 70565 - DNA, 2027 bp, Oryza sativa
tttaaaactttttcaatgttaaattatttcttaaatgcaattccatttattaaaaatacttccttagctcaaataaatcccagaaaaatctaggaattatagaattaagcaaagtatttaatgaaatttatctggccactttttagattggaatttattaattaaacttagattttcttttcaaacctttttaaaataaattctagaaattccatttaaacaacaatttatataatttgaatttttagggtgtgacatcctacctgtcggagagagagggagggagaggccgactggggaggcagaacggacttgagggagagagagagccgagcgggccgagggaggaggccggcccgagagggagagaaagggggcgcgcgggccgcgggagagaaaggagggattgggccgaaaggggcccaaagagaggaaggaggattttatttgttttctttttattttaattgatgcaatgatctttgtgctattaaaattatttctcgagctccgaaaattcacggaaaatttcggagagtacattagggcacaaagaatattacaaaatattcccggccaataatttttaaaggaaatttttaattccctcaataattcacttgattaagttgatttaacttttatttaatttctagaaaatgtattattaattgatttttattcccgaacgaaaatcgggacgttacatatcctatacttattctagttacataaactatctcctgtaaccatttggataatcaagccctgcgagtatatggtacccataatatccacacccaacattataattttgtcggcgcatcttcgcactacacaccattgcatgctaatggttattcaacactgcttgctcatgatggttcttctgtgccgcttgcgaaacccacttcatccgcacttactgggaacaatgaccatgtcactgttgatagtgatgatgacaatggtgccgttcggaccagattgaagctaaattggatccaagaggaggatgttagactggtgagattttgatgcaatttgcctatatttgctttgtgaatgtgtgtgcacaataacgctttcttttgttatgtttgtagatgagtgtttggttgaacaattcaatggacccaattaatgggaatgataagaaggctgaaaaatattggggagatggagaagagatggagaagcccaaagcaagccaaggagcgttggcacaaactcaacactcggaaggatgtattccaaggctgttggtggaaggctaaccacacgtataaaaccacacaacatgagatggagaagcccaacgcaagccaaggagcgttggcacaaactcaacactcggaaggatatgttccaaggttgttggtggaaggctaaccgcacatatactcggacggacccattatttccaatcgttagatctatcttatatattataaaaaacaagtgtgtattcatgatacatcgcattctaaaaaatattatcatgcaattatatttcatcgtccaatcgtattcatgctaggctgcatggagcctcccgccactcgacatgaaacatttgctgatggattatccctcaaattttagactacataaacccatgcatttagtggagcctcatgtcccacccaatttatccgttaatatacaatggcaacctatatcaaaaaaaaaagtaaaacaccttacttttattttaaacttaatttgatagacatgttctctaaacaaaataagtctaccatctttaaaataagtctaccatctttttttaagatgatgaagaagattataaataattgtttgtaaggattaattaaatatgatgtagtataaagctaactaataggttagaaaattataaaagcaatgctgacaaaaacaatttacggagaaattgtatgtggcagatattctccggttaatattgtactcttgtatgtgtctcaaacatagtctactatacatacccacaagaatgcgcaggtatctttctagttaattctaac

SEQ ID NO: 70566 - DNA, 4689 bp, Oryza sativa
cctccaatattgcaatagaatcaattgctccttgttttggattggtactattatttttgaaactgctattgtttcaagtgagtgaagtgggtctctaacaatctggtatcagagccaccaatccctactgagttcaccaagcaagttgccatggcaagtgaacataagttggatatgattttgaggcgaatggaggagttcgaacggaggcgggtggaggcagagcagacaaggagagctgatttccaatctctcaaggtagcgttagcatcatggattccccatttagaatagcactgaagactcacattttttagttgggaacaagcagtacaagatgacgcccaccatgtgttcgacaaaatgcttcagccccgatgtcgagcccaatctcactgttgatgtggttgttacatgtgccaccactgctatgacctttgttgatctggtagctgctgaggacgcaatcggtgcaacctacatctacaatcctatacagcccatggtaacgcccgccaagtgtttgacaaattgctccaaccccaatgacatcccagacctcatcgtggtagcagtggttacgtgcacctccacttctctggcctccatggacctagaagttggtgaggacgtcgcctgcaccactgaaattgatggccctgactgtcacaaggagacgcacaccaaatgttcgatgttaggccttgatgtcaagggtggcgcagaccacgtcggggacgtgttcctgacaatgacgggtgtggccaaggctgttccaatatctatcgagtcaattgacatcttctcggcaaggttagtcagcgacctcaagtaggacataccaatgcccaccgggtgtttgttgagaatccctcgatatgacagcaagacacagttcagtaaaaagctaaggctggaggggattgaattgaagccatggccacctccaacctacagtggagtgattagtggactgagttccggccaacgccttggccagcattcatctattgttggcttgaagaacatctacttgatccttggccaccatcaactgaatgggctaagttgaaaccgtggcccccaccacatgagaatgacatcctgcccttattgatcaatggcttcacccatatcctggtggatcgaaaagcaatttcaaaattctggaaagcgatttggagtgagtcaggtgaagaaggatcattgtttgttcctaagctatatgagctgcacttgagtggtctccttcagcattcagtaagcatgatatgacaacagcttatgtcaaggagaatatggtccactaaggctaaaatgaagatgttgaatggttgggattctaaacagtacctgagcattatgcggcctattccaggattgtttgttaaacttatccaagatatatctccaaagagccatcatcaagcttatgtagaagctcaagttgttaaaaattcttggaaaactttggtgaaaataaggtacactttttggctcaatcaattgctgtacctgagactcaccttggacaaagctgtattggctgctgttggttgtatggcccaaatgcaattagcacattccatttactaatagccatgctgcatattgtgagaccacttcccatgtagcaaagaaatgggctacagacttgaaaggccaaaccaagttggaagatgccaagtttgattggaatacactgggtacattggttcaagaggtcaattacatttaattgatctgtgacagggtttcttatggttgtagtgttcagaagtgctatcctcagtctattctattcatgcacaatggttggtgttttggtggattgcttgattggaactctaaacaatacaggaacagtatgctaactgtgaacccattggaactcatgcaagttatgttagtgccattagtgtgggatccagatgcgttgaaatgggtcagattggcagctatgctttacaaccagaaaattgtcaattaactacctgcatgagagcacattgcattaagccaagtgattatgagatcatcactgcctattgatgtaatggaggatgaaggcaatacagtttggacttcagaattttcagtcagtggagtggtacagaagaagcgattgaaacgtgatctttggtcgtgtgcatttgctgttaacaaggacatgaaggttgttatgttgctgcagcaatatggttctgcaaacttagtaattgtcaatttattgagtgttccatgggatccaggcggctctcatttggcattagctattaaacaaggaactaggctttcactgtgggctattacaagcattggctggttgtgtttcctatgatcatattggctacattacaagagaaatagtaacaggggagatcaagtgggtgaagcttgcacagcttcgagtcatcggcttggggacaaaccgaatttcaagcgaaggaggatgttaggagccatatgggctgcaatatgggctggatgaactactttccaagaagtccaagcaagcccaagagacaaccatatataaatagcagcagcacttctaggagggggcgaacagatcattggccaagacggcgaacggcggcggcggcggcctggaggccggttggctccttggcgatcttttctctacctcccttctcatctactaatctagaagcttctagaatcttttagcctttgtatccttccatcttccacctcaaaagcctccaatattgcaatagaatcaattgctccttgtactggattggtattacttttgaaactgctattgtttcaagtaagtgaagtgggtctctaacaatatatttcacacaagatgtctgaacaacgtgctgaaacacaccttggtagtggtagatgtataagtatttcaaaactcgtacaacagcggggattattacttatattccccttaggagcacatcacaaatacaatccatcaatcgtgtataagaatcacactagtattagtaattcatactcagtattatcctttactctgcttcagtgatcagtgtcagcagctagcgttcaatgtcgccgccctcagacctcggcgacgtggccgccgccggaaggccgccgcggacgtcgtcgccgcaggcaaaggcgatctcctgcagcttgatcgacgcgctggagctgaacacgagcagcggcttcttccgcggcacgggcaccggctctgcctcgcggttcaggatctgcaccacgcgacgcatcgccgggcgctcgtcgcagttggggttcgcgcagctcagcccgacgagcagcagccggagcatctcgtcgcggtagaacccgccggcgaggcgcgggtcggcggcgtcgatgaggcggtcttcgccgtgcaggcgccacacccagtcgacgaggttgacgttctttcccccgccgtcgtccttgtcgatggggcggcgaccgcagcacacctcgagcaccacgacgccgtagctgaacacgtcggtctgctcggtggccttgcccgactggaggtactccggcgcgaggtagcccatggtgccggcggtgagggtggagacggggctcttgttgtggtccatgaggcgggcgaggccgaagtcgccgaggcgcgggctgaggttgccgtcgagcaggatgttgctggtcttgatgtcccggtggatcacccgctgctcgcactcctggtggaggtaggacagcaccgacgcgatgccggacgccaccgtgtaccgctccggccacgacagcgtgcagggctcgccgtagagcgccttgtccaggctgccgttgggcatgtactcgtacaccagcagcagctcgcccttgtcgtcgcaccatccctcgagctggaccaggttcttgtggcggaggcaggcgataacggagagctcggcgacgaactcgttccggctctggtgcgcctgcgtggatcgcttgacggcgtaggagacggcggatgcggtggccgtccccggcatagccgccttgtacaccgtcccgaacgcgcctttgccgatgaccctgctcgcgtggaatcccctggtggcggcgctgagctccttgtagctgaacttcctcggccccttcaccagctcgggcaagaagccggcgttcttccgggaggtgagctctatcagcttcctgatggacacccaggcgaagaagacgaaggagacggcaagcgcgacggggccgaggatgccgagggcgagcccgaacctcttcttgcgagaggcggcgccgcccgcggccgcctcgccggggacagtctgcgccgacgcgttgccggtggtgttcgaaaaggaagaggagttggtcgccgacgggaagccgaacgtctggaaggtccattccttgatggtgtgctgctgcgtgctcccctccgtggaggccgagaagccgacgtacatggcgtccctgagatacggcgagaggtcgacggccacggagaggacgggcttcgccggcttggcggcggagtagctgagggacacctggaggaggtggtcggcgccgtggtagtcgatccacgccgtggtgaggttgccgctgttgaggacgacaccgaacgcggcgaggtcgacggcgttgaccgacaccggcaagccgaggtcaagcccgacgtggttgtcgctcgggtcgccgaactcgtcgttcaacatcgtatcaaactcaacggcgaca

SEQ ID NO: 70567 - DNA, 12090 bp, Oryza sativa
cccaaatataactgcaacctgaatattcaactggtgaactggtgagccaacaagatgaacttggctagtattctttctatacagaaatctctcatcaagttcaccccagaagggtgcaattgatcttgcaaactaagaaatgaactttaacatatagctgatataacattggtatgccacaaaaaatacccttacaatagaaaatgcaaacccaaatgttaaaagagaatggttggttgatacaaaccattcatctggcagagactttgtatcgaagcctgcattcaatattctccatttacgacagctgtagcactgaacccactcatgatcagccttatagctccccctcccttttctctggataaagaaagttaaatggagtgaatagtgcttaaaaagagaagagaatggaatattctgaaagtcaaaccagtaggatgtactagtagcctggtggtgggagggaatgagtcatgaccaagatcgacagtgtgccaatgcaattgtgtgcattcaacaggaaagcacatctcctgatctacaaaattattaacacatgtacacatgcaatttatatgtagcttaagtggggtgcttgtgaggcgtgtcttctctgtgctctgtaccgaaaaggaaggcaaaatgaggacttaactaatgtatacaacaatctaaaactggatttgagagcatgctataacgagaacgattatagtacatataacataatctatgcactttttacataaacttaacccattatccatttatcaacctacaatagtgaaagaaatattgagacagcatttttaattaaaggttcatgtactatagctatcccctgattataataaattctgtctcagtaattttcaaaataaatctgctcatgtccttttttacacagcccatctaaatatccattaatcctaaatattctgagtgcagccatgttaggacaactttttctcctttttttcttgactgagggttgttaacttgttactccatatatgcatgatcaaaagctgtgtcagctgtcagcatatgctgtcagctactctataccttgttattgtcatttgggagatctagtgaccattgaattcaaagaaaaattaaagaggacttcatggccagagatgcaagtgttatctaaaatattttcaaatatgaactaaatcatgcattcataccaattcgagagtgtcaaaatttgtatcccagtattcatccgctttcctaccaagccactcctccagtttagcatacatttcacaatcttggaacccttgtttactgttaagaacccatgaattaccatcttcatcatcctgcagaaaagaggaacataaaagtttgttcaagggacaccacaaggaaaagtaacaggaactgaattacatggcagataagtatatttggaaatatacaataaggtctgtgatatctgcaactccaattactccacgtcccatgtcagcattatgcttttgacctccaactcgttttaagactgagaagagaacacaaaatagaagttcagaataagggtgcacatgtcacgagggaaggttatcgttcatactaatttatttattgtgcaacatgaaagccaaaaagtgcaaatagtttccacaactaaacattaaacaaaatatgtgattaagacctgtttgcaactacagctaaataaaattcaataagaagaggcacaatctcattataattcctgcagatagttgttgcatagcattcaacagacctcaaatttcccatgatcaacaaagatggggctaaattttgccctccaactctacactagagagagagggagagggagactttatgcagcctgtttgtgtaaatgtattacggtttgtgttctactgttctatatcaaatgttgatcttgaacagttgcatttgcatgtgtgcttcaacacggagaaattattctagtgcaaaaatggttttggagaattttgtaggggaacatgctgaacggaagaggacaaaaatgctgactttacctctattagacggccatgccaatacaagaaaattccacagttcattctgtcccattctacattgctccttccaagggtcaattgaatagtcctacccattatttcaccagatataacagatgtcttgttaagggtctttgctaaagggcgagttttgacctaccaagaaaataaacagtaaaagaaaagaatatgaatgtgccaaaacatagagagaaatgacatatgggtatttaccgaagacccttggacagagatcttcatccgaggattcaggaacataacttccaaataggactgaagagaatagtccaatggtacctaaaaaataccatgaaacaattagtgaagccagaccatgttttcagcatttccatggaacaaagtttactggaaaaataagccattaacactgatgtcttgattaaaaatcatgcacacacacacacacagtacattcagaataagagtacagattgtgaagcctatgcggctacatctcatcaaggttaatcaaccttcaagggcaatatacagaccataaataatttacatttcccaatgccacagcaacccatcagaaggatataataaatttcaggtttatatgtaattgaaactgataattggctcccatctacaagataaaaattaaaaataaaagagtaaacttcacaaaactacaggtactttgatcaatatatcagaaaactacagatttaacatcagttttatcacaaaactacaacttttgtaaccacaatagtgctatggatataaactctaaaaatctgtagttctttgataacctcattactaaatctgtagttttgtgatacgatgctttaaatctgtagttctggtacaaatttcgcgctaaatctgaagttttgtaatacaaattttcaaaaatttgtagttttgcgatagtttggtcaaagtatctgtagttttgtgaaatttgtcaaggaaagattgtaatccatacattgttacttgtttgtcctgggcgcaatctgactcttcttgaacggattagtatgtctccacgaccatggtggacaggatcttcagatggcttccctgaactccagtccaaggtgtaatctgcaccccatctatctaaattccatatataaatctgtgttccagtaccgtcttcaccaaatatccctagcttttctccaatgaaatactcattggagggagaaaattccttaatagcattcaagttatattcagcagtagcttcagattggacacttgaatcaacttccatgtattgcccttctttacgatatgtcaccacaggtatctcaagattctgcagcaaatagcactgtgttagctacgttttacaactgagctacctagctttagagttcccagtagactaagaatgaagtacatagagccgtgcttacatctttattttcattaaaagactgagataggaaggccactgatctggaagatgaagtttgggttagcacaattgcatctctgccaagtttcatagcaccagtctacaaaataagcaccaagaaaacagtaaactcaacaagaataagaacaatttttcacataaacaaacatctgcaagtataaatttaggtcgaacaagaatgcaatacggtaactgttttgaacactagcacatgaagtgtatggatttgcctcttaaaatcaataaaagggctaaaggagcatgaacagagggtgtgtttactgaatagatattcctaacttctaattgacataactaacatttattcaagttcattggttgagcagttaaatactgtacagtccaagacttttaagtcatgctagcttacagacagaaaaaagaaatgaaaggacgtcagctttgagatgctgttcactgcatagcaaaatgttacactctgcctccaaaatccgtgttagcgcagttcttatgtggagcaggcctatgtttgcatagcactccgcttacactttcatcccggctcgtacaatggttggagaaccaaggctataagccgctgaccctcacccacctaaacttccaagatggtactaaaccacctcctacaaccacaattgggccatgggcctcaactacaccacactacaggtggcaaacgggctacagtgttacacaaaacctacctaactagcacccatggtgaataatatgctgcagaaagcatgttcagaagtgtattggataatacagaaacaagttctaatttactcacaggtaatgcatcatataagccgataaccaaagttttgtatatggaatgcagacaacagagttcccggtacattttaaacaagtcagacatgccacatcaatacagcataaaatcggcttgagatgtgaaataaattattttttaaattattaaatatcagaaatgttaagaaactgataaccggagaggaggatgacgccaacaggttaccttaaatccaattccaaacctcccaatttgatcctggcgttgcttatccggtcttttgtgaccgaatgagatcattctcatcatttcagcacaagtcattccatgcccatcatcaattacagacaagacagggatttttttgtctgctttcttcgaaaacaatgatttgactgaaatattcaaccttcaagaaaggtaggagaacaaataagaagtcagctcaatcaaaataacacaaatgcacccccccccaaaaaaaaagggggggtaatcttcaaaatacgctaacaacacagtcaaattagcaaaagcctcaaatagtctttaaattatgtatacaacactaccctcagagaggaaatgcttcctacacaactacacatattactgagattacattctgtaaatactacaacaaaagcagtaaatatgtaaagtttgtatactaatagaatgggcatgtgcatattcatctggaagagatgtaaaacaagacaataaagaaaacttagtttggcatagtggaagattgtagtctagagctttagttcactgttttgccacaatagaaatattttgtaactataatcagtaaagaaacccttaactaattagatcgcatgttgcagcacagcacaataccggaaatgccaaatcagccctaaaaattatctcaagaaaaaacagcacccaatctctggctacacaaccttgaagaaatgggcataccttgatgcatctgcatctctagagttgtcaatgagctctgctattgctccaaagacccagccagcatgtgtctgactgagtgttcgcagataactaggatccgtgctgacaaaattttttgcaagagtggtggttctctttttcactattggatctaaaattctagggccatcttcaacagactcacatggtgatgattctggaactgatttgtgcagctctgtgacacgcgaggcattcatctccttaggatttgggccactatcacaaatctcctctctcaaatatgactttggattcatcgagccagattggaaatcacttctgtatgacctttttaaagcatctgtcatagcaatattcatgtgtcattctggtggcataatagacaagtgaataaagttaaataccacaaagaaacgaatcagcaaatagctcatagctgactacacgcatattatggtgtatatctttgatgttaactatagagagagcttcctccaacaccatggacaagtgagaatacaaatgaagtaataaaaaaaaagaagggactccaattgcaactcttggggattaatagaccaatattgatgaaacaaagattactggaatgtattgccaattgttaaatttcaagtttttttttatataaaattagcatagggtcagccaaaataaaaggagaagtaaaccatccaagcatagcattcctgttcaacaatcagcataggaaaactctcaccagatactccagccatcggtttgcagtctccaggatctttttgctcatacatgaccaccgcatgtgagaagttagggcgttcatgagattcatgagattgaggagggaaaatatgtaaggcaaaggagctgaatctaactacagcaaccttcaaaaaagcaccgaaaaagaacaaggaccccacattacaggcaagaaaagaacagagaacattgctaatgatgttaataataaaatacaaaatggcaagtagagaacagaacaatgctaatagtgctaataataaaatacaacatgcctactgacttgcaggggaacaaaaccctgacaaaagttgattaattggaagataaaaggtactacagtgcatggcctcccccctatcagcctatatgtccctgttatttgtcccatgtccgacacctaccccacctagtgcgggttctcagtaagaagtacgatagtatccaaatggtcaatcctttgccccattttacttgaacaaataagtaacaaaaaaagataaaatatcttgtatatatttttttagagcacctatcttgtatatttttattagcaattatgacatgcaatagaaacaataattaccctctgattgtcccagaggaaacgcatgaactttccccattcaatattctgacgatcatcttcaggttcaggaagcagtgaaaatttcaggaaatcacactgctggtacaccttagttggcacaaacctaacaattgaccaaaccgagggcctgtaaatgtgaaaagcacagacataagatacctccatgaaattaagaaacaaatcaccccaccccccacaacaacacacccaaaaaaaagtcatggtttttttaccgacatgttgattaaatgtttgtagatttgagtaaattaacagtatagctgcagcaattcactttagtagtatatatttttacaaaagctctaccactattttgatgatagcatatgagattgggtagttgtagcatggcatttaacagggggtatgtatggttgaaatcattgctggtgactatttattttgactgagagcaatggagggctcagggtctctgacaagtactgtgaaacagcgggagcagtcagatgatgctagtatgaaaacatgaacacaccagcattgaactttataacagaagaggaaaacccactaatacacactgtagattgtagatttaaccaatcgatgacagtatgcgatagagaacatcaacaatatttatctgacaatagttttggccaatggatgatgatgtaaaacttgtaaagtattcacagatcaggaaaagaaaaagagatcaacttacactttaactggaatatcacagactttggtgcggcatatgttcttagaatctttttgtaataatacatagttcaagccaccacctaccacaaaaaaatatatccttcaggcaaaaattcacacagtatgtattctaccaaaaaggataattctaacaacaatataaaagaagcaagcatcattcataattgatgtgaataaatgttaacatattggcattactaccatttttaagttataaaaaaaggctggacaggtttgccacttcatcacatgttaaagtgaggtactaggaccctatccacatctatcaacactgttgatcagttaaaagtacaaaactagagctgttaatataaacttaggagtataggtgatagagtttccacagattttgcaatatgtgaagtttcaggggtacaagtggacttggtgcagtttcctcttaattttgcagtggaacctggtctacagaaaggatatggccaattggccatcctttatggcaacgcatctcatataatcataccttgattttcatgtggcggctcattcaaatcaagtgtttcatccgccatctccttctcttcaccccctatgaacagcaacaaccatcaaatgataactatattttctaaaagcaaaagatcatcatgcatgtaaactgaaactgaaaccaagcatgagtattaactaagcaggtcaattgtcattctggagtaacatatgaccattaaacaagccagtagatccagaaatgtggtatagtagactcacagtatcgtacatcattaattgttcaaactagaggaagcaaacttatcaaatcccaagttacatgactattcatctataagttattaaataatgccaaaagaaaaaaaaatcagctgggcaaacaggccaatccgaccaaaactcatcacaaaggtcaaacacgacaagaatttgctggtgaataatatatcccagaatgctaaatacatgccagataacatgcttaaaactatccagatgaatcgaactaagcaatgctacaaattataaaaacatcagattcagccctacataactacataagtcaggtacaagcaagcagcaacgaggctcaactctccagtatattaaaatgttaaatgcagctccaaggcttcaatgaaggccatgactcatcaaatgccctccttacagcctcgcataactcaacatattaatgtgattccactatagaagaaagaaagcaacaaaaagtacttgagatcacggtccaaagtggtgatttatgtcacttaacacctccaatcataaatatttggcatttaggacaagatttgattaaacttttaaaacattcaccattagaataagcttatgatgctatgatagaacttttcaaggcaaatctacacaaaactaagcatttgagaagttactcatggtcaaagtttcaaaagtttaaccaaatcttgtccgaaacattaagcatttattgcaggagtgaatactttggttacacaccgagctcggtaaaagacaccaccttcaacccccacaaaaatcccaaaagactccgtcttctataaagaccatgagcacccaaaaaaaaaatctcagaaaacaagttcttaatgcgcatcaaaggcatcaataggattgcaaagtaaattaccaaaaaaaacagagagagaaataaaactgaaagcggagagagaatggaccacctccacacatttctaaccaagagaaaattttgggcacccgaatctcccgatcacgcaccaaccactacgcgagcaaccgcaaagcacgtcacgaacaccaccactacccacttcacctcaaaacccaaacgtcaaaggccacgcacagtaacttttacccccaaaaaaaagaacaggagaaaaaaatcagagcggtgaggggtttgaactagacacatttttctaaagggagaaaatgaaaaaaaaaatcgagcctccgatcgcgtaccaaaccactgcacgcaagcgagtcgtgaaaccaccaccaaaaaccccacttggcctcaaaaccccaaacccccccaagccccggttctcgcaaaaaacaaccacccacgagcactccggcgccggccgcggagcgcatgcacacacgcacacacgaaccaccggaatccacggcggtggtagcgaaccaacccccccaccaccaaaaaaaaaaacgaagcgcgagtgatagcggaaggaagctagggcttggcggtggcggcgggcattaccgggagggatcggaggcgaggcggaaacggaggcggcggccacggcggcgagcgcgcagcgggtgaggaggcgccgccgtgggattttgggcccggcgaaccggggcgtgttttgtgctggcgatacgaaggagcattgaaggcggacgccgcttccgctcgcctactagccttagggcttattcggatcggagggtaaactcaggaaaaacataggatctgcattcctatggattcgggtactgtagcagcattcggatcaaaggaatcccctgtaggaaaatcagaggaaattcgaaggaaaatttccttggccatccattccacaggaaaacaaacaatccactccaacctctttttatttttcctgtgcatgggaacgaggcaatcaacaaactaatcttcacaagcttcactcctctgacacatgatgattttagttagtgggtaggttctttaaaaattcctatgtttttcctacgctctatccgaacgcatgtttatatagtattcctatgtttttcaattctctgttttacacgtgcattcctatcatattcctatgattttcctattcctgtgttttttcaatcctccattccgaataagccctaagcctatatagcctcgccacgtgggattgttctttttgtttctttttcttttttttttaccgttgcagtaattgtgaccgtccgccaacctcacacatcaaaacaagtcttttctttttcaccgttacagtaatttttgaccgtccgccaacgtcacacatcaaaacaagtcttttctttttcaccgttgcagtaattttgaccgtccgccaacgtcacacgtcaaaacaagtcacaaggttatctcttctaccataacggcagtagtattagagcaagtttaatagtacagccaacaacggacttcaaattatttatagctaatctaatagcttattcatataatagttaactataaaaatatactccctccgtcttataatataagggactttgagtttttgtttgcactgtttgaccacttgtcttattcaaaaaaaatttagaattattattttttttgacttactttgttatccaaagtactttaagcgtagcttttcgttttttatatttgcacaattttttttaataagacaagtggtcaaacaatgcaaataaaaactcaaaatctcttatattatagaacggagagagtactacactattaatatttggtcacacctctcatacacatataatgtcttggagtccatgttgacatataatgtcttggagtccatgttgcagctggctacaaatctgtagcccgcttttttctctctcttctggatatgtggttatagctcaatatgtggttatagcttgtttatattctgctattgtacctgctcttaaagattgacacgagggaacccacattggaagatatacggtccccacatattaatggctataatggtagtgtcgttatgatagagaataattaatcatccagtcatgaaacaatttatattagagtaaatttcataaaactacagatactttgcacgatctatcacaaaactatatatttaaaaaattgtttcacaaaactacagatttagtgtcttcatttagcacaaaactacaggtactttgcacagtatatcacaaaactatatatttaagaatttgtttcacaaatctatagatttaatatcttcatttatcacgaaactacaggtttagtgtctccattatcacaaagctatatgttttacactaaatctatagttttgtaaaacaagttcttaaatatatagttttgtaataaattatacaaagtatatgtagttttgtaatagattgtacactaaatctatagttttatgaaacaagttcttaaatatataatttgtgataaattatgcaaaatacctgtagttttgtgaaatttactctttatattaaaataataaatacatttttaatttatttaaaatttaattgggttattgggtttgccatctacacttttattatctcaccgcgtgaaatcaccgtgcataccttgtgtattgtctaactaaccgccatgagtgcctcacaaccaccaaaattaagtgtgttgtgtgcatgggcatgatcaggtgaaatttaggtgcttgtttccgtagtttggttttaattgaaattacgttgttttgcaggagaagatgggtaaacttcggtatcattatcttcctctaataatcacattagttgacaattatgactaaccaagcacacttaatgctctaatgttttgtggcaaggtttagaaataatacaacattataaataatacacttttaatggaaaattgtcaaaaaaaaagatgttgattgttcaaatcacaaatttagcaccctatataataaccgtagtttgataaggtacctgtgttcgacaggtacgcctgtcgaataacaacagttcgataaattagttggcttgattaaaaaaggaaaagagcaaccatggatcccaa

SEQ ID NO: 70568 - DNA, 8852 bp, Oryza sativa
ccctattgaaacacctcttcatatatattttgtaatcattaaaaaaatcaagaacaaatcatcaacatataaaatttaaataagtttatatattcaattcttaatatcttaatgaaaaatttcaaattgacaaataataactctataaaaaataaaataatccatataagcacatgatggcctagactcacgagccaaacaaagcagctcacgagtcagctcgggctcggctcattttagcaacgagctgaaaaagaggcttaggtttggctcatttgacttacgagctgagctaagccaaccaagcccgagctgatgagttcatgcgcccgagctttttttccacctctacccacagcccactcacattcactcatcactgtccagattcatagtattataatgcgtcacatccggtattagattcgttttttttaaacggtggagtatagaccaaacggcatatcttagccttagtaaaatactataaatttaaagttatgtatccatgacttcactactatatcaccagatattatttgtggcttcttctactatatttgttgggcatttatttatgagaagttcaacatattattatagtcccaaaaataatggttaaaaattgtagtgcgagaattaaggccgtgttcttttcaactgtaacatcgaattgttaaaatggattatttactccacacttcgatatgtacattttaaaaaaatctacctcatttcttaaattacttgttataaactatctataaagtttatttcttacaatatttcatttatacctataatatattaataattcatagtataataatctaaatcacgacctaataagatcatactagtagtatgtagagctatcattctaactaccatagcagtcattgaatcgctataattagcgttatggaaactttcgtcgtagagtccgagcctcagttcattggaaaagagtccatgagtcatcatggcctcgtatggtatggaggacaaaatataggctatatagccacaagcacatggaaaggggttaggaatagtatctaatactgtcacaactcaccttagattaggtacaataaactattaaccaactataaatatattttaaagagataaaagataagagaggagagcagtgggctactacagcacgaacttcaaaacataatgtatatataacaagtgagatcatatattaatattaatagtatagtaaacaactattatatgaattgactattatattggttataaatgaattgaaactagtagggggttatactactccctccatcccatattagttgttgttccaggtaatttagcatcgattaaggtttgagaaaaaaagactatagtatctctaattaaatattgtatggttggatataggagggtggttaggggtagaaaagagataaatttgaattagagtgattgatgggacaaatactatttcattgtgataactattttaggataaagtttaaatgctgaagagacaagtaatttgggacagaggggtattaaacttgctcttatactccagtaaggctgccacagttttttgttggtcacaattaagataaagttagctaagcgtttaataagtctaacatgtgagctaagatgctaagaaaatactatggcaatagtaactgagacaataaatccaatatataactaatgaggaataagtaaggtatagcgtaatgtacgtgataagttgggattttcaacgaacctgctctcgctatgcacgatccgtgctaacccagacagagatggaatagccgagtagtagccagacaattcaacatcctctcacgcgttcctggaacgctagttgtttatatatatcgagcatagaaatatgtataatcactttctagtgatactaatactactagtatcataccctatattttattgtgaatcacacgaataaatgtatgttaactatataaaaattatataaagaatatgaagatgatgatttgatatacttgtataggttgaactctataatgaaatgttaatgatgtgtgttatgtttgcacgatatttaagggcatgttcggctgcccgttaacgcggctgggctgtagcagcttaaacaatgctactattgatgattcagttgttgcagacgtgagatgcaacgctgcggctgcacagcaatggctgccaaacacagtcttgggtgataatcaatctttgtgataatcaattaagatgttttaaaatagtaatactattgggtgatgatgtacatctttgtgataatcaatctggaaatataggaagaaccgaaggattggtgcagattccgagaaggcacattagatacagaaaatatcaaaagaatccacaatgcatacgtgatgacctttggctattgtctgcatatttgtagctaagagctcgtttgcgtcaagccaatgtgaaacttaaagtagggccaaagcgaaaaaggatattactataaaaattagagaaggttatatatattgaccctgttttgaaaaagagaatagaaatatcatagtaagtctcaaataaatttcacactaaaaaaagaggagttctttgattccccccctccccccaacaccttgatggcacgagagggcgaggagatcatcgcccagaaacatagtacgtggtcctcccgccaagggagctacaaactaggcttcgcgtgcaaactcacaataatttcattagaaactatgttttttaaattgacgtgagaaactatgctaggaaaatgtctaattttcctatctcaaccgtaaatctaggcataatacctccctcaaatatcaaatcatatcagtttaccttggttttgaaggtggcttcatctgacatggtgtctacatgactacgtggcatcacaattggaaaaaaaagaatttaaccagtaagaaccgaactctaattctttctcccctacctcctctctctagcatcgctcaatgactgtcccaaagctcgctgacctccccactactccctccctcggcaccagccttcactgttgtcggtgatatgggcccgggggtatcaggtttagagggaggaggctgccccccgatgccacgtggccctcccccgaggggagtcaggcccgaggtggggtggcggccactccttccccaaagactagtcggaggaggctgccccccgatgccacgtggccctcccccgaagggagtcaggcccgaggtagggccgcggccactccttcccagagactggatggagaagactaccctccaatgccacgtgtcgggcccgaggtagggcagcggccactccctggccgagactaaagggagaaggccgccccaggcgccacgtggctccccccccgaggggggatcgggcccgaggtcgggtggcggccgccccctcccgtgactaggggtcgggctttcccgaccccctctctaggtcaccacatatggtgggttaggtgtccgcctccaggtgcccacttacccacatttatggcgtcctgagcggtcgcgccacgccgcatttaatgcggtgtgcagtgcactcaaccggtctgtgaccggtcgaatgactgatgggacccaagatgtcaggcgcaccatcgcgtgtgtcaggcgatgtgcagcccgacatatcccatcaaataatgatggtgagaggttctcatcctcttatcccagccggagtcggtcctcccgctctggtcaaagcaaggctcccgtttcccggtgtaataagagcccagaagtcttcacccattaaatggtgactgacaggggcaccccccgtgtcaggcgacaagatttgacaggccccatcatcaagacgacgtgtgcttggcttcccaagtcaagagacaagacatgcatttaatgcaaagattataatacttctccaccggagctaggttaggttgttgggcccatgtggtaacccctttaggtataaaaggaggttcaggcctagtggtggaggggggacttccgagcgaactggcgcttgggtctcgcaagcccaagcaccggtgttctacattcaatcaatcatgcacaggagtaaggtattacgcttcatagtggcccgaacctgtataaacctcttttgtctcatcgtcttggaggggcctaaccccctcaagatcacacagctccgctcactaagccctcgaatctcacccgctgcccccagccgaactcacaaaggggggcctcatggttccctggtggaggagttcattctccgacaactgtcatcatccctcaacctaaagcatactaccttcctcaccggcgtagctcgacctctcccttcctctccttttccgacctagacatcgagcttggttaagggagagctatgtgacaaaggaggtgtcatcggctcgagctcacccaaggccaagatctccactgaaagccatgactgcaactcccattcgccacaatgccatgcttgactacgggtggtggagtcctctatgtcccttcattccccattaattcctgtgatccctcctcctatacagcacaaccactgccgagttcaagcccctcgcgcgagtggctacggcaagctcccccttcctcaatgctcagggaggcgatgcattgaggttgtcttgatggagaggtattagtcagggatgagatcgatgcgtgccgtttctcaccatggagatggtatctcttccctctctcgccactgccatcaccgaatagcagctcaagcttttgaactcaccacttgccacttcctcgcttttgtatataccgagttgacgaggtctcaatgaggaatagatgaagaggttaggttaatggttggtgaaactccgacaaggatgcagtggtggtgaagtgttgacggaaaaatcaaacacactggcctgggagatctgcttagctccagttcaggtccaaagattgatgagatgtgggcgtgccagttagtttgatcctgcaactgacaagatatgcaaatagcagataaaatagccgatcggctaaacaaccgatgtagtgattccagccgaaaaccgataatagccgatgccgataccagccaatagcgatagggtttaagcaatcggctatatgtccaatgtagataatgctataaaggcaattggctgatgatgatgtaataaaataataatataatccaatataaaccaatcggcaaataatgatatgataaataagcatcgatccgaatattaaagcacacatcggctggaggtccgatgtcatgaaatccacaagattagattaaacagtgaaacctttgttgtcatcggctaaatccaacttatatgtatatgcaatccttacgagccgatgcaacgtccagataactcaccagctgaaaccccgatgaaacccttattggcaatcaataagcaggctagagattatggttctaagcacgacttagtagatcaaacttaactgatgcaacactaagtatgaaaagaaacacaatatctagacaataaagccgttgactgattttcagggtgatagatgcctaggctaatctaatctagcaatgcgatttagccgatactggcagaaaccctaaagcgagagacagccgatagagctaaattgatatgctaagactagattaacagagacatgataaataggtaggcaaatatatcatccaaaccagagcaatccaagaggtcgaatgtactgatgtagccttgaacgacgccgacgtaaacgatacaattgcctgggccgacggaacattggacttaccccttcgccggagatcgaacaccgatgcagccccgcgtcaggtgccaagtcccgccggacgataaaataaagtaaaaaggtaaaaggtggcgatgcaccgaattgtattgatcgtgaggatagattacatagaccccgggtgtacatatttatacccatgggttgatacaagtccttgtcagacaagaaagaaactttcctaaagataaaagaaaaacatagagtccttatcggacactaaacacactttcctaaagataaaaggaaactaacaaactattcctaattaataggtaacttgccatgccgcattctctttgagctcggtctcttctcgatagcttcctttagtagatcaatttccttaaccgaatatagcaagaatctaacaactgacgacttgataactctcatcggctaatcttagtacttcgaagccgacactgactttaagccgatgatgactttgggcttaccaaatttcactgttaatatgaagataactcaattgtgggttgaaggtgaggacgagagagtggaggatagcctagagatggaggaggatggtcggacagtgttgtgagttacaccaaggcagatgatgccacgagcaccttcccctcggcaccgtgagcctcccgcctcccgcctccctctctaggcgcctattcccagccatcatcgcctaccttctccaccttctagtcccggtctccttgctctccttcgctaacaatggaggtgctaggcttgagtggaagagagaagagaggtggctagtgacatatatataggttccacctttgttttattattttctccttgactgtactgcacgtatacaccacctcgaatgaaaccaccgttaaatatctcggagaggcaaaattaacctttttttgatattttagggagaattcatatattgttttgttgagagagagagagagatatcggacttgggacaaaatatatttcttccaatgttggtgtgattgggaataagttggggcctattaaataagtaagcgcttaatgtcctgatgggctattctcaaccggcccaatcccatcatggctgatctttttaggaaaaagtccactatgactcccttaaaagtaagccgaatctaattcgtacccctcaaccacagaaccggatagaacgactccctaaactattgaaaccagtgcaatttgactccctcagcggttttggagggtggttttgctaatgtgacgctgatatggcgatgttgagctggtcagcgtcttacgtggcacttacatggcattagaattaaaaatatatatgtgggacctatttatcatttacaatatatatatatatatattgtgggacccacagacatttggggccacgtatcatcctctctctctctaacccttctacctcctccctctctcttccttatctctctcttttcttatccccttcggctgcggcggtgacgggcgggatgatgggtgctggagctgtggcggcggcgagcgggcgagggctggagcggtggcaacggcgggcaggttgcaaattcaaccgtgcggcatcttggatgacgatgatgatgctggcaagtagcaacaatctcacagtgaacaacgcaagctgattaatgcagttctccactccaatgatccaatccaaacaaactgtcaatttcacacatagaacacatgcacgtgcacctcgatcgatcgagcagctagctggccgccgccggccgccacgcagagatggcgcaaagcggcctcttgtgccagcagaagaaaaaggcatggccgtacgaccccaccggctccatgccgtccgctttcatccgcgccgcccactgccgcgcccgctcgtgccgctccaccagctccaccccctcgcacgccaccacaccacgaatctcctccccgagcatcacgcactcctctcttggtgcttgtgctcccctcgtttgcaggatgacccaggtgcggcgccggctccggcggattacccgctcccccgccctcgagtgcggccaaccccgagttcccgacatggtccatggctcgcgcaggcggtaatctatgatgagagtggacgccggcggccgacggcgtgcgatatggaggttgcacgcgggaagaggcgaaatgagatgcagggattagggattttggggagccaaggaagaggaggggaatcggccgacgccccgctctggccctcgccagctcgccgccgccgccactccagtacacgtcgctgccatagccaaggggataagaaaagagagataaggaaggagagggaggaggaagaagggttggagagaaagagaggatgatatggctgtgggtcccacaagtatttttcctatgtgaacgacaaatgggtcccacatatatatttttaattctaatgtcacgtaagcgccatgtaggacgaagaccaggtcaacatcaccacatcagcgccacgtcagcaaaaccattctccaaaaccgctgagggagtcaaattgcactggtttcaataggtgggggagtcgttttatccggttttctggttgaggggtatgaatcagattcggtctatttttaagggagtcaaagtggactttttccatctttttaagttgctttttccaagcgaaggctagggccgtgtttagttccccctattcccaacttttcatcacatcatatcacatctaaaatttttctacacacataaacttccgactttttttcaaactcccaactttcttcaaactttcaacttttttttcaggaattaaacacaccctaggaggggaacccctatggtctagaattttttttggtttatttcttcaagctccagtaccactatcttcttcacaattgtttcaagtgtgaagaattaattaaagcctgtttcctgtaagtgcaggtacaatagctggctataagccagctgcaaacaaattttaaggagataaatgaggagagagaatagcagcgggctataaattgatgcagtgtacggactccaagacacagtgtgtgt

SEQ ID NO: 70569 - DNA, 614 bp, Oryza sativa
ttgatgagtgagttttactaatgtgaacccattgcacatgaacatataagcaaacatgcagatatatcctgattgcagtgtctataacaacatatcaaccacattttttgcgaggcttatataatttgaggcttatataatttgaggcttatataatttgatgagtcatccatgtcgaaatggtaatcaccttcatcaaaattttctgttgcctgtggtttccctttcctaacttgcacggaacgtagagctgttgaacacaattttgatggtgtggacgagtttactcgcaatttacctgacgagtgatctgttccattccctccaaattgaaagatatttgagtttgagtttattgttgtatctctagaaagtcttgcacttcttcgaggaactgaatcactactctgattaaacagccttccagaaacctgagaaaataatcttttaactgagaaaaataatcttttaagtctggtatcatcacaagtcaaatctaaagtggggtatgaacatggtgtgaggactatcaccagaaagaacataaaagagactatacagcccgacctccaagcaacagaacaatagaaacatagggtcaatattagacgaga

SEQ ID NO: 70570 - DNA, 1312 bp, Oryza sativa
ttttctgggatttatttgagctaaggaagtatttttaataaatggaattgcatttaagaaataatttaaattgaaaaaggttttaaaaagttctcttttggctttgggccgaaagtcggcccaaaaccttctctctctctccccggcccaagtcggcccagttcgcagccgcccacgcgcgcgcgcgcgttcagtcgctgacaggtgggtccgtcgtcttcctcgggccgaaaccctagcgcgccgccgccgagctgccgccgccgttcctttccaaatccggccgttcctttccgtttccggtgaaattgattgaggggaaacaatctccgggatctcctctaccttttgtcctgtggaatcatcggctaaatcggtttggaaatcgagggattcgagttcgaatcggatcgggctctctctctccaagccgagctttccttcgccgttgccgtcgccgtgggccttcgccgccgcctccgagtccctttaaaaggctccccggtgtctcctctacccgccgccaccctcgccttcgcctcttgtcgccggaaaagctctagcaccgtgtgccctagcgccgccgtcgtcaccgtcgctccagccgtgcgccgccgtcgctccagccgtcgccgtcgctcgggaaggccgacgtcgtgttcgccgtcgcgtcgccgtcctcgtcctccccttcgccaccgccgaagaccgccggagcgtcatcgccgtcgtcgacccgaagagcttcgccgcttcctcctcgtcgccgtcgccgtccgttgatcttccgccgtcgttttggtcgccggtgagttcgccgtggcccgcttcgtcctggtgctttccgttttcgtcctcgcgccgccgttcgccggcgagcgtgcgccgcccgagccgtccgccccgccgagccgccgccgccgtcggtgacgtcattgccgacgtcatcggggtcgtccgccgtgagccgccgtggacccgatcgatctcggccgtccgtttggattggatcgaatctcggccgtccgttcgcgtgaaccgccgcccgtgcgcccggtccaccgcaaaccctagcccgctgacgcaataaaccttcttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttgttgaatt

SEQ ID NO: 70571 - DNA, 2497 bp, Oryza sativa
cggcgttgacagacacggcaagccgaggtcaagcccgacgtggttgtcgctcgggtccccgaactcgtcgttcaacatcgtatcaaactcaccggcgacaatagaggcgttggtcttggcggccgaggaggaggagttgaagagaccgaggtagcccccggtggccccgagcgtggcgtggtcggggaagatgaagaaggcgatgccgtcgccgccggtggatccggcgttctgctcggcgatgacgaaggagaacctcgccgcgaacgacgccgccgatcctccgccaccgccgaacgcgacggcgcggctgcagagcacgctgccggcggaggacgacggcacggcggtgtcgcgcgtcaggccgacggagccattccgcaggaacgagtcccccagcagcgtcaggtcggagaaggccagcgccgccgaatcaaagctaacattgaaaccaccaccaccaccgctcgccgccgccgccgacgcagaaaccgttagaaggagcgacaagaaggcgacggcgaggcggaggcggaggggaggagcgtccatgggtggcggggagggatccgggtcatggggttatgtggggcgcgcggtgtccgtgggattccgaggtggtataatggagatcagaacggcggacacgaggagcacagtggaggctggaggggaatcggatgtgcttgttggtgtcgaagcgtgtccattttttttaatgtgggtaacggtcggattggcgcgtttgaatgtaacggtcggggagggggagcaggtgagtgtggccggcaggtggggccgcatcgagtcggcggatgaggctgacaggtggggatgggagggtggctcgtgggcggttcgcacggttggctggtggggtccacagccgtgtgtccgtgtccgatcagatcggacaccgacacgggtttgcatcctctgcctttgtggcaaaaggcaaagtttgccgttgctttcatccacgccatccctcattcaatcaaccgcttccatcaatcgtgattaactagtagccatttaattagagaaattgaagaaaacaatctcaagcggtaaaccaggaaaaaaaaaacaaagacagccaacacatccttcgctatttgaatgagcagctaaaatatatactccctctgacgccgttgacttttaaacgacgtttgaccatttgttttattcaattttttatgtaagtataaaaatacttatgtcatgcttaaagaatatttgatgataaataaatttacaataaaataaatgataattacataaatttttttgaataagacgaaaggtcaaacgtttattaaaaagtcaacggcgtcatacattaaaatacggagggagtatttgatatctattcattcagaaacataaagaaaataattatcccacctccatactaaacaactcacaactgtctcgctaatgtttactactccgtctcaaaaagaatccaatcctatcaacgaatctagacacatacgtgttcaggtctgttgctaggattgtgtttttttttgggacgggggtatttagaaaaaattgtttaagttatactcccttcatccgaaaatgtttgacgccgttgactttttaaaaaatgtttaaccgttcgtattattaaaaaaattaagtaattattaattcttttcctatcatttgattttttttatgtatacatatagttttacacatttcataaaagtttttgaataagacaaacggtcaaacatgtttaaaaaaatcaacggcgtatgagaatataagagtatattttttctataattcttatagtcaagtcaaatggttgagaactttgttcgtataagtattgtaaagattttttttataaatatgtttagcaatgctaagaattatttgtcttttaaatcagatcaattaattgaatgttaattgtccatgaagtggggacaaagacatacatccattgattaaaagatggatgggcaggatagaagcaacagcaaactgtgccgtcagcttcaaagtcagaggatgcgaacccgatgtagtgatgtccggacatcgatcggagcatacacgtcagtggttgctgaagtgattcctgccttcactgtttcaccacgaacgccagtgtaatacagtaaagtgttgtgcggcacgtgctttgatactgaacacttttggctgagtttgagtgagagaggagaagagaagataagattgagaaaatacgtaggacgaggtgagttattagcgtatgactaattgagtattaaatatttgaaactataaaaatagattaatatgattttttaaaagtaaattttatataggaaatttctgcaaaaaaaacacaccgtttaatactacctccgccccaaaatataacaacttttggctataaatctggacacacggttggccagattcatagctaaaaatgcttatattttgggatgaagggagtagttcggaaagcgtgcgcccggaaaag

SEQ ID NO: 70572 - DNA, 1609 bp, Oryza sativa
tggtgtaatcaaaagcctgcagctcgactctattttatcccataaatatattcatgtctataaacagtgagcttgctatgcttatggatgattcatgttgaggatacaatgtaccgatgttaagcaccgtccctttttgtttaaggcagtgcctcgtattcatgtaatgagggagaaatgtgtaatacagacaagttccatgaggattcgtttgaaagatgcggatatgtgatcatgtgcataactgcagactgactaaaggatccccctagggtctcgtgtcagaggaactatgttctaacctcgagttaataaccaacctgtggatggaaaagaaaaacaattaaactgtgatgggctaaaaagccaacgagacagtagttgaggataggagtttggatacgccttttacagatcaagataagggttgttggaggaaacccctaagggtacccgccatgcctctacattgataagatcggatatacctgccaacagttaagaagatctaggagacatcaatatttgagaacataatagtcgatggctggtaattagtttatccggtatcagaaaaaggtcaaaggtgatatggcagaagaacaatttggatgctccccatctcgaggaagcactaaagatgaccatcggcaattaaaccctagtggtatagatacagatagcgggcaatgtatttccctgaaggtagtcagtacagccttttgacgaaccacatcaaggtttcactggaaggcagcaagccaaaggacctcatcgtccccagaagcgtccgcaatccacgttaaagaataccacctgttagagataagccgaaagatgatttataaaaaaaaaaaagattggcaaagatgttctctagcatgaaagaagtaggccgaaaggcgattgataaacagaaacatgctctgcatcgcttaaggaagacccctgatagtaattgccccgcaacagtcaccttgtcattaagtaagcaagatgacctaggtaaaagtgtttctatgaagacaaggagtgaaatcttcaactcggtatcggatgctacacggagtgaaaagtgcaagcaccggttaccaggtaatgccatgtcctgggagatgatccaacgggaaagaactcatcaaggttaaaggtgtaaaggaatacgttgagtgctaactgaggacaacctgaagataataatgggaagtaaactgaatgtaaagaaagtgaatccgagctgcttgttcgtgggaactattcccagttatgaaccaagtgatatgttcgaagatagtctacagaggtcagattaaaatcacctctaacaacgaagcttcagatctggcaggatcacgatcagacaataagaagtccagcagtaaaactatttgggaagacgtcaaagtatatcaagtgggataagctggttctcttgggaagcataattcaaaggcaaagttatcgacccttgcatcaaatagcagaagtagctatcacccggagaccaggaaagctaatatgaggcagtttgggggcgagttagaagcaaatgacaagcatggtatcttataatgacgagctgatctcgacgcatgacatgaagttgata

SEQ ID NO: 70573 - DNA, 590 bp, Oryza sativa
acgattagtgttagctagtactaggaacaacctcaacgcttttgatgacaaacggcccaaagcaacaggagcatctcttccaaacccaattcccaaagaaatgaatacgtgcaaccaaagtttctccaccgtctgattatctgtccatcattagctggtttaatcagttttcagtttttttcacacacagattgcttgattagatgcagaaagaagcgaggtttattaaacttggcgccaatttagcaattaacagaaaaaccaaccacgcatatggcagcagcagcagcaactctcgccacggaaaatgctagtagtatactaggccatggacctggacctcgccgtgcaagtctcccgccggccagtctccggcgaggacttcgccttcgccacctccgacaccgacgccgccttcctcgtcctcgcccacctccccggtagtaacccatgctccgccgccgccgttgaattgacattggtgtgagatttttgtgtttttgtgtgtgtgtgcagggtatgacacgcaggaggtggaggtggtcgtcgccgatgccgggagggaggtgcgcgtggtcgtcggcgcgagg

SEQ ID NO: 70574 - DNA, 763 bp, Oryza sativa
ctgcaccattcaagaaggcagcaactgtccatgcctggtgcaagcaggccaacatgctcaccggtgacaaatttgaaatgactaacgaaatgtgctgaaatgcatatcagctacagcttcaatcaacacgattcccatctcgttggcaaacggcaatcatcaagcaggcccaaataactcagggatgctatgtgcgggctcttctgatttcagaaatttacaagcaccaattgccagccaaattaaaatccaaatcagcctgaattgcagctcacaacgaccatggcatgatagttctcacttctcagatcctttcgtgatgcagccttgaagccatgacagttgagcagcgaaaatatctatgttgatgaggcctcaatttagagaaaaaaggaaggcatagaaaggattcagaggagaagcatgctgtatcaagaggagaagagagcgcaatggaaagggcggccatcacggaggctggcactgtagtttcggcgcatggaagacaaagccaaacgaaaatccaaatcagcctgaattgcagcacacaacgaccatggcatgatagttctcgcttctcagatcctttcgtgatgcagccttgaagccatgacagttgagcagcgaaaatatctatgttgatgagacctcaatttagagaaaaaaggaaggcatagaaaggattcagaggagaagcatgctgtatcaagaggagaagagagcgcaatggaaaaggcggccatcacgggggctggcactggag

SEQ ID NO: 70575 - DNA, 28222 bp, Oryza sativa
gcacctccaaactaagcaaatcacatacttttatgtagaggaatcaccacagcaggttggtataaatagacaatatacatggaacacattttttctcgaaaacatctacatggaacatatagcaatcatgattcacaaatacaagtcaagaatgaaaggactaacatcacaacaatttccaggttcacaaatcactagttatgaatacacaccatcgctattgacaagtatagcaaagaataactaaggagggaagagaactacgcattcgacaaaggaattgacgaaacactatgctgaatgatgatacatccaaaccataaattgcttggtacataccacatactactcatttctatctgataactttcacagtggtcgaaatcagatcaaattagtgctaatcatcgaatatatctttctcataaatcccgcacaccacacctgctggcttaaacgaaaaacaactcgaaacaccatcgcatcgcatcgcatccacagagtattgaagcactctccagattacaatagccgctggacgttgcggccggagtaacgagttctaaccaagcaccaatccaacgaacaagcgcaaaggaaaaaggaagaagaaaaaaaaaagaaaactcaaattggatcggtggactggaggaagggaagcgggcggcgtgtcaaaggttttagggttggggctcgctcgggaaccaaccgtaccttcacccggaggagcttccggccgccggcgagcgtggaggagggagtccgcgtcgacgtcgaagtcggcgccgcccgtacgcgcgttgttctcacgcagcagtccgaatggacttctcactttctcagagcatccgcaggcaggcagcggccaactggttttgaacactgcggaaatggaacaagcagatcggcctcagttctttttttcccctcaaaagctttacatatatataaaaaaaaacttacaaatatttccgcacacccatacacatcattacacacgcaacagcacacttaccacctgacgaatatgttccctagcataagttcaaaacaacacaaccataatctcacaaaaattctattgaaagaccacttatttatggatactaggatttaaaccctgatgagttgtgcatgtgcttttaaaaataacttacaaaaactcactgtcaaacttctttttaacttttagcagccgttagctgcttactactccctccgtctcataatataagagattttgactttttacttgtactgtttgacgatttatcttattaaaaaaattagaattattatttattttatttgtgacttactttattatctaaagtactttgagcacaacttttcgttttttatatttgcacaaattttttgaataaatcgagtggtcaaacagtgcaagcaaaaagtcaaaatcccttatattatgggatggagggagtatgtctttaggacaattttgaatttcacagcttaattttaggaataatttaggtttgtttttcttccattgctcatctttagcttcaagagagtttcggctaaaactagtaccgattaaacattcatcaaatgacaaacggatattccatgatagaatacaacggatggagaaatggcttggaagcacatggaactgattgttgctttattgcaactcaacaaagttcatcaaaaatacattgcacatctcccacaacaggcagccattacgaaattttgatacaactcaagatttgaaactctaggcacaagccaagcatgaacataacaattcagtcagctaattattacagttacaggcagagcaaatatgcttctacagagcaacctgttaaaaaaaacaaaagaaaaggagaatgtagggatacagatacaacacaacagcatctacaaatcagggaacatgtctagaaaaaaaacattggttttctaatgactacaagttaatagggcataaatagcaaacaacaggatagagcccccagctaaatttggagggggcccaatttgttacaataatcgataaccatgctttcgcaccgatgatttcattcgcaggccagcttggtgtcgaaactactcaagcagattgcaaaggcctggaaggccgaaagggggtaacgatagtccattgtgaacatatccttcgcaaccttaccaaattgtagtatgaccttgtcatgatcaggtggaggcggcggggcaggttgcgatggcgtcggggctccagcagcaggctgtgttgcagcaacaagctggaagttcttcacagacgcgacggttaccctgcccttgaagttgaggcaccagcactgcaactgctcgtgccatcttggggccttgttacggagaatcaatggcctctccttggactcatcactgtcacccaatgcctggcctccgaccatggggccacctactgagatgtcagaatatctgctactgctgaaacggatagagcggtccataatggatgacttggaaaaggagatgctgccaaatgactcatcaagagagcgtgcaagcacactgtctggctggcatgggacagtgccaccagcctcaagcgatgaggcagggattgagtgcatcacacagttcatccgcctaggaccccgagtccccaagacattcagttcatatgaaacttgagctatgctgtaggtgctggaagggttctttggcgacaccttcctggagtagaacctacggcttgttttccctgactgtgaaacattggctgtgttgcatggaggttgggtatcatatattacaaactttgttccgagaagatttgacctaaaagtccaacacagtaaatatatcagattataccattaaaacacttagacgatgtaccttctctaaacaaagttgccattattttgggttattacctcaattttccaatgtacatgttgcttgacctagatgtattgtcagcactcataaatattgtatattctgtacaggttgcacgggagtatcttttcgccgataaaaggaacttgccactttcaacgagcacagctacatgagatgtgttacaacatgtgaagtcagcaaatataacagaaactaaaaaagtatgctggtgggagggatatatgcagtaagaaattagctcacaacaggacgaaatagctgcaaaaggggggggggggtaacaaaggaggtggtatggtatgaatatccatatgcacaaatgattagcacgcgtgggaattgcaataattaagcaagatcagtatgcaataattaaactaataccaaacaagctgtacggtcatacataacttatatgcctcaataactcatacatactggctaacagtgcaaatcatacattaacttttggttgatatttatgcaaggagaaatactgtcatgtataatatattgttgcttatataaagaatagataccacatacaagtccctcacagggaatgctagcggtgatggagcgtaaatgattatgccacatatgcaagctatacattaatctctggttgttgtttatgcaaggtatcatgcattcttgcttatataaacaatagatactcatacaagcccctcacaggaagtgctagctgtgatgcagtctaaataataagggaaaattggtcctatgacatccaaagatcccattcatagaaatttaccattgaaagatcttggtacactttaatattatcgaaagattacgtcgttcagtttttaaccattgcatccccttccattagtgtttaccggattattcccccttttttgcacttaaaacttacacttatgcccattagacatacgtcttgagcttcttgaaccagattgtcaccagcaccgctgcagcgcgccttgctgtgccacccatattctcaagctctagtgtgtatcttgttgatttggatttgcaaggttttggaatgcatgtcacagccattcacgttgctgtcagggccacagtggtgggtggcatggaggacctggtgaaactgatgaggaagcacctcaagacgttgcacagctgcagcgtcgggttgcaggatgtgcatcagcacgagctcctatcaggctgtcacgaccctagttattggaaccggaccggaccagcagttggaccggaaaaaaccggaaccggagcctccgccggtctggtccaactaaaagaccggctgtgcaatcggcccagtataaaccggttgggccgcccggttttgtagaaaaaccgccaagaaaaccggatttcaaccgcccggtctgcattgcgcgcggtcacctcggcagctggagagggaaaaatgtgagaaaaaggggcacaggtgggattcgatcccagtacctcatgcatggaactgaaccaaccaaccaccgggctatgatacaccttgtgttttgaaggaataaactatatatttacattagattgaaccgcttcaaaccagtggttcaaccggttgaaccaacaaaccattgaaccgagggcatcgccggtttaatgaccggtccggtctcaataactatggtcacgactgctctgccacgatgctagcgctgcaccattcaagaaggcagcaactgtccatgcctggtgcaagcaggccaacatgctcaccggtgacaaatttgaaatgactaacgaaatgtgctgaaatgcatatcagctacagcttcaatcaacacgattcccatctcgttggcaaacggcaatcatcaagcaggcccaaataactcagggatgctatgtgcgggctcttctgatttcagaaatttacaagcaccaattgccagccaaattaaaatccaaatcagcctgaattgcagctcacaacgaccatggcatgatagttctcacttctcagatcctttcgtgatgcagccttgaagccatgacagttgagcagcgaaaatatctatgttgatgaggcctcaatttagagaaaaaaggaaggcatagaaaggattcagaggagaagcatgctgtatcaagaggagaagagagcgcaatggaaagggcggccatcacggaggctggcactgtagtttcggcgcatggaagacaaagccaaacgaaaatccaaatcagcctgaattgcagcacacaacgaccatggcatgatagttctcacttctcagatcctttcgtgatgcagccttgaagccatgacagttgagcagcaaaaatgtctaagttgatgaggcctcgatttagagaaaaaaaggaggcatagaaaggattcagaggagaagcgcgctgtatcaagaggagaagagagcgcaatggaaagggcggccatcacgggggctggcgctgtagtttcggcgcaaggaagacaaagccaaatgaaagggtttagtgcgagtgtgtcatgtggcacttatgtcgttgctagaggacaaatgagtccgttttaatggcaacctattaaattcagatggaatggtataaaagtgaacggcctaactcgatgatattaaagtgtatagagatcattagatagcaaattactcacaacaggatctttcagtgtcgtagaaccaatttcccccaaataatcatgccatgtagcgagtacaaaaacaaacacaatactaggataaaggcttacctgagctaagacatagatataggttgtaagtttgggtagatttatcccttttaatgaagcactggatggctccattccggggcccaggctgaaaaacaaaacatggtcaagaaaagcatattaatgaacatatcaaatatttctatatcagaatttcatttcgcatactataaatgagcatattaagccgtgtatacgacaaccatcaaagatgtatgttagttaaacaaatctgaaatcgaagcgcggaaatacaagactaagcaagagagcatcatcatcacctgcttgagggaaacaggaaaagtgatcttcccgcaaaactcggggttcttgacgatctctctacacatgtccctccatgtccggcatacggcggcgcacgcgacgacgttcttcctggacggccacgccgcctcgctggcctccagccgctcgatcacgtcccggagcaactccggcggcaggttagcccagcagctgctctggaccacgtcggcggcggcggcggccgcgtggccgtcacgcagctcgtgcaccgcgctgtgagacctccccctccggtgccccaccagcctcacctcgaaccctcgcctggacaggctcccgaacccgtcgcgcacgtcgcggacaatgctgcggaacgacatctccgcctcgcctcgctccgaagctcaaaatcaagaaccctaggcgcaaccgctgtaaagaaaatcaggtgggtgaaatggggcggggagattcggagggggaggaggagcacggatccgggggagacgaacctcgggggtggcgccggcggcagctagcggtggccggcgggggagggaggcggaggcggaggaggcatggggatcggaggaggaggaggaagaggaggggaaggaaagaacaagtggtggtggctggacaagtgttggggggacgcgacttcacgtgggagcagaacaaaaaaaattgaatttgttttttatgaagaatagacttatcagttattattattactagtggtaattcattttggtttgttctgttctgttttatgttgtgttttggtagtagatttgtgtgctttttcaagtgatctttgtttaattgttcggcgaattctatccatttgtgtgcttatcgactcgactcgggcttccatatttagctagataatactacattcgtcttaaaacataaggaatttgatggataagacacatcttagaattacaaatctagatagataagatgtgtcttatttattcaaaatccgttatattttaggatggagggaatagcatatacatgtgattataaagtcaatgtcttaaatttgtatggttttcaagtgattttgattctagttaattgtccggcaaatttgggttttaacccatgtgtttactcaggcgatcgatcgacctcttggaatttgtccatatctccttgtcaaattaagttgtttttttgggttggactagctgattgcgtatgaatatatgatactagagttagaggcctcaaatttaaatcctaacgaatatacgtaaacacatagttggagaaaaagacacaaagtagggtaattaggtataagtgaattatccgtagttttttgaattacggcgtgatagccaccacgtgagcagtgcggataataaagtatacttcgaaggtaaatttagggtattgccttaagcccaggcacgcgatactgtggttctacgcagtaagaaccataatacccgggttaatttacataaaatttaccaaaaaattattttacggtaatacttttatgttttcaattactggtgctgaagccaaaagcttcacagctcaaataaacagaccctcctccactaatgtccaacaaaattattccaatcgacaatggaattaaaagattcgaacctttatatgtattttctcgtacttctatatatctactacacacctgattttgattttcttttttcccttctgagaacaaaaaacctgcttgcagaggactggtacaatgccatgaagcagatagaaaaggtccctagcttaaagaagacaatcaacttcaaatttcaagcagcaactgttcttcagaaacaatgtaaataaccacactgagcagtgaactttgcaagctttacctcctttaaagaatcctccactttgaaaaagaatcgggtcaggaaaagctggagagaacgctgaagaaaatgtcacctcagattatggatgcaatcagacattgtcattatacataaacagtaggtcgacaatgatgacaattgacaacattaacagcatataacatgatcttctgagtatgtgtggttagcaagctcactgaagaataagagttatggtacaaatcaagctcactagcacaaataatgtagggaaaaaaagcagaacaaaaaaagtatgctgaaccttaaccttcttgcgtcagtctactcgaacaacagaagccatcagcgacctgaaataaccaaaagaagaagcaaattcatgagacacaacttgacagaatccataatcagtcaagaatacaactttatcgtaattaacaagtgagccaaccctgcatgggaaggcaccatagcatagaaagtatccgtatatagcatttttgttttcacttactctgattgtggaagtaagtcatttgataaaaccactaaaaatataaggacgtaaagctacaacaatgcattttgagaacataactcataaccaaggtaaaccaatggtaataacaatttatttatgtctccaaccccaatatgactgtgtatatagaacaaatctacataatttttgcaattgcttcagaagctagaaagctcttgttttgcttttgcacaaaccaccatgtagtccagtagttatgtactccgtactacggaactagtaacttcatcaggatgaatgttcactccctataacttctgaatgccactgcgttataagcctataaagatgacattcctacacgaattttggtctgcaattgtttttcctacctcataactcacaagccatagtgaaggatggataaaacagacaagataaggtgctctatcatatgttttatctatgacacattctccagctttagaggcactaaagtgttccaataaatgattgcggaatgacaaaaaagaaataagttgtttgttgggttgctcttgatcaatcttatatgcactattctcatagtgtttccatattttgtaacaacatatttgatctactgagaaagttatcccagaacaacatatttcgtaacatgtaataaggttttccatataagaatatgcgcatgctcagcaactcaatgcgcactccacttacacagacggacagatatatgcttgcctaatcagtcccctctccctgtcggctgttgcctcacactccagcattggcccactgctgacatgtgagcgagacaccaataggatgaggtgaacttttcagtggcatatagacaaccaggatgcaccctttccaaatttattaaacaaaaacaagactctataaaggttggtaaatatgcctagaacaaaaggcatgttaaagtaagttctgctgaaagtccgatataaattgaacagatgcaaatgtgcactttagcgcatttaacaacttggactattatgagttaactagtgacataagataataggcataaaatttacaagtagaaactggtagaattttattatggaaaaggaattaatgtgaaactaaatgaatgatgtcggcactatgtgaaacaaccatatcaatagtcacagtgatccagtaaaaaaacataaatataccatgtacattaattggaatggtcacccctcatacaatgtcattaattgatgatacaggcaacttatattcttttttagctcaagtatctcaagaattcatggctcccaaaatatttattgatgttatcacatatagaacattaagctgtaaagatgaaatacagtgctaagatggtactagcgcctttctgcacagtaataccaaaaacttgataggcaaaaagggttcctcaaaatgaaaatttaggtttttaagggtaatgatgctggggagttggcttaccatcttacaagtcagccttgattggttaaaaatatgtcatgcatgattgccactgcctttttgcttgagttcaagctctaactctttgtgccttacctccagctccaagcgcttattctcaagcctcattttttcattctctaacctcatctgttccagttctctatccttatttttactgaagcgctcccatttgagccgttgttttgcaagatagactgcctggacttcaatctgcaacctttgttcctcaagatctgcagattgtgtagccaaatccttttgcgccaaagccaagttggttccatcaggaaatgctttgttgatatccagtgatatgccatgggaatcagacctcctgctacatccatgtgagctggaagagttgccaaaacccacatcctcctgatctgtcataagcctcaatcttttatgcatgggcagggcactcttatcaccttgtaatgtgtaattttcctcatcattctcctcctcggaatcagagtctacactttgatcatcttcatcggcatctccgcttgttcccctcctcagatcatgctcatctttacatctaagggcaagctgcagtgaacgctgaagggcaggatcttcaggcaaactcactcgattgttattatggtaggagcacatctcctcgtagaacaagtgctttgaactcagtatcttcctcgcatcatctttcatcttgtcagacagattactcatgcaatccagcagagcatgattctccacaatcttgcaagctgtaccccggccaaggatatctgtaagtcttttgtatctcttattgagatcattgaatttatcttcacattgctgcggtgatacactgcagcctcgctcacccatgacctttgatattgccttccacttgccctttttctgcattattgcagagtttctcttcccagctcctgaatcagctcctggatcctccccagtgtaagatactgcagtaattaaaagcttgaccattgaatcagtccacttcatccgctgccatgcagcgcccttctttcccttgccgctctggctatcagtggcatcctcgttgacaccatgttcctcatcatcactcatgccgttcttggcgtgttgacgatggtgatggtggtggtggtggtcaacctttccaagctctccgaattgaaattctgacaagtgatcagaatctgtagactggtttacatgcatcgataaattgccaggcatctgagtatggtcaaagccctgctttccaggatttggagcatgcatttgcccagagttagaacgcatcaagcttccagagggtaggttgttgccttccattcaccccaaggatcagccaggcactgaagctgcttattaataccatatacaaacagacgagattttgcgcaggcactggtgaccacttttgttacatcacctgcgaaagcaattcaggagaattgttgaacacctaaagcaaaatacatgattgagaaatctataataatatcaaaaattaatgagatgtaataactaaaactgctgatataatgagtaccatgcttcaaagatttattcaaagtgaaaattaggaaaaaaaaatatccatgtattccacagaaaaggaatcaacagggccggatccaacttgggacatggggttcagttgaaccccccccccccccaaaaaaaaaaaaaaaacttttgggagaacaaacaaactgttactacttgtattaaaagaggtttaaggctctcaaattaaggagaagagcttcttccagatctagaagagaagttaacgaacgcaagcaaattccacgtcccggtgggatgggagatagagatgaatcagaaagaggatgtggatgctcaccaggattccctcccctgctctgctcgatcgccgcccctcccctgttcagccgcgactcctcttggcggcggcgcaaggagcggaggagacaacgagacgggagatttctgtttcttttacgcgatactcgactactcctccacctttatggctgtatcacagtatttttactattttaaaactactcgctaatagtacgagtaaattccataaaactgcatgtacttacacgatatatcgtgaaatgatagatttaagaacttgttttataaaagtacagatttaatattttcgtttatcacaaactacagatttaagacacatttaatatctttatttatcacaaaactataggttttgaatacactaaacctatagttttgaaataaatgaagatactaaatagttctgtgataaacaaatacactaaatctatagttttcttaaatctgtaattttgtgataaacggagacactaaatctgtagttttgtgaaacaagcttttaaatctgtagttttgtgataaattgtgtaaaatacctgtggttctgtgaaatttactctaatagtatttctttatagtaactgatggcccatatatctatcatcaaatacttagagaaaaattaacaaactcagttagcaattgtgtcgataaaaaattcctcagaccaccagcaaccactatatgccactccgcgcaccgccatcacccctctttctccatgagccaccatcgttcatcctctttgcctttacatgcgcagttgtaccctctagtaactgacatgtctttttctcctctcctatcatcatgcacactactgttatggacttatgattgcctttgaggttggagatgtatggcttgcagggcctctgggaggcaggagctaactcgacaaagaacgaagatgctagttctggactccttcttgctagatctagcggttatccaactgtcggagggaaaaagaaacggagagagagagagagatagtgtgcggagactttggagatggatagaataaggtggtccaaattgaaatgtaaagttagctattgtgtaagtgaaaaaatggttaaaggatgacataataatatgaaaacttttaagaatttttaagaatactgtaatttactccctctaaaaaacgaatttagaactggatgtgacacatactagtaaaacgaatctagacatgcatatctagatttgttgtactagaatgtgtcacatccagtactaggttggttttttatgggacgaagggagtacttttttttctctagcacaattaaagatgagttgtctattaccagataatctcgtgatatgctaagtatggttaggccagtgtacttagctataattaataatatcatgatatgttgatgcatggcgatacatacttctattaacacaagctgattaattatagttagatagatttagctaaaagataataaaaataataccatcatttttgctcaataataaaacattcgactatggtcttcttttctcattgcatgatatatgatgactacattagtagatatttacgtaattctttgatattgttttttattttctacatatatgttaattgggactaatatttttctcataattaaatagataacaaatcatttttccatatttcttctataaaatatgaatagggcttgttggtgctaaagccccagctccatcccggcagaacccctgccctgcatgcagagtagcagctgcacagcttcgggagaggagcagcatgtagcagaagcagggtttatgattccgagatgcttctgtttcgggctctagcggaatgacggttttcgcgaaatctagtggaaagctgatagattccgaacaaatttcataaagcaaaatttgaatacaaataccttgagtttaccgataagcttgcgaaaaccagtcagctttgacgaaattctgagcgaaatcatcgaaatttcaatcggtaactagaaaaggtaactgaaagtgttttcctttttttaatacgttattcttttatttcctactataaatttcattaaatatacagaatacattttttttcaaaaatttatatccaataggttctacgaatattatactatttataagattttgtttgattttttccttttttatcaatttaaatttgaatttggatgaaactcatcaaaatctcagatggcttctattttctagcctcgtcgaaacctcaaaattttatggaattcgaccggttttcgtcggaattgtgaaccttgagcagaagtgcagaacaaccaggtcgcaaggaagaaggagcaatcaaagacaacatgtcgtggtccatgggtgattaagtggactaattggctgttagggcttccttattaagttattagtttttgcggttttttttcctacttcaattgatggaacaatcacgggattagggaagcgagtggtttttactcacaaagtaatccaacaattatcaacaattgtgttattgaatttgtggctgcgcctttgtagtattatggcttacatcgtgagaaattgaaaaaaaattgataggatatattaatatgaaatataacactctacaaacatgcaagttaaaattcaacttttaaaaattgtaaaaaaaataacaaatatagctgcgaatatacgatatctattttttcaatttaatttgttattttttagcaacttgtataagtcaaatttggcattgtatgtttgtggagtgatatatttcatatcaatccatattgttattttttaaaaattatttagaactatttaagatgatatgcaagctttcatcataattcgtaaagcacgtttgaaagaagcacccctgtattttcgttcagattcgtcgctgcactcgcggctatagcatgcgccatactggcagattcgcccgcgaagaggaagacgaggacgccaagacggtggaaaatgattttttttctgcgaaaagagattaaaaataacaagtgggacgatgagcgtgtggttcgttttcatcgtggtgtcggtattcacggtggctgacaggtggggccgttctgtgtgggccatgggtgaccgtcagtcttggcaagggttttgggctgcccgcgcaaatgtgttcttgtctgcccactagccaagttgcccactagccagtcccattttgttggctggctgggcccactttgaatgagctcatgaaagctccatatctattttattcttctcaaagaaaagtatttactgaaaatactaagagcctgtttagttcacgaaaagaaaatttttgggtttcacatcggatgtttgaccggatgtcggaaggggttttcggacacaaataaaaaaactaattttataacccgcctggaaaccgcgagatgaatctcttgagcctaattaatccgtcattagcacatacgggttactgtagcacttataactaatcatggactaattaggctcaaaagattcgtcttgcgattttccccttatctgtgcaattagttttttaatttatctatatttaatacttcatatatgtgtccaaagattcgatgtgatgtttttttgggaaaaagttcttggaaactaaacagggccactccagtgccatctcccccatctactactaggtcataaatatttgacgcttaggattcaattagttattttaaccttttaccatcaattttgtattaaaataaatggataaaatctaaataagtttatgatatttatgatagtactctatgtacatgttattaaaaactatcacttgagaaattattgataatcaaaatttaagagtttgatcaaactttatcataaatatcaaatatttattactagagcacaaagacatatcataaaacaaacccagtttcaacaaagttggggccaactccaaccccaggccatgttcgtttgtgtctatattttcaagcaatgctgtggacctttggtacctacctacaggctcgcaacgaaagaagtcacttcagttctgcatctacacaaagaaattctgtcaaggctgtcttccttttatgtcaaaaagatcacaactaccaaccgatttagcctttgattgcatcaccagtagtcattgcaagaacatgacctggtttcttcctactactccatccgtcccaaaatagaagaacctagaattgaatgagacattttttagtgcctcttaagattcattatactaggaaatgtcacatccggttttaggttcttatattttaggactgtgggagtaactgattctagcctttgattgaatcaccagtaatcattgcaagatgggagtaactgattctagcctttgattgaatcaccagtagtcattgcaagaacatgaccccatcctgaagtggtggaacctgttgagatccctgacaacgaactccctctccacaatggcactgatgaccttaaacgcttcatggcagtcacggcacatcctcaggttcttcatcaccctaatggccatccccttggggatcaccagcaatccaagccccaatgccagcaactcactgtgcactccaaccatcacacctctgccttcctgatgatgatgatttccatcctcttcttcatcagcatcaaggactctggcactgccaattctccccttgtaacccttctccctcatcttgccctccaattcatctaacagcagcatcacctcaccggcccttgagccggcaggcgataccatgccagcgtagaacacgtaggagatgtcctttatctcgatccagctgcacccgggatccttccgaatgccgcgccgcctcatgttcgaccacaccgcagcagcgtcgtcggcttgaccggctgaagcgtatgcgttcgacatgaccaccagtgcgccggccacatcttgggtgaactctgataccttctgcccagccatggttgctaggtccaggcgcttgtggttccggcaagctgacagcaatgagctccacagcatgagggcgtcattgccattgacctgtgcttcgtcggccagctcgaatgccgcctcgagctgacctgcacgaccgagcatgtcgacagcacaagtgtagtggctggcacatggatcaatgccgtactcgcttcgcattgaacggaggagctggaggccggtgtcgaccagacctgagtggctgcaagcgtgcaggacgccgagcagtgtgacactgtttggctgcacgcctcggccaaccatgtcactgaacaaagcgagtgcgcacctgccgaggccgtacttcgccgtcgccacgatgatggaggtgtaggggatgaccgacggctggttgatcctgtcgaacaccttctttgagtactcgtagatgccacatttggagtacatgtcaaccagagccactgcaaccacgtcattgtcttcgtgcccatggtggaggaccatgccgtgaatgcacttgccgatgccaagccgcccgacgcccgcgcacgcgttcaccacgctgacagcatgaagtggttgggcgccatgtcttcgccattggttctgagctcggcgaagagctggatagcgtcatgcccgagcgcgttctgcgcatacaccgacagcatcgaggcccaggaaaccgcgtttctcgccgtcacgggcattgcgtcgaacacagcgcgggcgtccccgaccctgccggccttgccgtacatgtcgacgagcgcagtggaaacgacgctgtcgcacgcgtaccccgcgacctcagcgcgggcatgcacctgccgcccaaggccggcgtcagccaggcgcgcgcacgagctggcagctgtagagaaggtgaaggcgttgggtggcacgccgctgcgtgccatggcgcggaggagggcgacggccgcccggggccggccggcgctggcgtacccggacatgagggccgtccaggagacgacgttccggtcgcgcattccgtcgaacaggtggcgcgcgagggcggtgcagccgcagcggccgtacgccgcgaggaggtggttggaggaggcgaccgaggaggccgccccgagcttgaggagcttggcgtgggtggcggacacggaggcgaggtcggaggcgccgcgaaggaggtggatcagcagcggcatcagcgtggccgcgccggcggcggcgttggatgtcgccgtcatggagaccggttggtgccagtgtcatgtcgaggatcggaagcgcttgggaggtaccacgccggaggagccgctgccggggacggggcgcgccggggaaaagcagcgccgccgccgccgccgccgcggcgcaggccctagtccgtgtttgcttggggagaaccggagaaggcaaccagatcgtttcatttcatttgaaaatgacatatactatagaggaatactacacaaatactccctccatttccacactatgactttttttttaagttaaacttcttaaagttttatcaagtttataaaaaatatagtaatatttgtgataccaaattagttttattaaatctaacactaaatatattctgatagttttttatgttgtatatttttctataaacttagaaagaattgactttaaaaaatattaaaacgatttataatatgaaacgaaggtattagtagatttgatggtacaaagaaagtatttttctcaggcaacaatactagaggagggtatattatcaaaattttcatgcgaaaaattgtaatagatgtgaggagataaagtatttttttaccattaaaatgctaagctaattagaaaaaaatcactgttgacgtgattattaaggtttaaatcccgatgcctaaaaatattacacatgcgcatgtgtacttattataccaaggctaaagatttgttgtttgttttttcttcttttgggcgtgtgtagtgtgtgtaaatatgtcttttgtgtaatcaaaaaataataattctcaagtatgttagtgtggtgtactagtgtagttgtgtatgtatatctttcatgtaactggaataaaaacaagtcgattaagataaaaaatggagtcactttaattcctttctattttccaccttctgcctattttcagagtccagactaaggccgtgtttagttcccaagtttgaacccaaaaacatcacattgaatttttctacacacataaacttctaacttttccatcacatcgttctaattttaatcaaatttccaattttggcgtggaactaaatacaccctaaggaaacgaaaatggcatgacaaggatagaggcataggacagcttacaaaaacggtgcctttgtttcgggtaaatagctaatatggtccctgaagtttcacttcgggctcagtttagtctttgaggtttcaaattatccaaataattccttcaaattaattatttgggttaatatagtccttggacccacaaaaaagaccacgtgagcatgccaagtcatcatcgcatgcagcggtataaatgaaatgaccattctacccttatatatcatatagaaaagaaacaaaagatgcaaacaaaaaaacaacaggccaacctagacccaacattgttgcagagggtggccaacaaaggaatttatacgatcagtgttgggctgcagcaatcgtaagtgacaattctaaaacgatcatacatgtgtgaaacatttgttttcttttttatatggtatataagggtagaatggtcatttcattcgtactgctgcatgcggtgatgacttgacatgctcacgtggcactttttttggtccaagaactatattaacccaaatgattaatttggaagacttgtttggacgatttgaaacctcaaggactaaactgagcccgaagcgaaacttcagggaccatattagctattcacccctttgtttcttaataaaaagtcggttccttcaaacaacaaaaccatcaacttcctatattaaccctatatactaatgggcaaggtagcagggtgccagaccaatcttgagatcaaaacatggacagccaaattgttccctatatattcaataacagttttcaacttgtttttgtgttgttcagttgcaagcaaataagcaccacaatcatgaaaaacaatgctccagtgtcacttgaatttaccatccatagttccacacacacacaaaaaggagaaaataaagggtctggaataggactcaaagtgaatcatctagctaattctcaaaaaaaaaaaagtaaatcatctagctacattaaacaataaactgttacagtaactggaaaagaaaaggaaagcaaaataaggagatgatgtccataactgcatgcacatctcaaacttttaaagttgcaacacaaactcacaaaggccaaagatcattcagacacatggagcaatcaatggttgtacatgaaaaactacagccaggaatggcccctgctcataactcaagctttctccaagttcaggagcacacaggaccatcattatcctgggctggaaggcttgatgcattctgcaatcaatcagtagcatcaacatgccatgtttgttttcagttaccacatgaaccagagcagcaggatattttcaacatttcttgcattgatcacatgacagcaattgaacaaaaggacagagcagataataattgaatattttccaaccaaagaacatggttttccggcaaaaacagcaatcagtactatagaaacatcaatttgggaggctcagtaatgaacttaaaaacatccgaaatcatgaaacaaatgttctatatatatgcagtaaattacaactcacgcagatgaattatgaatatacagaagaatgataatgtggctcaggtgacgcaattactattacaaaagatagtggtggatagttcaaattcctcaatactagcaacaaacctggcatcaacaggaactctaatatggccatgtatgattcagcactgctcaaacagacaaactcaacaatatatctcattggaaacccggcaagaacttgagaataaataagaccaagaacttagaagcacttccggtggacaatcgctgggcctgattcgtcatattcagccttggagatccacatctgttgcacaataaacatcatagtgcgctgttaattagtaccaagaacacggaaacattttaattcatttttttaaaaaaaatagtaccaagaacatgaaaaaaaaatcatatttgtgcaaccaaaacatgtagcctttcatttctcttcttcctgaatgaattggcaagtttcaaaaagagagaaaaattcatattataagtcgatttgatatttttcctagtcaaactttttaaagtttgaccagtttatagaaaaatataacaatattttcaacacaaaacaaacatattgtgaaaatatatccaatgttatatttaattaaactaatttgacctagtagatgttactaaatttttctataaacttagtcaaacttaaataaatttgattagaaaaaaagtcaaagcgactcatagtatgaaacggagggagtagtaatcaaaattttacctgttggaaggtgctaagggaggcaaggatggatccaccaatccagacactgtacttcctctccggaggcgccaccaccttgatcttcatgctgctcggcgccagcgcggtgatctccttgctcatccggtccgcgatcccggggaacatggtcgatccaccactcagcacgacattgccgtacagatccttcctgatatccacatcgcacttcatgatcgagttgtaggtcgtctcgtggatcccggccgcctccatgccgacgagcgacggttggaacagcacctcggggcacctgaacctctcggccccgatggtgatcacctggccatcgggcagttcgtagctcttctcgaccgagctgctgttcttggcggcggcggcggcgttgagctcctgttcgtagtcgagggcgacgtaggcgagcttctccttgatgtccctgacgatctcccgctcggcggtggtggtgaaggagtagcctcgctcggtgaggatcttcatcagggcgtcggtgaggtcgcggccggcgaggtcgaggcggaggatggcgtgcgggagggcgtagccttcgtagatcggcacggtgtggctcacaccgtcgccggagtccagcacgatgcctaattaaaacaagatgaacaattttattttctttttcaaatctcactaatatgaaggacaaaattttgaaatttatgaacggcaacaggatggttaccacttactactatcttttactctttgtaactaaatatttgtaatagctactaagaaagaatataactaaacgaaagtgcttttaataataaatttagtaatatttttcatacattaataatttaaaattttgaggtttgactgtacgtattttaggacgtcatctactccctccgttctaaaatataataatatagaaccggatggaatatttcatactccctatactagaaaatatcaatatccaatccatcctagattcttatatttttagacgaagatagtatttaaggacaacccccctcaaaaaaaaaaaaagaaataaatcaaatttcgaaaatgaaattttaaatttgcgttacctgtggtgcggccactggcgtagagggagagcacggcctggatggcgacatacatggcggggacattgaagctctcgaacatgatctgggtcatcttctcccggttggccttggggttgagcggcgcctcggtgagcagcgccgggtgctcctcgggcgccacccggagctcgttgtagaaggtgtggtgccagatcttctccatgtcgtcccagttgctcacgatcccgtgctcgatcgggtacttgagcgtcaggatcccccgcttcgactgcgcctcgtccccgacgtatgcgtccttctgccccatccccaccatcacccccgtgtgccgggggcgacccacgatgctcgggaacaccgcccgcggcgcgtcgtcgcccgcgaacccggcctgaattttggattattattatcaatggtttatcgttgctgttgttgttgtttactgaattttttgaacgcaagaacataaggtatggtttgttgttgttgttgtgatttgtgagaggtggttaattggattgagttgatgatgatgatgaccttgaccatgccggtgccattgtcgcagacaaggggctggatgtcctcgccgtcagccatttgattcttcagagattatatatctgttgattcaggacaaaatggaccatgatctattagttccaatgcagtaagactatatcgattgattaagaacaatatggacaatctatttatttagtagtaacaaggcaatgcagtcatgatcactgaagaattaaaatggatgtttttgtcatcacaaatgttaaacttgatcctatacatctagggtataaatcaagtcctaacatattctagtttttttatgtaatcaagtcctaacaaactgtatgaacacaccacagcatgtaagcttcagcttaattgattagccttggaaagatggcagtgcaagaagattataatttggccttatgaactggattcgaactgcagtcaaatattacatttacatggccaaaatatagcacaaagaatctgagaaagaaaggcacaaacagattcaagaatatttttggttgttcttaccgggagattgcctgcctgaaacctccaccgagatggagatggaggaggtgcagaagaactaggcaggagagcttagggctctgcttggatttgtctcctttttatatgcacatattttcttttcaactttcttgattctgttttgaaataaaaaaagggtagaaatagagcaatatatttggctgcattacagtgtgctctaatccgttctctctattttttttggtatagaaacttgtttgggatttttctttttaaaaaaagacctatatttttacgtagaatttttcccaaaatgataataagtttaccactctttatttctaaaatgaaaatgtacattgtgtgtttttttagtttaccagctatttacgccacatctaaaaatataatggatccatcatggtggccaactgttttgctggattctttaaattgaaacactattcttttgagaggaaaattaaagggtgttgatcctaccaaaataattgaaaaagggaacctttgctatgccatctcatggccagcaaagaatctcctacttggcaaataatttgatcaacttccattgtcatagtggaggccatgaatggccagaatgggcaactgttttcaaattggcctggcacacacagcaatggttatgatagattcaaccaatgttgaccaatatacgggtcgaattaaaatgctaacaaatacggtttgcaaagattctcagctttcttttaataaaaggaaggagaccccaatcaagcaaaagatcaaaagattgtttctccagcaaggaattattagtggtcctagatgaagggaaaaggagcagcaaacacagaagagagtctcttttgagcagatcaacagaggaggctggaatgagctggtgatgaataggaaacgtgggccgcacgatggatgacatggagcgcacagagtcgtcagatttgatataaacatgcagaggggcgtcctctgatttcttggctggatcctgcttggaactgggccttccagttggcctagctcatttaattaccactattcatttttagataataataataattaccactgctcattttctatgtagatgcaccgtgcacgcaattaacgcacgttactcacaattggctacccttttattgccttgaggtcatactttcatgctagtactttgctaatatcagagggttcacattattcaatatcaaggtgaaaaccggtcctatcggtcgaaaaccgaacgaaactagtagaatcgaaaaacaaagacgactttcagtccgtaagaaatttatgatatcagaaatcaaggtccatgttcccatcttggatgtagtttgaaccaagcatgccagcattactaagcttgagatttgatgaactattgtgttctttcatttgattactgtgttcctgttgttcctgaaattactatgagcacacaagcagtacttcgttcagcttgtgcagagatcgcagaaggcaatctcagcagtttatgcatgattgcacaggacgctttcttgccaatggcaggtgaacacaggaggggcagtgtggcagccaaaggtacccaaaacatccaatcttcattataatagacgggcacggcggtaaattctgagtagcaggtcgttgatatatcaagctaggccgatccaatttcctctatgtaagaacaatgagaactgagaccgaaaaaattaggccccaagatgattgctcaaaatgcatataaaaatgcaaaaccaagccaaaaatgattacgctctactcctctcaacattagtgaggcacacatcctaaacaagcacatcggtgaacgaacgagacaaacgtcaggtaatatatgcaggggatcaatctttggctcctgagtcatcttgtcgttggctggcctctcctgaagttccctgcaaaacagcaaaagggtaaatcttgtcagtctttggaacaggagaatatttacaggatttttacatgggttagtcttcccacaaaaaatctttgaaactccattccaatttccaaaggaggacttaggacatgggactagctaaactttctctgttcatggttgttcgggccaagggaaatacctgaacacgtgcaagaagatcctctagttcggctaatatatctgagaaaggaggtcggttggatggaatgccttcccaacatctccgcatcaagtctaatagctggggatgagcattttctgggagccctgggcgcaatcccttgtataacagtaaaatgtcatgcttagtgcatttcacaatgggcgtattatggtaaactgtaacaagtaataactgacagcatattatttgaatagaagaaacctgcatatgctacacacctgtctcacacctacagctgcttggagaggggtcatggtattataagggatctaaaaataccagaaacgaaaatttgacaagccttagcaaacactaataaatgcacaatgtagataattgtgtctcttcacagaaaatcgtgtaccttggacgttatgagctcccaaagcacaatagcaaaactgaacacatcagctttgttatcatagggttgatgatttatgacctagcaacgccgcatcgaagatatattagcaaggaatataatattcttgtacctttagtagacaatataaactaggtaactatagaatgtccatgcaaactacagaacattcagattattgaaacaaagaaaaagtcttgtctagcaccttgaaccttaagacaaagcatctaaaaccctgagctttacaatacgttcatataacctcccaaagtgatttttgcctaagtggaatacacattggatgggttttgcccatgtcgcgtaaatgctgaacatacgtatcaaaatctccacttactatctcctctttatcccaattcattctctcaccaagggaacaaggactgaaaaaatgcttgtatgaccaaaaaaaaagatcaaactttaggaccaatgattgagaaagcaccaacatgtcatcctacttggacaaaaccgcttgttcaagtttccgtataggcaaaaccaccatacaaaacaacttaaggggaggggcagttgtttatagatggtattgcaaagtttggggggttacaaactaacctttaaaattcgaggtgctcggtggacttccattaaaagcttaaggggtggtatgcctatagggaaatttccatgaaacaacaaactattctgaactattcactttagcagtacaatatattatattgtgataagcatccaagttttgttttcgagacttcaaaaacagtaacaatattaggcacacttgaaactgaattactttgctccagcaacagagttgtacctctggtgccatccatctgtatgttccagtttcagctgtcatgttacctccttgatcctgaaaacgagctacaccaaaatctgccactttcacaacctagaaaaataataatgaagttatttatcagttcatagatattttctctcaagtgcaaagcagatggctcctgcacatacaaaaacacaaatgaagcatgattatattgcatcagtaccatttgcccacttgcataaactatactatcttgtcttattttttcccctcatatgttcatcaataaaatgttaaagattataggctacgtacatgatctttgtccattagaaggtttgcactctttaaatctctatggataatacccctctgatgcaagtaacacatccctctgcatacatcaactgcaaacttcagcagagttggaaggtccaagacattatgctgcttgtgcacaaagtcatacaggcttcctccagacatgtattctgaaagatataaaagtagatgatgagcattagtaggaatcttccagtcaccaagatataaattaagcaagaacccgctctttgtcacataataacaagcataattatatggaattaaaaattacatctcaccaatattgtgaaattaattagcattgtgtaataattattcagcacatgctttatttttaggaacaaactattctttgcaaattccccggtgagaaccaattgatgtcataaatcttaccagtaattatgcaaaattgtggtggttttgtgcatgcaccaatgaatcgcacaacattagtatgctgaacttccctgaaaacaagtatgggagatcaaggcaaggcataaatatttagttattggtacttgcatgaactgggtaatttcagacattcttaatctaagagcagtaatatgctcatggctaagaattggatatgcttaaactattcattcacaatggtaaatgctaaaaaagaattatataaacaaaacaccttattataatgttaaataccttagaatatatacttcctgtgtgaactcattccaaacattcttattcaaatgctcagatcttagaattttaacagcaacatcctcaccgagataagtcccatgataccttgacataaggataacacaccataaaaacaaagtgcaataaatacagtgataaaacaactcagcagtatacaattgacttacaaatccccacaagatccagaagcaatcatccctcccatcttcagcagtcgtttgtcaatttcccattcaccaccttttacttggaatggcagtgttctttctgcagctgatgagtgagatgaacctgaccatgatccctgcattttcagagagcaccagcaaatatgctgttagatttgtcaaatggaacaagacattgtatcatgcatcaactccttgcaaaaatacaaaataggattatatccgcatggaaaatgcttattgcttagacgatcataatatatatcacaagttacctcattccttaaaatggacgcttccagtgcctagagcaaaccatcagtgt

SEQ ID NO: 70576 - DNA, 1393 bp, Oryza sativa
gccgtcgacccggggtgagccgtgaaccgcccatttcgtttccaccatccctcccctctctcggccgccgctccgccgtgcctatggccgccgccggcgaccatcggggcgcgggcgcgccgcctcccgtcggccgtgccggcgaggccgccttcgggcgcgccccgcgagctgccatgtgggcccggccgtcagccgcccgcgcccgcgggtgcggctgacgcgtgggacccacggcgccggccggcgtcagccgtgtgcacccggtccaccgtggaccgagaggctgacgcgtgggccccactcccgtggacccggtccgcgcgccctctccctcggctgacgcaataaatccggtttttaattaaaatttaaatgaagaaattcgtaaatatccatttaaagagcatataaacttcaaatggccatatcttggccatttgaactcggaattggaccgttcaagtctctaatttttccttaagaagtcaagaacccatttttgtgctttgtttctgctgttatgtggagtttattagagtaaaagccttttcttttccgttggtcgtgtagacgctgcagcttcggaagatccgctcttcgtggaagttgaagccgacgtttgggaaagcgagcaaggcaagtcacatcatctttgagcatattgaatcccagtttataaaattatgttgatttaaattattgcattatcgcttcatttaaattcccgcgttatcactgttttatttagccatgcctatttacctttgttatgaccttattattattgttattgttattattaccttgttcaccctagattaaacaaaaccccaactagtggacactctactcatggtaccactagtataattttatgtagatgcttcgcaatttaattaggtaacattaggcggttttacaactctagactttgggaatattcatatcacctggacactttggaatggtttggttattgtggaaatggcttcacaccgccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggagatggacgaagtcgggggtcgatggacatctctaggacaaatgaaggctacacgagctgcggcccggtagtcgagatgtcatggcacagggccggtgtcctgctgtgtcacgcccggaatttctatccaaaattccaaacgcttacatgtgtgttaaaccctcgtccaggaatcaaccgagacacacaatgacaatattg

SEQ ID NO: 70577 - DNA, 1433 bp, Oryza sativa
ccccctcggctgattcctggacgagggtttacacacatgtaagcgtttggaattttggatagaaattccgggcatgacaagttggtatcagagctcccttgaccctaggttatgccaaatggttacccatagaagccctctaaaaatattggaaaagtagaactattcttctccctttctcttttaattaaaccaaactaatggcacatgcacttcataatctcttttaatggttctcattcaaaatttattctagtgttattagtactgtacatctattactgtactaatggctcattttccagcaaaagttttacaatgttgtttcatttaatcttgctgcaataaaataaatttagcaagttgattttataactttcttttatttcttttggaacctgttattcaaaagtataaaacttgtaatattgtttctgacttttcaaacttatcttgcaaacttggtttactttatttatttaccttttactttgaatttctaaaattaatccaaaaacttgtgctattaattggatagatgtcttaactccctcctttcacttgtctttagatgccgcgctacaagcctgagtacttgtttggtgttgagggatttgtccaggagttgcgtacaatgtcctttgtcattggatttgggactgcccctttttatgcccagattcctcatgatcgtcatgaagagaggtgccgagtcaaagtcactttgaacagtagtagtgaagatattccatcggtgatgttcgaagctggaggaagaaactatatccacgcatgtcaggaggtggcaaggatcgccataggagagctccgtgatcgctacagtgatcagttggccgacactgagtatcgttaccatccccgccaaccccaggggagtgaccgtggcagttaccttgagactgaaggaattgagaatgatgttaccaccagacatttggttgagatgctgtgggctatggatgaaagtcgtgcggagactgtgttagtagctcaagatcgtgaagattggaatcgtggtaagatttgcaagctagaagacaaggtggatcgtttggagaaggaactagccgcgttgaagggagaagcaccgccgcagaaggccaagattcgtcttaccgcaaggaagagagctttatttgtcccacgctatcaattggcgccaaaggtccgtgtggtggagaaagaagtagccccagcggatcctccggtcgtcaatgtaagtgatgatgaaggagaagaatcgaagcgcacccattccaagatcgagtggggagcaactcaagatgatgaagacgagccgaacgagccttcaatcaactccgatgctcggaagaactagagtgccttgttaagccgttgtcttagatcgttgtgttagtttgcttgttttaaatttgcttgtgtgggtcttg

SEQ ID NO: 70578 - DNA, 613 bp, Oryza sativa
ttgtctgaattccattttctgcttctcatcagggacaagattaaggtacaattctttttaaaaaatctatactgttttcactgtgattcattttgctttctgtcactattttgtcttacctgttgttttatgtattcctttacaaagcaaaagcataacctgtgatttttaggtcgtgaacagaatcagccagcacatagtggaggaacttatagtcgatagttcaccagaagttacaaaaggaataattggactttgtagtgatgcatcaactgggcttttctatgcatacgatgaaaattctatattccaggttagagactatctgattcttgctttgatgtaataattgccttcagagtccaaaattgtgttgctgatgaagctatatatttagatttcatcatctgatgagggtcgtgatatgtggcaagtatacctggacatgaaagaatatgctaccgcactgtcacattgtcgtaactccttccagagggaccaagtctatctagtgcaggtgatgtttatttgcacttcgatcccatgccctacttttttctcctttaataatttcccccctatgataagctggacccttttttgtttgtgatga

SEQ ID NO: 70579 - DNA, 657 bp, Oryza sativa
  unsure (1)..(657): unsure at all n locations
tacacggcgcaggtggattccggcgatccgtgcgtctccatcaggtcggcgtagaagcaccacagcttgagagaccgatgcagctttgtttggacgacggtctcgccgacgccggcggcgacctgcctcctgacctcgagcgacggctctgatacacatacctctagtaattgtttcatgaatttacaaaacttctaggtatgattttcatgagtttccaacatttagctcgttttcactgaatgtctgaatatgtcctcatgttaaatgggaaatatgttagaaattggatgtttgcgaattgtagttttcagcagtactattgaatacagagttatttcaggtgagcaatcttatcgataaaacagcaattagtggatcagagcccaaacttcccctagtcagagtaaaggtaaaatagggtgctcttcagaaaatattaccttcctttaaaatattggataaattctttatgtcaaatttctgaaggtggactactctgggttttcgacaataactccacagcggtttggtcagaagtatgtcggaaaggtacctcaaccactaatatgaaatttactgatgcatacctnctttatcatatactttttttttatggaatcctttatcatatactttaactggcgtattctttac

SEQ ID NO: 70580 - DNA, 20632 bp, Oryza sativa
ttcaacctgttgatgtaaagtatggtcaggtagaggcatgtcgagttcatgacatcattcttgatttcatcgcgtgcaaggccgctgaagagaattttgtcacctcattggatactgcagattttggccaagtttcggatcgcagggttcgtaggctaagtgtcatgaatatcagtgaagaccatgccaccatatcagcaagccaaatcgatctctctcatattcgatcacttactttatttgggcgtttcatgcaaactcctttggtggatttaccagctatacgtgtgttggatttagaagaatgtgaaaacatgggagacaaccatcctattcttgcgaatgtagaaacgctgctccatttgaagtacttgcgtattggaatgttgtgtccgataactgagctcccaagaaatattggagaactgcgtcatctagaaacactggacatgcgatttgcatgtcaagtcaaagaattgccatcaactattacaaggcttcaacgattggcccgcctatatgtccatcacaacactagactccctgatggggtaattggaaagattcagaacttggaagagctagaggagtttggtgtcgtctcctgcgagaaagggaaatctctgcaagaattcggtcagctacccaagctgaggacgctgaaagtaagatgcagtagtactacagatgatttggaaggaaggaagcgagccgaggacctctggaattatattggaactttgatatcttcatgcaatcttcatcatctttgtatcctccaccgacaggatgatccagatcatctcccaatgtcactggaatcatggtgcccccctagtgataattgtagcctccggaagctccacatcacacattactacatctctaagcttccaagttggatgggttcccttgcaaatctcaaggaattactactatatttctacagaatgaggcctgaagatgttgacatccttgaagcaatacctagcttggttttactcagagtaagaacactatacagcagcaatgggaggatcacgttccgtggcaacaaaggattcagatgtttgaaatatttctctctagatattgacctttgtgggacagagctggagtttgaagctggggcaatgccaaagattgagcatctcaagattaatttccctgtgcattcttggacggcgtctgtgaatggtgcttctgattttggtatccagcacctgtccaccctcaccgaagttgaggttggtcttggttgcttctttatacctgacaccagaaggatgtaccatccgacgacggaagatacggacgacagtccgatggaagatgacggcgaagctaacgttgtcaaatgttttgaaagtcgcatcaagtctgccgttgaggcacttcctaaccgtcccacatgcaaattcaacctgaacactgctattgtgccttgtccatcggtaagtttccagtcagaattgtagggataccacaaaaatatttggtgcccgtttaattaatggcaaaatttgttctaagacacttcagatttgtggtatttattttagggcactctaattttatagcatttgctctagaatactctagttactttttttttttcaaaagactactttaccttgaaccaccttctataattaaaatttgaacacactttagctgattctaaacattttgtaaaatttagaagttgtctgaaattacagaaatcaaaaatattttacaaaaatttgtttaaatttagacaatattatttaaagttttaaaactcttttggaaactttcaatgtatttgatttccgtaattaaattagggacaggtttttaatttgggtacttttaccatccttacaatggataatgagaggtatcactaattataataactttagagataccaaaattaggtacccccaagtgtgaaattttagtaccttacaagttatagagaaaatttcttatgtgcccctcaagttcttgctcaatctctactagtatgtcgggttttgctacatcctcagtacataccatttcgcttagttaactaccataaattaatcattttttttcaaaataaacataatgcccctcataaccataagcgataagtttgccccgcacaaaaataaatgcccctaaattccttagttttggaaaaaaaagaagaggtggaatgaatcaaatcaaaccatataaatatttactcatttttataattttctaaaaaaattaaaataatatatatattttcaaataatttcgatcaaactaaacttgaaaccaaagtttgatttttattttttttcaacagaaaaagaacaatggggaggtgcattaccctaatcaccattttttttgttattttatccaaaattgtaaaactaaaacttgaattctaaatgaatttaaaatttggttgaagttcaaccttatgagataagggtaacatggtcatgttgagaaaaaaaatggtggtaaactgagagacataaaaaaggatggaactcggaggatgggtgggggggggggggggtttattgagtggaaactgtaacaattttattatctcttgggcacatttggaaagaccggaaaaaaactgaaacattaagtgtacttatttttcaatcttttgcttatatatttttttcattcttcttccagtgttttgagtacaagaggaaacacccgagctttcctgtaggttcagttaaagcagttagggatgttcgtataagttcatcagcgattcaagataattccatggggcttcgccgccggcggccagcaaatcagccgtttcgattcggctgggcagggctgcagtattaagactctgcttggcatggcagggctgcaactctaaaatttacagcttcaatactccatcccatctttaagtacagccatggttttacacacccaactttaaccgtctgtcttatttaaaaaaaatttgaataaatttaaaaacataagtcacttgtaaagtactattcatgttttatcatctcataacaacaaaaatattaattataaaaagattcaaataaaacaaacgatcaaagttggacgtgaaaacttatggttatggttgcacttaaaatagaacggagagagtaatcgttaaggttcgggcacccctctccacagtagagctggagctgataatggctgtttggctataaagttttattgggacgacaaagactattcatgattgttttcacttgcatttctttcttggagctgtagaagttagcagctaacttcatgaatatggtttctgactacttgctgcaactaattatttacgtactaaaatttttagcagctataaatcttataaatagagggtcttttacagtacctcccactactatagtggtagtaaagtcgtagagatctaatctgaccgttgattataattgtgtgttagacatttaatccaatacccatattcgacttccaatttataattcatttgtgcagaacagatggctcgcgttaacctttgttgatcggcttctatcatcgctggctagctacccagcttgtggcatcgccagcgagagccagtagtacagaaccgggcatcccaattggcccatctgtgacggaggctatcggtccattacaaaggtacgcatatttatcgggccgcaaaaaaccctgtcacaataagccgagagaggatgtatcttagtcctctgggttaggcatgtcaccaatgaccctcatcggtgatgggccaaaacaaaacaccgtcactgatgagggtcatctgtgatgggcccagtgttacggcctgacaaagatgagtgtgaagcctatcaccgatgaccctcattctttgacggggtttggttgtgcttcgttacggataatccatagtataaatacccccagggtattcgaagaacagctatcctaattaacccagtgtatggtttacattttggaaaagagagcaagacgggagaatttttgctctttatttttctagaaaaaacaaaatgctcccaagataataataaattattactacaatttccgtgtaataactagctacatatacataacttttattttttttcataatttgcagatggacagaagatggatgtacaaaagtgatcgattgagcatagagtatggaaagggcattaccgattccatcaatgtcgtagagcaagagaaaaacatgacaaataatgaataaacaacttgtccatgctttgattgtaggaatgagaagatgtttaacgatagtgtcagaatacgcacacatctgatggtgatgtcatcacaacattgctcttcattaaaacaacctattccctatttctaaatacttgtcactttttttccttttttcaaatcacaaataacaaggaaacagttccagatgaagttttgggaaataaaaaagtgaccaaaattttgtacagtaatatctctgattgatcaaagtagatcaagataggcgtgaatatcaattattctctgcatgagcatatgatgtctgccatctcttttaaaaggagattggccctaacagattgtactggacataaatcaaaataaatcaactaaatataatacaacaacttgaggtcaagccactagctaattgacaaagctgctgccaaactttgtataatccaggcacattatgaccagtgacaactacaaactaaatatttgcaggtgacaaaccagagacccacaagagaaaacttattgctagtttctattatgacatgcacatgtgaattatcacttcaacaagttgcctaatagaaaatcgagacaaagatggaaaggacactttttatgattttagaaaaataaagcagctgcaattggtgtagtgtatcatcttctgtctgaatgcaaatagacaattccttttctcccttttgaaaggagtgctgcctatatcaactgaacataatcacactaccacattatcacactctcacttccttagctcgcatgtagcatagaatccagacacaggagagcaatggcggcaatgcatgtggatgcttccacaggggtgatgaacactctcctacccaagctctccaagcttcttgaagagtacacgaatatcaaaggcgctgcgcgcaaccaagcatgaagcctgtgctagagatgcttgcagatgcagatgatgggctcgatcctctgaagagggaatggcggcacaatgtgcgtgagctggccttcgacatggttcttccgcaaattgaagaagttgaaggcttgccctgagatcgctgatgcgatcgatgaactgatcaagaaatgtgcaatggagggaagcaagaggcacaaaaggtataattctgtcaatgtggcatccaattctagcacttttggtgttgatcctcgcatgctgatgctttatgatgaagttgataaacttgtgggagtcaatcgcgcaaagaaacatataattgattggtttaccaaggagaaaggtgagaaaaatctcaaggtactgacattcgcagattttggaagtcttcgcaagtctaatcttgccatcaaaatctactctcagctggaagaccaatttcagtgcacattttttttgtcattgtctcgaaatctctgtagagaaaagattttgagaatgattcatacaaacctagggatcacctataacacatcagatgacgaagggaaactcattgataggataagagactacctaaaagataaaaggtaaaccttgtaatttgtaacactgctatgtactctttactactacctctgtatttaatatgacagtatgaaactattgactttattcggtctttggtgtacaactttaaccactagttttctattagaataaaatgataatatttaacaaaattataacattgtaaaagtaattataagaagaaactattcatatgtttttaatgtttctaaatgaaatattttgagttattgatggtcaaaattttaaaagtttgaccaaataaagttgatagtgtcatatatttaaatatggtgggagtacttttctacatttcgttaaacagatcatgacatggactgcacacatttattgagcaattataattagttatctgaatatatatttacaatctactgccttttttctgttcacaaagagtgtaaatatgtgctagagactagtggcaatcctgtgcttaacttatgcttctttagtttcaaatcaagtggacttgagctagctgcaagcaaatacttttcatagaaatgatcaattgatcatctatattcaattaatttaatgctgatggcggctttatatgcttaaaagatattgatatctagctttgctaaaattctataataggtacttcattgtgattgatgatgtgagggacgcagaagcatggaaagctattgagcttgctttgttcaacaacacatgtggtagcagaattgttataacaacacgtaattccgcagttgcatcatgttgttcacatgatggtggttatgtctatcgaatggaacctcttagcctcaaaaactccaaaatgttgtttttcaaaagagcatttggttccgaggatttgccaaatcctcaattggaaaaagtatctgatgggatattacagaaatgcggcggccttccattggctattatgatcatgtctagcttgttagccgatcagaatgaagaagatgaatggaaaagggtgctaactgctattggttctgtacttgcaaaggacccagatgatgatatcatgaaaagtatattatctctcagttactatgatcttcctcaccatttaagagcttgtttattgtacctaagcatatttccagaagattacgagatcaacaaacaacgtttgataaatagatggatcgcggaaggattcattctcgaagaacaagggttaacttcatatgaagttggtgaacgctattttaactaccttatcaatagatgcttgatccaaccagttggttcaaagcatggtcaagcaaaggcatgccaagttcatggcatcattcttgatttcctcgcatgcaaggcttctgaagagaattttgttaccccattcaatgatgatgcagagcaagggcttgtttcagaaaacaaggtcagggttcgtaggcttcatgtgaataatcacaacaaaaaggaggttgccagattaacaggcccagttctctctcatgttcgatcgcttactcttttcggtgattttgggagaattcctatgtcagcattcacagctcttcgtgtgatggatcaagaagataattgggacctaggaggaaactggggcttaggaagcaaccatcacatggcgcatatcgaaatgatgttacatctgaggtacttgcgtctaaattcccctttattagattttgtgctcactgcaagaacaggagggttggagaatctagaaacactggacctactaggtgtgtcagttgtagaactgccttcagctatcacaaggcttcgccgattggcccggctttatatctctcacttagctagatttcctaaaggaacaattgcaaagttgcagagcttggaagagctaagcgagtttggtttcgtgtcgttccaccaacagtgggaatgcttgcaagaatttagtcagctaaccaagctgaggatgttgaaggtaaaatgggattttgattggtcttttgttcaagatgaggagggccttcagagttatatgcatgctttaatttcttcatgcaatgttcataatctatatatcggcaatatccacatttggccgggtccttacccactttcactggaatcttgttgccctactactacttgtagcctccagaagctgcacatcacatattgtttcatctgtaaggttccaaattggatgagctcacttggaaatctcaaggaattaaagctttatatctactgtctaagagcagaagatgttaagatacttggagcaataccaaccttgatttttctcaagctaaaaaccttttacggcaccgatgggaggatctttatccctggttataaaggattcagatgcttgaaatattttggcctggtcatgatatcttgtggaaccacaccagaatttgaagaaggatcaatgccaaaccttgaacatctcaagcttaggttctgtgttcatgagatggagtgcataaatggtgctaccaatttcggcatccggcacctctccaccctcaacaaggttgaggtccatatctatgggtgctcagttagtcacaaagactatgatccagaggctgatagggaagatagcaatgccaaaaatgctgctttcctcatcaaagccgccgttaaggcgcttccgaaccgtgtcacttgcagttttgaactagcaaaaacttatggaaacattggaactttccatgggcttatcaaaattgtaagtcacctgtaagaaatactaggacttgtcgtttgattcgtttcatcctctaagttgttactagtcctacatttctttctttcatcctgcaaattctatgtaatttgatatttaataccacatttaatatatgttatccctcacttgttactcccatgtttgggtcaattttcttatggtgtttgatgcagttgaatcgacataatggaatatcggttgagagactccttcaagaaatgcttaagtcgagggtgaagcaaatgattcaaaacaatatggcgcgggcacggggcctcttctagacagaaatggtaaattcaagaggtgagcgagagttctctcactgattccaccagtgcaatgtttcatgtcaatatgatcccacaatatcataaagaaaataactcatattcattcatttccatgtattggcacatcaaacaggatgagacgaaccaagacgaagaagtgaagaacacgttgggaatgaattgcagatggtgtgctatgaaaggtgcagtttgtgtgctagctgctagagagctggagtcagcgaatccactataaatttctacaactctattgaaatttcttggagtatctgttgaagtctttgtttgttgtggttgttagtgtacaatttggagctgctctgtgttggtttgagtcgaatggtgatttaaagtatgtacctatctgttaaacctggtgcttctataattcttcatataaataaagtgagttgggtttagtcccacatctgtaattgatgatagaggagcacgacttaaaaaggtgggggcaatcctcaccatcagactagtcttttggattgtgtaggttcaggatctaaagtcgtggcttcggttggacctgtggtggagcaggccttgacctgggtggcccatggttggtgggccgggctgcgcactctaacaagacctaaagttgtgacttcggttaggcctgtaacagagcaggccctatgtgacctgggtggcctatggttggtgggccaggttgcgcactctaacagttgttacttaggtaaaattttataccaactggtaaaaatattaaaataatagaataatgagaataaaattttataccaactggtaaaaatatttaaatattaaaataatagaataatgagaaaatatatagtgctgtttttatggaaaaggaaaaaaactgcatggcagcattaatatatgcatttgttgacatgtatgctgcttttacctggaggcaagaagcttaaatatgtctgtcttagcgttaaaggtatctagagatgccacagattgacattaaaaagtaacatgaatttctcttcgtttcctagaagaattgcctatatattatggtacaaattgttcttttattttgagaaacaggcttcaagcctaaagcaactaatcagtgcttaaggggttacagtcctcaactaacagagaagaaatacataaaggtggaactgaaaaccaggttgaacactcctcacttgtcaggcacattttggctaggctatgtaccaccttgtttgcagaccggcgaacccaaatgactttaaattcctggaacgcactacacctactcttgactgaggtatgtatgtatgtatgtctacatctcctccaggctccagctttggagcttccttggttcctctctatttcccaatcaattaatcagatcagccactgtttcactattgtttccttgatagtatgtctgtgtctcatatttcacttctgaacattatcttaaaaaagttcacttctgaaatctgaacattttcacattttcagtcgtacattatttgctcaagcaagatgaagagaaagacaatcgattgctattataacccggttgtttcaagggtgaactccactgaaaatcctagtccaatcattgcccaagatattgacccagttgatttgcaagctgctaatgaaaatgcggctacactaccatcactagaagctgaacaggggcaggaaattgtagctacagcatttgagagggacccagggaaacgggctcaaatatttgaacttcctgctgatcaacaagatgaagctcgaagattttatatatctgagggtccttttcgaccaatcttgcaagaacaagagtatcctttgaatgatgctaagcaccgtcgtcgatttcgcagcagttggtctaaacaattttgttggctggagtattcacgccacacagattgtgcttattgtttaacatgctttatcttttcaaagaagccaactgggaaggctggatcaaatgcatccacagtcaatgggtttcaaaattggaagaaagttaatgtaggaaaggagtgttcttttctaaaacacatgggggatgctagctcagctcataattattcagttgggtgctttaataatctcaaaaatagtatggctcaaattgacaaggtgatggttagacaaagtgacaaaatagttgcaatagcaagactaaggctgactactactattgattccattcggtaataacatgaattcatttcaatatttttttagaacagtgcatttataataaatctaagtatctaacgatttcttttgtttatatgataggtggctaacatttcaagggtgtccctttagaggccatgatgaacctttagattccataaatcgaggtaattttcttgaaatagaattccataaatcgaggtaattttcttgaaatagataagcttttggcatcatataataaggaggttaaagaagttgtgttggaaaatgctccaaaaaatgcaaagtatacctcatctgaagtccaaaaggaaattctaagcatagttgctcgaaaagtgcaaaaatcaattagagaagaaattggcactagcaagttttgcataatggctgatgaagctcgagatgaatctaagaaagagcagatggcgatagttctacggtttgtcaacaaagaagggcttataaaagagtgtttccttgatcttgttcatgttagtgacactcatgcgttgactcttaagaactcaatttgtgcggtcttgtctggtaataacttgaatgtgcaagatattagaagtcaaggttatgatggggcaagtaacatgcgaggggaatggaatggattgaaggctctaattctcaatgagtgcccatatgcatactacatccattgcttggctcatcagctccaattggctcttgtcgcagcatcaagggaagtacaagaggtacacaatttttttcagcatgcaaatttcataataaatgttgttagtgcttctccaaagcgcaacgatgagttgttagcaaaccaaaccacagaaattgctcgtgaaattgaattgggagagcttgatagatactggacgaggggcaaatcaggtgggctctctacaaaggccaggggacactagatggagttcccattataaatcgattcagagcttaaaaaaaatgtttggtgccacaatttcagtccttcgtagcattgcacataattgttcagttacaaagtattctaggggagatgctgcaggtgccctacgaatgattttcacgtttgattttgtgtttattcttctcatgatggaaaatattatgaagatcactgatgtcctatgccaaacactccaaaagaaagctattgatattttaaatgcattggattctgtttctaacacaaaagcattgcttgctgatttgcgaaatgagggttgggaacctcttgtccaggaggtcaaatctttttgtgagaagcatgagattgatattccgaatctgaataacaagtatgttcttctgcctaggttttaaatatgaatggcaatatgtgactgttatttttgtagatttttatttcttatttatgttcccaaatttgcaggtatgttgatgtgacaaaatctcaaaacaagaatgacaacactacagcttttcactattacaaagttgatgtgtttaatgttgcaattgatcaacaaatgattgagctagaagaccgattcggttctcaagctacagatctgttagccctgtgtgtttgcttggagtcaagacttgagtcatttgacatggcaaaggtatgcacccttgtagagaagtattatcctgctgatttctcaagtcaagaaagagctcaattggagtgccaactaccacattttcaacttgatgtctgcaaccatccagacttgagcatattgccatctcttgcagaaataacaagtggacttcttaagacagggaaaagttgttcctatccaatggtggatagattgttaagattaatcttgactcttccagtgtcaactgcaactacagagagctttttcagctatgaaaattgtgaagacacgtcttcgaaataaaatgggagacggctacccatcacatcacatccaagagttggtgcatctcaacaagagatccttcactagcatacccatgaagcagagtaccgtatgtagcactattaggcttgtggcccctcttgaccatagaatcaaagatctttctagcttccatggatcttccattcttgcagagatagtccatgagcatgttataagtgactacattcggttcaacaccatctctgcacatttttctgaaaatcccaatggcctctttgggctttcccgatgagcaatatccatgcaaaagactattgtacgtgatgcaatcaggcataacaccattcttgaccatcctagtaaggacctccctagccttttccattgcttgagccttggatagggtagcgacgattgagctgtaagtcacaacattaggcgacatcccctgatccagcatttcatcaaacaggcaataagctttgtccagttgaccctctcttcactctctctcttaattaatatagtgtcacataagctaaaagttatatatggcaatgtagttaatgccatagacaccatcctaggtggagggttgagactgcccttactccgatgttttatctggttgtgttttagttcacaccaaaattaaaagtttaattgaaattggaacaatgcgacggaaaaaattaaaagtttgtgtgtgtaggaaagttttgatgtgatggaaaagttaaaagtttgaagaaaaagttgggaactaaaccaggcctctctttttctcggccattctcaatttctcatctccttacatttcctttttatgggtatctcgaacaggatgggatggaatgatggaacagtgaagagtagcaagaggatgacgacaatgacagatcgatatcactgtgttgatgtttcaggatgttcagtcttattagtagttgggtttcttcttgttttgaagttttgatggacctctgatcttgggtcttcttgttgtagacacaaaaaaaaatttcctgttgacatacccgatatcttcatgataagatgttagcgctttgttcattctgcctggcctgggacgctgggtttgtctttgatgttaaggtttgctagcaggtaaagccagcgctgttacttgtaacacacatgattagcttaaaataaaactgggtgatgcgcatatcctctgctgaaacatgttgcaagcagtcccttactattcgccgcctcccagtcccagaatcgccggcatccaacacttgcatttgatgtttctgggacaacttttgcttagttcaacttttgccctaccagatctgacggtaacgtcagacagagtgtacatgaataccaatcaaaatgagctgaacatgttaatcgtatttttcagacagctaccatttcaaattcaagtaggccattcagattcacgggccaaaaccagaaagtcagcatccactggtttctcacgggtaaatttagtacatctcagaacgtggcgataattctaacgaaatatgaatctacatttgcaataatttacatcacttgcaacacctcccttagaaacggttcgggctgatctgattatatcgacaacataagactcgcataaacttggtaaacataacttaaatagaactagacactgcaaactgatgcatgctaaaacttgcgactaaaccccctatcttcagtgactacgagtagactgacatttacatctaccagatgctaacaccagactggacacaacaaaattgatgaccaaccaagagaaaagcatcctacacgatggacagaggtcctggagaaacgtttttgtcttccaatgtacatgatttcttgtgcactctttggttttgcgtagctggatgtaatcactttctacttgttgcgattctcggcttccctttaacctcagattcctattcaaaatgagggaacgtcagtgtaaatgcattgtgagacaaactcaggaaagaatctcaggatgataactgtaaacaactattacctgtggactgtgaagatagatggatgtctttgcagtggcagggttgtggttttcagccccacggctccagtcatagcagacctggttaacagtaaacatggttaactaaccaaactgtagtctttttcttcaaaacttggagcctcagttagaactatcacttagcatttttacagctcaacaagaacaagcatttcatttgaattcaaaatccaagggaatgcatttgacatacaggttaaacaggaccgggcatccatttgaactcaaagtctatctaatgaatggaaaacatcaggcacttctttcaccatgtttaggccctattgtttcagcttaagattattgtaatctagattattgagccagataactataagttggattataatgagccgacatagaataagctgttagctgtttgtttctctggattattagctgttagccacccaaaaatctaaaaaagcacctttagagtagattaccagattatagtaatatggcttatagattgtaatgatctatcataataagctatctgtttgtttcagcttactcctaataatccagattataataatcctaagttgaatcaaacagggcctcaatatgtgcattcaagatgtctagttcattgcagaactgtggcatgggaaacaataaaatacatctaaattcaacctggtcagaaaacatggttgcatatagtcacaaactaataaagtacaacaagatactcaagcatcacttgacttactgcataagcaaatatcgacccatcactgttgaaggtactgcaaggaataggaagagggcaccgactaaaagcctgtgtaaaaaaagtgacatgggaagtgaatgattatattctgtataaaataaagggatgcatgtgagaaattgactgcaacaaaacaaaattagcaaacacaaatgacctgccttgtactaagcacccatatgattgcaaattaggcagattgctcatgcaataagagaatccatgccatcgagtaaaaatatgagcattttcactaaaaaataattgcataacactaattacatggttgagcagatacaaacagatgattttttcttgaacactgttctgaatttacaaaagtaagttcatgagctttatcttggtttggtttccagatgtgtgcaagaatatttatgcagcacactaaaataacagataaagcaattatgactattaaaaatcactgaatactcaagggaacaaaaatacaagtgcaataaccagtacaaatggaacttcaaaagagccaacatcaaaccttcagtctttgtttgctatccttatcccagaaattaaatgcgccatctgatccagcagttgcaaacgtgtgatgaacctgtgccacgtgatagaaaatatgaaaccttaaatataactccgcaaactatgatttccagacttcaaaaaccagtaagtcggcaatgcttttctcaatgaaacatatcctagagatgtattcatcaatgaagcataccaatttaatgaaaaagatcctataactgaaaatatcataaccaaaagaagaaaaggtgttctatgatgtatgcataacattcaatagtcataatatggaattgttcgatggaatcgtaaataggacatttttggagtattttgagacatatctttatgagaattgcaacatctgcatgatcagattatatacggttgttagattaagtcttaacatttgacgttccttacttggaagtatcctacattccaacgtagaacttcaaccagtactttgtgaataactgcaaaaaaaatgtgttgccgtaggtgctaggccctgtggcaggttgacacctaacacctccaagttgggctacaggctgtctagtagttcagttgcctaggcatggtgctagtgctgagcaaagacagacaccaacaggcacactaatcaagatcatatgagagaactttggggtatgaaaccaatggtgccactcgtatatagtatatattgccagaattcattggtcaaaatatataaagttagaattgtgcaaaacatgtatactgttcaatggaaagagaattagaggtattttgtggaagaagaaactgtgtttttactgttctacaaatcaagtgatggttaagaaaaaaaatgcaccataactcagcataactctcccgcataagcatttccaataaaagcaaaagtgctatatggcattcatgtgtactccacagcaaggtaagaccattcagaaaaaatatcataaatatgctaaggtataggaaaacaagagacagacggagatcttactgggtgaaaattgagtgaattgacagagaaaatatcattcccttccctgtgacatttgaacgtgaaatttttgctttgctgtgagtcatcaatatgatgcacaccaactcttccttctatggaacccaccttgaaacaaaattagggtcagagtcagacacatggaaatatacctcttgtataatgtcagatagaaattattcttaggtaacgctgagcactctatccgaacaaggtcattgctgattatgggtaaaggtaaacattggttggttcaagcatatacaaaacctaccttgctagacatctctaggcagattataaatgggaagatgcacaactatagaaattgctaaacacaatttttcgtattgaaccttgtaccaatttttttggtgtcaaatatatactagctgaagacaataccattgggtgaataccaaccaagaaaaagaccataagtacataacaatgcattgctagaatagttatctatttaagcatttagaatagactagaaatttttacaaaaaaaagttgcattaccaaaaatccttgttgatccgggaatgcagcaagacacctagtctggtatttgagtggcgattggatgcgcttgaactccgtctaatgaccaaaacaggaaacaataaaaacactcagttcaatatgagaagttgcagatgaaaaacgagtgatccccattattcatttttaatggacatgtgcgatgttcacaaagaccaacctgaggattctgcaagttgaagacgaccagattacgatcagcagttcccacaatcataaggggataattcactgtaagtgcgtaacagcgctcaggaagttgctgaacatggacaggatttgattgccttgtgtcccaatacctataaatagcaaagtggtcagtattggattgactagaacagatcactgtaaccacaagaacagaggcctatgtgctgcgatgagattaagaaaaagttccctaaattttttggtaatgctcatacaacttatgtcacattaccaaagtttggctgtctatggtggcaaaccaaatatgggccaatataaaatgcatgcctaattgcctattaatcaaatagacagcttgaacttagatgcttgacctcaagcttcctaaatcaaatatcaatagcaattagggtctccccaacaatataagctaaaattaacaaatatttttaggaacgatcacaaggtgtatattttgaatccatagttactacttactagcgaataactatctgagtaaatagagtggttgatatgaattcgaattccatgtaaaaaggaataccgaggctgcaaggattggatttttcacaccttagagtcttatcccagcttccagagacaagaagattcatttgaggaatccaagcgatctccttgacaggtgcgtcatgcattgcaacagtctgagcctgcccaccagacaacagaggccacatttttacttgtttatcacagcctccagagaacacagtagttccatcatccttccaagctgaacagaggacctgatagaaaacaaatcaatgagcacactaaatactaggaaaatcaatactgtacattatgtgaatgtggtcttgagagaaatattgagatcatactggctggtcatgcgatatagatgcctttggttgactactcccaccaacaatctcccagcaccgcacctgcacaaaactcaaagtcaaacctggtaagaacacattgataaatgcatactgaaagtttacaggaaaaataaacttacctggttatcccaggaagttgccaccagaaggttgctctttgggctaaaactgaggctcgatacggagtcacctggattaggcagtacctgcatttacaatttaaacataataaataacttacaaagtaaatactagtatgatttattatttacagaatgtgaggaccaacacaagcacagatagaaaaggaggacaattgttgcataaagcatcacacctcaaatgacttgtttggattcatgtttggggcaagaccaagagtcgccatctccttctacctgatccttcaattcaaatttaacaaaatatcgtaagaaacaaaacaagagaaaccaactcaagctgttagcacattccaacttagaaacagcacaaagcatagagagacaatagcaatccgatctcccgcaaaagcaccacgcatgggcggatctaacatgggacatgggggttcagttgaacccccaaactttttgggaacaaattaacaaactgctactagtattaaggaatttctagaacagaagaagctagggttaacgcaaattcgatatagtgagagcgtgggtagagagagatgggaaggaggatgtgctaaccaggaccaggatgcggcggaagcgctcgctcgctcgcgggatggatgggatcggctcagccggccgcggcggtggcggcagaacgagcgccggcgccgcctttgctcgctcgagttcgagtcgcgggacggatggggatcggcgcaggccctccctacgatacgacctacggattttggttcacttcaaccatcggttcaataaaataatcaatttatactagtatattttatttatagagaattttggtttaatcaacacataaaatataatactatataattgttttgtttctaaaaccattgtagcaactaagcccaaacagtcaggtgcacatgcatggtaataatgggcgaaaatttgagggttgggtctaaaatgccatgtgcacactttttatactttttagcatgaaaaatatttaagggttaggtagggttttgaaagaacccacaagccatgtccatcggggtctcgattccagaccagcttagttttcctttggttctgcaaaaaaccatccgatttaaatgatttttctcaagtcaattacatctccatctccagactaagcaccagggtttgcaaaactgccggtaaccgcgtggttactgcgcttaccgcggggtacggtaaaaggaaaaccatggcaaccttcttaaattcaaataaatttaaaaaataatttgaaattttgataaattttacacggtttcatatggtttgccacgattaccgcgtggtaacctcggacccggtggtttaggaaccctgctaagcactggtccggtttttcttacaccacgggttcggttcgatttttacaactagactattgagatgccactggagagaataattctttgcaaatgccaattttgcatatgtagaaggacatgtcacattaccaacatggaggtggcaagaaaatgacccatttgcccttgtttgatcttagtgtacattgagtatgcggataatatacacctacaatacttgagcaactatatacaaacatatatgctagtagatccaatagatttattgtacttcaaaatattttcgttacaaatttat

SEQ ID NO: 70581 - DNA, 17112 bp, Oryza sativa
aaatacgaggcgagacgaggggcaaaagcgtcgtttcgtaggcggtgagcgtgtcccacgtggccacctcctcgggtgcgcgtagcgaggcgtggtgcccacctgccgggacggccgcgtgcgcctcgtccacgtggtgtgacctgcatggggcccacgtgtcggtgacggtggtccagtggacgcggtgcgggtaggcagggtttgcgagacgtggatagggttttccgtgcacggggtgctgctagtagtacacgacgcatgttccctgcaggtttggtgacgctcactggcatgtgggcccgtgttaatgctggacagtaggagtggttagacagcgctcgagagaacgacgatggttcaaaaaatacttaagtattttcacgcgcacgctttttaaatgattaagggcctgtttagatcccttttaaatgattaagggcctgtttagatccctgtcacatcgaatgtttagacacaaaaatattaaatatagaaaaaaaaactaattacacagattgcgtgtaaattgcgagacaaatcttttaagcctaattacttcatgatttgacaatgtggtgctacagtaaatatctgctaatgatagattaattaggtttaataaattggtctcgcagtttacaggaggaatttgtaatttgttttgttattatattacgtttaatagtgtccgtatatacgatgtgacacggcaaaaattttcacccttggatctaaacacagcctaaatagtatgttcattttctaaaataaaatctatagaacagttatttcaaatattatattaatcgatttttcaaagtttaaaataattaatactttctctaatgacttagtaccttgtaagctcaaattagatatagtgtaagttcaattttttttcttaaagaaaggtagtgcaccaatacgagaatagcacttacgagatagatcaagcgaaattaatctttaatcatgatatttcatatgggcgtagttcgcaaatggtatttttatatgatttatatattccgccaaccaactataacaaacaaagagggtattacaatcacttcaattagtgtgacaaacaactttgatgaatcagaacaaccacagctagaccaaagggatatccatcaaaatgtgcccccataaactcgtcaacatgactagtaggtcatgatagataaacactccaatcggttgaagtatgaagtaagcacttatgccataactattattaaaagaagtagtgaggctccaagagggtccaacttgttttagaataacacgtgaaaagaataggacacagtaccttgaaatttcaaaaactttagcctattaggtgattcttgtttttttttctctacaagtattatgcacagtcttgtactgactgttgatgtatttccaacattttattggatggaagtctaactcatcaaacatacaatcaaacaaagcaataataaaaatgattgtttctcattcaaggtttattctaagaatcaccctgatccaacatatatataatgatataacatgtgtaaaaaaacaagtatcaacaacatatatagaggcaccaaccaattcctaactttagctggtttagtttggttctattatcatgtcctcctagtatattcctttctttttagcatgttcatcccccatcactccataacactattaaacaaagacaactaaactaaaactataagatgaagtccttaactggtctatgtgtatgtcataatgagggaatgacaaaggtgcccttgatgtggactgctgtaaccttgctgcttgctttatccaaaatgtggattagaaccaaggcatagtagtgcgggctggaatctgcttaaagtagaaggaaggggagaacctaagatgatgaatccttcccatggggtccatgcatgtttattccccatgtaagcatgtcacatcctaatccccttcctagcattgacatcccaaatgagtgcacatactcactccattcttaaatattcattttttttaaaaaaaatgtgcgtaggaaaacctagaaatcttatcgttaatatataaaaagtattcagatttcatatatgaaaattatatcaatagattttaaatactttcatgtagttatagttatgataacattacaaacttattattaaaagaaacaattatcaaatatgtgcatcaaaagttgtatcgatatcctaaatgacaagtgaagaagaaaaaatagagggagtaataaatatctagaaatattctccaaaccatgcatgaataaatctttacatatgtacaaatgctccattttgtttttaagccatagaaggactactggatttagcatatttatttcctttgaactgttataccttttttaagaaagtagaactatactaacaaaaatgttgtaattttgacacatcaatgaagtttttaaaatgtaattttgaccactcatctctattgtaaaaatattcataaattctgctaaattgtattattataaaattttaaaaaacgtgaatattaggtaataacctaatatcaaataattataagggatgagacttcgaactcagatcgtctagcccaccaccttgtggagctagccggaagactcctgagcgtttctctcattataaaattacttttgacgcaaaaaaatatcgatttctcatagttttgaaagtttgaatggatgtttgtccagaaaggagtaataaaattcatgaaagtgttagtggaaatcgttactacacaaataggaggtttgattcccaccaaagtagagttagttatagggtatattaattataactggtttattattcttgcagttccatgcgatttgatctgatctcttggtcctaattaagtcatgtttagtattcttagaaattagtattttgtgacatcatgaaaagcatatatactccttattggcactacaacaagatcgatctccttttgacatatcgcataaaagcaaggatactttaatttcggaacattcttagcccattactgaaaatgactgttagtgttcgacgtgtaacagtgtgttaattaaactacatgactacccgcatgttgctgcaaaagaaatatatgataaaataatatacatatgagttgtaaaaaaatcttatttactatacgattttttttcatgtacttatattttgtaccttgatcaattatccaaatgttatatatggttgggttttatggtgtgactttttttttggggggatgcaatttgcatccttaatgaatcatccaaaggctaaaacaattgagatgatgtgattttatgagagaggagagaattatcattaactacacttagtgggaatgaactttatagatatgtatatatagattaaacgtatccatgtgttacacaagagtagtggaggcgggcatctagcgtaaacacataatggtatactaattaatagtattagctagaatctctatatataggatgttaaaataaattcctccatcttccttggcaatattttagcgaagatccggaccaattccatacaagttgaatactgatgataaataagatcgaaattatagtaaatcattataattgaagataattttagatcgtattttttgacgtacgtatgtccaggcatagctccatgagcaccaatcgagaagatcggatctagagctctatcagtcgacaatccaattttggatgtgtgaatgtaacgctgcacgtcaaatagctagcttcatctcatggctgatgggcaggcaacgtaagcttggagctgaaagagcactagtgtcggccattacactgtctctgtttcttttttttttcaactccaaacttcaactttttcattttttggttagcacatttttcaaactgttaaatgatgcggattttttttaaaaaaatttctatataaaagtagttaaaaaatcaaataaatccatttttcaagtttatatataataattagtacttaattaattatgtgctaatagattttctcgtttcgcgtgaactggaaatatttcttcctaaccacaaaacgaacgaagccggatccatttggcaacaaaagggatgccactttgtgtacgttggcgtcacacttgcattggaggtcctgatgagtcattttcttggaaaagattttctagagagaggaagtgaagaaagtcgcacagttccatccacttctttctccaaggattgggtagtacatatgttatgctatgcttctcattatttgcaacggtactatgtcatacgacacgcgtgtataccaaaagatattaaaggagaaatggttgtgcatctgtggcctctatttttagcgagttttttcaaataaaaaaaaacttactttggtgttccaagtataaggcattttaggcctacatatactcaagaaataagaaaatacctcaaatgtgttggttacccttcatttgtacgacgttggaagagataagttttgtgagaagagttcaacttatttgacaaacatatcaaacatggaaatgaaaaaaaagggtgaaaaacacctacaagttctaaaacaatatagatttaggaaagactagataacacgatatgtttataatcgatgtgataagtcatgagcacaaataagagttgaacaagcaaaacctacaagaaggttggccaataatttctttacaagcaatatatttaaaaaaacttaactggcaaggaaaatatatggttatataaagcttatccacatagtttgtgcaatgcctactttggtctttgagtaatcatcaaagaacaccccaaaagtctgaattctggcttagacactagcagtggccatggtgccgtgggtaccaggcacacttgagatccagaggcagaagcaatgaaagctgcttgctgaaaatgctagtagaaaatttaaaagtgtcctgatctttcccttctattgctaaggtgaaaaaaaaagttggagcatatgcatgtgattggttaggcactggttattggaagaagcaacaaacacattgtagtggtggatggcaggccctacctaagtcagattgaacagagaaatgtgcagtagtttatccatttcttcttcaggagaggaagaagaggaggttgcattgcattgcagcaatggattgaggaagtagctttcagagttgaggtgtaaggcctgtcaacttgctcaatcatatatggttgggcagccttttgatcatccatccccatgctggtcttatcttggccccaattaattaattaatcaatttcctttttagtgcaaagttaattgtgatggtacacttttgccactcaactttgtcgtctctccctctactcttgtttcaggctagtttgcacgtgtgaattaggatcgagttttcatgattcataaaccgttggttttagaggtttgagtgagtaaacgtttggcttactgatgaaaatactctattagcatatgattaactaagtaataacttaaaaataaatttgtttaaattttaaagaaactattttattgaatttgtttttcaaaaaccatacatttgttaggatatataggaagcatgcccgtaatgatctacgaagtagtagctagtactaactgaagaacatgatttacatgtatggaactttatgtatgcttcttctagaacgtgccggttatcgagttctacacaattataagaactcatgtaaaaatcttgagttccaagttccaacctttcacataggcttaaaagttcaacacaaactggattacaagtgcagtgacaacttcaaatttcctaattttctttgccatgagtcatggtcactgctgagagttgctgattcatcaagctactagacaaagctttgccctggatggctccgaccagtgacgtttgatggatacacaaaagtaatgcatgattaggtgacctaataggctaataagaggggtcaaacttaaatattgggcacaaaatttccccaggagaaaggatgccacattgggtggacagtgattggcaaaccaaccgaccgagaaacctaattggctatggtctacatggtgggctatgatatgttccaaagtgaactagtatgccattgccgaggataatcaaaaatttttctcttaatcaacttgatcaaactcttgttagatacctcggcttgcccattggcttgcgcataatatggtgaagaattcaacaacttgatgcccatgctatcggcaaactgaacaaactcatcagacacaaagattgatccctggtcagttgtaatagtctggggaataccaaatcggtagattatatgctccttgacaaattgaattgcatctcctggatcaaccttcttcaaaggaatagcctctacccacttggtgaaataatcagttgcaactaatataaatttatgccccttgctgaaaggtggattaatctggccgatcatgtccataccccatcctctgaatggccacagtttgataataggattcatagctgatgctggtgctctttgaatcgctccaaacttctgacagtcttgacatcctttgtagtatctgaagcaatcttccaacattgttggccaaaaatacccagcacgttgaagcaaccatttcatcttatgagccgattaatgagtaccacaaattccttcatgtacctcacctatcgcaaccttggcttgatcggcacttaaacatttaagcaacaccccatcaatcgtccgttaatatagctcatcatccaacaaggtgtactttaaagccttataatgtaatttcctcgaagccgattgagatggattttgcaaatattgaaatacatcatacctctaattatcggctgtgatcgcagcaacttctatttcaacatctctcaacatcggcttatatcctgatgcaccctgagccaagtcgttagcttctacattctgctctcgagacacatgctttaaagtgactagccgaaattcattcatcaattctcggcactttttattgtaaaccatcaatgtatcattcttgcattcatactttccaacccttcctttcaaaatcggagccgatagcatgtacttaaccacattggctttacataccacagtgcattcattggacaatagataataccttaacttggtgcaagagaaatacaaatacaagcacaacttttccacaggagaataccttgtttctgcatccaagagccgacgacttaaataaaacacaaccctttcttttccttcaagctcctgaatcaacaccgaaccaatcgacttgtcaccagccgatagatataatctgaaaggtatcccttttttggaggaattaaaactggtgggggaactaagatattccttgatattttccaaagctttctgctgttctgccccccaagtaaacttttgatcggctttcaacctcaacaaaggtataaaaggttctaatcttcctgataaattagagataaacctccgaacaaaatttatcttgctgatcaactcttgcaactttgccttgtcctccggaggttgaatcttttgaattgcattaatactcctttgagtcacctcaatccccttctcgtgaacaagaaatcccaaaaattggccagccaatacgccaaaagcacactttatcgggttcatcttcaagccatactttctagtcctctcgaaaaccttcctcaaatcggctatgtggttctctatttcctttggcttgacaaccacgtcatcaatataaacttcaaccaaccagccgatcagatcatggaatatgtaattcatggctctctgatatgtagctccaatgctcttcaagccaaaaggcatcacaacccactcaaacaagctgattgcacccgtacatctgaaagctgtcttatgaatatcttcttctgccataaagatttgattataacccgcattaccatccataaaactcaatattttgtgtcctgaagcagcatctaccaactgatcggctaccggcattgggtacttatcctttggggtagctttgtttaagtcccaaaaatcaatgcacaccctgactttgccatttttcttgatgactggaactatattagaaacccactcagcatatcggcacgggcggataaaaccaacatcatataaacgtgtaacctcagccttgacagcctcaagcatatcggctttacatctccttggtggctgctgatatggtctaaccccatgtttgataggaagccgatgttcgactatcgatcggctaagtcctggcatctcataatactcccaagcaaagcaatctctgtattcctttaagagctctatcaacttggttctaaattctggagacaaattcttactgatgaatgtcggccatggtctatctcctggacctatgtcaatttcttccaaatcattagccgacatgaaaccttgtccttgcttgtcatcgagatcatctaccgtgtccttggtgtagacatttgaaccctccacgatgccctcaaaacaataatttgggttctccatcttcaattggctgtatatcacaatcggacacttttagaaaatctccatcccaaacctttccagacaggcaatcaataccatccatctcccaaagagctaaatcggcactagcaacattaactgacctgtcagctggcatgatctcaatcttgtcaccttgccattgaattaagcactgatgcatggtcgaaggaatatagcaatttgcatgaatccaatctcttccaagtaacagactataggaacccttcccatcgatgacaaaaaatgtcgtaggaacagttttactaccaactgttagctccacattcaaaactcctttggtttctcaagggttgccaccgaaatctttgagaaccatgttagtcttgataagatcatctgaatttctgcctaactttttgaatgtagcatatggcattaaattcacagcagctcctccatcaaccatcatcttggacatcaacttcccattgacaaatccattgatatacaacggcttgagatgccgattctctgtcccttctggcttctcaaagactgcctgctccggtgacaaaactaatctagccgaggcctcttcaacatcatcaacatcggcttgcctagcttcaaattcggctggtagcgtgaaaaccatatttaccgatgcagatgcagtaccttgcctttaagcaacctttttgccttgtcggcttcaacttcatcggctgttgtaaccgtgctcttaacacgccactcttgcttggtctttattttcctcagccgatggctaatttcctgttgcacctcctgaaaacgttccctgttcctcaatctttgaacccttctcttctggttcttggtgaaaataactgtagagcaccattgtgctttcctactttcatcctcatcatggtaataatcttgatttactgggcccaatctctgatggacaggtactctcttctgagtcagccgattgcctctattataggatcggcttgaactccctgtatcttcactgcatccagggtaatcctcaatcgatggcagcctcatacccttattccaacaaaatctgaaaaagtcacagttccaatgaggatcaaaaccaccatcattttcttcttcataatacctctcctgctgcttctcatatcttctctggtatttattaataattctagccgagttcatctgaaaatttcgattctttcccccatcggctgtcctcccagatgtatgcgtcatattaacagggaaaggattaccatcaaccatcatcggcttctttgaatcatcaaacttgatctttcccccctcaatggccacttggatttgttgcctaaaaactttgcaatcattagtagaatgagaaccagaattgtgccacttgcaatacctccttttgcctagctcttcagccgatgggattacatgaccagcaggaagttgaatctatttttcccgaagtaacaaatcaaaaatcttgtcagccttggtgatgtcaaagtcaaacttctcttcttttccagaacttctcacccattgacatggtatgacttttttgcttctgacccactcggctgctgctacttcagaatcatcatattcttcagaatcatacatataaggatatacatgattgattttcttgaaattctttttagcttcagcaaatctttgctcatgtaaaatcaccttctgcgcaagatgggatagactctcaaagtctgggatgaaaatttctccttaattggtgctatcaacccttaaaaagccaggtcagctagctgggaatctgttaaagacaagctatagcacctattcctcatctccctgaacctctggatgtaatcctgcacagactcatcatgcctttgtttgattgctgttaaatcggacagtttcatctcatgaattccactgtaaaaatagctatgaaactgcttctccagatcagcccaactattgacagaattatatggcaaagatgaaaaccatgtgaataccgatcctgacaaagataaaggaaacaacctaaccctcaaggcgtcaacagccgatgccttgccacattgagccaagaatcggctgacatattcataagttgaaacattgtcctaccctgagaattttgagaaatctggtaccttgtattggctagggtaaggatgccgatacatgtttccagtgtcctttggcttaagcccaaactgctccctcatcatatctgcaatcatatcagcccatggcctttgctaagataccccttgtgtctgctgctgtaccggctcgaactgattaaattgaggagcaaattgaggctaacgcgatcctgtctgctgatattgaacatgaggtgacggaggctggtattgatagttcaaattacctccttgataattctggaaattcggctgaatattacgcaccaaatgttcaagaataatttggggtacaactgattgatcggcctgtacacctggccgattgttaggtgttctcaacctagccgatgcgtgttgcacgttttgctgttgaattggctgaatcgtctgttgtctttgcggtgtctgctaggtcagcaatggctgtgctgagtcggctgtcatcggttttgttagaaacattgtagcaacctgttcctgagtcagccgattgtcatttttcccagcatgttgtggttgttttctggtcaataacctaggattaaccacctgtcttggtgccgatgatgacgcagctggtgcagtagttgaaactggtgccatcggctgaaccggcagtgtagcattctgctggtttgctgtcaccaaaggcctgtagtttggaaaaacaccacctggtagatatactggccctgaggtttggtgctcggctattgaaccatcgacaacagtctacactatgtttgttaaggtattaaccaacactccagattggttgatcagagcatgctgcacagcgtagtcgatccgatcttgaaagttattgaactgtaatggctcctggttgtcatctgcgccaaggtcttcgactgtaccatcttgagggacatcacctttatcgcctgagccagctgcagcacccttgtcaccttgagatgaacttgagccaacttcatcggctgcaactaccttcagcttgtacttctagacgatggtttctatgcgggtttcttgaaaagaattcatgaactgatccttcacgttgctcatcatctgttcaagttcgcccctttgttcagccgtcagtctatctagtgtgattggaacaatgttggaggggtccacttcagctgatggatttttggctctcgttttatttatgggaggtttgactcctgtccccggagacggtggtaatttttcggccatcgtgaagaagtcgttgaaaactcgtgtcccactgggcgtgccaaaagcgtgttgattcgaaaaacacgaggcctaggagatctgcttaactccagtgcaggtccaaaatcttgccttttaggttcatgagcgtgccagctgatttgatcctgcaatcaacaagaaataaagacaaaaagattgtagtttaatccacaaatgatagccgatcggctagttgccgatgacatatcatttacctttgagccgatgtcatatgtgaatcgatcggcaattgtgaataagtaaattaaaactaaatctactcgatcagctgtagatgttaatagtagataatctttatgtcgatatatacttaaatcaagtgattgggatagatcggtcgccatgccgagacagtataaatcacttagatcgaaatatatattaacaagaagattatagatgtttacagcatagccgatcagatagatctagcttgtatcggctaatactttgatactgctctacatcaagatattaaggcaagtaaaatatatcaaacagaaagcttaatacatctaaatgcaataggatcttaacataaagggcagatttagcataacaattaagcatataaatcataaggctaaatcaggtaagatcggctgaaaccccgatactacctgttgtcgaaatgacaactgcatacgtcgaaggacgtgttactcaacagtggttggaaagcagtaaaaatgtattaaattgagagtttttcttcgaaaaatcctccctttacgtggccctaggggtctatttataaccctattacaggccccctatttgggtttaggttttacaggggaatttacatggttgcccttatgaaagggacatttacttgggcatacagtgtaattgaggtgcatgggcctctaatgggccaaattggcgatcgctggcccaatggccaacgggccgaagcggctgggatgtccccttgggccttcccggagctggcctcgatatggcgaagtcatcctccttcggcgtatacccttcgcccttcgaccttcgcctaggatgcacggtattcgccatgaggcttcatcctttgccgtcttcgccgcatagtcttcgccatggagcttcgccctgataagcttgacgccttgagcctgaaccctagctggttgcatggtttcgacaggtctggtcgaagggtctcgtgacatactgccaacaagcccctcacgggcaagggtgagataggagcttcggccgagaccgtgcaaaccatgtggtatggtatgaggcgccctctttcgaccgatgctcctgccgaaactaacattggaatcctgcaaagaacgcgtgcagtgcatgtatctgtatttctgttgttagtaatgttttgcagctttcgccttctgtgaacggcggagctgttcttattctttcactgggccgaaatgagcagtgatgggcttttcttcgtgggctcgtcactgtgcggctcggtcaatgggaatttaccgtttcgcctacccttatgatacgtggcgggttgtgattgggtgggaaggcgaactgtcgcctaggtgggctatatatccccctcttcccctttttcaccaccgcacccccatcattttcaccgcgagcgctccctcctccgtccttttcttccgcggcgccctttgagttgctagatctttcgctgttctccctcttcgccacagcgcacgcttttcgccatggctcctcgtaagccaaacccagcctcagcgacgggccctgatcccggccggatcaatgatgacaccaccacctttttaggggcttcgctcgtggatgacaacgagctggcgaagttggtcagctccggcgtggtggtggaggggcaggccttcaccccggggaaggccgtggtgccgaagcccagtgacaattggacggtggtattcgccgtcttctttgaggcgggtcttcgatttccatgcaacgtgttgttgccggagatccttcgcctcttccaggtggagctcccccagctgagtccgtcagcgctcgtccggatcgccatcttcgactgggcatgctggaccgccgggttcgaaccgagcgccgagctcttcggtgccgtattctttgccaccatgaactcgaagacggtggtcactccggctaggacgaagaagatggcgttcgggagtgtgaacttcaatgttcgccccgaacgctccgatctctggccggtgaaccccgccatgtcgaagtgggatcgccattggatggtgaagtggttctaccactccatccccttcgaggctgggtccgaagtggcgaaagccctacgatgtcggtgcagggtgattgcaccgaacaggaagcccaagttcgctgttgacggcgccatggaagcccagttcgccctgctgcgcaagatctgttcccgccttagttgtcgcgacttggtagaggagttctgcatgcttcgcattaccccctctcccagtcgtggcaagttgcagtcgatcaagacgaggaggtcgacggcttgccgaagctggttctgcctgcaggggcgaatagtgagtccatgcttttcttatgtgcatctgtgcttcgccctttttccccggttcgacgcttgatatggttacaccttttgttttcgtagtgttgactcttgatcaggcgacgtgtcggtcactgagttcagccagctgctcacacggcaggcggccggtcgggtgaaccgggtttatgacggtgaactgcctcctcggacgaaccccctcaaggccgatgacgccgcgggtccttcgcgaaagcggatgcgtgggcaagtgaagtcggcccctcgaaagcgaagggcccctgcctccactgactccgacgctgatgacgaagacaccgttgaagacaacgacgacggagaggagggggaggatgtgggggagacggaggttgcggccgaaaaggccgcggaagaggctgtcgacaaccgcgccgggacgcccggctacactccaacttcaagccccgagcacgtcaagaccggggtggagtcgaactgctccccccttcgccgaaaggatgtggagggggcgaaggcactggtcgctatcgcgtcagccaaggtggcaaaggggggtccggtcaagaagacctccaagaagatagggctcgtcaaggtcggtcgcgcttttagcgatgactagtcctccgacgaaacccctacttcgcctactagccgaagcttagggctttcaaccgttcctagcgccacgatcgatgcgggcggagcgggagggagtgttgccgggacctcggcttcgtccgatcaggttgtcaagaccgcgactagggtttttcagtagcccagttcgccagccggtcgtttcgccgctcggccttgggaaggggaggaagacggcggtcgaaacatccgtttcggattactcccttgcggcgccccatttcgcccctgccaatttcgagactcgggcggagcttatcccttttgttgagggggtgagcaacctcgtcttcccggctggtagctcgagcctgttcatggagctaaacgagttcgatgagggctgctctgccattaagagcttggcggttcgggtacgtagcttgactgtgttgtgttttttttaatcgtcgtttttcgacagcttgtcttaacattcgtcctatctctcttatcttcgaaccagatcctcgcggcccactgttcgaccgaatgaaccatgcgggctcgtcttgacagtttgaagaatcgtcttcgagccaaggacgacgaacttggctacaagagcttggaaatggaaggcctcgcccacacccttaaagagacaaaggccgagaacaagcggctccaggctgaactggaaaaagggagtgaggcgaaggcggagattgagcgcctcaaggccgagctcaaaaaagagcaaactcattccgccgctctgaccgactactacaacctcaccgagccgaagatggaggctcttcggcaagaggttagccaagcggaggcaaacgccgagaaggaggcggaacggttcgcgcgggagatggcgaaggccaccgagtctgcgaagaccgcgtgccaaacgctctgccttgccctttccgacatgggggcgagggtgcgtggagtccctggcgaatatgcttccgcctttgacttctcggagtggactcagcaggccggcggtgcggtctcggactgcgccagtgcatacggtgattgctgtgcacgcgtgtcggcggccttcactatgggccttctgcagcagttcggctgcgagaacgttgccgagttccctaactttgcgaagggggactgggaagttagtgcgcaggacgtttcgtgcctggcggaaacagttctggcagagggatggccgatccactgccaaggcgcgtctccttgagcaactagcgaaggtagaggcggcggaccagggcgaaggggaagatgctacggccggagagggtagaggcgatgccgaagatcacccagaggtgtaaggccccctgccctctctttagattttgtagttttcttttggcgtttgccgtggagggcgaacgatgtaaatttggccgatggccttctccccttcttattgtagccggaaacagcctttttgatatatgatgaatggatgactccagtttagtcaactattgcgttatcttcgccttattttcgcgtgcgaaagggagtctactcttttcgcccatttgttcgtgtcttaaccttgcgcttttccatttacctttctagtgctgattttagcagggtattcgctatcatgcctagaaattcacaaaccagaatttctaagctgaatgtgcattaaacccctgtccaggaccagccagggtacacaaatgacaattgttgtcatacagacccacgtcttacaaaaatataaaagattacaaatgcagcggaaaaaggtaaaagcgaactaagcctgaagacttgactcctgcagcgggcgactctattccacaggcaatccttgacggcagcaacaaaaccaacctcaatgagacagctcccactaggaagatcttcaactctagtgtggggaaaagagagcaagattgagtactacccactgtactcagcaagtcataccggaagaggaggtatgatgcaagatataa

SEQ ID NO: 70582 - DNA, 8338 bp, Oryza sativa
  unsure (1)..(8338): unsure at all n locations
tgcttgtgacccaagccaggctgcaagccacttatcccttctttctataaatttaaggccaaaagctcaaacctcgtgcttccacgtcatcatcaaattgtgaaccattggatgaatgcattagatcgcttctcagacgttggatggaatgcagcatagagcctaacccatcagtcaccgggcgaagtcttcgcctcctcagtgccaaatgtagcccatataaacacattggcccatctctacacacatctacatgtatccaggtcgtcaatctgtataaaatagctttatggctgaatgctccttcagttgacatgtgctacctaaattatctacaaattttggatagggctgctaaaaaaaatttcttcaaaaaagctatttgtttcttttgtttcttcttgagattatacctcctatctaacaaattgatgttaaccaagtctcgcagcaacacgcggggcatcctctagtatactcaaagttttgagccatatacgcaacgttcttactcagccaggaggaaccctgtatacgaaatcttaggtgggcccgaggccctccaaaaagggcccctattgacgtcaccctagggtcttctttttattttcaaagacattctgagcatgctgtttatttaataataattcttttaccagataaatgggtaccctggtttccatttcaccgataagagtctatgtgaaattttagttcagatttttttccctatttttttaatatgtttgaaattttgcatgtgttttttagatttttacgagttataagtaaaaattatatgttggaataattttttttgttcaattggagaattataagtaacaggttataggggagtgataactgataagaactattgaattatcacccaagggttaaaaaaatgactgaatctttttcaaacttcaggcgcctggaatcactcccaatttttcatatgaccatccctgacattttttttatccatggaaatggcagcaattacaagttgagcgacgcaaataactacccaagcaagttaattactgtagtaaatatttacacgtcttttaaattcaaattcaaattctcctcctcctcctcctcctcctagctactgctgctgctgctatcctatgatgaagtgaacacgtccgtttaatttctttcctgtccttgcaaatgaaaatgcagagaactcaaactgagccacttgagctccatgtcgtcttccccggcgagctcagcgacgacatcttgctcctcctccggtgatcgatcaggctggccgttgccggcggcgagctcagctcgctttacgccggctcgcgcgggcgcgccgcccagagcgagctgagcgcgcggaggcgctggcagtagtcgccgagcgcgaggagcccgcgcgccgcctgcggcagcgtcaggatcttgtacatgttctgcagcgtctcctgccggagatggtcggcctgcacgtcatcagcaagatgtcagccgagctctgctcgtcgtcggacatggagatgggaggtaggtggtggtgatcggcgatggcgtacatggtcgacgaacgcgacgaggttgctgagcctgcccatggcgctccccatctgcgccatgtagcatccgccgtcaccggcggcggaggacgacggctcctcctcctccggcggcggcggcggcggcgaggcgtcgcaggaggtggagacgacgacggcctcggcgagcagcgagtcggcgagcgtctgcttcagcttgtccatgccctgcgacagcgcgtcctctaggtggcgcgccttctgctggagcccctgcacgtcggcggcctgccgctccgtcatcggctccagctgcggcgcgagcaccctgatcacctcggaggggcggaacccggcgatccagaggaagaaccgctcggcgccggtgcgccacacgccggacatcacgaagaacacgtcgcgcctcgccgcctcacgcttcgccgcgaacagcctgtcgtagtgcgccagcgccgcctccaccaccgcccggagctccggcccctccgccgccgcctgcagcgacgccctcagctccgccgtctgcctcccctgctcctccacccactgcgcgtactccacctcgaacgtcaccacacctgaacacaacaaatcaacaaaattccatcacaattcttgtcgagctcgatcaatcgatggattcttggagagaagctgacctgaatcgatgggcgctggtagggtggctgggttgctgctgcggttgatgtacgcgctctgcatagctcagccatacgtcagcaatgacagccatggagaagaatctgctcgtcacaagctggttttctttttctttttcttttttttgttcttacctgttgccttgctcgggtgatctcctgctccagatgcgccagcttcatccggctcgtctccaggttctggatgtaagcctgtcacaaaatcaaacaaacctaaattaaatcatatctttgaatacaaaatcatgaacaatgagacgaataatgtgatgtgatcatgagcttgctcacctttttccgtagccggctcttgcgagctgcttctctgttctgcgcgagccgcctctggatctaatcgagaaaaaggacgaacaatcaatcgaattatagtttgttaattctaattaagctagtcgtaattagcaataatttcgggcgattagtttagctagcttgtgtcagagagattttgtcccaccttgtctcgaggcttggacgcctcctgctcgaagctgtccgacgcatgcctcggcgattcttgcagagctgcagcgttgtcttgatcgtctccatgctgcagaggcagagctagctgatccaacagcaagagcgaatcaaagattttcaagaaatacatcagcaagatgatggaggttgttgtgttaattaattattataaataaataaataattacctggctctcgaacttgggctctgttagcggcggcggcgcgacgaccatggcggcggcggcggcgttgctggtgctggcggtggtgtccgggcggatgaaggggtggtctccccagacgccggcggcgaggggatggtgccggcggtcgtagatccccatcgccgccggcgccggcgcagcgaactgcgcggccgccggcgccgccgaggtcatgtaccttggcgcgctgctcgccgtcgccgccaccaccacaccaagaaacaatcgatcgatcaattcaattcaattcaacaccgccaccaatcaaagaaacgagaagaaacaacagctccgatctctctctctctctctcactcagagctggttcggttcaatggatatggagctcggaataatcccgacgagctctctcccgctcctctccccgctaatggcgacgacgcatccctctctctcatatcgcgtagtagtatttgattgctttgttgcgtgctggcctggaccaactcacacactacactctctctctagtttctctctctacggcggcgtcgcttccaaagacgacaaaacggggcacagaaagggtgtcgccttgttcgcttccgccgtcgccgttatcactgacgacgtgatggcgtcagcggtggtgggggctgcgtttgagagttgaagagaagaaaaagaacgtcgtttttcgctagtacgcatctcaaactgctgactgatgtattttaaaaaatataaaaagttaaattaattctttttaaaatttataataattaatatttaattaattaggcactaatagtttatcttattttgcatattttttcaatgcttctcatatattttcttcatcttaaaatataccccctccgtctcgaaaaaaggcattctatagtaatggatgtgatatttcctattacaatgattctagatgaaagcttgtccaaatttgttgtatcagaaaatgtcacctctaatattatattgtctttttttttatggaatcatggaaggagtactcctataaatgatttctataaatgattttggaggtataaaagtacggctgaagacgacgcagcaagcctcgctggcgcatgggggcacagggcgcttgggtgggcccagaggcgggcgcccacgtggcaatgagtgggtagtatgggtggggccgaggtgagatggcggttgctgcgtgtagatccagtttgtggggggtacggtaactctgtcaaccgttaggtacatcagttgtgtgaattttttttttgaaaaaaaaataaaactaaggttattttagtgatgggtttgagttttgtttgtgaatgctctgactatcaagagggggatttaggattttagttaggttggctcttgcatacaaatccgtacatatacatgtttcgatttataattataagtagttactccgttcatataataagctcattttttcttctcacatctatctcaaaatatatttatttttaagtaatcattctatcggaatttatgaaagtatagagtataaagaaataaataattgtattgggatttaataaagtgggagtgctataattttttttagttctgtagtattaatgtgtgggatgggtgaaaattaaatttattttaagacgaaagaagtataatttaagacatgggagtattgctttagtggctatcattatcaaaagtaatagagacttttatgcgtacaccaaaatttggttcaatggtatatactccattggcattaggtatatcatgtgcaacctattttggattgtgtgctcataggaaaaggatatacattctaaactcttactagtactgtgatgttatgagcacattaattttctctaattcccattaatttaaatcaaacagtcaggacttttctaagagttatgtaaaaaaaaataatacgtgtagcgatgttatttccaataataatgttgaatagcgtattcatatgttagaaaaatacctattgaactcattataaattgataaatcaatgttacggcacaatcccattcagaagaagacatattttgacggaatgaaaaagacgcactagttactggtacgtgcattttttttgtaacgaaaagaaaaaaaaggaaagtaaatccatgcacgtaaaaccgttacttagaccggtaccatgtaaacaaaagaagaagttccatgggtttcatcacgtagagtaagatcctagctttccaaaggaacactaaaaaacaaaaacaaaaacaccatttttgtcttcaattgcgaggtcacatgttttgccggtggatctcatcggcaggagacgagacaacgacggagaagcgggatccgacgtggcggcatccacgtcatcccgagggtgacaggccaccgtgaaataacagcagctaagcactcaagcttttcttctcatggcgacacgtcatcatattttagaggttgaatagtacttcctccgtctaaaaaaacaatttactagatattgacacgtcataatactacgatcatatatagtattacaatgtatcaatactagcaaccccatcgtttagtttattcgtggcatatttgcaatagaaaagtaatttgtaaataaaatacttgttcttagtgatccaaaaacaaaagctgaaaaataaacttcgataaaaaaacttaaaatgaactttaaatctaagatagaaaatttaaatttccgctgataaatataagtataatcgccagcgatgaagggagtactagcttatcttgtggagtagagacagtgacggcagcggggaccatgtcgtcattgctggcgtcaccccgcatcagcacagtggggccgtacgattggctggctcactgactgtggcttggccggttggccgtgcgggtgggcccagatataataggcatcccttcgatggttaaaatgcctagttatcatatttctaacagtaaaaataagtcgatcttaaaaaaggtctttttaatatgggcataatcattagagcataactttgttcactatttattttaattgtaatatatttataaattgtaattttatggcagtttttctcacagcaaatgtatgcgcatatgattctcgtccatcgttattgctattggtatttaaatgttttcttaaacatgtagcaaggaattttacatggtgttttgaataagcgcttcatttggggtggttgtttggttaattattagttgtcacacatatattgttgacactactgagtgggctaaagcccatgtgaagaattattcttaagaaaatgataaaggtttttttaccatatgtgtaggataaagaaccttcactttcgatgtcctttactgggataaggcgctgataagttttctggaaagcgccctgggcgagtaatcgctagtctttcccaataactcatctttctctacgttcgggtattgcgcatcgacaccaacaccaggcacacattgcacatgcggtgcgtgttactccccgtcaagacaatcctcttcctgaatagaaccaggactgttggtatgtctcactcatgtttcgcatgtttaatgtgttcatgtttagatcagttgagttgattatgttagtttacatgcttattgtcatgatttatttataaataaaataaatttatatgtgtttctatttcaaatatatatggtctttgttttaatttctcccttggtccacactcaagattaaaatatgtcaaccgagtaatttattcataattaaaccggttcaaacaaagtactttctttcacactaactggttgttcggaacgtggatatctcacataggttatgattgacatgatattggtctaattcaaaattcatacactccaaaacaacttctaatataacttactagaaagtggaaatataaactttttcacacgaattgcatgcttccaaagtcataaacctagcccttttgtcagaaaggacggcaacatatataattgtcatggagtagtaaagataggaaaaatctttttctctctttttttaatggttgggaccaactttgattagttagctctgagttagttggcgatgatgcgtctctcacaacgtttgagccgtcagtgcgtcgtcagcaaattaactagcggcacttggaatctgactatttgtggggggtggaccccacaacatgccaccagggcaccagggaatcaggatctcctttgcagccactcctagtgctttctgcactattctggtcaaaatgaacctctattctagcttatagatttgtagtttgtgaaaccacatgcatatctagtaccactccaataatctagagccataggattttatgcttaattatcttgatgagggatcatgtattatctatcataaaatttcagccgtgcgatggtattcgagggcatcctcatcattttcactggaaagtatatccatattcctgactgtgacgatgataggaatgtagttcgacattttattggaggaaactatatcccttgatttatcatcatctctattttaacgtaatagttgatgtgttgttcagaagtaattgtcatgcaagttgagtgttgactcctacttttagtctcttaaagtaatcaagtgttcaccttggtttaactgttttgttataagatattaggtgccgcgctatctgttttgtgggagattatggattttgaaagaagttgacgacctagaagaccttcaatattagggcgaatcaactatttagacctccacgaatgggtctttgtttttagttcaatcaatttttcaaagtgtagatttcaaaggtaaggtgaatctccaaggacgagcatacacgtacacatgtcgaaaaaaatctccctctctatggactcccatgtagccatgttgtaccactagatgaagattccaaaagaagggcacagccccaatactgtggtggacctgacctcactttgttgtttttgtaaatagtccacttgatctgctaaagaactattagcaccaactctataatttagtgtatagagtaaaatgcaccggcggttcttaaacttgtcagcaggtttcacttaggtccacgaacttataaagcgcacatcgaggtcccctaaacttggtttattgtatcatcccggtccaaagtcgcgtttgaccgtagtcttgcctacgtggcacgccacgtgaacgatgacatggtttttttttattttttctctcttcttccttctcttttctcttttatgaaaagacgatgacatggacgatgatgtgtatgaggcattttcatcttttcgacaaggaagaaagagnnnnnnggaaggaagaagggagaannnatnnaatnnnaatccatgt

SEQ ID NO: 70583 - DNA, 10654 bp, Oryza sativa
  unsure (1)..(10654): unsure at all n locations
aaaacgaatcgtggaggtttggatccgaatcgaactcgttttgttttatccctaaaaaaaccgagttcgatttcttcccgattcgattcctctcgtttgcggcttgatctcttcgatccgagttcatataaagcttctccttgatctcctcttccgtttgccccctttctcgagctctcccgtgcctcctagagccgccgccgcgtgcattaggtttgccgccgccgccggccatcttcggtcgcgtcgcgccgccgcctccgtcgtcgccgccgctcgccgttgccgccaagaggagcgccgtcgtgtgaggaagctcggccgccccttcttttccgccgccgaccaccggagccccctcgacgccgtggacccgaaccgccgcgccgccttctctcgtcgccggccgccgtcgtgcatcctttgactacgtggtgagtaccaacgggttcgcctcgttgtcctctacgcgtagatggcctccgtttccgccgtcgacttccctagcgccggcgagctcgcgaacccgagccggccgccgttgggtgacgtcagcgtgacgtcatcgcaagggctgacgtcatcagggccagggctgacgtcatctttctctctttttcctttttcccgttttttctaatagattaaaactttggaaaatcataactaaataaccgtagatccgttttaggtggttcaagttgctaaatttttctaaaataaagatctacatattaaaattgtccataaattgaattaaatttgtttaattctttttaattgggctttaattagatttaatcttgtaaaattcataataaattcatttgaagtcggagtaaggccgttcaagtctcataattcatctaaaattatgatctacatgtttgtttactttttatgtactgtttatttggtttttattagtctttttcttcgttttacgtgttagtttgtcgtttccgtcgttgcgaaggttcgtgagtgcgtcggaagtgatcaggaagattaattgaagactgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccaatttgcattgaatgccttattccttgataccttgggtaataaattgattagcttgaaccttatgtattggtttggttcagctaaatgttatatatatttgcttagcaaagcttagaaacattagttcactaatgggatgaatcatatatactacattattatttatggtcatattgaatggtagctcacgatggttaatcgtgttatgataattaattggtaattaaaatatgattattggtgggttgtgagcacatggttttgaaggtcgtgctcatggcaattaaggaccggttcgcgagctactgttgtgaaacatttatcgtgccaaccacaagccagcgtgggcaacggctttatcttttgtatagcgtgattcattattgtgcaccagactgagaagtggcgagaagtccatgggggtcgctggggagtccatgccttgtttataagggggtgattatgatccaagtacggtgcactgtggtgagttgtgttatgcgaggggtattgtcacaactcctttccgaggtaccgcggtggtactgaggcacatggtgacatgatgtggggttgtgtcttgtgggtacagtggtacacctctggccagagtaaaactattcgaatagccgtgcccgcggttatgggcgagttgagcaatgtttttcgtgattagtctcacacctctcataataattatagatgttataactggtaataatttgcttagctcctggtttggagttagatctgtacagccgggtatggttgttcaggatggttgggcctgtacagcatgggtgtgctgttaagtgttgattaaaattttggattaattactccactgttttatttctcttaaatgttttgctaaatgctgcttttgcaaatgagcctatattatgccatcctttggtatccttgtgcacttgcatacttgctgtgtggcttattgagtatgtcatatgctcattcttgcaataatcaatcaacctcagttgaagaaaaaggatccagaaggagaagacgtttggcttataccccagttgagctgcctgtgggagtggagccggagcttcgctagattttattttccgctgcagttttcttcttggtgaggactaagtgcctcttaagtaagtatttatcgatttagttattatgatggatttgtatattaaattgtcagtttgtgtacctcggctgattcctggacgaggattttatgcacaaattagttcggaaattactagtgaatttccgggcgtgacatctaacttgatcaaacagagtaggtttagcttgtaaagcggccacaaaacctttgttgactattcccaagttcaagttttcaaattcttggcataactcccaaggtaaacgtcgaccttctgacatattacagtagcttttcctgctaagggcatcggctacaacatttgctttccccgggtgatagtggatttccatatcatagtctttaatcaattctaaccatcttcgctgacgcatgttcaagtcaggttgagtgaaaatgtacttcaaacttttatgatccgtatacatctctgtacggttaccgaaaagataatgacgccaaatcttcaatgcatgcaccacagctgccaactctaggtcatgcgtaggatagttattctcatgaggacgtaattgcctagatgcataggcaaccacctttccttcttgcatcaacacacaacccaaaccgagtcgggatgcatcacaatacacttggaaacctttcctcgaatcaggcaaaattaacacaggcgcagtcactagccttttcttcagttcttagaaactttgttcacaatcatccgtccacttgtacttcacttccttctgaagcagacgagtcattggtctggcgatctttgaaaagttctcaataaaactgcggtaatacccagcaagtccaaggaaactacgaaattctgaaaccgtcttgggttgcttccaacttaacactgactccacattgcttggatctactgccactcctccagacgagatgacatgacaaagaaacttcacttcggacaaccaaaattcacatttactgaacttggcataaagctgatgctcacgtagtttctctaaagctagacgaagatgctcttcatgttcttccttcgtcttggagtaaataagaatgtcatcaataaacaccacgacaaacttatccagatattccataaacaccttgttcatcagattcatgaaaaaggctggggcattagtgagtccaaatgacataacggtacattcgaacaaaccataccgagttgtgaaggcggtctttggtatatcttcctcacggattcgaagttgatgatatccagaacggagatctatcttggagaaaactgtagcacctttcaattgatcaaacaggtcatcaattctgggtagaggatccttattcttgatagtgacctcattcaacgctcgataatccacgcacattctctaagtatgatctttcttctccacaaagatgactggtgctccccatggcgaagtactgggtctaatgtatcctttctgaagcaaatcatccacctgtctcttcacgtcagctaactcattagctgccattctgtatggtctcttatggatagggtttgttccaggtaccaagtctatccgaaactctatgtctctcttaggtggcatacctggcaaatcctcgggaaacacgtctgggtagtcttgtactataggtatctcttgtagaacaacttggttcaaggtcacaccatgagatttaggagaggacgcaaagaaagaaacagtttccccattgctactggttaaagtcaccttacggttggcacaatctataactcctctgtgacgagataaccagtccatccctaggataacatctagatctttggattctagcaagataagcgaggatgggaaaggaacttcttctatttctatagtaacagaaggacaatactgtgtcgaaaatacttgattacctggggtattaactagtaaaggtctcccaagactaataacttccatcccatgattgctcgcaaaacttttagacaaaaaggaatgtgtagcaccggaatcaaaaagcacagttgcgggtatagagttaacaggaaacgtacccaaaacaacatctggtgcattctgagcttctactgctgcaacatgattaacacgtgccttcggtactggaacattggagttgttcggggctggagcgttcttcacgcgccgaggcttaggacacttatcagcataatgtcctgggtcaccacaattgaagcatatcactggcttgcttccctgttccttcctgacgggctgattctgagctgaagttgctgcaggacgagcaaccatgttgcggttgtcattgccacgattaccagtattgttgttgtagaactggcgttggggacggacaactgatgaagatcctacttgagggtacgatggagcttgaggtccagtaacgagtcgcggtctctggttactgccctgttgtgccttgaattgggcagccctgcgcttcttctgctccatccggttatacttgtcttcctgacgaatcgccttgtccaccaactgctggaaatcccggaaatccgtagacatcaaagcataagacaactcatcatttagtccctccaagaacttctcctgacgctcttcatcggtgcgaacatcttccggagcataacgagctaaacggttgaaatcatggaggtactcagtgaccgaacgagatctctggttgagtgctctaaattctctcttctttagagctacgacacccgctggtatgtgcgtcttcttgaaagcggccgtgaactcctgccacgtaataggctctccttcagccctgccttggcgaaaatgatcccaccattcagcagcaggtccatgcaactgatgcgaagcaaaagaaactttctcctgctcagtacactggatcaagtccaacttcttctccaccgcatgcagccaatctcctgcttctactggattggtggtgcttgaaaaggtagggggtctcacacgtaagaaatctgccaacttgttttggggaggtgggggtggattctgattctgattgtttgcctgctgattctgtgcctgctgcactaacagattgatcagttgtgtttgttgggccagaatctgagctagcgtgggatctcctccatcgttagtagctccacttccacttccacttccacttccggtgcgcgtgttcaccatctgacgataagcagaaacaacaggaaagaacgacagagagacacccttagaacgaagttatttaattaatttaaattctatattactcttaactgtgtatgattacatttaagttgcattaacactatctcaccaactatcttacactctgacaagcaaaagaactagactcatgctgttacatcccacccatgatgtaagcaacaactaaaacccacacactcacaagcaaacttaaacaagcaatctaacacaacgaactacggcaacgatctaactaagcgactactcccgccttgcgtcggaacgaagcgatggatcttcttcctctggagtagctggctctctttcttcagggtcttcctcctcttcctcatcacttatgatgtcgatgacaggttcagcacgatcgggcacagcttcacccatcacgcgaatcttcgaagctaactggagacgaggtggcggacaggttctctttcttagtgtgacgcgaagcttgggtgttggcggcggcgtttctcctttaagttcagctaattcgttctgtagacggtacaccttgctctccaacttgcaaatcttgcctcgattccagttttccctgtcatgagctgctttgtctcgctccacacttactgcatccatagcactaagcatatgcaccgcatgcatcagagtggcactctcttcaccatcaggacagatataggttccatagtcttgaccatgaggcttgtgaggatgatactggaaagctgatgaatccaactcttcttcaaaacgttgacgcaactctccaatggccaccaaagctacttcttgacaagcatggctgtacgatcttcctccagcttcaaacttaatggacagaaggtcttcacgatcactagccaacgtcacacgaacacgacacttctcttcgtcggggtcatgggaaatttggcgatactcgggagcaacttcatagcctacctcaaaagccatcaacctcagctccctgacgaatcctaacacctcgatcaaatttctcggtgaatgtggcggcatctaaggaaacatagaagagaggaattaatgcatatttttctaagttagctgcaccaacttgatttaactgattttttgccnaaaagggaagaaaataaaatttaaattccttatgatttattttaagcgcagtacagtgtcaccccaagaaagatgagtagtactagtgctatcatgattgtatcaaacccataatagatgtacagtgcggcctaatcaataaaatttggtaaagagaaaaaaagaaacattttggaagaacaactttttgcttttaaaagaaaagaaattgaatttcaataaattttgtgcttaaccttgcatgtgctgccaacttaattaatttataagagaatagagaagagcagttctattttttttcaaaatattttgaaggctacttaaggtttaccatttggcttatcctaaggtcaaggtggctctgataccaacttgtcacgcccggaatttctatccaaaattccaaacgcttacatgtgtgttaaaccctcgtccaggaatcaaccgaggcacacaatgacaatattgataatagagtacaattaaataactatttaatattcgcaaataataaaatattacagaggtagatagttcctcccaaaaatataaaacattctacgcagcggaaaaataaaactataacaaactacggaacagctatgacgactccactccacaggcatcttaaccgagaacaagcctaatcctccagatcatcaccttcactgagatactcctcttctgatgaatgaatattgcaagaatgagcatatgacatactcaacaagccacacagcaaatatgcaagtgcacaggataacaaaggatggcataatatagctcatttgcagaaaacagcatttaataaacatttaagagaatagtaaaacagttgaataattaatcaatattaaataaacaccatacaacacacccatgttgcataggcccaaccacatttgaacaacccaaccccagttgaacaaattgaacctccaaaccaggaattgtccattccaaaccaggaattaaattaattaccacattattaccattaatgagtagtgtgagactaatcacgaaaaacattgctcaactcacccataaccgtgggtacggctattcgaatagtttaaactctgatcagaggtgtaccactgtacccacaagacacaaccccacatcatgtcaccatgtgcctcaataccaccacggtacctcggaaaggagtcgtgacaataccccttgcacaacataacccattacagtgcacctttcctggatcataatcaccccctttaaaacaaggcatggactccccagcgacccccatggacttctcgccacttctcagtcgggcgcactataatgaaccatgctatacaaaagataaagccgttgcccatgctggcttgtggttggcacgataaatgtttcacaacagtagctcgcgaaccggtccttaattgtcatgagcacaaccatcaaaaccatatgctcacaacccaccttatccaggttttaattatcaattaattaacatcacacgatttaccatcgtgagctaccattgaatataaccctaattaataataataattttgtaatataatttatatttaacccctttagttaactaatgtttctaagcatggctaagcaaacatacatatagcatttagctgaaccaatccaatatataaggttcatgctaatcaaattataacccataggaaaataaagtcatcttcggccattaattaattgggaaaggttcaccacccgatgacattcgaaaacaatgcatagttgaaataaaataatagctttaaacgggatcaacatgctcaaagggttgtttgggatctgtctgacttgccttgggcttccacaaacgcttcggaacctttctcaacggaacgctttcctccgaacgtcggaaacttaagcattataacaaaatcaacaaaacagttcaaaaacaagcataaacagtacatgtggatatttttaacatgtagatcttgattttagaagaattagaaacttgaccacctaaaacggatctaccgttatttagatatggatttccgaagttttaatctattagaaaatcgggaaaaagaaaaagaaaaggaaacgatgacgtcagccctagaggagatgacgtcagccctggagatgacgtcggcatgacgtcagcaacggcggccggctcgggtccgcgagctcgccggcgctagagcggtcgaccggacgattggaggacacctacgcgtagaggacaacgaggcgaacccgttggtactcaccacgtcgtcaaccgatgcacgatggcggccggcgacgagaaggaaggcggcggcggctcgggtcgacggcgacgagagggctccggtgatcggcggcgaaaaaggaggggcggccgagcttcctctcaccacggcgcacctcttggcgatgacggcaagcgacggcgacggcggagacggcgcggcgacgacgccgaagacggcggcggcggcggcgaacttggaacacgtcgcggcggcgctaggaggcacgggagagctcgggagagggggcaaacggaagaggacaacgagaggaagctatatatggcattggattgaagagatcgagctccaaacgagaggaatcgattcgggaagaattcaaactcggttttagggataaaatcaaaacgaattcgattcggagagaaaactcaacgattcgctttgattcttgggggaaaagaaagaggagaacgagaggaacaaaacccctcaaaaacccggaggaatcgggctcggatttgggcggaatcggaggtggaagatggcggctcgggctcggtctcggcggcggccggaggttgaagaagggcctgacatgtgggccccacatgtcagtgtcccgagagagaggggcgcgggcggcggcggcttgggccggcatgggccgcgcgcggggagagagagaaagagagagtcgggccgaaaacggcccaacggcttagggagggggatttttgaacttttttgaataaaacaatttgtgaaatgttgtttcaaatattaaaaatacttcccttgctcaaataattcccagaaaaattctctaaaatagaggagcaagcatagtatttaataaaattttatctagctcatttttatgttgaaaattttcctagaaaattagggtttagctggtaggcttttaaaataatttctaaaaatgatttaaaatctgcatttttaatttagtcgatttttagggcgtgacattgatcaagttagagaagcccaaattaatgatcctgatattcaagagatcaagaagaatatgagaagaggaaaagctatcggtttcttggaggatgagcatggaactgtatggttgggtgagagaatctgtgtccccgacaacaaagatttaaaagatgcaattctaaaagaagctcatgatactttatactccatacaccctggtagtactaagatgtaccaggatctcaaggaaaggttttggtgggcaagtatgaagcgtgaaatcgcagaatacgtagcagtatgtgatgtttgtcagcgagtcaaggcagaacatcagaaacccgccggtttgctgcagcctttgaaaattcctgaatggaaatgggaagaaatcggtatggattttatcactggtctacccagaacgtcatcaggccatgactctatttgggtgatagtcgacagacttaccaaagtggctcatttcatcccggtaaagacaacctattctggaagtcggttagcggaattgtatatggcaaggattgtgtgtttgcatggcgtccctaagaaaatagtgtctgatcgaggcagtcagtttacttcaaatttttggaagaaacttcaggaagagatgggttctaagctgaactttagtactgcttaccatccgcaaactgatagacaaactgaaagggtgaatcagattttggaagacatgttgagagcttgtgctttagatttcggtggaagttgggataagaatctaccttatgcagaattttcgtataataacagttatcaagctagtcttcagatggctccttacgaagcactgtatggtcggaagtgtcgcactccgctt

SEQ ID NO: 70584 - DNA, 1734 bp, Oryza sativa
tcgactctagaggatccccaacataacccattacagcgcacctttcctggatcataatcacccccttttaaaacaaagcatggactccccagcgacccccatggacatctcgccacttctcagtctggcgcactataatgaatcatgctacacaaaagataaagccattgcccacgctggcttgtggttggcacgataaatgtttcacaacagtagctcgcgaaccggtccttaattgtcattagcacaaccatcaaaaccatatgctcacaacccaccttatccaggttttagttatcaattaattaacatcacacgattgaccatcgtgagctaccattaaatataaccattattaacaataataattatgtaatataatttatatttaaccccttttagttagctaacgtttctatgcagggctaagcaaacctaaatatagcatttagctgaaccaatccaatatataaggttcatgctaatcaaattataacccataggaaaataaagtcatcttcggccattaattaactgggaaaggttcaccacccgatgacattcgaaaacaatgcatagttgaaataaaataatagctttaaacgggatcaacatgctcaaagggttgtttgggatctgtgtgacttgccttgggcttccacaaacgcttcggaaccttcctcaacagaaacgctttcctccggaacgtcggaaactaaagcaattaaacaaaaatcaacaaaacagtacaaaaacaagcataaacagtacatgtggatatttttaacatgtagatcttgattttagaagaatttagaaacttgaaccacctgaaacagatctacggttatttagttatgattttctgaagttttaatctattagaaaatcgagaaaaagaaaagggaaaggagatgatgacgtcatgctgacgtcagcaatggcggccggttagggtttgcgagctcgccggagctagggcggtcgaccgggtgattggaggacacctacgcgtagagaaccactacaacaaaacaacccacaaaacaacccaaaggagacatcttatttgtaagatagagacgttttatttcgtctcccacagataactgagacgcttttataaagcgtcgtaggatcgtctctgtttgcaccgtcttaaaattatggagacgctttttaaagcgtacctatattatttaagacgttgctagagacgtgtaaattgcatctctacaaaaatatagagacgcttttatataggcacgcacatcttaatatatttgatattaatgctttcatctaggctcgaacacagcacctgcaggttacaaagttcatgcactaaccaagtcattaacgtgacaatcttgaaggtaaatagatagttttttttatattgcaactctgcaaacatgcgttctgtagcagttctcttcttttttaatctaagactgaatattaaatatttatttttttgtccaaataattataatattattataatggtatttgatgatgacgattaggatcagtgtgtttattttcttctttctctatataaataattatatattatctaataacgatgacacggatataataaaaacgtctcaaaactcatttctacacatgagatgttccaaaaacgtctcaatattcatctctaaacgatttaattttgtgctaacctgtaaagcgtcttaaactatatcctcaactaataaagcgtct

SEQ ID NO: 70585 - DNA, 18293 bp, Oryza sativa
  unsure (1)..(18293): unsure at all n locations
ctcgaacacagcacctgcaggttacaaagttcatgcactaaccaagtcattaacgtgacaatcttgaaggtaaatagatagttttttttatattgcaactctgcaaacatgcgttctgtagcagttctcttcttttttaatctaagactgaatattaaatatttatttttttgtccaaataattataatattattataatggtatttgatgatgacgattaggatcagtgtgtttattttcttctttctctatataaataattatatattatctaataacgatgacacggatataataaaaacgtctcaaaactcatttctacacatgagatgttccaaaaacgtctcaatattcatctctaaacgatttaattttgtgctaacctgtaaagcgtcttaaactatatcctcaactaataaagcgtctcaaacatcgtccctattttaatttcacttataaaaaagagacgacttatagaatgacttaagtgaaacgtcttaaaacaatggttttgttgtagtgaacatcgagacgaacccgatggtactcaccacaacgtctatcgacgaacggtgatggccggcgacgagggggaaggcggtggcggagctccggtggtcggcggcgaaggaggacgggcggccgagcttcctcacctccgtgcgcacctaacggcgacaacggcaagcggcggagacggcggacgcggcggcgcgacacggccgaaagatggccggcggcggcggcggctaaatgcacgtggcggcggtgctacggtgcacgggagaggacgagagagggggcaaatggaagaggacgacgaggggaagctttataaagcattggattgaagagatcgaactccaaacgagaggaatcgactcgggaaaaatccaaactcggttttagggataaaatcaaaacgaactcgattcggatgaaatcctcaacgattcgctccgattcttgggggaaaaggaagaggagaacgagaggaacaaaacccctcaaaaacccggaggaatcggagtcggattgaggcggatttgagaggagaaaggcggcggcaaagcggcggctcgggcggctcggccggaggtaggggatggatccgacaggtgggccccacctgtcggcctccacgagagagggaagcgggcggcggcggcagctgggccggcttgggccggttcggccgcgggagaggagggagatgttgggccgaattcggcccaacgaccaaggagggggatttttttgaactttttaaaataaaacaatttgtgaaatgttgtttcaattattaaaaatacttcccttactcaaataattcccagaaaattctagaaaatagaggagcaagcatagtatttaataaaattttatctagctcatttttatgttaaaaattttcctagaaaattagggtttagcttgtaggcttttaaaataatttctaagaaatgatttaaaatatgcatttttaatttagtcaatttttagggcgtgacatgctgctaggggctcagttctgcctgcctgtcccgggggttccggccgtaggtgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgtgcaagccgagcaatgtacccaagttagtgttttaattcttaaaacctgcttatcaactaaaatgtggaatggttggcctaggttggcttgggacgagctgggacccagggtcgggttgccagttcggtctgaatcatcgtaggccttgggttaaggcaggttcgtgtgggttcacggccttgataaataatatggtatagttctagaatcgtgtttacaaaatagctttgagcaactaagtacctttaaatgctgtttactgcaaaccctaaccctttatagtatgactcctttgtactcccttgcatttattctgcacttgtgggtgtgtcttgttgagtacggtggttgtactcagtcttgctcaatttttcccaaccccagaagaggagccccttgaagatgaaggttttggtgtctagctcgtgcctgccgtcaagcgcctgtggtcgtcgccctagtcttccgttgtttctcgtttgtctctgtgtgtgctgggccttcgctgcccatgtaataagttagctatttacgcttccgcttgttaaactctgaattgtatcaacttttggtgtaccttgcctcctgggacaaggattaatgcacgcacgtaaggaacgcccgttgggttatttccggtcgtgacattagatctttattgattgagaggaactatctacctatgtaatgactttttattcgcttattaattagagtaataattgtactctattatcaatttgttattgtgtgcctcggctgattactggacgagggttcacacacatgtaagcgtttggaattttggatagaaatttcgggcgtgacatatatgcatatgaccgacgctaaggagttgtgggatgcactgaatactaaattcggtgctactgatgctagcaatgatctgtatatcatggagtagccccttgaagtgatgagaaaaagaaaactgcgtcttttccgatctacgtgtagtgctagatgctgggtgccatggatcgagtgatcaaatcagaatttatttacgttcagaactcagttgactgcttctatagataaggcggaatgtccttagttcagcattatagcacatagtctccaacgctacgccatatgtcgcttagacttgaccttttctcccgccccctaaaatcttcggctcctcgtttttattcaattatgaaattactcattttgatggagatttatagcatcattcaagtaaatacaaattgagatcgtagaaacatgagcttgcagtttcatgactacaagatggctgacaaccgttttgtagtcgaacaggctcatgagatacaaaccatagctaaggaactcgaactccttaagtgtgtcttacccgacaaatttgtggccgggtgcattattgcgaaactacctccatcatggagaagtttcggtactgcattcaaacacaagagacaggaatactccattgaggggttgatagcatctcttgatgttgaggagaaagctcgggaaaaagacgccgcgtctaaggatgatggtgggcagtccagtgccaatgttgtgcacaaggcctagaacaagagcaaggggaaatataaagctcaacagaccaccaacttcaagaggcagaagaagaacaacaacaatcctaaccaggatgagaggatttgctttgtgtgtgggcaacctggtcatctggctaggaagtatccacagcgcaaggggatgaaggcacctgcagggcagacttctaagtctgctaatgtgaccattggcaacactggagatggaagcgggtatggtaatttacctactgttttttcagttaatcagtctactaattggtgggttgatactggggccaatgtacttgtttgtgctgacatctcattgttttcttcttatcaggtcgcacggggttccaccttcctaatggcgaatgggtcacatgcttctgttcatggtgttggcacggtagatgtgaagtttacttcgggaaagatcgtgcagctgaggaacgtgcagcatgtcccttctatcaacaggaatcttgttagtggctcccgtctaactagagatggatttaagttggtttttgagtctaataaagtagtcgtgtctaaacatggatattttattagtaaaggttatgagtgcggaggcctgttccgcttttccctttctgatttctgcaataagtctgtgaacaatatttgtggaagtgtggatgatgaggctaatgtttggcactcacgtttatgtcatattaattttggcttgatgtctcggctttccagcatgtgtttaatttctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatgaggtgttgacgaagggtggaaaacaatatttcatgacgttaattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgacgaacatgacatcatacatgagaggactcctccctattctcccgagtctaatgggattgctgaaaggaagaaccgcacactgactgacttggtgaatgccatgttggacaccgcgggacaacctaaggcatggtggggggaggcattgttgaccacgaatcatgtgttaaacagagttcctaacagaaataagaacaaaacaccatatgagatatggattgggagaaaaccatcactttcttatttgcgcacatggggtgttgttggtcgctctgaagttaaggtgaattgtatgtttcaattgatctcccgaaggtgatgtcaagatgaaccccacacctgctccttggctattgagcgcgccatcgaacgccattgtccatgtttcattgtcggtttgactgtctaacctattattaggcatagtccaatcggctatgacatcggcgagaacctcggacttgatggctgttcgtggtacaaagtggacgtcaaactggcttagctcgactacccatttcgcaatgcggccgataacgtctttgtttctcatgacttcgccaagagggaaggcggagacaactgtgaccctgtgggcttggaagtggtggtgtagctttcttgacgtcatgattactgcgtagagcagtttttggatctgtgcgtaccttgtcttcgcgtcgtggagagctttgctgacgtaatagactggtctctgtacattttctctttcgacaacaatgacagtactcacagagtagggtgtggcggtaatatagaggaataactcttcattaggttggggagcaacaagtacagggggatttgataggtagcacttgagtgcgatgaacgcttcttaggcttcttgtgtccatacaaatttgtcctgctttttagcagtgcgaagaaatgctgtccttgttctcccatcctaacgacgaacctacttagtgccgccatgcatccggttagcttcagtacctccttgagtcttgtgggcgacttcatgttctcgattgccttgatcttctcggggttcgcttctattcctctgccagagacaaggaacccaagcagtttacccgacggtaccccgaacgtgcacttctcaggattgagcatgaggcgatattgtctgaggttgtcgaaggtttcccgtagatcgtcaatcaatgagtcgcatgtcttggttttgacaacaatgtcatcgacgtaggcctcaacattgttacccagttgatcgctaagtgccccttggaccgtacgctggaaaatatttcctgcggttatcagtccaaacggcatttttacgtagcagaatacaccgaacgatgtgatgaatgttgtcttttcctcgtcctcttttgccatgcttatttggtggtagccggagtaagcgtcaagaaagcttaacagctcacaaccagctgttgagtccactagttggtctattcgagggagagggaagtgatccttggggcacgccttgttgaggtcggtgaagtcgacgcacatcctccacttcccgttggccttccgcaccatgactgggttggctagccactctggatggagtacttctctgatgaaaccagctttgagaagtttatcgagctcttctcgtatggcctgtttctgatctggtgcaaatctccgcagcttttgctttactggcttggcaacgggtcgcaccatgagtttgtactcaatcacctccctagggacccctggcatgtcggacagttgccaagcgaatacgtccgcattatcgcggaggaaggtgatgagcgcgagttcctatttctcgttcagtgatgccccgatcttgactgtcttgtcggggttggcactggagagtggaacgattttaattgcgtcgtctggttttggcatcttagtcgttttgatcattttcttgggtggctcggctgtggcgggtgggctgggcgtgtgctcgaccatgtcgaggctctgcttgtcgcattggaccgccagctttgtgtttccttgaatagagattgttcccttcggctcgggcatcttgagtacctgatacgcgtagtgagatgcggccatgaacttcgcgagtgcagttcttccgatgatggcgttgtatgctgtatcaaactcagcaacatcgaatgttatcttctctgctcgaaagttgctcgcttggccgaaagacacaggaagcgtgatctagcccagtggcttggacgaagactaaggagtgattccatggaagggttgatcggtaggcgtcaactcgtttcgtggaatgcccattgcgtccaaggtgctggcaaagagaaggttgatggagctaccgccatcgacgaagactcgcgctaccttgatattccgaatagtgggttcaaccacgatcggatatcgtcctgggataatagcagttttggggtggttctcatctgagaactcgatgttctgttcagaccacttcatcttgggtgcaaccccctgccatgtcgaacaaacctcacgttccacttttttgtattctcgctttgaagagtacgctgtggaacctccgaagatgtgcgagacatgaagatcggaatctggatacgccgagtccgagtcctgagtggttgcctcagtggccttctcaactacacgtactcgcttgcccttctccaaagccagctgctttgccaacgactttttgaagatgaggcactcctccagagaatgtttgtccgacttgtgtatggggcaccatattctcttcgtatcactgccttgtgggtctgggtgtttgggcgggcgcttgtattcagacacgaggacttccgcttgagctttcctcttcccactcttgccgcttttcttcttgcttgattcgggtgtgtccttggctggcttcttctctcctcccgcctttgactcgtcgttcttgcgtctcactgcgtcgtctgcatgggcgcatcgatcgacaacctcaaacaaacttcgagtcgttgtgattcgccttgttgccaactcctgggtagtatagcgatctctgacaccggttttgaaagcacgaatcacagaagcatcggtgatatcggggatcgtatttctgcactcattaaagcgccgaacaacacgtgtaaatcgtcttcgatcgcgtggcgcttgtaagttccctggaagttagcgacgaattgctaccacaaatctgcccatgaagagatcgagtagggtgggaggtgcatcagccacgaacgcgcagaacctttcaacgccgttggcaaatagtttgctaacgcgttgtcgtctgccccagcagcgtatagtaccgtggagtagacctggaggaattcttcagggtcagtactcccatcgtacttctctattgctccgggtcggaatctctcgggccatcggacatcacgtagagaacggttgaaagctctacacccagtgcagggggcggtgggttgtcggcgattgtgtgtcctccgtggatgtctatcggatgacgaagatgaagatgatgacgatgatgacggtggttcactcggctccggtgtgcgattccgagggcgacgtttaggttctcgagaattctgtcgtcatccaccattgttgtcctagcgccgatccccattatcatcaccgtcatgttgacgccctcgaccagcatcgtctggtgtccgctgttcgcgatcgtcgcggtcgcggcagttgtgacgattatcgtggtcttggtcttcgttcgagcgacctcctcgctgtcacgcccagaagtttcccctttttcttgctttaaaaattggttaaataaattgcccgaagaaattatcttaattaacctagagctaactccataattaataaatgcaattaataatcggaaatagcgtggtggaatttttcttgagttccccatgctccaatgcattaacaagatttttagtggaattttcagagccttggaaataattttaaccaattaaaaatcaccaaagtgcaatatttaatcctaggaaaatccttctcctctttttctttttcttttccttcctttttctctagatgggccatcggcccatctctctccccgcgctcggcacccctttcctgggccggcccgctcctcctttccactccccgaagtcctccctccctccctttctctttcgggcaccgacaggtggggcccacctgtcggtcgtcccctacctccggtcgttggagccggagctccaaccgcccgcgctgccgccttctccgctccacgtcgcgcctccactccgcgcccgcacctcgcgcccacgtcgccgccctctcccccgcatctcccgcgcgcgcgcgcgcccgcaagtggtgggggatttgaaatctcccaacaccctcttctctctcctccacctctccacgtcgccggccaaataggggccatccccggccgtttccgcccctccctcgcccataaaaaccctcactcgagctctctctctcattttccccattcaccgtcctctcccacgccctctaccgccgtcgcgccgcgctcgccgagctccgcccccgccgcccatctcctgccacgtgccgtcgccactagggccgccgctgtgccaagccgccgccgccgctagctccgccgccgtgtgggccatctcggccaccgcctcgcgtcgccggaaccccaccggaaccccatctccctcgcgagccggtgagctatccattcccctccgtctccggccagccactttggtcgtcgtggtcgccttatccatccctaactcctctcctcccctcctctaagtgtcgccgccgctcgtccgcccctcctcttgtcgggtcgtcgtcgccgcctttgtcttccgctccggccgccgtgtcgccggtgagtccttcctccccctcctttcctcaccttcccgcgagcgccggccacgccgctgctccggccatgcgccgccgcctttcggccgtcgcagccgcttcccgcaccgccggtcaccgccgtcggtggccgtgcctcgccgccgcctcgccttggtcggccggtcggccttgaggccaagctgagcctggccggcgcctccctcgcctcccctttgagccaccgcctggtggggcccacctgccaggcgccacctccctccctttggagccgctgacccgtggggcccacgtgccggtgccccccctttcgctgacgtcagccttgggctttattgcgcaataaaataattaaggctttttctttattagtaaaaacacagtttatcttttaaaattcttaagtaattcatccgagctccgtttaagtccattcaagtctcagtaaatcaagaaaaatgcaaagaatccactaaaaatggttttgtttcctgtttcagtagtcttatagcatgttttgcttgtgtgctttgtttgtcgcgtaggtttcggccgtttcgtcgatccgcggtttctcgaagacgttgctgaggtctcatcagttcgagagcaaggcaagtcatgcaatacgtttgatcatattgtacccaatttacaaatatcccgcatttctattaaatgttgcattcttttacaatgtaatgtgggatgggtcctattcctcagccacatattggttaccttatgccattgataacttgggtatcaaaatgactagatgttggcttaggaaatgcttagccatgcttagttcaactagtacacaaatggggatcacattattacatagactctgactattggcatagctttagattggcgccaccgcaagggtgtcagttaattaaaatattctgaatggcgggctgtgagtgcatggttttgctggtcgcacccatggcagttaaggaccggttcacgggaaaccctgggagacttaccgtgctgaccacaagcgggagtgggtaactgcttgatctgaagtatagctcgaccctttcctaggcaccggtggtgagggtgggcgtgatggagttgggtcggccgaggtgttcggttgtccagctgccggattcaccgcggcgcaagaggggaccgcccactgccttttgaggggtgggggtgaaaccttagcgtggtgtggatggttaggggagggttaggtggaggatcttgtcacgatttccccctttgcagtatcatggtgatacttcggggcatggcgacatgtgtggaatcgtgtcttgtgggtacagttgtacacctctggcgagagtaaaactattcgaatagccgtgcccgcggttatgggtgatcaaccagatttaccgtgattagtctcacccctagtttagcgtaatgaactggtgtagttcaggtggttggttgggcttgttgcaacgtggtgtagcgttggacagtgattggttaaaattgattaattactacagctattttactgctttcaactactgctttgaaatgcctgctttatgcaaaagaacccctagcttcctttggttatatcctgcatcatacctccttttccggtatgacttgctgagtacagtgggtagtactcagtcttgctctcttttcccccacaccagagttgaagttcttctcagatggagccgcctcagagaggttggtttcgtcgctgccgtcaaggtttgcctgtggagtggggtcgcccgctgctgaagtcaagcttcccggtttagctcgcttttatctttctcgctgcatttgtaatcttttatatttttgtaagacgtgggtctgtatgtcaacaaatgtcgtttgtgtaccctggctggtcctggacagggatttaatgcacaatcagcttagaaattctggttcgagaatttctgggtgtgacaagttggtatcagagccgaccttgaccgtaggacaagccaactggaaacctaagagccctctgaacccttttttttcatatgcatatgctcttttgcacttggatttgtttcaggaaaatttggggttttgcctctttggtttgtgggaaaaatcttggtcgttcattcggatcggatttttaaaattagctcagtgtagggttttagaaaaaaaaatctatttgggggttttaaaattagctcagtttaggtttgttgcttgtgggttagtcggcggtcgatatcatgtgtcagtggtatgactgcctcaattaggagttgcgtgcctctttttcagtgttttaatcaagattaagataattacacttaaattcataagcaagattagtttctaagccccctgtttttcttccttttctcatatttctccctatccccttcagatggagacaaggaatggttaacgggactccaacaatgccagtggcagcgaagagccgatcaatggagcacgtgccaacagtgcatctgacaacagtccgtccccatcgcctgagaacccaacaattgctcaggtgttgaacaatcagactcagataatgacaatgatgatgcaacagatgcagcaacagtaccatcaggtgttgcagcaggtgcagcagcaagcacagcagcagcagcagaacctgcagtttggtcctccacctcctcagtccaaactgttagaatttcttcgtgtcaagccgcccaccttctcaagcaccaccaacccaatcgaggcccacgactggcttcatgccattgagaagaagctgaatcttttgcaatgcaacgagcaagagaaggttgcttttgctacataccagctgcaaggccccgcttctgtttggtgggacaactacatggtgacccgtccagctggggcagaggttacttggacagagttttgtcatagtttcaataaagcccaggttcccgagggagttgtggcgcaaaagaagagagagttccattccctgcaacaaggaaccagaacagttatagagtatttgcatgagttcaaccgcctcgcgcgctacgcccctgaggacgtgcgtaccgatgccgagaagcaggagaagtttatgtctggtcttgatgatgaattgaccaaccagttgatctctagagactatgaggactttgagaagcttgtggacaaggctattcgtcaagaggagcagtctaacaaaatgaaccgtaagaggaaggcagcctagttcaggactccccaggggaagtgttagaagcctcgtttcacaatgggatatcagggtggaccttccaccatgattatccgacagcaccgtccctaccacccgggtagcttcaacaagaaccaccatagtggcagtcacaacaacagtgagtagcacagcctcaaccctactccgagttcactaaagattccagcccaatcagttcagccacctttgccagaacagcccaagaggttgggagaaaaacccgaactctgcttcaattgtaacaaacccggacacacggttggaaagtgcccgaagccaagacgtgctggacccaagttcgttcaggcccgtgttaatcatgcatctgcagaggaggtgcagtcagcaccagaggttatattgggcacattccccgtcaactcgacaccggcagtaatattgtttgattctggtgcaacccattccttcatttccaagcgttttgctggtgcacatgggttatctttagtgaagcttaagataccaatgcgagttcatactcctggaggtggcatgaccacaactcactactgcccatctgtgacagttgaaattcaagggttgatttttccagcccacctcattcttctcgaatccaaggacctagatgtcatacttggaatggattggttgacaaggcacagaggagtgattgattgcgccagccgcaccatcaagttgaccaatgcaaaaggagaggtggtaaccttccagtctctagtgccgcagaagccagggatcagtttaaaccaggctgctggtgaagaacaagaggtagcagtggagaaaaccactaagaagctagaggatattcccatagtcagagagtatccagaggtttttccggacgatctgacaacaatgccaccaaagagggatatcgagttccggattgacttggtacctggaactgcaccgatccacaagaggccttacagaatgggagccaacgagttggcggaagtcaagaagcaagtcgatgaacagttacagaagggatacatccgcccgagcacgtcgccttggggtgctccggttatctttgtggagaagaaagacaaaaccaagaggatgtgcgttgactaccgcgcactcaataaggtcaccatcaagaacaagtatcctttgccaaggattgatgatctgtttgatcagttgaaaggagctactgtgttctctaagatagacctgcgatcaggctatcaccagttgaggatccgcgaagaggatattccaaagacagcattcatcactcggtacgggttgttcgaatgcacagttatgtctttcggactcactaatacacctgccttcttcatgaatttgatgaacaaggtgtttatggaatttctagacaagtttgtcgtggttttcatcgatgacatacttatctactccaagtccgaggaagaacatgagcagcatcttcggctggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcagttaccaaatggaccccaccaaggacagtcactcaggttcggagtttcttaggacttgcgggctattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcttaatccagcctgatcagacgaaagatttccaggtctattgtgatgcatctcgccaggggctaggatgtgtgttgatgcaggatggcaaagtggtttcttatgcttcacggcagttgcgtcctcatgaaggcaactacccgacgcatgatctggaattggccgcagttgttcatgctttaaagatttggcggcactagcaactacccgacgcatgatctagaattggccgcagttgttcatgctttaaagatttggcggcactatctcatcggtaaccgttgtgaggtatatacagatcacaaaagtctaaagtacatcttcactcaacctgatttgaatctcagacagcgaagatggttggagctgatcaaggattatgatatgggaatacattatcatcccggcaaggctaatgtggttgcagatgccttgagcaggaagagctactgcaatgttgcatgggtagagcaactatgttgtgaggttcaacgcgatttggaacatctgaaccttggtatagttgagcacggattcgtggttgccctagaggcacagcccacactggtggagcaggttcgcatagctcaagcaagtgatcctgaaatagcagagctcaaaaagaacatgagagttggaaaagcccgaggttctgttgaggatgaacaaggaacaatctggatgggagaaagattgtgtgtacccgaaaacaaggaattaaaagacctgatactaaccgaggctcatcaaactcaatatttcattcatcccggtagtacaaagatgtaccaagacctcaaagagaagttttggtgggtcagcatgagaagggaaatagctgaattcgtagcactctatgacgtctgtcaacgagtaaaggcagaacaccaaaggccagcaggtttgctacagccacttcagattccagaatggaagtgggaagaaatcggaatggatttcatcaccggtttgcccagaacgtcatcggggcatgattctgtttgggtagtcgttgaccgactcaccaaagtggctcacttcattccggtgcacactacctactcagggaagaaattagcagaactctatctggcaagaattatgtgtttacatggtgtacctaagaagatcgtgtctgatcgaggaaaccaatttacttcaaagttctggcagaaattacaagaagaattgggaacccggttgaatttcggcactgcttaccatccacaaacggatggccagaccgagcgagtcaatcaaatactagaggatatgttgagagcctgtgcgcttgactttggtggagcatgggacaaaagcttgccgtatgctgagttctcttacgacaacagttaccaagctagtctacagatggcaccgtttgaagcactgtatggacgaaggtgtcgtactccgctcttctgggatcagacaggggaacgccagttgtttggtacagaagttttaaatgaggcagaagagaacgtcagagctattagggaaagattgagaatcgcgcaatctcggcagaaaagctatgcagacaaccgccgaagggagctcgctttcgaaacaggggattatgtgtatctccgtatcactccgctcaggggagtacatcgcttccagaccaaaggaaagttggcaccacgctttatgggaccatacaggatcttggaacgtagaggtgaagttgcttaccagcttgagcttccctccaacatgcttggcatccacaacgtgttccacgtctctcagttgaagaaatgtttgagagttcctgaggaacaggcaagtccggatcacaccgaaattcaggaagatctgacatatgtggagaagccgactcgtatcctcgaaaccagcgagagaaggaccagaaacaaagtaataagattctgcaaggttcagtggagccaccactcagaggaagaagccacttgggaaagagaagatgagttgaaggccgcccacccgcacctcttcgccagctcttccgaatctcggggtcgagattccgtttaaggggggtaggtttgtcacgcccagaagtttccccctttttcttgctttaaaaattggttaaataaattgcctgaagaaattatcttaattaacctagagctaactccataattaataaatgcaattaataatcggaaatagcgtggtggaatttttcttgagttccccatgctccaatgcattaacaagatttttagtggaattttcagagccttagaaataattttaaccaattaaaaatcaccaaagtgcaatatttaatcccaggaaaatccttctcctctttttctttttcttttccttcctttttcactagatgggccgtcggcccatctctctccccgcgctcggcacccctttcctgggccggcccgctcctcctttcccctccccgaagtcctccctccctccctttctctttcgggtgccgataggtggggcccacctgtcggtcgtcccctacctccggtcgttggagccggagctccaaccgcccacgccgccgccttctccgctccacgtcgcgcctccactccgcgcccgcaccttgcacccacgtcgccgccctctcccccgcatctcccgcgcgcgcgcgcccccaagtggtgggggatttgaaatcccccaacaccctctctctctctcctccacctctccacgtcgccggccaaataggggccatccccggccgattctgcccctccctcgcccataaaaaccctcactcgagctctctctctcatttcccccattcaccgtcctctcccatgccttctactgccgtcgcgccgcgctcgccgagctccgccgccgccgccgcgccaagccaccgccgccgctagctccgccgccgtgtgggccatctcggccaccgcctcgcgtcgcccgaaccccaccggaaccccatctccctcgcgagccggtgagctatccattcccctccgtctccggccagccactttggtcgtcgcggtcgccttctccatccctaactcctctcctcccctcctctaggtgtcggtgctgctcgtccgcccgtcctctcgtcgggtcgtcgtcgccggtcaccgccgtcggtggccgtgcctcgccgccgcctcgccttggtcggccggtcggccttgaggccgagctgagcctggccggcgcctccctcgcctcccctttgagccaccacctggtggggcccacctgccaggcaccacctccctccctttggagccgctgacccgtggggcccacgtgccggcaccccccctttcgctgacgtcagccctgggctttattgcgcaataaaatgattaaggctttttctttattagtaaaaacacagtttatcttctaaaattcttaagtaattcatccgagctccgtttaagtccattcaagtctcagtaaatcaagaaaaatgcaaagaatccactaaaaatggttttgtttcctgtttcagtagtcttatagcatgttttgcttgtgtgctttgtttgtcgcgtaggtttcggccgtttcgtcgatccgcggtttctcgaagacgttgctgaggtctcatcagttcgagagcaaggcaagtcatgcaatacgtttgatcatattgtacccaatttacaaatatcccgcatttctattaaatgttgcattcttttacaatgtaatgtgggatgggtcctattcctcagccacatattggttaccttatgccattgataacttgggtatcaaaatgactagatgttggcttaggaaatgcttagccatgcttagttcaactagtacacaaatggggatcacattattacatagactctgactattggtatagctttagattggcgccaccgcaagggtgtcagttaattaaaatattctgaatggcgggctgtgagtgcatggttttgccggtcgcacccatggcagttaaagaccagttcacgggaaaccctgngagacttaccgtgcttaccacaagcgggagtgggtaactgcttgatct

SEQ ID NO: 70586 - DNA, 16696 bp, Oryza sativa
tctgtttgccatgcctaaggttttacagaatcaccttaatttcttttgtgtaaattcaaatggaacaatgggttttttttagaacagagaaataataataaatggaacaccaattaagaaattcttacctaagtttgtggatgttgaaatggtcttcaaggtatcccgggtaaagctccatatgattcttcagttgatcaccgtttatatctaacatatattttcttttaagtgagagagagaaagattgaaaaatcaattcaacttttgagatacatatgcggtgtgccttcaccaaaaagagaactacatagatcctgaagcataatgtgtgttattggtatattttttaatgtagattattatttgattactgcttcaagtctaggatttgtagagtagtatttcatggaagtgtagattcttaaacgattttaaattcaacaaagattaggttttctcttttaaaaggaagaggggatatattcttttcccttgtttctgaatgacataagagcaaaaaagttgtcggtacgtcatctgtgaccaatggactaaagatgtgtggtgatgcatgaatatggaaaaaaaaatgctctcatgatatattagtataataccctatagaagatatgatccttaaaataggtttacatgtttgatcattctcaacctcttaggaatataattactaactggagagatggagttccattgattaggaaataccatggtctataaaaggagatgattgtgtgcatcctagttggtgcagaggctggaagtaatatttctattaattatctaaaaatattagtgacaagaaattttttacatttggttgttgacaattgatagaagcataaatacttgtggagaaacaaagatgatgagtcatgttctttttattttcagcgagctgttgctattctgaaaaaaaaaacagatcctgatgctatgatttagtttgctatgacactgtatagttttcttcaaggaagattgtgataatatactacaaggcaaaacattctacttcatgtttgccatgcatggagatgaacaatgtgatataaataaaccttaaaaaaattggcacatttctctgcaaggaaaaaaacctactagtccttcctttttctttttttcttcttttctttttgcgacgaaaaaatttctagtccaagtaacctgatattggccaaattttaaacacctccttttgtggttgaagtgtgcaaaataaaattactatactgaagaaatcaaataaaaagtcgacaactaactgtaaaccgaataaattgaacaaaataaaaaaccgagtagcaaggtagtacctttcctgtgaggatgaccagacaagaaccaaatcaaccaagcaagaaatggagcaagaagaaaaatggctcaagagctcctcatatatgcaagtgctcttgctgaggtccaaagggcaaacaccacttgcccacatgaaaccatgtaccaaggttatataaggagccacccctgcttttttccccctcagaaaggaagagccaattgcagagctgcttttgctaagaaatgttatcaccagggccttcatgctagcttaggatgcactaattattccttttagtaaactaatcaggtgcatatgtccaaagttaccagtaaatataatgcatgatcacctaactaccagaaagatggtaactttggtggtgtaaaagttaaaaaagaagaaggcttttcaagtaccatttactactggcacctgatgaactacacatatgcacactgcaaaaaaaagtgaagcttgaggttaagtagctctgtgcacacaactacacactgattaggcagaaaggcatgtataatgacagattaagaaaagatagtatatatacttactcttaacctagtcaccaaagtttaaagggaaaattagagaagcttgcttgattaagcaatccttcaaaggcaccttgtaatcattactagttttcagatttgcagcaagcaagcagccatcttattccagaatctcactgttttgattagcacatacacaatcagctagctaaggatgtgttagatcactaataaacttgaccatactttaatttgaagcaaattaaattcttcattgactgtgccacattgactgaactgaaggctcatgaagacatgcttatctacacaagattttaaattgagaaagattcatagtagtactagtatacaaaggactctcatgttacttgattccatatgcatgcatgatgcaagtattaattaatgatcaaggaaggattaactagattcaacaccttaactcatgcaatggagcttaccttttctagcatgtaatcacaaagaggcctctttacagaattacaccctcttttgtcagctatctgttcatgatactgctggtgttcttcatccatgtttgctttttaggtgccatatatagcaaatcatcatgagcaacatacctaccaggtataggttaattactgatgtttctttttaattagataacacattctaattaattaacccaaccaaaacaacataccacattgtcaacttaagatatataatgagtaagttcaacttaaactaagaagtaagatagtgccatgtacttcctctcaactcatgacagaattatatcctagaatgtatgtagccaaagcaattaactattctgatcaactatatagatttgaaccttttatatggaataatggatgtgacagagtaagtttgtcatcaataaattgtgttttttatgttattgtccctcttcgaatatataaaaagtagaatatatagtgttcaaagatatgttttgtcaacattgaaaaacagataacatcattctttatctactacaagagggagtatagattggtgcgtggcaacgaagcattctcctttgctctagctagaggctccagagaagataacacacctttggacctaattaaagaagatatactctgatgtaaagcatgcacaagggattaacaaattcatcaacagtgattagttgattaaaccacaatggttttttattatgagggctctaatgcaatgggcccattgctgattgcagcattatcaaaagctgccagctgcctctgtcactatccaacatttctttctggttcccatagttcctttaatgtcttgaatgtgtatgggttttccccttaattttcttctttcatggtttgcacaacttgattttccactccctcttcttaatttcccgctctttcgtggtacccatgattttatttgtggcttttaatgctttgagaaaagtttatttacccatgcatcctttttatcaagtgtggacctgtccatagaggcctacaagtatcctcgatgaattgtatatattttgatctaatttcctagaattttatatatatatatatatatatatatatatatatatatatagagagagagagagagagagagagagagagagagagagagcaggagaattatacattttattattattcatgtacacctcttctatcatctgggtcgaattcatgtaacctctagtactcccctgtgaattatgtgggttatttgctctttagcttatcatccacaaccaacatttgaatttcaaaacttaactttagagttgattttgattttttttaccatattttattttcagtattggctttttagatgctaacaacacatatgtaaaatttttgcccataaattatattttggtcgctaataagcgttacaacttataattagttatagtcaaaacgaccggactcatttgtaggtgcaaatttaaaagttttaatttgtaatgattatttctatatatcttgtataaatgatctagtgggatttttttgtggtacaccaaaactttgtgaaccattcattctacagtcatccaagggccaatatttttcttacctcttgggtggtaagatctcatatattatcatttatttaaaggctattactattaattactaattgaaatatggagagaagaaatgtttccttgcatgtaataaatgatcttgtgacatttacattatccaccagagtttatacagtcccatttccttactacttttttttcaatatgatacatataatcattaaaatgaagttaattccataaacactgaaattaattaacttcagccagatcagcacatgtctcattgtctggcctcacttctacagatgctgcactaaagtgcttgattggcccaaaaaaaatgtcagtaccttgtgttcaacatgaagttaaccataaacagcatggattcttctcaggaaaagagagaaaagacttggaggagaaaaggaatttgcatgggaccaaggaaagaaaaaaaaaaggtttcgaaagcattagctaaaagaaagaaagagtggagcctcaggtggtgagaggggttctatttcactagagagaagttaataaagagtggtgctgcatgactaagattctcacatcactattgtgcttgtatatatgcaatcattcatggctacatcaatatatgcatcatgcatgcatgtataccatatatgtatgtatttgcaacttgctagggaatatagaactttagacacctagattttggaccacatatatacactttgacgaatacattatacatacaagcctagctacttggaacatagatattttgcaagaagcaatgcaatattacatgatacttcttttagagagagagagagatagatagatagattttgtgtaatttgggaacacaaaatagtcagtaaaacttgggaagttagtcaatatattctgtcatttcaattggagtcagtgaaattagaggaatctccaaattgataattgtttccaaggtataaatgtagcaggatctaaattgggtcttacaaaggaaaatgagaaatgttatagtacttatgaaagaaggtaacatatggtatcatcttttctaatataaatttggttcattatgatatacaaggtcctggaaggcttcaaattttatgatgcctctcaaatattgtaaaatcactcaaagaaaataactgaaaccataagagtttactattatatgcacaagattaatgtagtgcagttttcttccatgtaatcgacaaaataagtagtgcatgcagtttggtgtgtcatcagcatggagtagggaccgcctcatcaaacatggcctgagttaggatcaaaagtgtcatacaatgagcaagctagagtgcaatttgataatttattctactaccaaaaagaggccaagaactagttaaacataacaattactcaattaggtcttaagataatgctggatgtctcattgtgatggttgcttgttgatcaatgactagatgcggcctcagaagccgacgcaggcagatgagaggtgaacatttttttctgtgattttggtgatgagatttcgtgtgcaaaagtgataagtgctgagcacaatagaatttggccatctggctgcaccattcggcgattccttgcatttgatgctttataaattttgcaacttgcgttactgaagaggcaccaggtgacagattcaggaaacttgcaaattctcgcatgaattaaactgttaatttaacctttcaaaaattcaccagtctccagtggcagattcagggaattaaacatattaattgtgtcgagtgatactatgattggcattattttaggtcaaattagcaaagtatatgtttaatttagcctaacattcaattttattttttcttcagaaggttattttttttaaaaaaaaacgcttgatagttatacaactgcactaattggttgtagcttcgttgaagtaaaggccagaatatccattttattaaaaaaaagatgacgtcacatgtgtatgagctcccactcagataaaaacagccttttacactgtaattaatcaccatttgttatcaccagtccgtgattacccaagagcgcaacacgtagtcatacacttagattggctcacgcatctactttgtcgaatcaagcaggtagagaaaaataagacacggagatgagaaagagaggcgaagtcttggataacctcattgccaatttgccaatataataatttatcagttgcaaagcttcaaccttgttagttaaacgctgatcattatgaggaggacacttcgtgcactcaagtctgaagccaaactctttgacaatatgtgccagaagaataattggcaccacttgttttgtcatccagaatcagagaagcagtctattttttttattaatgaaatggttacttgcaaagatctcgagattatatttgcatctctctctctgaaagatactattttaaacagtactattaattaacaagaagcaagatacagtcaggatcagaggctagctgagcagcagtgacatgcacatgtcaatgagataggcgttgacttggttagtgatcatcaaatgatggcctagcttgaaccaccaagcaattgggttctaggtagcaactagtggtttttttgctgaaaaaagtgcaggttttcatctgtagatgcagagaaggatgatatgaaacagtgtccttgcagacacataggatgagccttttgtcccactcacaatgcaataattggccaaagaatacaagcaattaatcagcaaacataatgcagcaggcaatgtcagttgtcaaggtgtcatctctgcctcacctttactttccctttcttgatcctttgcatggacaggtatagattgggtggtagctaggtgccaatttgtgccacacaatgtaccccatcgatctcagaaagacttcatttctaagtgctccaactcttgtccccaaaagactttatttttatcttttaatctactctagttccgtaaatcgaaaagttttatctcttcaataactcttaatttcctcttacctattactccgcagcactattttcttattaatgaggggcattttggtcttttaccctcatcactaatttgtcaacttcgtcttaaaattgaagtctttgtgagacagagggagtacatatggaggaccccaaccacaaaggcacgctgctttcacaagcttggttcaatctaaggggcctaaagttgtggaggaatatgtaactgaataacactgctatgtgcctcactaagacatgactttcagttgcttatgaagctttaagctgactggggcttgcaggaaaggagaggatgcaactcaccaaagtgcagagaaagttgcaaagattcactatctgtgtgatgcttttgacgatgtagagatgtatgttattctcatgtagctttcggttggtgcctggcttaattttagaatagtgccatgtatttagatttgctatatttgccacttgcataactcttcacttatttgttttcataccaaaaaaatgggctcttgatggtattgaactatcaccatattatcaaggctcctcatactatgctttgctatatttgtagcataagcctgaatgtaacctagcaagaaatcaacagagaattgcatgcagattagtcttctgcttgctacacagcaggtgattcattttcagtagtacactggcagtcagaactgtaattttaagctcttttgtatgacacatcaccatattttgatgtaccaaaagattcatgactacaatagcacattgtacaacatacacattcatgcgcggtttacgatcgcgatacgttctattgttaccattgcataaaagtaacacaaaaagaaagaactaaaaacctctcaattatggcctttttttttacatcatttcttcccagaagctgttgggtagatcctcctgaaagcccaaaggattctgcacccaatctgctgctgctgcttctccttgatgctcacctgatgctcatggcttcttgctgcactgcccttgtgtcctctctgctgctgctgttgccctttgagagaactggccacagctgcttcgtacaccattgctgcagacaaaaactgctgtttttttccccttgtcttcttgtcaagaacagattgccaaattgcccaaattgcttgcctgcttcaggtgactgaaaaaaagaggatgtgatgtctcatatttgtagtggttgatgatgcagcagagaggaatggctgtcttggcagccaaggaaccgaaactggcatgtgtctgaatttctaaatttctagcaggtagcagccaaggaactgaaattgacatgtgtctgaattatgaatttctgatggagattgtggtcaaagtatggctcattccactgaaccaaatgacaaatatttcctatgaaaactctggttttggcctcttcctggaagcctgggagaggaaggtacaattgaaggagtctaagtagatgaattgatggatggtttctttgtgcattatttattattcgtttattcgcttattcgcggaataagcgaaacaacatatttccaaacaaaaagtaatttgtgaataaaatttttatatacgtgttcttagcgatctaaaagcaaaaggctgaaaaataaatttcgatgaaaaaaacctcaaaatcagctccaaatttaaggttgaaaattcaaattttggctgataagcataagcataagcgaaaagacgaggccctcagtctcttcaagtagtctgactgtctaccttcttgttattgtattttttacaagaaattagatgccgcctatccgtttgtaggagatttttttaaaaaaaaatcgaaacaatgtatgtagacacttatatacccacgtatatattcatccctataaaaataaaagaattattactcataaatatgatcatcagtgctaagtaaaatacataggtgaacaggttccaccccccaaaaaaaataaccagtatctacgctcagttcgtggagatttcaagattttgaaagcaggtgactgcttagatgttgggagtgaatcaacaggctttagaccccacaaataggcttttgtcatcaatttgatcaatttttcgaagtgtcctaaatagttctccaaaaaagaaaagagtcataaattccaaagctaaagtactctgtgacgcaaaatatctccctccatgaactcccacttagtcactactccctccgtcccaaaaaaaagataaaccctggtttctgtgtccaacgttcgactgtccgtcttatttgaaaaagttatgaaaaaaataaaaagacaagtcacgcataaaatattaatcatgttttataatctaacaacaataaaaatacaaattataaaaaaatttcatataaaacggacagtcaaagttggacacggaaatccagagtttgcctttttttttttggacggagtgtagtcatgttttgccactggatggagattccaaaagaaagggcatagcctaacactgtagtggacctgatctcactttgtggtttgtgcaaatagtccacttgctctgctaaataactattggcacaacatattgtggcatcaaaatatcaaacgataagcttccgttctgtttgctttgtctaaggctttttacagaatcacctttcttttgtgtaaattcaaacagaacacaatatatatatatatatatatatatatatatatatatatatataatggaataataataaatggaacaccagttaaaagtggtcacctaagtttgtgcaaatagtccacttgctctgctaaataactattggcacaacatattgtggcatcaaaatatcaaacgataagcttccgttctgtttgctttgtctaaggctttttacagaatcacctttcttttgtgtaaattcaaacagaacacaatatatatatatatatatatatatatatatatatatatatataatggaataataataaatggaacaccagttaaaagtggtcacctaagtttgtgcaaatagtccacttgctctgctaaataactattggcacaacatattgtggcatcaaaatatcaaacgataagcttccgttctgtttgctttgtctaaggctttttacagaatcacctttcttttgtgtaaattcaaacagaacacaatatatatatatatatatatatatatatatatatatatatatatatatataatggaataataataaatggaacaccagttaaaagtggtcacctaagtttgtgcatgtgcaagaagagattatcatggcagcaaaatctggaaagttagggacaagcacaaacatgtaaaccattcccttaatttgcagccatttcttacatttgcgatcatccccaattgatggcacatccttgaagaatatgactgttggggatgctgcaagattaaacagtttgtgagttgttttacgtgaacaatggcttttgcattcaccaactcgtgagataaatatacaggcttatacaaaaggacggctgccaacaacgtggacctcgcggacaaaatatacaaccgggcccacactggggtaacattttgacaacaaaagaaatttgccgttacaagaaccactccctcagcaatctagaatctaaccaagctgagaggtggagccaaaatggcgcggaaataattatctacctggcattgagactacaattagctcaaagtttggggaaatgaagaaaccgctacccgcgccgcttccacagcacgaacacctagcaaaggaaaacatgccagagatcagaaaacaggagagatggttgatgttttttaatacaatgactcgtgcagttcttcaagaccctagtgtgcataagcaatccctaaagtcacaaatatttgattttgatgtagaatgagtatcggtcaaaacattcaaaattatggcaatcaattttataccatagcaagtttgtaaaatctaacaagtttatgatattatgacagtacttttcgaggcagatctatgtatatcattcgttttgtttttaaactaagtatttgagaaattattaatggtcggaattttttaggtttgacttatgttgtcctaaatgtcaaatatttatgactggagggtgtaaaatcttgccatatgcataagccagcgtttgggaatatgttaggactaggattaaggcatacctgtacagtaactttacaaaggggtaagaattttctgcaaaagctaccagcctaatttcaacatcatcctggtcctgaatttgaaggatgagcatacacactgccttgaacagcaggcttctgctgctgttgctgccgagattgcagctgctgcctctgcccaccaataccatgcccatgtataggcacgccacctgacatttgcctttgcaacatgccttggctagacactgacaacagcatttcatttccaacaaaggtatcttgaggcgagctagctaactgcgaggttgatggaactgtagttggatcatgagatgactcttgtctccgctggtttatagatgaaacaccacctgggctacctgaatctgtactctttgcaatggatgtggagggaattgcctgattatgttgaacttggtcaacaggtgattctatcctaccatcagtgttcatatgacggttttgttgcatcaccaatctctggatgttgttatgtgatggattcatgtaccgttgttgctgctgctgtgccaatggagatgacgaatgaagtggagcttgttgagaagttaacatagtctggttaggagaaccctgcattgagctttgactacctacatctgatgtttgtattggtgaatgaggcatctgagacccatatatcttgggttgattaccaggttgaaccactgatggaaccaagcccttattaccagcaaaataccccgggccctgttgcaccatacttttatcagaaacttggtttttagaggttgtagaaataccgcttgcttgagtggcatcaactggtgaactctggtgcatcatattccctcggcctaagctcttcataagcttagcttgctggctaccttgatttctttgctgctggttttgtctagactgctgctgaccctgttgcttcttctgcttatgcgatgtattaacaggctggttgggaggcactgagctatctagtgaattttgtgccggatgctgctgtttatgttgtgactgcgaagatgggatagcactggaagctggcccttggctctgctgttgcatttgtgaaccattctgtacagtcgacactgcactggctccagaaagtgggtgctgttgttgggtcatcatgcattgttgcatgtgtctatctttagccaagcgcatagcataagcctgctgctgtgggcttgactgggttgttccttgaatatgggggtgatgtgtatttccaagcacgtgtgattgttgtggcatctgatgtggttgggatgactgaactggaaaaggttgaccaggtgaagatgctccgacattggaaaatggagtaccactgaaatgaatggactggttatttccctgcgatacttgcatctgaaactccctgcatcatctgcctatgttcttccatgttctggccaggctacatcaaagaatgcatagcatcagcaaccacataacagcaaaaaaggacagcttctagctttttactgattaaattaagctttggatatcgtaagtatgtccatgagctaaaaaatggatagatcgatgcatgcatcattaactatgggatgtaataacatcacaaaaaagcaacatgcgtgctctagctatgattctttcagatttgtaatatgatactttaaaactatcacctgctaaccatccagcgattgatatttctaaccagaaaactgagggagttggctacagtattttagctttcagtaggcctagccaatgaagaatgtgcgacactaatgattaaccaggtttgtgcataggcccatcctaagtgggacctgagtattaagtgaattttgggcctagagtttgaaaataatacttgaataattatataaattcgcagcaggaaggactcaaatttccaggttccatccagtcttcccacaaagcatgtataagcaatggactgcatggcaaatgtttctgcttgttgtacgagcagtttggtcagatatgaaagtttaaaataacatatacatcagatctgaatagaatctaccgcttaaagagagaagttggtaatggatgcggtgcatactctatggtgatattttatgataaatcaatgtaggcaagtgtgtcgtattgatgtattgtaggacttcctaaaataaataaataattgcgtccactacacatgcatacgtgtagatatagcctgttgatatgattgtttaattggaaaattaagataaatacttttgcattttataagatcagagtatgtgatacttactaatctgaaaaccattgcagcagcacacatgcactgctagttaatagaataacattagaatattaaattgccagttagatagaggaaccccgcaaattgaccagtatcaccgattttcacagcagctaagtttgcttgcccacaacacatacaagccagtagcttgaatgaagttcatatatgttcagtcaatcagtacatattataactacttaggactggttttgaaactatgttatcatccatatgattagaacagaaggtaggcggaatacacgatattctatgcctctagcacacacaccagccaatggagagcacaagacatgatgaaagatatatatcataacacagaatggaaggaaatgtttacccgaagcatctgcattggatcgcgtggcctcaacatagtatttccatggccaggtatggtaccaggatgaacattcaccgtgttttgcatgccttgcccattgttgggaagcatgtttccaggtgaaaccatatttagcattcctgaggaaccaagccttggaaagggcggcctggtcactggagtaccacgatttagtccagtcatcacccccataccatgagcaccaggcatcatccgaacaccacgatcaactccagcaggcgcaccaggaacaggcaccccaggttgctgaagacttctgctgttgagcatctgattgtactggattctttgttgctcatcaccctgcagagaggtaggtctaggcattccgtacctctgagaatccctgcaacaaaaattttacagaaacgaacattaaaatgtaaaattaattttataagctagagaaggaaaataggatcatttacctaggagtatttggtgttgaaggtgatggcaaagtattgcctaaaaccataccaggagaccctggtagcctagtattcatattaccagtaggaagggtggggccaatggaactgggatggtttggaagcattaaaccacttgcatgagatcccgagtaaccaatagaaagtgcatccgggtttggagtcattgcatcacaaagatcaagcggcctattggtagttttaaatacgagcattagataaagtataaagaagactggcagggactgtggatacaggaaaagaacatataaattgaacacagcaatgctcatacatcaaaatgactccaggtgcacatgcttgagaaagtgcatgaagatgagaagaatggagtgggtttatctgcttgagctcttggctctcaccctgcatgaccaaaaaagtgaaaggggacatagggaaaatgatcagactaacgtgggtaaacatgtaaattcagaaaatacacatggtttaaattgcatatacagcaacaaatataacactatttaacataaaataatttggcctaacaaaacttaagcgagagataccacaaatatcataagattttatatccattttaaatgagagataccaaacataaggaaagaccactccacaattcatcatgacaacccaagatgaaatcagcattttcaatcattttcttatacatgtcaaactgtagcagatgattgtcgttactgccagtaatgagataccatatgatgaagcaagagcgtataaaacaacatgacagatcaacacattaacattgaacaaagaagaataaccattatgtactacacgccgtaggaaaatttacaattctaatatactaatacaaagtcaagcctgtaaaaggcttttccaaaaaaaaactaacctttctacgattcggatgcaacttttgaccaaggaatattattttctcgaagtgtgccttaagagtctcttcctcgaacggtccttgaaggcgctggaacaggtgtctagcactaccctgatatatttacatggaacagatcacaatgttaactgttaaaaagatgacatcctttgagcatctatatgaacactattggacaagaaaaactagcctcacactctgcaggtcaaaacaaaaactggatactaaatcaacttcagaatttgaaacttctaattctaaatcccatttacatgctaagagggataacacaagaaaacataaatgggagagcaaacctttgggatgccaggcaatgtggactgatagtgttgtgatgagcccgagtcatctgcgctatccgcaccatcacctgaacctttttctgtgagaagtttatggcgatctttacactcgttaggccttctatatatacactgcatatacgagatgccagaatccacaattaaataaaacaaataaaacatcaatgtactaaaacatcacattatgatgatcatatttgatatcacataagatccaatgtacaagcgaggaaataaacaaacaccaattaaaaaagaggattgacaaaaaagaatacaaaatgctaaagaagtggagaaaataacatggttttcaataaaatgatttctacaaggcagacttgccggtactgggaaaaacaaaggattgacatggcaaaaaaaaaagaaaactttgaagtcctaaataataatatattaccttcaattgaacaatgctgttcagtgcgtcactaaccagttcccagttttgacccatatcatgtacaagcacaacaagagcctaatataataaaaatgttaggttatttctgcacgatatagcaagatagaaatgatcaattattttaacagccaataacctgatcctcaaagctcgaccatggacttccagggcctgagtgactagcagccatctggcaaaaggatcaaaagttttagaaaacaggtatactagtgaatgtgcaacaaccaagaataagaatggagtacataagatgttaagaaagcaaaaaaggtatgaaagacaaaaaaagagaataatatgacgagttttttttccctttattcctctgtctcaaaattcaactacctatatattttggtcaagcggacagaggaagtagtaaacttccaattttcccccatgctgccttcgataaaaccatcacagagccacttttaggcaatgatttcagataattctttttgcacaaaatgtccaaaaactacacccttttgaagcattggacccccccccctctacctcggcgccggactcattggcgaggtccactgccacggcaccactgtgtccccctcgctcagagcagcggcggccgctcgcaccgccgctgcaatggcaagaacatgcagcaggagttcatacaacggcaagttggagatagaggagcgatggatgg

SEQ ID NO: 70587 - DNA, 2101 bp, Oryza sativa
catggctatacgaatagttaaactctgatcagaggtgtacaaccgtacccacaagacacaggcccacgacacgtttctgtgcaccgacataccaacacgacataccggaaagaggccgtgacaggacccttcacataaccccctctaaccaatcgcaccacacctcaggtttcacccccactcctcgcaagggagcggacagtcccctctcatgccacggtgaatccggaagccgatgaaccagacaccccggccgacccaactccatcacgcccacccttgcctgggtactttggctagaggaaagctacactacaaacccagccgttgcccacgctggcttgtggtaagtacgataagttcttcgactagcaaaaccatgcacccacaacccaccatgtagtgtattttaattagctaacaccattgcggtggcactattccaaagctatgccaataatcaaagtctatgtattaatgtgattccccctttgtgtacaagttgaactaagcatggctaagtattccctaaaccaacatctaatcattttaatacccaagttatcaatggcgtaagggaaacaatatatagccgagtaataggacccatcccacatgatattgtaaaacaatgcaacatttaatagaaatgcgggacatttgtaagttgggtacaatatgataaattgtaaagcatgacttgccttgctctcgcactgatgagaccacagtaacgtcttcgagaaaccgcggatcgacgaaacggccgaaatctacgcgacaaacaaagcacacaagcaaaacatgctataagtctactgaaacaggaaacaaaactatttttaatggattctaagcatttttatgaatttactgagacttgaatggacttaaacggagctcggatgaattagttatgaattttagaagattcactgtgtttttactataaaaagaaaatccttaattgaattattgcgcattaaaggccctggtgacatcatcaaacgaggaggatggcgccaacagatgggccccacttgtcatcggctcaaggacatcggtccacggtggaccaagtctacgggacaggagaggaggggcgcaccacgtggccggccacgcgggccacgggatggacggccacgatctgctgggaggcagatcgggcggctggggatgggcggggccaaagccggcccggcatggcgcacggcggcggtggctggctaccggcgaccggccggtggcagcggctggcgacgtgggcggcggcgcatcgcggcgacgcgcatgcggggagcggcggcgcgcgcgagaggaaggaaaggggagagagttctcaccgaggggttcggccggccggggaaaggcgacggcgaacggcggcgacgagcgaccgggagatggcgacgagtggcgaacgaactccggatgggcctaaggagcacaatgagggggattagagagagagagagaaggcctgctgtgagcggaaaccatggccgaaggcggcggcaatggtggtactcaccggcacgaggtggacggcgatctccggcgacagattgcgacggacgaggggtggacgaggtggccctcaggcttgcgaacctgacggcggcgacggcttggttcggtggcggccctagcagcggctagaggcggccggagcagtagaagaggcggcggcgggtgggtgcgcggtgcgagggcgatagggagctcgagagcgggcggcgaaagagggaaaaaggtggagagaggtgtggtggtcgattatatagaggtggggaggccggacgtggccgggagcggcggttccgcggcgacgacgtggagaggtggaggaggagagagaggcgggattcaaaaattgaatcccggccatctcgcgggcgctggcgtgtgcgggagtggggcgtgggtgcgggaaaagcgggggcgcgcaggggagtgggtgacatggcccgggacggcgggagggcgtggcggcggttgaggagggaggccgcccctccggctggagggtaggggcgaacccgacaggtgggccccacctatcggcgctcgggaggggagggggagctggatggacttc

SEQ ID NO: 70588 - DNA, 11449 bp, Oryza sativa
ggaaggaaaaagggaaaaaggaaaggaaaaggatttccagggaattctttaatgattgtgctgaattttaattggttaaaattatttcttgggctctgaaaattccactaaaaatcatgttagcatattttgatatgtagaacccaagaaaaattccacatgccattccgattattatttgcatttattaatttagggaataagctcaaggttaaataaacaatttcttcggtcgatttaattagacaaaatttttaaagcaagaaaggggaacttcagggcgtgacattcgccggaaattgtgtgttcggcctccctttgggaatcggcgaagtaagaacgagaagttcgtggcggtgaagggtttgccgaaggtgcgatgtccgtttcggccagtttaccgcgagatgataataaacggcaaaagctacaaggttttgaaggttgtcggctggatgcgggcgcaccccgggcgaaccctggaggactacgatcgtgtccatatagaacgccgggaggacatggctcgcttttggcgaaaccatcagaggaccgatcgtcaggaagcgatcgcccagcgtcgttatagtctagtttgtgttccacccccctccctccttaggatagtgtatgacattagtagtgatgacgaaccatgttcgtcgaatcgttccttagggagtggggattgctttgggggcggagacgtaatttatttgtaagctaggctgtaaagccggtgctatttgtacttgtatcatgttgtgtgactgcatcctccgattattttttgaaattaataaagatgtgttttatttccttttcgctgtttttcgcattgtcacctttcgtgcttttgttaggtcgaaccgtgtcaaccccattgcgtatactagcgaaataggtatgctgaattttcagctttcgtcttccgtttttggtctgtggtattccaagctgaaggaagcgcttatgttttcacatggatcgagtgtaatggcgttcggttagttatttcccgaaacaagctgtcgtggtttcaacgctcggcgagcgttgcttcggccgattcgtttcgtccccctggcgttttcgctgatcaggcgtttgccttggggtttttccacgaattatcattcagacaagtgcgaaagacacaaggattttttactggttcgggccgccaaggtggataatagccctacatccagttttttttccttttttcattttcctctttttttttgtatttttgtgctgaaaggcttacataatgagagatgccgaaaggcctatacaaaaatatgtacatttttacaagttggcgatttgggtgccacccattctagacatagaaacgcttaagggaagtggcgttccaggaatggtcgaactcttcgccttccagcgttgctaggcgaaaggagcctgtcctggacccgtgtttgatgaggtatggcccttcccacttcgattcaagcttcccggccgccaccgggttcgtcttcttccttaggacgagatggccaagcaatagctctatcagtcgaacctttttgttgtaagttgccgaagtgcttgtggcatatttgcgcatgtgttacagtgcttcgactctcacccactctaggagttcgagcgacacctcgcgcccatcttcgcctccagagaacatcacccttggtgaattagcccctagctcagttggggtcattgcttcatcaccatagagaaggatgaacgggctgaacttggttggccttgtgggggtcgttcgaatggcccagagaacagatagcatttcgtctggccatttacccttcgctaccccctcaagccttttctttagcgcctcaaggatcttaccatttgttcgttcggccgccctatttgactgtgggtgcgcgaccgaagtgaacctgatttccaggtttaacccttcacacatctctctgaacttgtcagaatcgaattgcttgccgttgtcggtgatgaattcttttggcactccgaaacggcaaacaatgttttttccatacaaacttctgtactgctgccgaagtgatcgcgccaagtggttcggcctcgatccaacgggagaagtattcaacggctgcaattgcaaacttgtacctatttcgtgccataggaaaagggccaataatgtctagcccccacctggcgaaaggccagactggtgcgataggttgcagctcgtattggggtgcagtttggcttcggccatgccgctgacaactttcgcacctcttggtttgctcgacacaaactttcagcatggttggccaatacaccccctggtgaaacactttagaggcaaccgtccttgcggcctggtgtgcaccacacagctcctggtgtatttctatcaccatttcttctccttcggcaaagaagatgcagcgaagcaagggttggagcaccccggagcgatacaactgccctgagaccagcttgtattttgtggctctgagctgtaagcgcttcgcttctgcttcatcttctgggagccagtcattcttgaggtacttgacgaatggagttcgccaatcttctgggtcttcgcccagctctgcctagtcgattgccatgatgtccaggctttctgtgggcacacttggtgcatacaagacttcaaaaaagatgcctgatgaatgcgggcctccacaggtagcagattttgcaagggtatctgcttcctcattctggcctctaggtaagtgttcgaccgttatgccggcgaagcacttttccatagatcgaactgcctccagatatctcttcattccttcttcttttgcctcaaaggacttgtcaacatgacttgccaccagcttggagtccgttcgaatgagcaagtgccgaacccccaatgcttttgcctttcttaggcctaatagtacagcttcgtattctgccatgttgttggtcgtgtcgaactacagccttgcggcataccgaatcggcacacctcctggcgaagtgagtactgtcgcggcgcctgcccccttgtgcgaccacgagccgtcggagtacattacccatggctgttcgacgggctcgggttcaggggcgaatgctggtgtccattcggccacgaagtcagctaggacttgggacttgatggcggtgcaggcgacaaaacgcaggtcgaagggggataattctgccgcccacttgcagagtcggccagtgatttctttgccccgtagcacttcgcctaaaggatactgcgatggcacagtgactttgtgggcctgaaagtagtgcttaagctttcacaaagccatcactagggcgtaggcaatcttctccatttcaatgtatcttgtcttcgccccttgtaacgctttggagatgaaatacactggtttctggcctgactccgtctcttgaacgagagctgcactgatcgccaccggcgaagctgctagataaagtcgtagttcgcttctcggcgctggactaactagggtaggtgggctttgcagattctactttagctcgttgaacgctacttggcattcgggtgtccagctaaattttcccgtgccccggagggtcttgaagaagggaaaacctttttcggctgccttcgagagaaatcgactgactgccgcaattcggcctgcgagcttttgtacttcgcgtacgctcgacgaaggcttcatttgctgaattgcgtcgattttctcgggattcgcctcgatacccctttcagaaacaagaaagcccaacagcttgcctgcacgaacaccaaaaacacacttctcagggtttagtttcataccagccgcacgcaagttgtcgaaggtctcctgtaagtcagacgcatggtcgaaagccttgcggctttttacgatgatatcatcgacataggcctccacatttcgccccaactgtttgtaaaggaccttatacaccagcctggggaatgttgctccaacattcctcaggccgaaaggcattctgaggtggcaaaacgtgccgaacggcgtgatgaaggctgtcttggggatgtcagccggattcatgtggatatggtgatagctggagtacgcatccaaaaagctcatgagttcgcagccagctgacgagtcgacaagttggtcgatccgcggcagggggaagtcatctttcgggcacaccttgttgaggtctgtgaagtcgacgcacatgcgccacttgccgttcgacttcttcaccaaaaccgggttcgccaaccactctgggtggtcgatctcttcgatcaccccagccttgagcagcttctgcacttcggcctttgctgcctcttggcgatcggcggacattttgcgcagcttctatttccttggcttggcatccggtttgaccgctagatgatgcatgatgaggtctgtcgaaacacctcccacttcgtcggggctccatgcgaagatgtcagtgttcttcttgagcacctccaggatattcttggcttcctcttcgcctagatcgccctctagcaggacaaacttcgtgggatcggcgtcatcgacttgcatcttgatcaccttgccatgaggggcgggcttcggcatgcgtttagcatggtcatgtggttcggcctcgatattgtgcactgccctgttgattgcggccaaatcgccctttgatgcggtcaaaggttgaagcctcttgatgacgatcacgcctgttgggcccggcatcttgagcttgaggtagttgtggtgggagatggcttcgaacttgttcaaggttgcacggccgaagatggcgttgtagttgtatgggatgtcgatgacatcgaacagtatttgctcttcgcgcctgttttcacttgtgccgaaagctaccaccagttgtacttggcccaaaacttgaactgcttcgccaccaaaaccacgaagtgaggctggtgcttgggtgagggctagggttggcaaccccatcttgacgtatgcttcggcaaagatgacatcggccgagcttcccccgtcaaccaggattcgccggacttcgaagccaactacctcggccgagatcaccaaggggtcttgatgtgggaatagcaccccttcagcgtcttctggcccgaaagagatttgctggttcaagtacctcggagccccttcgcctgccgcggtgatgttgtgcaccgttcgcagctgcatcttcttctaccgcttcgactgttggactggcggatcgtcccttgtaatcatttgaattactctgcgctggacatcctggcgctgttcggatgggggagcttgttcttgagcggcttcgcgaggtgcttcgacagcagccccttgctgcggccttgggtcttgagcgttgccacgccgccgaatgtttcggcattgctcggtagtgtgcgaggatcacccgtggaatgcgcaatagacgttcttcctgaccttcttgcgaataggctactgatggctgcctgcttgctgagcatcgaactctttgcggagggcttggacctctttgacagccatcacagccttgcccgtgcggtcatttctgaattttctccacgtcatgggagcttgacttggccttggcggctgtccctgattcgccagctgaggttggcgaacggtgagaggagtcggttcggcgacctgtgcttgtacttgggcttgggcagtggcgatggaggctttatcgtactcggcttggattgcttgccatcgcttggaatcctcttcgcctcttgcgtacccgtcgatgatgcgaagcaggtgctcgagtgtctgcggctccttgttggcgattttccttgtgagttcgccttcgagcagcccggccgaagcggcgttgatgatagacgcttcggttatatcttgaacttggcatcgggcttgcgagaaacgacgcatgtattctcgtattgattcccccgggctctggcgaatgccgagtagatgctgctgcgtcttcggctcctcataggtgcctcgaaagttaaggacaaagacgtcgcgcaattgctcccatgagtaaatgctattagctggtaaattgaaataccaagaacgggcgatgccatctaaagcgagatggattacctttgccttggtgttttcgtcgctgtgagcgacttcaatcgcggactcgtagatggacagaaactattttggttccgtttcgcccgagtaccgcgggacaggtgggaacttgaactgggttggtattggatggatcttgattcccccactcagcggcagccccttttcgccccccgatttgccatgacaccttgctgcgaaggcctgtttgtctgtggatatggcgtggcgaagggcgaagtcatggcttgcgtgtgtggttgcaccacagtgttcggctgtccggccccaaacagcgatgcctggggtgccgccatggatggatcgaacgaaggctgggtccaagccatagcggcctggttcggcgcctgatttgtttcgaagcctagtgtcagtgcctgtggttgaatggttggtgcttgagcagcgttgctggagtcgaactgcggtcttgactccaaggcgaagcccccggaccaggctggttcgacgtctgccaactgggtgcaccttgacttgtgttcccctccggtcgggccgaagggcttgtacttgagatgttgtggggttagttgagttgctgaaggaaagcttgaagctgtgcctgcaaagccgaggcccctttcgccattgcttgtgacatttggcctaggtgtacttgggcaacgaccggccgaacctgcggttgtacatgaggggtcgggtgtacattgcggccgaaggctgcccaacgaagtacactggcgcttgtatggcttgtggtggaaaggcctgagttgatgcttacgggtagacttagggtggaatgtagcctgctgaatactggaggattggggccgaagcgaccttagcttgccgtgctacctcctacgcctgctgctattcttgcatctggcgaagcatgtcttggagtcgggtcatgttttggcgcatggcctccatgtcggcttcggcttgtgtttcgaggttggggttgacttgcgtagcggcgagcgcagtcgaagccgttgccgactgtgacgaagcagcttggggcaccagcagctggcttgtcgaaaggatctccgccctggtctggagcgcccttgctgccacagctgccttcgccgtgtcgaccgtgttcggcaccagccccgacgaagcggcaggagccgaaggtggcggttgcggtgcaggtgccgaagccgacggtgcccccccggcttcgatgatgggcgccgaaggatcggctccctcttcggcggccatctcctctcctgcttcgctcccctttcgcttcgcaaccttctccttcacgaccctcttgggtggcattcgccctcagtggtttcgctcggaggtccccacggtcggtgcaagctgttgtcgaaatgataactgcatacatcgaaggacgtggttactcaacagtggttggaaagcagtaaaaatgtattaaattgagagtttttcttcgaaaaatccccctttacatggccctagggatctatttataaccctattacaggcccccccccctatttgggtttaggttttacaggggaatttacatggttccccttataaaagggacatttacatgggcatacagtgcaattgaggtgcatgggcctctaatgggccaaattggcgatcgctggcccaatggccaacgggccgaagcggctgggatggccccttgggccttcccggagctggcctcgatatggcgaagtcatcctccttcggcgttcgcccttcgaccttcgcccaggatgcacggtcttcgccatgaggcttcatcctttgtcgtcttcgctgcatagtcttcgccatggagcttcgccctgataagcttgacgccttgagcctgaaccctagttggttgcatggtttcggcaagtctggtcgaagagtctcgtgacataccgccaagactaccctaatcgacaaccaagaagcaggctaaagattatagttctaagcacgacttatgagatcaaacttaactgatgcagccataagtatgaaaagaaagacaatatctagacaatcaagccattggcagcttcatagagtggtagatatcctatataatctaagttaacgttggtacttaacctaatcggctgccttctagcgatagatgttagccgactggagattagataacaatattaccagagattatatagaatatataataactcgacaacttacataaacaagattagagtatcataaagatggaagcactaatcccgagaacgcaagccgccataacaagttttacctctagttgaagatcaaaaccgatgcagctcaacccgaaagcaagaactcgtcgaaacaaaacgaaagtaaagggtggcgatgcgccgagattgtatttgagcgtgtgttgtttattacatggggctcggggtctatttatacctgagattacaaaatatgtccttgtcggacacgactcctatctctaacaaactctaagataccataagtctttgcgacagacttttgcccaaacttatctctaagtaaattacataaaatatcgtaattaatagatacaattgccttcttaggactcaatccgtgtgtggcaatccatatgaagcacttcaacctaacccgatgacgtataccgagtcgtattgtcggaatcggctcaatcggctaaccttatccgactcgaactctgccgatcacggtcgcagccgattcggacttagccgtttcacgctctgtttccggaacgatcttcgtcctcgattccgcttcgatttgatcttcatctccgatgcttagattaccaaatttggtcattaacatttatatatccgattcaaatttgaatttgaattcaaatattttttatatatagtatttctatacatctaaagtttatatacctaaagtttgtagacccaaagtttataagtcaaaagtttacatacccgtttcaaatttgaatttgaattaaaatgttagtttatagacccaaagtttataagtcaaaagtttacatacccgtttaaatttgaatttgaattcaaatatcagtttatagacccaaagtttataagtcaaaagtttacatacccgtttaaatttgaatttgaattcaaatattagtttatagacccaaagtttataagtcaaaagtttacatacccatttcaaatttgaatttgaattcaatttttttatatatatagtatttgtatttctatacatattttttccaactttgtttttttattttttaaaattgtattgtgtactgtagtataggggagggatgggagcgtatagggggagggatgggccggtgatcgctaagagcgatcacccgcccattagccgtccccgttttggattgctaccaaaacttagccctaccaatattttggtagtttaaataggacatgtgcttggtttggattgaaaccaatttattggtgatgcccatgctagattcggcatcaatctacactagaattcatatgttggctttattttggtagcaaaccaaatacatctttgccctacccaaaaaattgatattgccaacattagcctaagtttcagcactaccaaaaacttggcatggtagcactccaaatagacctgctaatgtctgcaacgactcctgccgtcccctgatacaagtaattttgggtggatctgacgcttccggacatgtctccctcccacccaaaatcccttatattatgggacggagggagtataaaatataagcccatgtacaatcctaatgttgaagttgctgaatcatacaagaatcgatgagcctttgatgttataaaatttgattattaaaaatattgttggtcaaaactagcaccttaaagtaaagaaaaaagtattttatgaaggtcaggaatatttttttatggtatattatatttacatgtgttttatgatagtttaaaatatcaatttttaatatcttttttaaaaaaataattttaattcattttttttttgtcctcgaataattatcactatctcagtttcatttatcatccatcagctagacatgtgttcatagttttctttttctttttcatgatagaaataaatccggcctcttctttgagacatataatgcgtgaccttaattattacaatcacagcatacagttattttcatgccccccaacattgaaaacaataaatattatcatatatataatttttattcgatgttcttcaagaggtgtacatataaattaaattttcaatgtatagctaatcgtgttgctctcatgtcctattcccaattcaatgcatgactggaacttgtgcggaatgtggataaaattcacaattcaatgcacgaccaaaaccaaacatattgttagcaggtaaaataaaagatagcaaacaaaatatattgaggtgcaatccttttgcgcacttgcgaaagaaagatagcaaacaaatcagaatactgaaaaaaatccttattgtcggagggtgaactcctcaagcgggggatggagaggccccccctttgttagttcggttgggggcagcaggtgaaattcgagaactcggtggaaagcgtgatgtagagggggtcgggcccctcaagaacagtaagacaaaatgggtttatataggttcgggtcactaggaagcgtaataccctactcctgtgtttggttgagcgattaagaattgcaggtgcttgagtcatcgagaaacaagcgtgagcttgccaaaggatcgatccctccttctctcactaggcttggacttccttttatatctcaaggggctgccacatggacctagagctctctctaggggacagggaggataatcgcattaaaaacatgtcttgttccttgactcggaagccacccacgagcgccttgatcgtggggcctatcaaatcgtgccacctgacacgagggacgctcgtgtcattcgtcatttaatgggtgaagacttctgtgtccccattcgcgcaacggagatcttgttctaaccgtagcgggcgaatcgactccagctatgatgatgaggggacagggcgggccgcacgccgcctatcacacgcgctagtgcacctgacacccctggtcccatcggtcattcaaccggtcactggcccgtcatacaccggtcaggcgcgctccacgcagcattaaatgcggcgtggcgtgcctgctcaagccgccataaatgcgggtaggtgggcgttttggagacagccacccagcccatcgtacgtggcgacccacggagggggtcgggggagttacaaagggggcatccgccgccctacctcgggtccgacccccgtcgggggagggccacgtggcattggggggcagcctcctcccttttgtctt

SEQ ID NO: 70589 - DNA, 18359 bp, Oryza sativa
  unsure (1)..(18359): unsure at all n locations
aatgtgtgtgtgtgtatatatatatgtatatatatatatatatatatacatatatgtatatatatatatatatatatatatatatatgagttggattttttaccacgcgagttcacatgtacccacgatctacaccctatatgtagcttgcacgaatcttagggcaagtgtgtgtctatatatatatatatatatatatatatatatgtatgtatgtatatgaaaaatccagatttgcactcgggttcacatgtacctacaatctacatcgttgatgtgttccaagattcgtactgcaaaatgtacctaatcttaaccaaatgaatgcttactatagggagaaaagattagcattaggttggttcacaatatgtataacatgtgtgttgcattttttaccaaatatttttttcaataataatcatatatgacatttatatatctagtgcattgtatttctctaacccttattttgtttataacatgatatttagtcaaaatgagaaaaacaatatctactatatcaccaaattatcatctcgcaaaaatgatacttccaaaatggtatatatcctaccataaaaactatataaacaaggtaatttatataaaaaaggtaaactacataaacaagttttgcatacaagaaatataaaaattacataaacaaggtattttacacttgtaaaaaatatagtataacgtaaacataatgcatgttacattttgttagcaccatatatatatacatatatacatatatgtatatataatatacatatatgtatatatgtatatatacatatatatatatgtatgtatatatacatatatatgtatgtatgtatatatatacatatatatgtatatatgtatatatatacatatatatgtatatatacatgtatatacatatacatgtatatatacatgtatatatacatgtatatatacatatatacatgtatatatacatatatacgtatatatacacatacatatatacgtatatatacacatacatatatacatatatatacacatacatatatacatatatacatatatatatatatatacatatatatatatatatatatatatatatatatatatatatatatatatatatatatatatatatatatatatatataacacaacacttaaacgcttatactgaacataaccaaataattaaattccaaattgaattgatttggtgtgggggctgaaaaaagcagctaggggggacaacagtatcatacatatatacagaccagtccttgcgtgaggtgagaacaggaagaacagattgtactgtgaaatatatttcgatacttatacatcttgagaatgactcgccaacctaaagtgggtgaaaataattgacaatctacctgaactaatatttggtgaatgtatccccatcgtatgggtgtgatctatgaaacataaggtttaagacaagagagaatctattctataccacttagtgtgttcgagttcaatgatttactatagacattgtctctttttataatatatcaacgacttttattaattgttctacagtacaccattggctgaaacttctattcaaaaatacccaaaatacccttagagacatacaagattaacaattgatttatctcatcagaagttttaaaaaaatatgaaaatttttatgtggcctctttacacaatttggaagtttgtatacaagtttcaagctttttcaagtatatttagtttttagaaaaaaaacatttttaagtggtatatgagggagaatttgcttatacaagaggtaatagcataaaaatatcttatatagtgaatgaaagatgatttatattgaaaacaacaataaaaaagtattttatatagcatataacaaacaagttatattttgttaaaaaaataaaaatttagtaaaaaacttgaaacttctatataaatttccacgttgtgtaagaaagccacataaaaattttcatatttttttaaacttataatgagataaatcaattgttaaccttgtatgtccataagggtattttgagtatttttgaaaagaagacccaacataatggcgtattgtagaataattgataaagtcaccggtatattatagaaagcaacaatgtcgatggtaaattattgaactcgaagaaactcaatggtataaaatagattctttaagagacaatccatacacttatatagtcagttaaacattatttatggcagtgttatggtaaccaaacgtacgaagagtaatatctttactattataaaaaataaatatgtttttgtcagtactttgttacgtcatccgtatataagtcgattttgaagttcgttcgtttttggaaatatatatctgtatttgagtttgttcgcttttgaaaataaagagggagtcatataaggaatattttaaaaaaacctgcatgctaacttggaatgatcggactcctaattatagctcatgatttttttacaaaaatatatatatccaagcgaattctcacaataaaactattataaaaactgaggatgtttttactgctactttggtacgtcatccatatatgagtcggtttttaaattcgttcgcttttgaaaatacagatctgtattttggtcgggttctaaattcgttcacttttgaaaatacaggagcaattgtataagaaatctctttaaaaaaaacttacatgctgatgattagactcctaattgtagctcatgattttctagaaaaaaaatatatctaagcaaattctcacagtgaatctcaccttcactaaaccatataacaatagtcttcccccgttgcaatatatgagtattttttctagtaatatagaatattacgattattgcaccaggctcttaagatgaatcgggaagaaaccttttctgctgcagtggaatccttaatcatgtccagaggtaaatcaattcacagttgcatttataatttattttagaattgttcatgctcattcaaagtgcaaatgaaatattggcataaatagagctcctgtcattgtgtactcactttattttccaatcaatatgtgaagtagctttttctacgggtatcatgattttgctacaaaatcaaccatgttggcatatttactaagcataattttgatgaacacctacctgtgaaaaggaacatcatagtgtattatctatactaatactaatataaaaagggatagctgttaccagtgaattttagtaagccccgaagttatcatcggtctagagtcgctttagagtctatggaatcggtcgatgggaattatcaagtcaccaatagttagattcttgatatatttactaaaggaagtttatcaagaagagaccgagttcaaaaaggatacggcataacagtttatctattaattaggaataatctgttagtttccttttatctttaagaatgtttctttcttgcctaacaagaactagtatctatccatggatataaatatgtacacccggggtcattgtaaactatctcatagatcaatacaactactctcggcgtatcaccaccctcttttccgaggtttttacttatcatcggcggaacttggcacctgacgtggggctgcatcggctttcaatctccggcgaaggggtaagtcatacattctgtcggtcctaacaatcgtatcagttacgttgttgttgtttaaggttgcatcgttctcgacctcttggatctctctagtttggttggtatgtttctctacctactcccttcgtcccattttaagtgtaaccatgagttttcacgacccattttaatcattcatcttatttgaaaactttttataattagtatttttgttgttatgagatgataaacataaatagtacttttctcgtgacttatggtttgaaatttttttaaaaaaaattcaaataaaacggacgattaaagttggacgcggaaaatcatggttgcacttaaaataggacggagggagtacttatcatatatcttagttaatctagtcttagaatctcaatttagttatatcggccatttttcgctttggggtttatgctggtattggctaaatcgttttactagattagattagctaaggtattcaccaccctcaaaggcttgattgtttaaactttatgcttctttgcatactttgtgatgtatcatccctagtcgtgtttcggcacggccacggccacccgtgggttcctgtgagttcaccgtaggaatgctagtagggaaaaaatgaaatggagggagcagcatatagggcctatatagctggccaaaaattttgtcctacatatcacatcagatatacagacacatatttgaagtattaaatgtagtctaataacaaaaacaaattacagatttcaatagaaaactgcgagttgaatttattaagcctaattaatccgtcattagcaaatgtttactgcagtataacattgttaaattatggcgcaattaggcttaaaaattcgtcaggtaattttctgaattacctggcgaactgtgtactttatttatttttttctatattaatactctatatatatatctatatatatgtctaaatatttgaggtgacagagtgaaaaatttcgtttgtgaactaaacaagacccatagatgaaacgccttgcgattttccgtaaaagattccgatgttttgggcttgcgtcagtttgggggctcaatattttcggtagctctctccgaaacagacaccgcccagcccaagccaaaccgactaggaaaacacgggatcggttttataagggaagcctatccgtatcgtcgtcgctagtcgcaaactcgcaatcccactcccacagcaggacaggccacaggtcctcccaaatcagagaaatcttgaatctcgctattcacgcggctaggcaagcgagtccggtctttcctcccgtcgccggcgagcggctgaggcggccatccctttctggataggatacgacggctcgcgatcccctcccgcaggcaccgagcgcagtcggtgcccggtgaggtgagttgtctgataccagtgaaaagttttttattattattattttcggtagctttctcattgataattttgggtaaatttcatcgctgcctcaacaagattcgattcaccccttcctcgaaagaaagaaagaaagaaacgttattcccctttgatagagttttagcaatccgtctgtaaattgtttgctctgcatcttttgctaacccaacggatataagaaatcatggtttgatttctattgaaaccaccgctgcctgataagtccgaacccgatttaataaaatgtctagtccgaaactaaataggatcgaagtcgagtttcccgattagtacagacaccgaatactccattattatattatgatgtgcaaagccataactgattatgcttaattattttctgcagtttgatattgttggcatgatggcgaaacgatgcacggacatcttgctagctccccggccacgaaagacgaagcggattgatatcaattcttgcagatcgaggttcttgctcccttacatcccggatgaggtgatgttcgacgttctgttacgactgccatccaagtctctcatgcggtttaagtccgtgtgcaaggcttggcacgccatgatatcaagcccaattttcatcaacgctcacctcgagtggtcaaagctaaagccatcatcactgctcatggctcctggcttttaccagaagcagaagaacggtcagaatattgcctttctgatgggcctctataagtaccagggtggtaataataatgtagtgcatctgcatgattttccacgtgattttccgcaggtattggatacatggactcgccctgtgcactgcgatggtttgctccttgtttccaacatgagcaaaaaaatgattatctacaacccatcaacaagagagattgtttccctgccaaaagggagccgtaaccttcataagggcacagggattggatttgggtttgaccctcgcagcagcaagtataaagtggcgagagttttttatcaaagggatgacaaaacatcaatgttggtctgtaagtttgaagtgcttaccctgggcactattaatgtatggaggcaaactgaagacccaccttatccaattggtaagtcgactccagttcatgtgaaaggcgctatctactggatggtttctcgaacatcactttgcccagatccacccaacacacttgttcgattctgtttgactgatgagaagtttagtctgtttccatgcccatgcaatgtaaagccttcctgtttgaccggattgggggatgaattgtactgtggctattttttcagtcaaccactccaactggagatttggggttgtagtgttgttgggcagaaacctgaatggactcgacgctgcgctttacagattccacctgatgttattaagcggcctgtagcaagtcctttggttgtctttcatggaaaaatgttgctgttggcgttgaaaaaggtctacaagtatgacatccaagcctgtaaattggagaaaatacctttagtggttgaagacttcatgtgctatgaccgcgaaaataatatgtaccagacatattcaaagaaggaagtaatggatttccatctatttaattatgttgagagtctagtttcgattagagaattttgagaaatcattcttctcgtgttgtgttgaggagtgatctaaggttacagtagatgcctttctttctgagtagtgtcaaccatagacaattcttaatgagttggatgtatgctttctttttcgaagctaagtggtttaacagtaacaatgtattgttcattctagtattatgaattttcctttactctcatagtcctgttcattttgctgctgacatttgtgacattcttctcttatttttgccaacgttttattaggtacttacaagttggaagacttacatctgtcatgcaaatactcttggccatgtttttcttcttgtcaattgaggtatatattaacatgttaacatatcctgtcagttgagatatatactgcaacgaaataactatctgcttctgctactactaaaactgcggaaggtgctgacaaagaaatgtgctaccgtcctcctactctttcagacgatgatttttcagaggatgagaaccctgcagaccagcagcctagaagagagactgaaccaagctcgctcctccaaattattgattcttggcacaatagtaaggatgtctctagcaaaaaaaactcgagacattgatgggcttgttgattgttcaaggagtgagacttgctgcttccatccccaaattgcagcagttagcctggtaactttctgaaagcacaagtgctcgttgtttttgatcaatcatacatgaaacaaaatggcactcctatggttatctgtctactcaaaatgtatgttcggctatatatactggcaggagtcgtctaacaaagtagcattcttttgtttttctcagttgaagagggcacgtttatgatgtcatatggttaacaaagtctagagttctagagttataatgaggaggaattctggaacctgaaagcttggtagtttttagccaagatgttattatcatttgctctggtgagggtacatatcaataaggtggatcagtctgattctttttttgaaactttcctcgcatttgatgccatctattgttctccttttatgtttgtctatcgttattcataaattgttgttttccacacttaaccacccccaatggaagctataaaattattcaagctccagaaggggtagtagttggactccaatctgtaggcaacatcaaaatttgcctggcacgtacgaatagtggattaatgttttatcactttatttctttcctttcttcttnnnnnnnnnnnnnnnnnnnnnntggtttatcactttgggtgttgaacataggagcaccaggaggggcagtagttagaatccaaactgctgctgtgctctaagattcctgcgactctcagagtagtttataatccatcttggatttgttgcattactacacgcacacgcatactggatcaatggtctattactgtttttcttttctttttttcctcaaagaatggtttatcagtttgggtgtttaacatttgatgagctagtaaacttgatttggttaatgaaatctgcagtatctatgtactgcaggagccacacagagtgtttatttggcttgctctgccaccaatcggatttggatagtctcacatttatttgaagctaagtaacaagatgtcgattgatgtattgaaacatttatgtcgatgaggatataaatccaaaacaataaatgctagattgaaaaaaaaaatgatctaataattatagagagcagatcatctgaattatgtagtgctacaatcatttgaaaaatctatgccaaacattaattgatgggaagacaaatccatatcaagaaatatcatactgaataaaaatccaatggatagagtatataaaataacacaagatcgccgatttggatgtcgacgtcatttctatctcaatccaatccgcaagatatcaaaacatcaatggacacaaatctaaatgccaggattaatgcaggattaatgcaggagagaacatatataaattcagaaacagattgattattcattaccttttttttagaacagattattcattactaggattgcttaacgtctatgcctgaatacaaacaccagcaaagaaccatatatataatgccaatgagcaagacgaaggagaaaaggtaaagagaaattcagaaatactcgattgatctgcaacttcttgccatggcacccatcaagatcaataagattatcgctgctactttcttcatggttcttgtgatcatgtcctgcgccctcacatccacacttgcttgccgtaagttgctagtctatccgttccaaaacataaccatctttctaatttaaactgcaaatgtagctaatttaaactaaaaagttaactatattttgaaagatggagcattcattactcttctgtgtttttaattgttttcacgattacataaaagacaaaacacaccaccaccacatacgcacatataatatcatttctttagcagcgagagataatccataaactctcatagaatactaactctctccgtttaatattataagtcgtttgacttttttctttgtcaaaattatttaggttcgatcaagtttatagagaaaattacaacatctacgacacaaaattagttttaataaatttaatattgaatatattttaataatgtgtttgttttgtattgaaaatatcagtatatttttctacaaacttgatcaaacttaaaaaaaaattgactaagaaaaaaatcaaatgatttataatataaacggagggaatattaattaatggattggtattgttatgtgcagggggtgggacggagtgcaccgttgaaacgccacactgcacaatggattcatgcaatgcaaaatgcaaggcagaggccagcagccgcaagtgcaacaggatgactgctagttgccacaaatatgctagacttgagaagtgctgctgcacttttcacgcaaagtaatatcgacagtgacatcaaaataataataataataataataataataataataataataataataataataataataataataataatagtatcgacggttgatgacaggattattgcatatggttagattaatctcatggaacctcttatcgctttccgcgtataaattgatccaataaacatggttggctttatgaatcattatcatgtgtcctgcctggagttctctttctgttttctcatgtttcaaatataggtacgtgtgtgcgtagtgtgtttgtattgatatcggagtatatgttttggcaaaatgtgctgccagagaagtgggaaccaaagtcccccgtcctcggttatttgggcacatgagggcccgccaccgctatgatgaggcccgccacgaagcgaccaccgattgcctcaaggtctgaaggaaggtcgtccacgtgtgctggctcagaggttgccccgatgtaggaagggtgcctcaagaacagtgccaactcgagcgtgctttgactgccagtcaatgggccagggccttgaggtcggccttggggctagaagcctttctcagccacgccaccacaattaaggggatatgacccggccgcatgtgctctattaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggccttatcatgtcatccgacattaatggtggaatgacgtggttcctgtggagaatcgtgggccatcgtgtacaacggaatagggcgtatgatcttccacttgcccatgtcgcccctaaaaaagggtgatgaacgggttgccaggtggcacggctttataccatgctgcctgtcctggtccgctagtttatggtcttctacctagtctcagtgcttgacagttgggccctatgacacccaggacaccctcctccatcacgtgccatgcgtcagaagggagtaggtgttcacatcaaacagggccctccagaagggccaatgcaagaccaaggttaccggctcctgtacgtaggtgtgtgtccaggcactatggtatccccttaccttaataaaaggaggactaatgcctccaaaaagtggttcaaaacctaagataaagagagactcccctctagtggtcacaaaaaagcttgaagaacattatgtaaactaagtaactaagcaagaacataaaagcagggtgttacgctcccaagcgacctaaacctgtcaatatcacttgtccattgcttgtacatgcgattcacatccaacctcgaacacttgcaccctaaccaaatctcaagagggggggtatctttccttcctgctagaggagctcgtgcttcaacaactagtgcgccaggttgggatgaacatgtttgagcttgcgttctcacatcctccattatcgccaaagggccaaagggatgccatggttggagggcatcgtcatgtcgattatgagggtgaagccagggataaggaagcggctagcgagcctttcagtgtcgcccaaactccgtcttgcctgtcgcattcttcgtcgagacgcgttgtgtgccctcgacagaccaaccatcatcatcacctcattgcacgagcggtgacggtcctctcgctcgccaaggggctagggagtgcccaactagctcggcgacgaccgcttccatcgtcccaagtgaaaggacacaacgcatttcggtgtagtgctacctcaactttgattctaccacactggggtgtgctccttgcagcgaaggcactccttcgtcatccgccacatcgggccggcagtggcactcctggggggccaatggatcaaggatgtggccaacctagtgggtgtcactcactgccaaattgctgtgcggaacccctgctccggctccatgtcgacgtcccatgtggcgccgagagttgcacagtcgcccattctatcaaaattaatttatgagaagacataaatccaaatcaagaaattcatgctgaataaaaatccaatggatagagtataaaaatacacaatatcaccgatttggatggcgacgtcatttctatctaaatccaatctgcaagatatcaaaacatcaatgagtacaaatccaaatgccaagactaatgtaggatagaacatatataaattagaataaatttagaaacataccgattattcattactaggatagcatggcgtctatgcctctatataaacaccagcaaagaaccatatatataatgccaatgagcaagacgaaggagagaaaaggtaaagagaaattcagaaatactcgatcgatttgcagcctcctgtcatggcacctgtcaagatcaacaagtttatcactgctactttcttcatggttcttgtgatcatgtcttgcgccctcacatccacacttgcttgtcgtaagttgctagtctatccgttccaaaacataactatcttgctaatttaaactgaaaatgtagctaatttaaactagaaagttaactatattttgagagatggggtactctttactcttctatgtttttaattgttttctcgatcacataaaagatgcaaaacacaccaccactagatgtgcacacatataatatcatctctttactagcgagagataaatctgcaaacccttatagaatacttatttaattaatggggttgctattgttatgtgcagagggtgggacggagtgcaccgttgaaacgccacactgcacgatggattcgtgcaatgcaaaatgcaaggcagaggccaccagccgcaagtgcaacagtctgactgttagttgccacaaatatgctacacttgagaagtgttgctgcacttttcatgcaaattaatatcaacaatgacatcaacatagtaaaatagtactagtggttgatgataggattattgccgatgtttagattaatctcatgtaaccccttatctatctttattgcttccctctataaattgatccaataaacatggctagttttatcaatcgtatcatgtattcatgtgtaagtgttcgcatcaagcagggccctccagatgggccaatgcaagaccaaggttaccagctcctatacgttgggtcctacttgtgtatatccaggcactattgtatccccttaactttataaaaagaggatcaatgcctccaaaaagcagttcaaaacgtaagacaaagagagactccctctggtagtcacaaaaaagcttcaagaacattatgtaaacactaagcaagaacacataaataaggtgttacgctcccaagtagtccaagcctatcaatatcacttgtccattgcttgtacatacgattcacatccaagctcgaacaccgcaccctagccgaatctcaaaggggggtatcttaccatcccgctagagaagctcgtgctccgacagctagtgcgccaggtagaggtgcacctgtttgagcttgttttcccgcatcctccattatcgccaaagggaggccatggctggagggcatcgtcatgtcgattccaaggggaaggctggtgctgaggaggtgactggcaagtctttcagtgccattctatcttgcctgccgcgttctccgttgaggcacgttgtgcgccctcgacgagctaaccatcatcatcactaggccgcgcgagcggcggcgaccctctcgcttgccaagggcactgggaagtgcccaggtggctcgatggttgttcccaccatttggagggagcaggcacaacgcgttccagtgtagtgctgcctcaacttcaattttgccacaccgggggtgcgctctttgtagtggaggcactccttcgtcatcactcacttcgggccggcggtggcactcctaggggttgatggatcaaggatgtggccgatctggtgaggtgttgctcaccgccaggttgccgttgggaaccctgctccggctccatgttgacatcccatgtggtgcccgagctccgcacagtcatctattctatctaaattaatttataagaaaatataaattcaaatcaaggaatatcatacttaataaaaatccaatggatagagtataaaatacacaagatcgccgatttggatagcgacgtcatttctatctgaatccaatccacaagatatcaaaacatcaatgaatacaaatccaaatgccagaattaatgtaggagaacacatacaaatttgaataaattcagaaacagatcaattattcattactaggattgcttgacgtctatgcctctatataaacaccagcaaagaaccatatattccagtgagcaagaggaaggagaaaaggtaaagagaaattcaggaatactcgatcaatttgcagcttcttatcatggcacccttcaagatcaacaagactatcgctgctactttcttcatggttcttattatgtcctgcgccctcacatccacatctgcttgccgtatgttgctactcttgctctttgttttttttgggagccgttttggattaaatctcaaaatatatcctatcaattctaacgcatgtactcaatttggcacaattataaatccttctttatcataatataaatttagcttccaattatcatcaatccggacacactcatctataatgctaccctatcaaaacattgataagtcctagtactatgagtgtctttaggtattaaaccaaacaaaccattaattattttctcaattatataaaaggcacgtaacataacatgcgcataccacatacacatgtattatcactgatttagcaactagagataaatccgcaaaccctcataaaatacttactaattaatggagttgttgttgtcatgtgcagagggtggtacggagtgcaccgttgaagaaccacactgcacaatggattcgtgcagagaaaaatgcaaagacataggccaccaaccgcaagtgcaaccgaatgacagctagttgccacaagtatgctagacctgagaagtgttgctgctatttttatccaaagtaatattgaccgtgatatcaaaataataataatctgcggttgatgacaggattattaccgattgttagattaatctcatgtaaccccttatctatctttgttgcttcccccatataaattcatccaataaacatggttagttttatcaaactatatcatatgcgctgcttggagttctctttctcccgtttcgaatagtacatgtggatttacttgtgtgcctgtataactatattgatgtcgatctttttaaaagatctatttatatcttagacttaaaaatataccatagattcgtatcacttactagatttgtattacacgactgcaacataatttgttttcttgttttgcctagtcaaaaggctccttgattcatgttcgataaagcgaataacattgtgtttcatctccaaacttccacgtttggacttatcttataatacaaattcgatgcaaaaaatcgcaatgagaatggtgccacgtggcaacaccggtttcgtggaagaggctcgacgaaaagatcttgcgtgtgcgcgtgcaacgatctgctcttgcgtgcgtgcgtgcaccggccaccagatggagtttcttccagaagcttcttcacgaatgtatcaaggagcaattaggtccatggaccatggctcagcaggcagtgcaatggcacacaagaagatgctggatgaaacgagatattaaccatacatgtaggatgtaggagtaacatataaatatccggtgctgcggtgcatgctgatcaatgcaaacatccagtgcatgttgatcgatgcatgaattggtgcatgctgatcaatgcaaacatccagtgcatgttgatcgatgcatgaattggcacattcagtagtccgtactccctattttgtacgcacagctttgattaattttcactttctttgtactctcttcgtctcagaatatagcaatctagtacttaatgggacatatcgtagtataatgaatatggacataaactacacaaggatatttttaagctcttcaatctcccgtctagattcactaatgttcatataaatttcgacatatatatgaaacacatatattgatccatgtataaatttattcaaaacccaaaacatcttatactatgaaatataaatttattcaaaacctcaaacattttatacacatacattgatccatctatgaatttattcaaaatccaatcattttataatgtgaaatagaaatttatttaaaacccaaaacatcagagaaaataagcccataattaagtggaagtatatactcatttgttgtataccgcgttttttctagtatactaccaaagtatacgaaataggcagcatctcttccatgagagaaaagaaatgcttccggaaaggaagcagcaaaaacgggacggaaacgttagaatacgacttctccgtgacagctcagcagctcattctccctcttctggtaggattccccgtcagcatgtgggccccaccgcacgccggtgcgccacgtcagcggatgacagttgcaactgacataactgcccccacctgccgtcttctcctccccccccggcccgtcctctccacggtgggccccacgtcgggacagggtcaaagtcccgctctccctcgtgtgtgatctgacggaaatgccccctggtgtttctcgaaggagtaggggtagtaccgtaattttccgtggacgctgtcttggtctggggaacgtgggctgctcgccgtcgcagactcgcgccggggtcagccagggtgggacccacctgtcagagtcccgcgttcccagcgcgtcgcggccgcgtggggtccctctcttccccccgttagccatttgttcccattcggttttgggcttttggctaatgcgtgattagtcagactaattcgtgattagtgtgtgtattatgtagctgatgttaccattagtgtttttggatctaagcgtgcaattaatctctgtgccttgctttgtagagcaaaaatgcaactctttgagaagccttacacattaatgttctttgtctaattattgactagaggaatatggttttttttccctcaacgattgcaagacttactacttcaaaaagaataaaacagttgcgggtttaggattttctattccaatctgttagagaattggatagcaaaagtggtatttggagtaatcagatgatcagctacaaagcaccacacttgtaccttacatggctcatgtgtaattgatctgtttgatgggctactataattagtagcagaaaatgcaatgtacttttatatgaaagatttcttcaatcctttcctcaattggtccattgggaatcctcatggccctttagcagttgggacaaacccacaaacccataataatggaaacatgtcaattgtcaaagctcacaactactaatcacatcccccacaaaaagcaaaagcatcattaatcataacaaagaaaaaacctccaataagttgagagcaactaactagtgacaagtactaattaattacccacatctcccaaggacccaaatgcaaaacaactcaacccctccacacacacacacagaaaaacgtgtaccaaaaaaacattccaaaaccaaaaataattatcagcctataaatttattattatttatgtcctccacacacacacaccacccaaaatcatccgattaattaatttgatttaatgtaatgtaattagggtggtaatctaaaattaatcacccctccccctcctaatctcacgccctcatataaaactccccacccgctgttgcttccgcatcacccattccctttttcctttcttgcgccatttcccaccgccgccgccgccgcccgcgcgcgcgcgagatctcgccggcgatctcgccggaggcgatgccggtgacggaacaccagggctcgtcgtcgtccccgtcgaccttctccttcggccgctccctcctctctctgcgccgcgaccacgtggccatgccgtcgggcgaggaggccgacctggaggcgttccagcgccatttcgcggcgagcctcggcgagctcctgcctggggaggtggaggggggaggcggcggtggtggtggtggtggtggtggtggaggggaggagatcttgtccgtggcgtggatccggcggcttcttgaggcgtttattctgtgccaggaggagttccgggtgttcgtggcgcaggcgcgacgccgcggcgcgctcccggcggccggggagaagctggtggtggagttccatgagagggcggtcaaggcgctcgatgtgtgcaacgcggcgaggg

SEQ ID NO: 70590 - DNA, 646 bp, Oryza sativa
gcctgaaaaatttgcaaattgagctcaaacactccgtgtatagttcttcaaattgatttgcgctggcacgtaagatgtttatattccccagcccgcttccgtcgttcatttgacgtattccttgctcccgcctccgacgccaccgtacatcgcacggttgttgatgtaccggatgcatgaatggcttggtcgctctccctctctccatttcaacccaactgcgtgaactaaacttaatttgagcgcgtcagatatcaagctcctacttgatatcgagccggttagcggcaaggcgttggcgtggtggccgcgcgttgaaggtgtacagttagtggtggccactgttttcagaatgcaacggcaacacgagaaggcagattacaggcacaagtccaaccttgttgggccagcaacggcgatgcctacatacactgctttcccattggggcgtttttacgtgaactttctcaaccatgccacctggatacaagaacttctccgaggaattacttgcatgtttcctcgtcgatcggctggatgactacttcgctagaaagaacaagatacatgacaagcgcgtgaaaccaatcctggagttggtaaaaaaaaccaatcctggagttggtaaaaaaaaccaatcctggag

SEQ ID NO: 70591 - DNA, 15931 bp, Oryza sativa
atctgaaaattgtcgtgctctcaagtttccctgcaatgtatgagagatacgagactgaagtcagaccagttggtatctaaaggtagccaagaactaaagaaattctacaaggttgattccaattcatgtgatgaacagattggagaggccctattgagacaaaatctcattaaaatgtacctgcaaaaagaacctctttgagaccgtaactgagtcgtgaggtacctgttacaatgttagtgacatacatggctttgtcaaaatcaaaccagattctgtaatacctgtggaaaataaaagaaatatagtttctaactttctatgcacactagctagcagcactacatgatatgctaacactcaagcacaaatgttagaaagtaaaagcaaaactgcgccgatgtaaaggctgcaacagagctcacttgattacatttaaatgtgtgatagcttatcgaaataagcaccttggtttgatggcaaggggataactagcaagactatccttgtacgtcgttcgtctcgatttctgagccacgaacaatatggcggaatacgaaggactcctagcgggactgagggccgcggcaggaatgggcatccactgcctcctagttctgggcgactcctagctggtcgtgaactagctatctaaggagtaccaatgcaccaaccagcagatggacgcctacgtccacgaagttcgacgcatggaccgccacttcgatgggctcgagctccgacacgttcccaggcgcgacaatgcagtcgccgatgagttgtcgcgcatggcgtcagcacgagccccactcccccaggggcctttgaagaaaatctcacacagccgtcggcgcactcggaccccccgagggtgcctaacgccgcgacccccaccctgacgcctggtgagccacaggcctcggggcccgagggggtcaaccccgaccccccatgtcaggtcgcctggatggccgacatccgggcatacctcgacaatcacactcttcctaaggatcgcgccgaagccgaaaagctcgcgcacatctccaaacggtacatgcttgtagaagggaccctctaccggagcggcgccaatggggtcctcttgaaatgtatctctcgggagcaaggcgtagagcttatcaccgacgcccgcgagggaaaatgcggggcccactcggcctcgcgcactttggtcggtaaagccttccgtcaaggattttagtggccagctacactccaggatgcccaggactgggtcaggtgatgcaaggcttgccagttctatgccaagcaaacccatcagttggcccaagctttgcaggtcatccccttctcttggtgttgacggtcattattgatcagtttcgaccgtcaatattaccaaaatagaagagaactagtgatgcttgcaatgcatatatctgttagaataataatattccactagtattaggtataataaccttttgcagagaatgacaataaagtggaggagaatcgacatcaacttagaccataaatcaatcggacgatatcaaaaaccagacttatgtatgaatgggccaaaaactcagtattgacacgacacactgggccaaaattcacaagtctatggagaggaacaccagaggaggtcactagccaacttgtgggctggttgggccagcccagggttcgggttcgaccgaaccaatgccaacgctgatggatgcagggtttcgagggaacggtagagattaactccctatggtggttggagggtattaccgacctttccaaccaccataaccatcattacctgcctatttaaggagttcactatcttcacttcaacacatacctcaagcaagagctctctcatttctctcaaatttagtttagtagtatctagctggtggaataggaatacaatagaaatcaggagtccggaagccttcggaagagttcgggtatggctctagtagctctcctttcctcttttgtaggctttttacttttattagaatactcttctatatacatttatggtattgaaatactttctgagtatatgagtacctactttacattatgttcatgttatactgaatatacagctagcttatctgggagatgctttggtgcgggtataatgtttgcatatgcaattactctatgtcatgacgatgatattagagtagtatctggtagtttaggcgtggtgtatagattacgggatatcattatttgggattatatactgcggatgagaggtggaccgctgatggtgacagctcagtatgggtattcctccacgccggtatataatcctaagttaattccctggggagggtattcccccgtatttagctccggttgtatggtcataacgggctgtcataaggaactcggcagtcaggggtggcttctcaaagtaccaggagggcatcggatagaggatattagctagtatatcggttaactagaatgtatgtacactatgtacattagaagtataggaatagattttctctctcttttctttccgcttagcttagataatatattatgagaatgagtagctagagcttgtgtgtcactctacccttggattatcttaacccctgcttagaatatgattatcacaactaatatataaattattagtcaagttctctctacatgatcttcccacgggataaaataaatacgatacccttggaatactctcgggtgaaatgctacaatggtatatccgtgcgcttgcggatgaactctgtaaccataaaataacagaagtatttctgcgctattgctgggaattatatttctagtaatgacgttaagaaataccaacaagcatttctggcgccgttgccagggaagattcataatagagattacctgcaataatactttatatttacctctgtataatcattttcctttgcatgctaacattggttgttttcacttttttttgtgaaaacagggtagtgcatgactggtttcaacttgccggaaaacttcaaagaaaatccagatgctttcttccggagcgtcaggccgcgagtcgctgctccgcagaaaactctatcgataaagaaaccagccgtaccagcgccatcgaactttaagactatggctaacaagactctctggcaccgaacgtgtgatggcttatcgaaataagcaccttggtttgatgtcaaggcgataacccgcaagactatcctcatacaaaataggaacaaagggcataatctcagtgtcattggagcaagcagaattcttcctagatgaagcgggtgcaggcgcatcataagagaacctgtcatgttctagaggtgacagccatatgcgaaacttcctgacagaatgctgacattttaactgggaaccatcatggacttggatctgctaagatttttctttatcttcgacatgcagcgtctcatctgtctgtttgacacgcagcacctcatcaagatcatacaggttttcgataacccgcttcgttggatcatagagacccaatttactccctgtgttgagcagaatccttccatccttcggatcaacagccatcggaaccacgacattagctccaagggaataaccaggccaacctttcagacacactctgtatgctctatcccattgaccatgctccatcttccaaatatccaattcctcttcaaacggattagcgagaacaacgcaaagcattccttcaagctctaccacaaatgattcgcaagggcttctgttgtgtcttgttagagcacacgaagggcactggatgacaacaaatgtcttggtcgcgatctcgaacgagagaatggcgcttgtcttactctggctcaaccttggctcactcatccagtacagaaatccagccaagtaagccggaggcatgtcattcacaggcagaggcgggctgtaaaaaatcacacgtgtgacgcgatttacaggtaaaaagcgagcatgttatgttgtaacgacaaggttttgaagtttcttcactgatagaaatgacatgcccctgcatcagtggatcgaaccccaggccgacattcttattaccggtagtaaaagcatgatcgtgacgaaatctatcactaggtattctatttggaatgtagacaagagcccctcgggtactgcggacatagcggtaacctgtacaagggttgtatagataatcctccagctcagtgcttatgagattcatcccatggcaaggcttggagcaaaccacctttgcatcaagccatgtatcttactaggagattcttgaagcaatttttctatgctggcaaaactaaaacctgatgatccacctgtgcccatgcccacaagcctgatctttggcctcctgtccctgttgttatacatgtggtatccacgagcgaagctccaactttcaataaatctatgccactgcttagagacaagtttgaactgcacggcataatcacccggaagccgtagtagggcctcctttatcaccttggcaaggggagatgacaatgctatctcttcattggttttacacacaggagcaagactgtcttcaaacaaactgatcagtccaagagcagaacgtgcagtttggtaaggcaaaggagttcccttgatctcaaggattgtttctagtgtttcagatgtaggatcataggcgatcgccttgcgattggatgtagcaatgattacattcttcttccctgacataccactactgccagcagaaccaataactctgataaatctggtttcattaaatctcgggcaacatgctccgtcgacaaatcgatgcgatgctccaatgaccaatcactggagtaaagatcattcagcttccaaatctccagcgtagacgacatgcgacgaaggtcccggaccatgcacaggttaccagagagatccaccaagtgcactcctgaaacctgaaagggcggtgacctgaccaatctgaatgtctcttctgtcacagagaaggataagatggcagcatgtggcctcaagaaagagaacaaagagccagtaagccagtgaagaaacccatccacaaacactggaagaagtttatgttgttgtgaagctgaaatagaataagttccagcagtgcggaatttgaaaggtacacctccactagctggtctccatgagtcaccatgcttgccccctagagtgtatatctgacacttggtatgcggttctccagaaattatctctcgaaacagcctaaccaccttgtactcccctgtccgggcatcgaatcccagtccagcagatccagatggcacggtttggcaaggtggcagacggctgatcgacctggttgccgcattgagaacgtagtactctagtcccatagcatcgtgcagaagggtgaggccatggcacggtgtaggcgtcatggccatgaaatcgccgcgcacattgtccagattgaagagcagatcacgatgattgtcaccgccggggactgaccgcgacagcggcgaggatgtgtgcaccgatgtggagccgaatcccgcggtctgcgagacgaagaacagcttgggtggcaacggcttgatcttgttcttggccgtgtggaaaccgcggaattggtcggaagagagagccgtggcccaggacctgcaaacggctcgaaaacgtaggacggattcgacgggtagccattggagcacctcaatcatcatctcttctggcagcactaccgttgcaccactggctggtgaaaccttcctcctcttgcagctcatcatcaccatggatacatcggctcaaattcgccaaaaaaaaaaagtacggcagaacgaagttgcttgtatatcaggacaaggaaggtaaatgttgagttctgaattaaacagggtcaatacatatagaaatataaattaattagccgaaaaggtccaatgcacaatacggtgagaatatataacggattgataataatttgatataggtgtattattagacgaaattagactcatacgggaaaggaacgaactcttctttgcatccaaattgcagatctaacgtggacatggaggttcagaaaaaagcttcaaccttccagacctagaacagaagcttgccctagaggtaaaccaaattcgagaacaggtgcgtgttgtgtagagagatgatcgatcgagatgctcaccaggatgctcctgctcgcgagattgatggagatcggcgcaggtggcgggcgaagttccctcgcgggccgacggggaggagagatactcgagggggagaggcacaatatttttcggcacagatgaatttgacacgttttgggctggtggccgaggcttgtaagttgtaacaccacacggtttcatcaaattttgcggcttgaaaagaaaaatctaaacatccaataagctttgctcactacagatttcatttttgcataaggcccatggggataggcatacgctcaaaaaatcaggattttgcatgcgttcagcccaaccacatgcgaaaaaaaaaaattttcatgcgggcgcttaagccaaccgcatgaaaatcaaaatattgtgaaaaaaataaaattctcaaaaagaagaaacctagccccgccgctgacggtctgccacagctggttgcctaatcccaaaccctagcccgcccatcggcctgccacctgtcgccgctcctgtcacgaccggaaataacccaacaggcattccatgcgtgcgtatattattccttgtcctagagagccgtggcccaggatcggcagacggctcgaaaacgtaggacggattcgacgggcagccactggagcacctcaatcattatctcttctggcagcactaccggtgcaccagcaccactggctggtgaaacctttcttctcttgcagctcatcatcaccatggttgtcaagctcaaattcgccgaaaaaaaagagagtacggcagaacgaagttgcttgtatatcaggacaaggaagttaaatgtcgagttctgaattaaacagggtcaatacatatatagaaatatagattagctgaaaaggtaccacaatacggtgagaatatataccggattattttgatataggtgtattattagacgaaattagtctcgtatgggaaaggaacgaactctttgcatccagattggaataaaccaagagcggatctaacgttccagacctacagcagaagcttgctaggggtaacgcaaatacgagaacaggtgcatattgtagagagatgatcaagatgctcacaaggatgcggcggaaggagcaggacggacgatctcgcgggatcgagggagatcggcgcaggtggcgggcgggcgacctcctccaggggaggctggaggcacaatgattttgggcacagttgaattgtgctaggaatctgatacgttcgggccttcgggggcttggggctggcggccggggctttcaagttttaacacgacacagggtctcatcaactcgcgagagctaattcgcgcgtgcgtgatagcggcacgcgtttaggccataaggcccacagcgctggctcgtacgcacgcagacggcgttcacgtccatattttttttttcgaaaaacctaaacctaacgtacgtgcctttttcgtttctctttgcctttttttctgcgatctttttattttagaagttgaatctttcatcttcaattttagttgaaagttttgaatttgagttaaaagtttttaagatttgagttgaatttttgaattttaagataaaagttttcaaatttgagttaaatgtttcgaattttcaaatgaatgtttttatatctgagttgaaagttttcaaatctttagttaaaagtttttaaatccgagttgaaagttttcaaatatttgacttgaattttttcaaatcgagatttgaaagtttcaaaatataagttgaattttttttaaaaaattggattaaaagtattcaaatcttgactttaaaattttcaaatctgagttaaaagtttttcaaaaatcttgacttaatgttttcaaatccgagtcgaaagtttttaaatctgagttgaaagttttcaaatttggattgaaagttttccaaatctgagtcgaaagtttttaaatctgggttgaaagtttcaaatccgggttgaaagttttccaaatctgagttaaaagttctatttatgtattattttatttaaaaaaactaatactaacaattatcattagcgctaattaacgtcatcaatgctaatcatgttattagcgttgaggagaggtggaattgggacgtgcgtggctgcgccagttaggcagctagcgcacccgcgcccattagcaagcccctcatcaacttgcggctgaaaagaaaaatataaacatccgatcagttctgctaaactttaacccgattaattataaccgatgcttctacttatatgtcccttcttccgcattgtctcctatcttctttttttttttacgactcacacgagacggtgcggttctactgatagagcagaaaaaaattacaagattacaaccttggaaggtcgtaaccaggaaaaaggaaaaatatataccaccacccacacaccgatagcgccaacacataggtccgggagaaggctgtaccggaccggctgccgctagccatgaccgaccgccgctaggccaacaaaggagcatagacgagatcgcacaaaaaacgcccttacaaccaatacaaagcccaactctatcttagagcgtgcttgcaccaatcgttcgagtggttttcagcaaggggatgcctaaatgacatctccaaggagagaagtgatggaaaaccaccgccgccatctgtcagggactcaaaagagccaagactgggctttcgcccgcaactacccttgagggatgagacggcacgacaatgcccttaggaggggggatgaaccattgttttcggtctggccaaggcggggctgggttttcacccgccgctcatcacctgcgagtccacggctgacccaccgatgatccaacaccgctcaacctctaccgacatgtgggaccactgcactggcgccccccgctagccagccttcttgcgccgaagaccgcgccacacccaccagtagctctccttgcatcgtggtcgcctcctttactaccgaccgcgcctcatcgcgccccgctggcctactcaaccaccagacgcgcgtctggcgctagtccggcctcccgccatcagtcgcgcctgtcgcaccaagccggcctgcaccgtcaccagacgcgcctttcgcaccagtccggcctcctaccatcggctgcgcctctctgcgccaagccggcctccgatggtcggagtccgacccttgctccaatcgctgtcgcgctggctaggtgcagccatctgccaagcccccagctagccgtctgagaccaccatgcctcccccagcagtcacggtcaccaccaccgtgcctccacccatcgcagccacagtagtcgctgctgctgacggccagccacctcgccgccgtctagccactagcgtcgttgccacagtagccggcagccgatgctaccgttggccagccacctgttgtcgccgctgtccagtcgctgccaccaccatcgccatgagcccgcgaactccgcagcgccgccaccactgcgggcttgcctcacaccagatctgcccgactccggcgcgactggatccggcccgctgtcaccatcctcgccgccggcttccatccccgccatcatctccatccccgctgccgtcggtccccatatattctccttcttcggctgcccgttgtcgccaccttcccgagtcgcgccggccctagaggtccctgccgtcgcaccgtcgctgacagccgcgccgtcctcctgccaggccaccagccaccatgaagccttgctggctcacccagccaccggcctcctggcaacaccgttggcgcgccgccaccagccagatccgccataaggggtggcaaatgggggccccgcctcaggatccgtggtcatcgccaccgcctccattgatccgcagccatgaagttcccaccgctgaagggacctcacagcgtcaaccgtcacgctcttgcgtcgccctacccccgggacggctccggaggcgacaagtccggccaccccttcccgctccttcttcctcctccacctcgccgctgcctgagcggtcgccagcaaagaccgtaaggatggcggcggcggggcttctcgccagcctgctccggtggccaggggagtcgccccggtggcggcggcggcgaccgctagatccgtgccgccccggcctgatctggcggggtggcggccggcggcagggacagtaatgtcagcaacgaagaaggggattgtctccaatcttcgctttgggataaaaaagaaatgagatttaaaatagcagaaatgttgatagagagcgcaacaattacctgggacagtctttcacacggatccgtcggcagggagcggcaggggttgctacatcggcccgatttggtctgtcgccgccgtctcccaaaaatgagtaaaggaggggactgaaagagcattattctagaaaccatcgctagcggactactactgggtggttctgtcccaaaataatcgggattaataaattggttgacacgtgtctcacgcttgttgataggaaatggattactttaagagcaaggtcaatagtgtagccaactactggctccaaaacatctatagccaatctaatagcccattcatcaatagttaactataaaaatatactgcaccattaatacacggtcccacctctcatacacacataatatcttggagtccgtgttgcaaccggctacaaatctgtagcccgctttcttctctctcttctcttttcttctcgatatatggttacagccggcttatagcctgctattgtacctgctctaaaaaactgtcacgcccggaatttctatccaaaattccaaatgcttatatgtgtgtaaaccctcgtccaggaatcagccgaggcacacaataacaaattgataatagagtacagttattactctaattattaagcgtataaaatatcattacagaggtagatagttcctctcaatcaataaagatctaagcagcggaaaaagataaacagcgcagacggctccactccacaggcagcttgaccagggctacacctaatcctccacaccatcagcttcactgtagaactcttcctctgatgaatgattgcaagatgagtatatgacatactcagcaagccacgcagcaaatatgcaagtgcacaggataacaaaggatggcataatagggtttcatttgcaaaagcagcatttagcaaacatttgagaatttaataaaacagttaagtaattaaacaatattaatccaacgctatacaacataccctgttgcataggcccaaccattctgaacaaccatcccggctgcacagttctatctccaaaccaggaatataccattccaaaccaggagctaatcaaattttaccagttatagcatcttctattatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcacaacacaatccactacagcgcacctttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcattaagccatcattaaataaagtgagtcataagttatcccaatagtgagctaatgtttctaagcagggctaagcaattatatctaatatctagttgaaccaatacataaagctcaactagtcaagttataataacccaaggtatcaaggaataaagtaatcaagaacaaaagggctataacaaacaataggttaattccacccaatggcattcgaaaataaatgcaatagttgaatagaaacaatagctttaaataggatcaacatgctcaaagggttgtttgggatctgtgtgacttgccttgctggccttggaactcttcaaattcttctccggcgaaaacggactctccggaaacgacggaatctaagcagaaaagaacaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaagaaggtttattgcgtcagcgggctagggtttgcggtggaccgggcgcacgggcggcggttcacgcgaacggacggccgagattcgatccaatccaaacggacggccgagatcgatcgggtccacggcggctcacggcggacgaccccgatgacgtcggcaatgacgtcaccgacggcggcggcggctcggcggggcagacggctcgggcggcgcacgctcgccggcgaacggcggcgcgaggacgaaaacggaaagcaccaggacgaagcgggcggcacgggaactcaccggcgaccaaaacgacggcggaagatcaacggacggcgacggcgacgaggaggaagcggcgaagctcttcgggtcgacgacggcgatgacgctccggcggtcttcggcggtggcgaaggggaggacgaggacggcgacgcgacggcgaacacgacgtcggccttcccgagcgacggcgacggctggagcgacggcggcgcacgactggagcgacggtgacgacggcggcgctagggcacacggtgctagagcttttccggcgacaagaggcgaaggcgagggtggcggcgggtagaggagacaccggggagccttttaaagggactcggaggcggcggcgaaggcccacggcgacggcaacggcgaaggaaagctcggcttggagagagagagcccgatccgattcgaactcgaatccctcgatttccaaaccgatttagccgatgattccataggagaaaaggtagaggagatcccggagattgtttcccctcaatcaatttcaccggaaacggaaaagaacggccggatttggaaaggaacggcggcggcagctcggcggcggcgcgctagggtttcggcccgaggaagatgacgggcctgacaggtgggacccacctgtcagcgatcgaacgcgcgcgcgcgcgcgggcggctgcgaactgggccgacttgggccggggagagagagagaaggttttgggccgactttcggcccaaagccaaaagagaactttttaaaacctttttcaatttaaattatttcttaaatgcaattccatttattaaaaatacttccttagctcaaataaatcccagaaaaatcttggaattatagaattaagcaaagtatttaatgaaattttatctggccccattttatattggaatttattaattaaaattagatcttcttttcaagacttttaaaattattttctagaaattccatttaaacaacaatttatataatttgaatttttagggtgtgacaaaaacgctgctcaattctaatttacagatcgacacgtgtctcgttcgtttgttacttcctccgtttcaggaaagtcaaataacctgaaacggaggcagtagtaaatagattactggctatagggggttttcagttgcaatatattcgtagtaatccatttacaaacgaatctaatagccgatacgcacggtcacgagagtacggtttgttgcaacgtgggacctagtgcatcgtggcaacatggtgtctgttggtatttcttaacgacattactaaaaatataattcccagcaatggcgcataaatactcatgttatattatggttatagagttcacccacaaacgcacggatataccattgtaccatttcacccgagagtattctaagagtatcatatttattttatcccgtgggaagatcatgtagaaagaaattgactaataatttatatattacttgtgataatcatatcctaagcaggagttaagataatccaagggtagagtgacacacaagctgtagctactcattctcatactaaattatataagctaagtggaaagaaaagagaaagataatctactcctatacttctagtatacatagtatacatacattctagttttctgatatactagctaataccctctatccaatgccctcctggtacttcgaaaagccacccctgactgctgagtttcttatgacagcccgtcatgaccatacaaccggggctaaatacgtaggagtaccctccccagggaattaacgtagtattatatacacgcgcggaggaatacccgtactgagctgtcaccatcagcggcccacatctcatccgcagcatataaccccaaataatgatatcccgtaatctagacaccacgtctaaactaccggatactactctaatatcatcgtcacgacatagagtaattgcatatgcaaacattatacccgcaccaaagcatgtcctagataagctagcagtatattcagtataacacgaacataatgtaaagttgtcattaatatactcggaaagtatttcaataccataaatgtataaagaagagtattctaaataaagtacaaggcttacaaaagaggaaaggaaagctactagagccatacccgaactcttcagaagacttccaaactccttatttctactctattcctattccactagtttaagaacactaaactaacttgagagaatataagagagctcttgcttgaagtgtgtgagtgaagtaagaagaggagctccttttatagctgaactatgacggttgtgatggttacaatggtcggtaataccctccaactgtcattggggcttcatctcaaccgtccagtcaaaacctgcatccaacggtggcatggtgggttcggccgaaccagggaccggcccaatccagcccaatttcggctggcggcctccttcgttgttctcctttgcagacttatgaattttggcccaatccagaatgtcaactttgaattcttggcccattcatgcataagtttgattctcgacatcgtccgattgatttatcgtttgagttgatgccgattctcctttacttaatgtttattctctgtaaaaggttagtaaacctaatactagtggaatattattattctaacatatttatgcattgcaagcatcactagttcttctctatttaggtaatattgatagtcgaaactgattgataacgactgtcaatagtgccttgtccataagaacatgggtacgcgtgtcctacgtggacacaattaggcgctcagaatattaggaggtgttgtgcttctaataatatctctaataaattcatgctatctctaaaaattgtgaaataaatcttgttaaactctaagggaacatactctatactgcagtgaccttgttaaactctaagggaatacactctatactgcagtgacccgaaacttaaaaaaacttgattctaaactgcataaaaa

SEQ ID NO: 70592 - DNA, 3873 bp, Oryza sativa
cggagaaggaaaggaacggccgaatttggaaaggaacggcggtggcggcgtgctagggtttcggcccgaggaagacgacgggcctgacaggtggaccccacctgtcagcggcagcgagggcgcgcgcgcgggcggctgcgaactgggccggctgggccgaggagagagagaaagcggttttgggccgactttcggcccaaagccaaaagaggactttttaaaacctttttcaatttaaattatttcttaaatgcaattccatttattaaaaatacttccttagctcaaataaatcccagaaaaatctaggaattatagaattaagcaaagtatttaatgaaattttatctggccccattttatattggaatttattaattaaaattagatcttcttttcaagacttttaaaattattttctagaaattccatttaaacaacaatttatataatttgaatttttagggtgtgacaaacccctttaaaggctccccggtgtctcctctacccgccgccaccctcgccttctcctctcgtcgtcggaaacgccctagcgccgtgtgccctagcgtcgccgtcgccgccgtcgctcccgccgtgcgccgccgtcgttctcgtcgtcgccgtcgctcgggaagaccgccgttgtggtcgccaagtcatcgccgtcctcgtccgccccttcgccgtcgttgtagaccgccggagcaccgtcgccgtcgtcaagctgaagagctccgccgtttcaacctcatcgccgtcgccgtccgttggtcttccgccgctcctttggtcatcggtgagttcgccgcgtcgcgctctacccgttggtgtcctccgttcgtgccgaagcgccgccgttcgccggtgagcttgcgccgtccgagctgtcgagccgccgccgccggtggtgatgtcatcaccgacgtcatcgtcgccctctcccgtgagccggtcgtagaccgatcgatctcggccgtctgttttggatggatcgatctcggccgtccgttcgcgtgaactgccgccgtgcgcccggtccaccgaaaccctagcctgctgacgcaataaatccctttttccttttcaaaaataattcattattgcgtcataattcaattaaaatcaatataagtgttttaatctgattaaatcttcaaaaattcataactaattcatcttagctccgatttagttggttcaagtctctaaatttttctaaaattgagatctacatattaaaaatatccacatgtactgttcatgcttatttatgtgctgttttggtgattttgctcttttctgcttagattccgtcgtttccggagagtccgttttcgccggagaagagtttgaagagttccaaggccagcaaggcaagtcacacagatcccaaacaaccctttgagcatgttgatcccgtttaaagctattgtttcttttcaactattgcatttattttcgaatgtcattgggtggatttaacctattgtttgatatagccctttttgttattggttcctttattccttgataccttgggttattataatttgactagttgaactttatatatattggttcaactagatattagatataatagcttagccctacttagaaacattagttcactattgggataacttatgactcactattatttaatgatggcttaatgatagttcacgatggacaatcgtgattggttaattaattaatatgccaactaaaacctggtaatggtgggttgtgagcacatggttttgatggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataaggtggtgattatgatccacgaaaggtgcgctgcggtggaattgtgttatgcaaggggtattgtcacagctcctttccgaggtaccgtggtggtattgaggcacatggtgacatgatgtggggctgtgtcttgtgggtacagtagtacacctctaatcagagtaaaactattcgaatagccgtgcccgcggttatggacgggtctaacaatgtctttcgtgattagtctcacacctctcacaataatttgatgctataattggtaataatttgattagctcctggtttggaatggtacattcctggtttggagatagaactgtgcagccgggatggttgttcagaatggatgggcctatacaacagggtatgttgtatagcgttggattaatattgtttaattattacttaactgttttattaaattctgaaatgtttgctaaatgctgcttttgcaaatgaaaccctactatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctccctgtggagtggagccgtctgcgccgtttatcttttttttccgctgcttagatctttattgtttgagaggaactatctacctctgtaatgacattttcttcgcttattaattagagtaataattgtatcctattatcaatttgttattgtgtgcctcggctgattcctggacgagggttcacacatatgtaagcgtttggaattttggatagaaattccgggcgtgacaccttacattggcagtacccgctccatgaacttacatcctcatgcactctaagcgtcataagtttctagcacagagaggagttctggcactcccgagggggaaactcacgcaagcctaacattgcatcctgtagttgaacccaatccatgctgtcctcttttgggtatctccttgtagtcttgtaatcttgacaagtcagtctctggccatccatatcaggtatccgccatttggccatccgtatcgggtatcagccagcaaactgcttgttcgtccacacacctaagtgaaaccactatgtagggatactgcctccgctcgcctatctactccgctaggtctatacccattcgagaagtacggttgtactggggtcgtttcatgcttaacttcatggctcgatccttaactgatcagggacggcactagcctttactggacaccacccaagccctccagccgccctagtcgaaaacatttgttcagtttaattttctttcacatatcatctcatcattatcatggcaatgtggcgctcatgtctccacatgctgtatgtcaattaccttccctaagataattgcccaagcataaagcattttgacaaatatgaatatgcatggatcaaaattagcatgggctaagcatttgtcaaatattgactaaagacacacgatatcatggattacaaagattatatggataatcaatatcaaaggtatggcatataacaaggtaggacattcacatataaatagcatgcaaactttatttaaatcaaaataagttcgcaataagtccaacatgctcaaagattagtgatgacttgccttgctcgcagatttgctgacccggatcttcgattaactcagcaactccttcggaatctaaatttacgtgcgaaagatttgatttgaattcaattagaattcaaataaaatcaccaaaaattcaaaaattacaaattaaatcgagaaagtggtaccaacagttagatcttgattttagataaatttaggttcaagtttcattcgaatccgagttaaaatgagtgagttatgcaag

SEQ ID NO: 70593 - DNA, 4462 bp, Oryza sativa
ggcgaattcgagctcggtacccagtttaattctctttcacatatcatctcatcattatcatggcaatgtggcgctcatgtctccacatgctgtatgtcaattaccttccctaagataattgcccaagcataaagcattttgacaaatatgaatatgcatggatcaaaattagcatgggctaagcatttgtcaaatattgactaaagacacacgatatcatggattacaaagactatatggatcatcaatatcaaaggtatggcatataacaaggtaggacattcacatataaatagcatgcaaactttatttaaatcaaaataagttcgcaataagtccaacatgctcaaagattagtgatgacttgccttgctcgcagatttgctgacccggatcttcgattaactcagcaactccttcggaatctaaatttacgtgcgaaagatttgatttgaattcaattagaattcaaataaaatcaccaaaaattcaaaaattacaaattaaatcgagaaagtggtaccaacagttagatcttgattttagataaatttaggttcaagtttcattcgaatccgagttaaaatgagtgagttatgcaagtttaaagattcaaatttgaattaattccaataattgtgaaatgttactattcataattgatttatttttattccagcattaaccgtatgtggtagtgactgacaggtgggtccattcttatttccttttctttatcttattctttcaaaggaaatgagatgtgctattgacaggtgggtccggcccctttttgactgtggttaagccggccatataatctccggtgggtcccgcctgtcattgtaacaaaatctataattaagtttacttagattttaataatagggaccccacatgtcattgagtgggttaatcaccattaggtggaggattactgtgcgcaaactagatgtgggccccacacggtttctctctctcgtccctttctttttcccgtcgtcttctacctctcgccaggcagaggcagccgcgccatgcgcctagcgcgcatgccgggacggtgcgaggccggcacagcagcagccggggaggatgaggcgaatctccagcgacctcccgccggcaacaacggtgcagtacggcgcgggggcgagcggcgcggcatggccgccatggccgagctccggggtgcaaggggacagggcggtagggctaggttccacccaaatagatgggtgcgcaagcttctacagtgtatggtggttccgtttttctaacaagatggaaggggaagcctccgggatagcatgtccacggggacatcgccggcggcggaacagcagccgggccggcacggccatgggtgctaatattagggtagaggacgctaaggtgggatggcgagtcggcgaaacgcggcgtcgcggtggggaggcggtaaggaagcagaggatgccgacggcggcgagcgcacaggcgttcgacagcaggtcctcgggctccagcggcacccggcgttgatcgaaggcatcagcagcaacagaggcggcccgagccacggttcccgcggtcagctacgccggcttcggctacgcatgcacctaaggtgttcgatgaaatgtatttgaggaagaaggtagagagggatgggtttttttttatgggggtttggcttggggataagccataatggcatggaggataaggtcgacgacaggcgcgctcgatggctgtctacggcctaggtttagggaggttgacgcggctaagctttcctccacctatgattcgggttcaatgcatcgatcgggcatgattgcctatgcgatagccgatagggtttcagaagagggagtactagctggggaagaaacatcgcattatccaacggtctcagctaggggcgacgagatggcaatgcgatggcgacatgattagcggcgacgggcagtggtaacgaccgccgatacagaggtgcaggctattttctagggtgacgcggaacaacgtggcggccgttatccctcagctcgttggcgactcgcgatgagacgggacgacgcaggcgcttgtggtgacgcggcctttgtgcgggatttcggcggctcggtcggtcggcggtcccacgcgggcgtggcacggcacacggcgcggcgcacggtgcaaggtgaccaggagggcgcaccggtcgtgcgcgacacgttcgcggctcggaggtgtggcgttgtgtgtgcggcttgggctagggctctggtcgagcacctggcggcctaggaacagtggcggctgggaaaaagagagaaaaggaagaaaagggaataggaaaagatggaggggccaaactgcacaatgtcttggattggaattctgaattgagatgtaacctatacattttgggtttaagaattcaaatatttgatttgaatatttatttatttattcattcatcatttcccaaaatgaaattggctttactttatatcatcctaaattcatcctatataactcgaaggctttgatatttctaaagttaattaaaatattctaatgtgacctttaataatacattagcacatcggtcgagtttatttgtatggcaatgtattgcattttgatatgtttaatctattcaattcctattccatgaaggcactgtgagacttggtgcaatatcagtctaaatattgaatcgagtactcatataagcctttttatatatagaactcaatttatttacatactaattattttatgtgagtgaaatttattccatgagagcctcaaggcaagttatacatatcaacttaattattagggtcgttgtagtggtgactatttcatatgtacttagatgtcacagacacttatcacatggctccaatatttaatatttaacctataaattaaattagtaattaacattctctttgtattgctttgttgtgttgtgtgtaaatatttgtagggttcacaataaataccataattttataactattacttagttgtatagctttagcttaattttcatttgtgacaatttatagtttggcaagcaataacaaccataacatccatcatgatgcacaacaaaagaaccaataacattggcaatgcaatttatttaaaagtttttgaaagtactcaacttcgggtttcattttattggtcgaattttcagggtgttacaatgagcaaccgctggacccactattggtggggagggaggaggagagaagtgcggcaaaggaggagcgggtggtggtggatcttttttttttttgaaactgagaccattagcccggctttttatagaaagccaaacacggcatcgttatggggatacccattttacatcacgcacagaaaaggtccagaattaacaccattagggggggataaaaactgaacagcattaacaggaaccaaaacaactctaagacggtcttaacatcaaaactctcaagctaagtaaacgactaagaactaaaaacttcagacgatcagccaactccagatcttggttgtctcagagttgaagtagcatccatgagcttccgagtaatcttgtcaaaattctcagcgtccttgctgctaaggattctcccgagctgcaaaaatgaattgatttggaacattaatgataggggtgagtagactaatttttctctaaaaatcatgttgttcctagtggaccacagcacccagcaaactgcagcaagtagggacaaaagaactctcagatcatccccacccaaagagccattgatcaggtagaaatcctcaaaagacctaggtataatactcgagtcaaaagcatctctgcatatgcaccaaactaaagaggccattgggcattggaaaagaatgtgatcagtggtttcaagcatcccacaaagaacacaaaactcagaacccttccacccatttttcttcagctgttcagtagattgaatcctgtttttcaaagcaagcgacagaaagtgtttaattttttcaaggcagggacatttccacacaccctgcattctagtgttagtcactcctctaaagagaattgctcgatacatggatttagaggtgtaagttttattcttattaagcccccaaagaaacacatctgggccatcagacaactcaatagagttaatgatatccacaatagctagccattcctcagattctctctccccaaaagaccttctaaaagtgagagcattagcatttgcagtgacctcagcaactaagatgttttgttgattgcaaatctcaaaaattcttgcgaagcaaattttcatggggcatgtgccatgccacacatcatgccagaaccagatatggtcacccttccccaaagcccattctgaaccaagtttcaaccatttcctaatgttcataatccccttccagaactgggagccagaatctgaacattggaaaactctagaattcctcaaat

SEQ ID NO: 70594 - DNA, 703 bp, Oryza sativa
ccaacggcaatgaactttgaaaccacctaatgaagtgaaccactgcctccctgatgagttctcagttactctctcagtatatgttatatatacagatgaagctacacacatgttgcatgcaatttaactgcaatgtagttatatatgtgcatgagtaacctatactcccatgtcctgacgtgtagttttctagtacaaagtacagaatcactgcctgcactacgccggaccaggtcatctctgacgggcccaaaccctcacttttgatgggtttggtcttggtcagtgattagtggtcactgatgacaaaatcacctgtgacggatgaaacacccgtcacagataacccatctctgaccggtatataactcatctctgacgggttaaaacttgtcacccgtcacagatgagtcatcagtgacgtggcgtaactacctgaccgtcactgatgactcatctctgacgggttgtaacttacgacccgtcactgatgacaaagcaagaaatacaatttttgaattttaaacgccacaaaaaacctcaaaaaaatatttgaattttactagccatactatacatggttacacatcactacctacaaattcacaatttttcacgcaatataacttggatgctacaagtgagatacgaactccagacctcaacctccatatagagatcccttaccaactcacctactcaa

SEQ ID NO: 70595 - DNA, 24168 bp, Oryza sativa
gtggtcgcgtcgcggcagctgcaggcgatcggggccggcctggccgcgccgcgcgcgcacgaggcgggcctcgcggcgcccgtctacgccatgggctgcgtgctccacctcgtcgcgtgggcgctcgtcgccgccgtcccgtgccccgaccgctccaccgcgctccaggcgcaccacctccccgcggcgccggcccgcgccgcgttcccgtgggcgccgccgctcctcaccctgcaagaacgcctcgccgaggagggaaagcgcaaggacaggcgcaactcctgcggcctcctcaaggaaatccatgtcctcgagaagtccacgcagaagcttaccgacgccatcgacgcggcgccgatcccgctcttcggcgacagggaggccgacgtgcgggaggccgcggcggagctcgccgccgtgtgcgccgccatgagagacgggctcgagccgctcgagaggcaggtgcgcgaggtgttccaccgcatcgtgcgcagccgcgtcgagggcctcgactcctccatgcgcaatgccgattgatccatccatcgatcgatcgatcgatcagaatttctcgttttgattgggcaacgtgttggtcctaggtagatttcttgttcttgatctgctttgtttgagttccaatcgtaatcgagtataaatgtgtactttcgtgtaaagaaaaggggattagagagggccatcataatgtaaagatggctgctttgttcctgtgctcttttttgttctcctgcatttggtatatatatctcatcaattttttgttcgtcattgcgtcttcggctaaactttgatgattcaatttatgttctagagctcatcaaagtaattttttttggaaatttagtccttgtcatggtttcctgactgttgctggatggtggtgttgtatgttcatatgattttgctttcagaagattgcatgccgacattagcctgaggtgtcattctgaaagggaggtgttgatggaaatgctgtcaaatatgaatatgtttttattgttcttgacagatttagtactggtgttgaggtacatgtcatgtgatccatgttcaatcttggaaagggtacatgtcatgtgatctatgttcaatcttgtaaaaatctgtcttttcatgaataggaagaaacctgaacaagaaagagatgacaattttttttttcagttttgtgaattcaattgagtcttttatgttgtggagcatgaaaatttgtggagtattggagattatcatccagttctgtcaccaaggtgtaggtggctagcattagtttgattgtttctacagccatgtgatcctgtcctgtttttttaagacaaacctgttcaattagttagttagctgtccatttctccacttttatactcttacctgtttcgaagcatgtcttgccataccggtaatagtcctctagatagtcaatgccatgaaaatcacagcggcaaaactgttcctgctttgaaggcatcactaaactgggaggaatgtcttcatcttcaagcaaaaggttgtggatttcagctgaattagtactgcagcaaaacggtatcaattgggttgcgcaattcttcgttccagttatatcttctgaaaatctattttctgcaatgtttagactacttgatggtctccgtctctttgagcgtgtgttaaagactcgcacctacaagtgcgtgcgtatgttgtgcttttgtggtggtgcattttgtgtggggtcttccatgtgattaattttttttagaaaaatgaatggtattttcagaagcttctgttttgtttgagcatgcatgacaattcagcagccacagatccctgtggtcacacagcattgtgggtgctgttatacctgtgacacagagttgttgataactgatacctactgcttatgctgagaacctgtctgtctccaatgtggtggtaggctcctcctccagttgttgctgcaataacagcaacagatcacactgaaactcccctatcagcaacaggaggaagaagaagaagatgcttcaaggaggtctcccccctgtcttcgtcggcggcgatggtcccggctcaccggcggtgtcacgtcgctggaggtcggcacggcgactcggctcatccatggtgtgaccttgaaaggccttgacccagtagtggtagtggtggtgatggagatggaaatggcagctgagctgagctgatgattcaacggtccaactgaattgttccacacgttggtcatcaggacagggttcagacgtgcagccaacacggcagcatgtcttgcccacaagggacattgcccatgagagggacaggataggatcatacagctttcaagtttgtgcataataagtgcatccagcaattgacctggtaccaggaaaaaaaaaagagtgatttcactcgttcactcatcaacttgatgtttggaacttggaagggagaaaaataaggaattccattttcaccaaccaaacagtatcatctaccatggatatttgtcagtttcaccatgggatgatgagtgaaaaaaaaacaaacacatatcatgcttattttgacataagctctggctggctggctggctggccatcctaaactgcagtgttacatacaccaagaaggattataactgacggcaaaaatctacaggaactatatggttgaaatgaaatgaagaaatcaggactatttatacaatcaaatctaacaggctggaaaaatcgttactgctaggaactttacagtgctaccaatcttggtgtcgaattgcggtgaaaactttccgctagggtaatctttcttgcttggtcagtagtgcactattggtttgataagggccaaaagtgcaaagaggaaaacccagtcatcgaaaaagttcagggaaggaccacatgataaacttggcgtagatgtcagtctccaggaactctatgtgcgctgctctgccaatcatggtgtttaggttccgtccttgcgcggactgatcaaagttcacatcacagcgcatgaagatccgggtttcagatgtgggtgcgcgcatctgatctaagcaattgttgagcatttctgtaaagacttggcccttccttgagttatctgatgatgcagccgggcagagctcgattcttgctgaatgatatggtacataaccatcctggtatggcaagaaaatgttacaaactcatgatttcgaaataaagatcattagaaatgctgaaagattcagagcagccacaactctgattcacatgtaaattaaagctgttaatcacgtggaaaggggataacctgtggtgaagatagaagtataatatttttgaagttctccagtgtcttcaactgaaaaggattataaaagggaacagcttatggccaattctaagatctgatataaattcgcaacagataggattactgaatgcactacagaacgaagcagagggtgataccataccttacaaagtttataaaagaatgtattctgggggtcttgatcatcactgaaagtgagttgatggatgcactgtgctcccttgagcttttttagaagccagaggccagagttgaataaagagtttgagctgtaccagtagcccaagtgtgggcctgatattgacatgtacgtgtacaggttcttcaagtatggttgtaatgcgggttctattcaacatgcaaagattgagttagcaccatcgagatgaacttgcctggaaggaatttattgagtaagttggataatacctgcaagtgcagttctgatgataacgttcccaatggaatggccaacaaaactaagcttcaattctttgcagcctccgtactttgcaagcttatcaactttctttttcaggaatgcaacaacttccccagcaagcctaccacccatttctttaaaatccccagatgttttatcttcgttagcctcagacattaagcactcagctccaggatccaacagaagccattgatttcgtacaagacgtaaatccagatggtgtccctgctttttgtacaccataataagtttcacccgaactgcattgtgactctagtgaagctttaatgaaataaagagtacttgcctgaaacccatgcacaaaaatgacagctcgcaatatccgtccttttttaccagcactgcttttcagtgccaaagaatctccttgtagtttaggtagtacaatcgtatccttttgttctgaagaatttgttgccaaatccttgctagagccatgttgcggaacaaccatgacatgttgttctataagaacaacaggaacacgtgaaggatctgcatatatttgcatatcttgaacggacagcgtgttgatctgcaggatgctttaaatcagtaaacgattctaaattaacaagtttttcactcataaagttattccaaaaaaataacaagccgaaccttcatttgtgctatacttttcctgtgcagttcagcccgtgaggcagaattttgtacaggctgcacgcaaatgcaaaatatcaagtatatagaaaaggagggaacaccgttttcctattgaaaatggttgttatttaattttaagaattcaagagaagaaaattacatcatcatggaacttccttgagccagaaactctcagaagggaatgacggtgagatgactcatcgtccgtactacgtaaatagcggtgtgggatctcaatttttgagtgaacagtccatattgaccattctgatttccggtcaagagcccaaatatcacgcaagtagtccaatatcttggttttatttatcctgtagatgcaataaatacattgttggacaaatagtagataaaactcataagtcaacatggacaaaccaagcggacagtccctaggcccactgaagatatgtatgaagtgaaaataagagaaacagtgaacttaacctatgaaatttcaagaaagcattccatagaagtgaaagttggctgctcacagttagaaacaattctaacaactcttccttaggaagtgtatatagcatagcatcgttggcaccatcaaccgcactgttgggtttctgtagaagttgtacaaaaaaatatcaacaatcagcaagtctcgtacaataaacacattcatagatcacttaagacggataaagatagcatacctccagaaagtcatgtaaaatgccagccaagtgcccaacacccttggtagttgccgggaaaactttatttgaattaggtagacctgattttgcaggctgaactgcctcatatttaccaagacttaagtcagcaacatctaaatcttctactgttttaccaatagcatcactgattttctttagttcttcgagtagcatttccctagaggttaataatgccttcacaatgtgatgcgatgttggtcctaaaccttggtctggtatctgcatattaaatgccattattactttgcagtcaccaaatggagaaagaaatcaccatgataaagcatactacattatccttcatgctgcaagaaccaattgattgaggagtaaatgttggctatttcgtgatagtaaaaaaaaaacctctatatgatcattgatgcagcttaaataaatttacagacaagaatccattagtatgctttgtgagtgatgaacccttagaaccctatagttaatctaccctgccgaaatctcaagaaaatattattttccaaagcaatgctaggggttgtgccaggaattggagtaaaaacattcttattttctgaagttaaatttcaggtgctggttcaggaattcaccatcaatgaacaccgccacatataaaacttcaccagatatgaatacagtctgcagttacctagttctatgcttgcgtccaaaggtgtttaaaaacattcagttataaacttagacatgcttccatagaagcaccgattttttttcccaaatgccaattaagctaaagttccacaaacctgtgtaccttcaatgatgatttagttgcaccagctttgaggtacacgatatgtaaagtcagatcaacaagcacggagtggaatgcgtcaaagtgaactggacaatatgagtgtgaaccaaggagtgctcgacgtgggactctaaattcatgaacagcagccgaagaagtggcactagaagcttgaatatcagacctacagaagatagcagcattagtattgatgacttaaaatccaaatttcataatatgaaattatgaatgcgaactcgacaatgtgcactgtatcgaaagcactatatatagggttacaaagtatctgctcacccatctccagcgttggggcatatatcagctcaaatttcaatataacagatgaagctgctgggcccttaaataaataaagcagatccgctgattaggcaacagcaaaattgattgagaaaggaaagggggtattaaagtgcccaacctcttcttcactgttgaatatgttaaaagacaccataactgatagataaatgtcttgtctagcatatttgattcgaaatggctgcgtgtagaagctgttatcggcatcatctattttccaaatgcccaatgcatcgtccgcaccaacatcagaagctgcacaatccacctagcatgtcattacctatcagctaatgattggaaattttacactttaaaatatgtatgtactttttttggactaaaaatttcttcagcttttgagtgtgttttattccctttgtaatctgtaaatatttctttaattctataaaatcacactgttgggcaaatgcctgacagtaatttacttcaaaaaaaaaagcatagacaatttttgttgagtgagaacacatattttacagtattataccgtgttaaacactgtagcacacagtttgtcatggtcaggggctaacgatcatcctttagttgtaccctcattgcccatcattgttttgcaccaaaaagggcaattatcataaagctaggtgccaaacacaatttgaccaatgagctcatccataaggactatatgtatttctctacagacattctgcatgacatcgtaattaatagaaacaagaaaaatgatgtatgacaagtctgtatggtaactttccgtatacagctcaacaacctctttgatgttatattaagcatgattcaatggtaacaaaacaggcttggtaatttaataccaacgagatagcactgaaaattgtaacaaataccctcccccgttttaccagttagaattattctcttttcaccatcatatggtatatgatacacacagtcaattattggcagtgatcaagcggttcacttttatcaatatggcagtggctgttactactcatcaagcacatcggttgtaaaggtccaagtttcaccatacatttccatcacaaagcatcttgaaatcatgaaagtagtagaagtagatgatgaagccttcatattcaacatcagaaatgatggacgcaccttcatattgcacgacccttgcaggtgaagctggcgtcttggaaccaccttcctcccacgttgcactaatcttcatttggtaccacctgaacataacacaaaactacccgttagagaatgaagcgacaaaacaccttggcataatcaacaattccatacaattacacacaaacattcaacagaagccaacatttgcagtaaactgtaaaaaaaaatgtgggcgatgtcaaaattcagcagctcgggcacaatgtccacagttcaaaggagtgaaggagtacaagaaagaactccaaaacagcgagctgaactgaaagaagactgcaaatcagcaagaaatgttcgaacaagcggagcccaaacatttagttaaaaatgcagtgtgatataatgaaaaacagaaggaagaattcacctaaaactgcatgcattttctcgattcgtcactctaaaaatgtgaccctttagcacaagccgctcgaactttccattctcaaccaaaaaggaacagaacccaagaacacattcacggaaaagagaaacccaaagaaaggccaaaaagcgaaaaaaaggatttcacgcggccgtacccttgctggaacagatcgaggttgtggaagcggtggatgtaaatggccacctcgtgcaccgtctccatcacgtccggcgaacggaaggggagcccgctctttccctccgctccggcggcggcggcggcggaggcgttggcgttgtgcacccgcctcaaagccggcgagaccctcctgaccgccccgcgcgggctgtcctcgacgccgccgccgacgaggcacctcatgcggccgaacatggcgcgacgtccccgcgccgcctcgcccgccccgatccgcgcatccctgcctcgatcccctctcgcctctcgcctcttcctccaactctagtctctagaatctccaaaccccctactccagacgacggcggcgacggcggcggcggcggctagatgccaacgcgtagacccttcgcttcagcggcggaggagtggcccccactcctcagtggggttggcaaaattcgcagatcgggaggcgacggctgcggctgcggctgcggcggcggccagtggaagcccaagccagaggcggcaggagcaggccacgcggaggctgtcacgtggggcccagctcaccggcggcggcggcggcggcggtcgggatcggaggcggcggagttgggagggaagcgcgcggtggccggcggtgggggggagctggtgagaaagcaaggagacgtcacgggggtggattttaatagcccgccgcactcactgacatgtgggccccggtggaatcccgccacagtggagcccacgtgtcagtgggccatggaccagtatctgacacgtggagcctagcgagtggacaggcgattatggccgtagctggacggggtacagcaggtgggtgtattagggcgcgcgctcctcggccccactcgtcagtggctcccctggcgccatcaagcgcgttcccggaaagcgccgtcgtaacgagcacgcgcgcgcgaaacccgtttcctccgcgtggaagcgggttttacaaatacgccttcgctttatttttagtacgggtgggccccaggggacgaggtgacagcatgattggcatgtgcgtatttttgcagcctgacagcgacacatctctcgtcgtccagacaagagaagatgagaagatgagatgagaacgaagacggacacggaataaacaaaagaaaagaattttcgcgctggtacttggagcttacagtacggtaccaatctttcgagtttcgatcaaaaagaaaagaaaacgatgaaaaatcctgccacccaatagatgagaatagtgcgtgtacgccgtacctttttttttccctggtgtagtgtcactgtcactagggactttgaacgggaaaattcagcgtccgattgatgacaggatgaatctttccaaattttgataatattaactttttggtaaattgacaacattatcaagtttaataggatttgctcaatataatattgtcaaaatttcatagacattaccaaaatttggtaacaaactaaatataactatataattaacaattttactaaataatggtatgatttgaaataacatcaatctgaacaagtcctgcgctactcgaatcatgtggagaacacggagaaaggattctcgcgtaccaaacatgggcgccgaaaaacgaaccacaaaatgtgccgtttcagaaaagtaaaataaaaagcacacggagccacctgtcatccatagcggtcccgcatgtcagaccgtggccattaccgcaggatagacggacggaaggattggatgcttcggcagcctacttggaaaaagcgaagcaagctcgttttaccacagtaagacaggctataagtaaactacaaacatattttaataagataaaagagtaaagagaacgggctacagatctgtaaccagctacagcacgaactccgagatgtaatgtgtgtataccaggtgagaccatatattaatagtatagtaaacattattgtatgaattggctagaaccgataatgggttataatattaaacttgctctaacagcacaagtacgggaaagcatggtcgagtgaagtggatactattgctgcgtactccactggactgaggagtgcagggagatcgatccacaagggaagggggaatctagggaaaagcagtaggcatagccgtggggatcatccatgatcgcgtcgcgcgcgtccggttggttgctgtcggctgcttttctcttcacggcatcgcatcgcatcgcatcgatcggggcctcacctcacatgcgaagcggcgcttgcacaactggacatcacgtagtactagtactacctccgtcgcttacttgtctttttaagtttttatttgttaatgtttgatcattcgtcttattaaaaaaaattagaattattatttattttgtttgtcatttgctttattatcaaaagtactttacatatgacttatctttttctatatttgcactaatttttcaaataaaacgaatggtcaaacgttgcaaatataaagtaaaaaacgtcacctattatagtaccagggagtaatacacatggttacttctgcgccatactatgttccaagagagaacacaaccgcaatttctgctccaacgcagcatcagtcgatcacattcacagaccagccaaacatgacacaacaaaggtcaccgctcacggctcacgggctacgttgtgcgtgtacaacaaatcgctgcagggaagtgacacataatgataagggaacatgtcaacattacagttataaaaatactactacactagtggtagcacattctgatccaaatcttttgtcaccttgcgctctcaacagaaacagagagctcttctctttttaaaacagaatccacagcaccaaaacccgccacttcttgcgggcaaatcaaaataaactacacgcataacaacagcccgatggcgaacataccggttccccaaatcctcaaatttgggaccatgcacactacaacacaggcaagcaagtaatcattctagaaccattcctttattttaagctttcacttcttgcaaggcatgggtcaataaggatttaggggactcccaaaacaatgcaaaacagcaagtaacagtccaagatcaggatcaaacagcaaatcgctgcacggtttgataccttccttacaaatcttatatgtgtaaacacaaaaaaagagaaggggaaattatatcccatttaaagtttatttaagcaccccaaatccctaaatttacaagcttggtagccagaagagatcattacacctgtgctatgggacacctcactagagggcctggtggtagttcaacattcacagagaactttacagaggtagaatttttgcggtttcgctaaggaggcacacaagggcgaaacgcttctgtctctagcgtgatgatagttttctctctaggtcgtatggttatcttcaacaagacctgctccgcactgatttcctcagctcctagggtgaacattcgtttcaagttgcaatcatcttgactggaccactttgtagttaagaatcaaatcctctggcttcttccagacataagcccgcactgtggccaagctcatttcgggtgccaaaacctgcttcatattagtaatatttatcacagaggtataagaacctaatgcaagaaaagcataatgatctccaaattgaaataaacaggattcagcatttgaccttttactgactgctataaggaaaactcaatcatacttgctaacaatttatagcaaatttatcttgaaacatcattattacttgttagtcagataatgtgaaaaagaaaatatccatgaatcaagcagaacaggttaaaaaaggtaaatttaccgcacatagtcacaacaaaaacttattgaagactataataacaattaagcatggctagttaatgttgtataatttccccttcagtacacatgttgtaaactgcatataaatattacaatttattgatatagcacagtaggaacctctcctgatattttaaatcagaaaaaaaaagccataataacaattgatcagaggctaaaactctgttgagaatgtgagaaaaatacatggtgtccataggtgcactagacttcaaaacattcggagcaacaacaaatatatgcagggttatagaattaaatgcatggttatagaattaaatctgaattcaaatccattattgaggattattggggatcacaatggacaaaacaggaaaacagtgggtattagtgatgccttttttgttagtggtaacattggccctcagcaaaggggaacagtacatagaaagaaagaaacaacagttgaatttagaaatacttgcctggctgttacacaatatctctacagaaggtttcaatttttgccatggttttagtccaagccgtgaagaactatctagcgctgaaaattgtgattggccagaagtcaatcccattccaaatgtgctgtcagcattgccatccagtggtctatcaagtttctcgaccacatagttagctacctgtacaaagaaatatagcttcaatagacataacacgatagtctagcaataacaaaacaaaattgctataaaaaatggtaacatttttcctactcaatctcagttgacttcttgtaccaatgtggcccttctctgttctttcggtttttgtattgattaactctctgcttgtttgttggtttgcatttgcactagaatctccttactaggaatcaagaatcatgttatgacctgtccagagcttagcatgtttttgctagtagatttttttcattcatgatagtagccttctgtgatttcacttctactccctgtaccaaaatttagctaccttagtacttcaaatttgaattacaaaggtagctatattttgggaaggagggaagtaatttgtgaaatttgcgaatcagatttgctaaagagggcggcgtcatatcaatctgcatggtattttttggggggaattgagtaggtaatcaatcttgttaagtcttgtatattgagtgctagacaaactaaaatccaggttcctgaagcataactacctaatattatctaggtagtaagttcgcaacaatgaatcaggaagctagctaccagcacaaaaaaaaaaagcatggttaggtagctattttcactcttctgtccatgcatgcaagatgcaacagactaatgtccatttagctattttcactcaattgttatgcatggatcgccagcaaacggctaaataaattcttttcgtagaagaaattcagcgtttgttaaggcccaggttacggagcagagatcatggataacatattctcagtttcccaaaaacctttcttttccgttttgagagaggggggggtttctatttatggatttcctaaactagtttcagggcttatacgtttcaaaggaattgtaaaggactgtcatttgtttcaaaggaatgcaccaaaggaaaatttcctatccctccactttttagggggaaacgaaggaaaaacataatccactccaacacaatgttttcaatactttggattatttgctacacaaccataggaaagtttcctatgtttttcaatccttaggtttgcacatgtattccaatactattcctacgttttgaaaatcctacaaaccgaacgagccctcatattacacgagttttcttttctttccccaaacaaacaatcagtgcagtcaaaataaacagaataacctaaaacctaatttattagaaaaactcctaaaaccaattatcctaaaacatatcaataattcttcgcatccaagcacctactaccttatactccctccgtcccaatatgtagcaacctaggatgggattaatcctaggactacgaatctggacataaggtatggtcagattcgtagtcctaggatgggttcttatgtccagattcgttgtcctaggaatcccatcctaggttgctacatattgggagtgtgtatcaagaaatttcaaagcaatcttactttgtgaatccgcaatatccgtggagcactaagtttcccttgtgttatgttcggtgcaggtgacccttcagcaggatgcaagtagaatccacacctacattaaagaaaagaaaataacatcagtgactagtttgttccatgacagttatgtctatgcaaaggcaccctgtgtataacatcaacttttgcagaaaacatcaatccaaatctcacttgctcgtactttcattattttcagtaaataccctaataagatccactattaacatgaaaatgggtcaaatccaaaaaggatatgcagaatctattgttttacaccctcaggaatttagcactgtgcagaccttaataaatagcagataatttgatgccttgcagagatcttaatcaaaccttgtggaaaaaaattactggtggttcaaatataggaaattgaatatatttaaatcctttaaaaagaaagaatagattatgccagtatctaatcatcattgtatagaactattagcactggaactttcaaagagggatatcagctaaccaagctatgccacaaaatcgtggcagaaaccaaatactcccccagtcccaaaatagaacaacttgtagcattcaaaatttgtcccaaaatataacttctcaacctacattctcttctcaaccaaccacaatcttccgctattcaaactcttcacctattgccttttctcaaccaatcgcaaccctccctcatttaattccacctactttcttaattcccatgtccaaccctaaaattccttatactttggaacggaggtagtatatatataatcacaatatgttcaacgaaagaggcaaaatagatgttataaacaggctttgagtaaattagtatcacagaggggacatttcatatcaagtccaaattgctagagagcacaaattttgaatttctgcaaagcgaatctccaaattaaggtataatgcatcacgatatatgttcaccaaaattcgaggaggaatattgaataatccactcaaacagccatccctgtgtgccctctagcaaacaacatacctaacgctcatatgttatacagttcacaaacaacagcatcaacgaaatttgggcttactattgcaactaaaatgccttgaccttctaaaagcccgagattccacgaaatactaccttccaagatagtgcagcatctcgaaagaactcaagcaatggtccaaagatataaagaaaaataccatcttaggagaataggaagtagaaatgagcaattactttgtattctcttttggaaatcgattatgctcaacacagtccacaatccaccatgggatatcgctctcggttccatctaaatctgtaattctctttctccaaggccctccacttgaaccttctgtgatgattgatggaggcgaaactgtggaaaactcaaatgagggaagcatctgacttgcatgattttcagccccatcatcaacctcagatcttggatggggcaaatttttcaaggatacatcttttcctgttgaagtgtcaccatttgacaagccgtgtgagccagatctctgcttttttttactccaatgaactaacaaaccacggagagtctcctgagccaaattaatctgcatttttttaagagggaattgttaagaagttgaatcaggtatgaatcagatctcacttgcaagtggcaatcatatcaggtgaatttcatcattaggtgtcatggatggtttgaaccaagaatacaaactaaaatatatcaacaaaagaaagaactttctgtcttagtaacagaatgattgaactactggtgcatcaaaagtttgaagaatgataagcaaaacaaccagttgacaacatatgattctgtgcaaaccttaagatcttcctgtgctcctgcaacgtttaagtcaactgcatatatttctgcagaaaagcattgaggtgtatccaggtggacagacaggcatcccaatcgagcatccatggtaaaccaggcaggtatgctaacctaaaagtaaagacacaaattacatactagtaagcagcagatttttactacacagagatcatgagtttatcagtaataccatctcaaacaactcttttttcttatcctcaaaagaaacctgcacgaacaaagtggagtggcttaacattctatcaaatatcaaattcattcaaaaaaaaatcaaaagacacacagtatgaactacagagtgcccgaaattgggactgaaactagaattgctgctgactctcaacatacttaaggatcttttcagggaaagagctattcgctaaattgagcaaaaataagaaccttgccaaagtcttcaataacagctcctcgagtaatctcccacaatttgacagaaccagcagtatcctatgaaataggagcaaggcatataagtgaactctttgtaatctgctaatggtagagcacatgatggaaataacacttgtaatcaccttcgtcaatacatgtcttctattattcaggatctcatgctgagttattgctggaactccaggaataattgaagatggttctttgtgtatagggacctaaagtggtataatcatgatataagcactcattaagcaccaataaaaatgttgcccatagttaaacaaactttctatgtttactcaggcaacagataatctgtcaaagaaattgcctgcttcagtgtggcaaagcatggaatgaatttgtgtctatgacatgctgggtcactatactaagacttgtatcacgccaaatatgtagcagcaaaccaaacaacagcctccatgttgtggcttgtgtgttacttttaaagatcagtcaatctcaaagttaagttcacaaggtttatactgcagaatcccttataccctattttatcttcaatgtgcgcaagtatgacaatcgctatggcatgtgaaactgttattactgacttaaaagtgtgtctgcgaagaaatacaaaattattgttcatgatacaattaatgaaagatggcaaatgtcatgcttacaggtgctgatccttctaaagaagcccttgccctggagaatgacaaattgccagctaagaatgaagaacctttttggaaaagctttaggggttcatgcgcttcagctttccatccattcacagaagaatcagttgttgcaacccaaatcatatcatcctgcaaggacaattgtagaatcgggtgctcgtttgtgcagagcaagacactctctcgattgcttaaatctgtcaagtacacctgccatccaagaaaacaggaaggttcagaattcagaaaagaagcaattatgcaacatttgaaacttgactcaccgactgatctcttccaccactataaacatgactaaacgaaggagtgcttgcaagcgcccagactgaatcagtatgcacagcataagaatgaatacatcgctgctgtcccagatcccataatctgcaaaatccagaaacatgtgcagacaagatgttacatgacttcatgatcagtgtgaaagtacagatattttagtgtgcatacacacatacacaagatctggagtgggcaagactagaactgtgaattaccttatcattgaatcagatgagcctgaaagacaatacctgtaaacattttacagaccaaattaaattactagctcaacaaattaaataaccccaaataataatattaataataataaaataaaaggaaaaaacattttgtgttaaccatttgcaaccaaatattgctgtcaaacatgacatgtaagctaccacaaccacaccacaccatcttagtcaccagtcagctgacctcacacgatgaaatgaacccctctaaaatcatcaagctgctagtaaattatacatgaaaatgggttgcatggcacataatatgactacgatggtaactaggacaatcaccagcagttaatgtcaaatccaacaggaatccattcacgtaaatactgctgaaatttaatgggggctaattgataaaaaaaaatgttccacagggcaagcttatcaaataatacatggtccattgctaagatcaaccatctcaaatttaaaaagagtcagagggtaaggggtaaaatctgatggtcaaaaaaagtacttttaagaagcatgcagatgcaactatatcaggaatatatttcacattccagaagatctaacaccatgacaatcactccttagcactcaatggattgtatacaatacaacgaaaatcttcaatataagccctaaaactaatactctgtgcaatcaaacccaaaattccaattattgatttgaacccctgaaatattgaatttgatgtaattaaaccattcaggtttaggcctgttaatttgaatcccactgtgcacctttactactaaaactgtaaactatatcattcctactaatctacaagcaagatgagcaactgaagttcgataactaaacaattgtgtagccttattcaagttatctacacaaaagcccaacagcaaattgttgaacatgagttgcagaaaattgatctctaaggtcctgttcttttcagcttattcaccggattgctgaaacatattgtttgttctatgcttcgaaaaatacttttttttctagaaaaaaagtttctgctactgtgttgcttcgaccacttattttaagctatttattaagtttatttcttcaaatatttaatttatcactataacctggtagataatctgtggcaataatccacaataatctaaatcaaatcgggaagcacgctagacagtttcagtaatagtttgtgactgtgtccctattcaggttgcccatgttgacacatatctgtagttacatcaccagtctgttaatcatgtgagaaaagggtactaactaaatatatccagataacaaagagctaaaatgaacaaacagaatagttgagagctcaaaccaacagaatagagcttaaagaacttgattgcacagatttgaatagttggggacttcaaatcaacaaaactggagttggactttagggtcttgatcatacacttgtagtgctattttcccataatatatcaacaatattgtgtgctgaactaattctgagtttcaaaaaaaaatagcactgctgacctagagctctttcatggatgatgaatgcgatagaagaccaaaatacttgacaaacactaaatttagcgagcgaagtaataccatatccaactaccaatgcgaaagccatcaatttgggcatgaacaatggtgtgatgtcagtctgggagaagatgctacataggatggtgtggaagagaaagaaagcggagagagaaggatgttgtatcttgattagcagagaggatagcttaataaaatacaatcgctatgtataccatctatagagtcaaatcattaattatgcaaatctattacagataactactaagtagacaacctattgtagaagttgtctacatataatctattatgacgtagaacgataatatagacagcggctgtctaaactacagttcatgctccgaagaacatttggatatctcagaattatgacagatttagaattacagatactaaaaacaaatgcagagcacaagtaactgcaggagattgaaagaaagaacacccataacttattatcgtggaataagaggctaggatagatttagatgacagtattgaagtggggcagcaatacgggaacagaagtcaattttaagggatattgtcaaggaaaagaaacatcattgtctagatgaatctacaagaacatttcacacaaacctgccagtaggatcaagaagtaaagccctgatattgtcagtgtgccctctcaatttcattttctttgaaccagtcctgggatcccaaacgcgaacaacctacactaaacaggtacatataaggaaatatcacaggagaggtctctcaaaagcagtccaaagaaattcgcacattatggtgcctcctaaccccaaggaaacttgcatactcattctcaaagatgaagaacataataccttttcagtaccaccagagacaagtgtgtttcctgtgtcactcatggccaatgcataaactgaatctttgtgacctttggcagtgattggactgtacccatgtgattgcccattggtggaagcaaggttgctgctagaatttacattgcacaaggttgtcaaagcaggcccagagtttccattaggagcttcatcctcttttgcatctacagatttggccacaggagcaagagaagaatcaaggtcccatataaagacctcaccgccaaggccaccagaggcaacaatattgctctacattgcagagaataaaaaaaaacatgtaaaacaaaagggataaaatgagtagttccacagaaaagcatagtgctggataatatacatttttttcagatgcagcaagacaaatcacataatcggaatgctggcggagagtcctggtacaagcaccatctgataaacaattccacacctgtgaaacaattaggaattaaaaaacatgtggatccaaaatgaatatataaaaactgctgaaacaacagacctttagagtggtgtctgaggaacaggaaacaagattttggccaacaataatggcatcattaacctgcatgataaatatatcagcttaaatcatagaaagtacttcagagataatgaaagcgtccatgttacaaaattaagctcaaatctcctcaaggatgagtttctccatcaatgatagaattccatccgaaactataatacttggatattgaaaactatgtagtcttctttccatctgatcctcttttgttttggggcaagatgcttatacatctttattcaaataaaagtggcaatggatcatcaaaaaacacgataatggataaatgttgctatggtatgcgtcatcatgtaactttgggctagtaaaatttcaaaacgtaatggtcaaataacaatattaaatcgactggagtaaaaacagagaaacgcatacccaatcaacatgtgactcaaaagttgctgagaagcttgcgactccattttttggttcccacctcttcaaggtaccatcccgactcccggtaaaaagataatcactcgtaccagaagtagaggcatttaggtatgacaagcagttgatcccagcacaatgctgaaaaatagacacaatggaatgcatgatgagacatttgcactgaaaatgaattcttttgaatcaactggatgcatccgcgattctgaggatagctagttctggaagtggaactgacctttttgttatcagcgtcattcagcacatatgtaaagcgcttctcctttctcggtcgacttgaacctgccgtgttaccagcacttccaacacgatgcattgaaagatgcctaatttatctaaaaccggagcagcttatagcctacaaatcagtggcatagaacttcaattttactatagatgaatatatatcaagccaagctgcaaatattcagctattgaaaaattcagcctgtatagttcacatgctgataaaattcaaaatattaaggtagaaataatcctgccatcattttacacaaggtacccccaatcagggccgaacctaacgtggggcatgggggttcagccaaactttttttggaaacaaacctaacctgcagctagtagtactactaaggttaataaggcaaagagaaaagcctccggatccaaaaaagaagctaggattaagtctacgagaaaaaggatgcgggtagtggacgagtaaagaggacgtgtcgtcccaccggcgaggatgcgacagacgaacggacgccggcgacgctgctcgccggacgagatcggagttggtgggcgcaggcggaggggccgaactcgtcgcaaagggggagatcgactagggcgcagtgccagttacgcttgccgctatacggagatggaggcttggattcgattccccgatatcaaatcaaacccccccgaaaaaaaatcctcgcaatccgagcagcaaagtcaagagcaatcggcagcagtccccggctcgagatggatctcaactccacggcgaggtcggcagcacgaggaaggggaaggatgggggaggagaggagagtaccgtaccttcgattcgacggcgaggtggcgcgcggcggcgaggcagggaggcggagggatcaagcaatcgccggcagccgcgcctggtaggggaaggggttgaggcttgaggggaggaagacgaactgacgagacgagagagagggctgaggggtgtggttatatgcgcacgataaatttacagtgaacgtgctatcaacgggtgacatggcaaatagcaatgttatactcatatctattgctattgatctctttgttgtccacgaaatttattgatctctctttttctaataatttaattagataatataaactactatgtgttaggcttggtaattgctgacatcatataatggatggataatatagccgtccatgatgtcaaagctaattgaatatctttttttttcttagtctatttggcttgagctctttgattgttcttgggagtttcatacaattttagctccaatataaaagtcaaaaatcttttttccaagaaatgtcaaaagtctatttaaactacaaatttgtctcatcaaaaaacgttaataagctagagtggcctttataactaaagcgagtgaaaaccacaatgtttgttttatttgttcaaggaaaaaacccagctttataatataaccaatgtaatatacggacttgtaattcttcttttagttagactcttaatgggtaagttttcaactaaaatgatccaaatggtattattaattcataatatataaatgatttctaagccaaaaacatacataagtccactgaccacctcctccttcctctttcctctgttctgaataggtcggctagagtgtttcatttcactagctaccgtatttcttaactttttcaagtttctaaataggtcggttacagtgtttcgtttcactagtttactatatttcttaacctttttctagcttgtaattttgtatcaggactcacttctatattggtgtagaccaagtatgcatcccttcctctgtatataaaagacgcagtgtgaatatattgagtatattcatatcactagcactcggatatgcacactgtaaacactgcttctagttactatagcttctaccagaatcagaacctcccataaacagtacagcttttgatccagattctgataagctaatccagaaaaataaactataaaccaaaagattctcaccagctgtttcttggaatcttaatctcccctaagcagggccgcagtctaggactccaggtacaccgaacagcccaataggggcacatgcatatacttgtgttgctcaggctgaaatactatcaatcacacgaaaaatccgttttacacagcacaacaatacgccaccaagaaacgaacgcgtaaagcacacaaaagacgcctaacacgtcacacaattacgtcatgttcgcgtcgccgaactccggcgaccgagcggagcaacaccggcgtcagtcacttcactgcccgcccgccccgcgctgctgccgccgcctcctggccgccgccgcggcgagcgcgagcaggatcaccgcgggccccaccaccatccccagcgggaacccgccgcgcctcctgcgccgccgccgccgcggcccctgccccctgggccggcgacggccaccgccccggttcgcgccgtctccttcttcccccgacgtgctgtaatcctcgctgtcactggaccgtggttttggctgctcctccggttcgccggcggctggtgtctcgtccgccgccggtggctcttgcaccggcgcctgttcttccgccggcgtctctgattctactggcggcgtctccggttgaggctcttgctccggctcggcggcgggtggttcctccgccgccggtggctctggctctggctctgtcgccgtcggcgtctcttcagctggtggttcttgcaccggtggttctacggcggccggtggcttcggctgctcgggctcgtcc

SEQ ID NO: 70596 - DNA, 675 bp, Oryza sativa
tccgctcacccgagctcggagatcgccaccatggtggggagaaagggtggggttggagagagagagagagagcgcaagaggggtggaaatgattaggtttgtggcatttaagcgagagagagagagagagagaaagagaggggttcgcgtggttcgagtagtgcgagtgcgtgtgtgcgtgtgcgcgacgagggggggcgcagcgcagggggccgtacagtagcgtgagctcccgcacagtgtctgaagagtttttaaaaagttgggaagcgagggggttttgaaaaagccgtattttatgggctcatgtaagcggctgtcgggtcggtgtaaccacggccgtaagagcaagtttaatagtataatagtatagttcactactagctttaattcatctataaccaatttaatagctaattcgtacaataattatttaatatattattaatatatggtctcacatattacatatattgtgtcttgaagttcgtgctgcagctggctacatatctatagcccgcgatcacttatcttattaaaatatgtttatatctggctaatagtctgctattatatatgctctaatggtgacgagacagatccatccaccatcccggcatatgcagctctccatcgcacgcagcgcagactggtgttcccgtggggctgcaggaa

SEQ ID NO: 70597 - DNA, 717 bp, Oryza sativa
tttttttgtcatattacatttgtagctatgttttgcacgcttttttgtctccaaaattttgttgtaagttgatgagggagaaaatttgtgtggggaagaaagaatatatagaaatttagttgatttgctaaagaaggttttataaaatagttgagaaggaaaactattgtgaaagttaatcttgaatactagaaaaaaaaactaaaatgaaaattaaaagaagtaaaacacattaaaattagtttaaaactttagaaatagtaaataagaattatttggtgtaatattttatgatttttgtatgaataaagatatgtcattattgtatgactgttgaaacagtttgtaattatcttataattattgtatgactatcattattgtaagaataattatttttgtacgattttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagccataattgttggacatcccacgaagagcaaggtgttgaaatggaagaagatgaagtggaagacgacaatattccggactttgctcagtacgttg

SEQ ID NO: 70598 - DNA, 695 bp, Oryza sativa
gttaaccagataataatgttttcttgtatgtccccaattattatcattccttctcacacaaaaattgtgccttttgtatttctgtaattttgtcataaaatgctaccactttgtatattacaaggaaataaccattatcatggtttcttattagtcaatggcatgtttccgagaacaagaaaggattaatcaatactctttctgagaacaggaaaggattaatcaataccaacttctttttgtaattttatagaaattgttggttttccttagcagtggctggtgatgaatttcactgcatcatattttatttgctttcagacaagatatgatggcaattgttccacatgaaatctgctaacacatgcatatttggtatgtacttctatcctgattatatggctttacctgcccttttcaatgccttctacggagtgtcgcctattaaaatcagtaattgacaagccacatggcatgctcatagtttttttgggttaaataacttgaagcatttcagcgtagaagctgggtaaagtatgggacaagtatgtcgctgatcatctccacttaaggcgagaaacatttttcttcatttgtttcaggaattgtaaatgttcttaggtttagaggtgagatccatgtgcatgctatctaactgatgctctctggtttaccaaatttgtggggctgcagga

SEQ ID NO: 70599 - DNA, 4111 bp, Oryza sativa
tccccgacctcccaagacgacgccggtatccacgacgccggcaactgcaccgccgaccaggtacgacgcccccctcatcctgaacatgatatgatgaatggatgaattgcagtttggttggatgacttgcttgaattgaatggatgaattgcatgattgatgaaatatatgaggtgatgaatttgcactgtttgtggatgaaatatatgcactgtttttagtctttttgtattagatgattttaggattaattttggccttggtatatggaatatatagccagggttaattttggccttgattaattttggccctggtgattaattttgtggatgaaatatatgctactgctgttatatggccctgctactgctctgctgtttatgtttctgttgtttctgtttatgtttctgttgttgtttatggccctgctactgctgttatatggccctgctactgctctgatgtttaattttggccctggtgattaattttgtggatgaaatatatgctactgctgttatatggccctgctacagtgctactgctctgctgtttattaattttgtggattaaaaataatgactctgctgttatatggccctgctactgctcttattgtgcctacttgttctttttttttatctacaattgtttatatacatgatttatataccactgctgttgttgcccctgtacttcttattaaatggccaatgatgaattgctcaataaaattctatctatacctgttcttttctttatggataagaacagactatctacacttgttgatttatatacccttgctgtcaaggatgaatttccctctgctgttgctgtttatgtgaatttccccctgttgttgctgtttacgtgaatttccccctactgttgctacccctgtggcatatatacccctactgctgttatatggccatgctactactcttattgtgcctacttgttcatttttttatctacaataatatatgcatgatttatataccactgctgttgttgcccctgtacttcttgttaaatggtcaaggatgaattgcttaataacattctatctatacctgttcttttctttatggataagaacagattatctacacttgttgatttatatacccttgctgtctatgtgaatttccctctgctgttgctgtttatgtgaatttccaccctgctgttgctgtttatgtgaatctccccctgctgttgctgcccctgtggcatatatacccctactgctgttatatggccctgctactgctcttattgctactattatatggccatgctgttgctactgctctaatttcctgcacttgctcttttctttatggataagaacagatgaactacacttgttctattttatggataagaacagatgaactacacttgttctattttctttgggttgctttttcctcctagtagctgatttcctctttttatcccttcatgcaaatgattataattgatgcatatttctgagcaaaactgaggccatatctttcatagtataccccgtattacattggatctaatgctatttagtataatggtaggaaatttataagctttttcgcgaaaattagaccatgtcaacgcccggcgcaaacccgctctccccaatacctgcgaggatccaggaagaagcaaacccagccacggagacagttgccgaaggtcatcccgcgacaacggcggtccaacaacccaaaattcatggtaatttataggataaattttcaccacatgaccacataaattttagctagcaccccttagcaaatattgccttctgtttgtgctgcagaattgccacaggaacaacatacatcgatgtcgggcgggacaagtgcaagtaggtctagtagaaatccctagtcacaaaatatatggccgaccatagtgcaagttataagagaggttgacgctagtggtaggcccaccgcgcccatgactgtcattggaagatggtctaactgctgcgggctagaggcacgtaagaacttccggatcctccataaaaatatcgggaagggcacagaagccgagaaagagcgagcttggacgggaatggagaaatggttcacatttccggctgaagcaaaggataggctcaagcggaaggcattccaaaagatggcaaaagcttggaagaattggaagtcgaagctcttcaccgagtttgtcaacctgcccgacaatcatacgccgttcgatgaataccctcaaataaccgaagcggtgtgggaggaattctgctctctcaagacctcccaagagtttagggaatcaagcgaggcacatcgcctactacaacagcggaatgagcacccgcatcggctgggcaccgcagggtacatcggcaaggaggcaatatgggcccaagaagatgcagccgctgcagcagcgaatgtccctgccccgttttcagacatccctgaacaaagagctcgcaactgggtgcgggcaaggggtaaggtcaacccggacggctctgtcacatttgagaacaaaagtgatgccgtcgtctatcaggaactggtgagttcactacttaacctaactaatttccgctcgtataaagtacaagttcgtataaacgactattttcttttctagttgggcttggttgctgaacaagcttcacaaagcgaggttgagtccgcgccgaagaggcgcgaagatgacatcctcacaaaggcacttggaaccaaagaacatcctggccgaactcggggaattggtagcgatgtgccctggaagcatggactctctcagtacagctcccaatacaggaaatgaaaagtctccaaggaagagagggatgctcgtttgaaggccgaacataaggttgaggtcattcaagaactagaagctagcatgaatgcaagggtggaagaaagggttaacaaggtcctcgccgacatgaatataccccgtcacaacacctgctgtgcaaccaactcctcgtgcacaacacgacgcgagtccgtcacagcataggagtagttgtgcatccacagaggtgccggcccctggtcttccgatcgcaccactagctgcagtggaccacatcgaggtaattgttgttatccgatccatatctaataaaagacatttacacgttccaatattaaattcaaactttcaccttatgcagggcgcagcacagtgtgtcctactagcgagagtccacccaactttcgctcctgaagtcgctgagggcatggctttcaagccctcggttacagacaaggtccacggcgcagacctactagctgggtatgccaaggtgtccatcgatatagtaaaggacacctggtcaggctatccgctgcccgtgcccccaaatgatgaaatcatgactttaggcgatgcgcgcaagacgttcatacaatggcccaaagaagacatagttgtgaagatgactcctcgtccaagtcgaccgacggagtttacacctcccaagtttaagctatcaattgaggctccccgtggaccggcattgtcagtacctcattctcctggtggagctgatatggacttggcagatatagctcaaagcttggctccaataaagaccacaagaaaggccgatagctccccaccacttgtcaagggccagaagcgtgaacacggcaaggggaaggtcggggagttggcgccggagccaaaaagagacaaggctgcgacgtcgatgccaaaaaggggcaaggctgcgccagctcaatttgagctaggcatgccattggtggaggacaatgtgttagccgtgatgggtattgcttgccgagagctacataaacaatacatggagctaagcaatgccaagcggaaaatgagggagtcatccatagttagacatcacgaccaccagccgttcctatcgtcgcctgcctatataactataggctttgatgacctcttcgaccttttcaggatccggaagttggacactggtcttctaaaatgctactccttgtaagtgcataccttctatacttgtgatatgattggactatatctcctaattaaattagttctaatacgtaaatgttttaaggttgtgttggatcgagagtcg

SEQ ID NO: 70600 - DNA, 1054 bp, Oryza sativa
tttttgaagttaaggtttttagtactaacactacataaccactgcgcaggcgacatggattctcctagtcatcgtacctaagtggagtagggttacctaccttaactccaataagtccaaagattatgatttcagtgaaatcaccaaggccttaaatatggcttggggcccatatgtggaaaagggtggtaggcacaagaagggcaaggacgaactttatcatgacaccaagtttgcatgcgcacaacagatcggagaccaatgtggtttccacgtgtgccacaacatgttaacacttctaagagaggtgaaagatttcgacccttaggttgttgctaatggcgaataagctcatttcaatacctacattgctattgaaaacgtgctaattaacctcttatttattaaacagaaaggtagagctggcttcaagatctcacccatcaaccctcccgctatcagaggcgaagtgtgcgccttcattcttgcagaaataatgaacaagaaaggacgttttcatgtcaaatagactcatgaacttggctagataatttattgtgatgtaaaaagatgtttttataatttcttgcgatgtaaaaaattatgtttttatggagtgcaatgtaatttactttcatatgtgcaatatttatggtagtttactaaattgtcatcacatttgatcaactacgatttacgttgtactattcatctgttttctccttttttttcccttattgataggttgtggaggtcgagtacattatggctttaatccatttggtaagtatatatgcggttctatgagcaacgaccgaaattgtggctttcaaggggtgtgaatttgctgtgcaaatttgtggcatttgaactgcatatatgtgttgttggggatctgtgatgtttgagatggatctgtgatgttatattgggggggtgatgtatctgtgactagaatatatctgtaatgtatctgtgtttcagagggcatggctagcaaatcctaagactagccaatatttagcatttatttatttcttctgaaattaactca

SEQ ID NO: 70601 - DNA, 7037 bp, Oryza sativa
ccaagataccacattatcattcactaattaacaagatgctacatcatcatccattaacaatcatcacatttaaacatcatgcaaacatgctatatctttatagtttttataatttaacagcttttcaactacaaacatgttaaattatcatccaacatcattcacataatgtttcaatgtatatctttttatgttttatgatatcctatatacttatatagttcatcctcacttagtgattaaatgattaatctatggtccaaattatctttttccttttttcctctaattaagtcatatcacatcaattgtttttagcctttagatgattatacggtccaaattatctccctacttttcttcttccataaagtcataccaacttactttttacgtttgaatcaccaatctatatactaattaaatttaaattatcataaaccacattaatttacttaatctgatgttatctatctatctacatgttatttttttaaagttatcataccgaattcccgcagcaaatgcgcgaggttttatctagttaatatagcacctagccaccaagtgtccatagcctcgctacaacaaaacaacccaacggagacattttatttgtaggatagagacgtgacgttttatttcgtctcccacagataactgaggcgcttttataaagcatagtaggaatgtcaatgtttgcaccgtctcaaaattatggagacgctttttaaagcgtacctacattatataagacgttgctagagacgtgtaaattgcatatctataaaatatagaaacgcttttatacaagcattaatataggcacatacgtcttaatatatttgatattgaatatttaacgctttcatccgggctcgcacacagcacctacgggttgcaaagttcaggcactaaccaagtcattgacgtgaacaatcttgaaggtaaatacacttttttttttatattgcaactcttcaaacatgcgtcctgtagcagatactcttctttttaatctgagactggatattaaatattcaagtttttttgtccaaataaatataatattattataatggtatttgatgatgacgattaggatcagtgtgtttgttttcgtctttctctatataaataattatatattggctaataacgatgacacgcatataataaaaacgtctcaaaactcatctgtacagatgagacgttccaaaacgtctcaatattcatctctaaacgatttaattttgtgctaacctgtaaagcgtcttaaactatgtcctcaacaaataaagcgtctcaaacatcgtccctatttcaacattaaacaatggttctgttgtagtatatcctctccttgcgtatgtacactacatggttacattatggtgcccttctttatttaaaggattgtcgggttatatagtccaaatctaactccactccctgcgacatattccaactccaagtccaactcctagtagaactagtatcttcgacaaatattctaacaaagtccagcttcgaatatatgatacctagaagcagtagaattaccataccgatccatcggtcctccaaacttgaattgtcttcatttgaatcttcactgtaagccacccgatgagcctacaccaaactcaccgtcattaagagactccaccttaactcaaccttctctcgactccacctttccaccttctttcctatcattaaagtcgtattgcaaagcgaaaatggactactccttagctgaacaccctagactcctcgaagactgtcagggttatggataaggtataccctctacccttggatgtacgctatacggcaatacggtatatcggcgcgtgtacggacgttctctgaatacgttaaggaaattcatttcgaagtccaccaatggaaaggttcctacccatataggactgggtcgcactatatcgtgtagggtccgatgtctccgagtcctacttggagacctcctgacctgcgatataaaagggaccctccgggaagacctagggcatcgaatctcatagccaacatgtcacaccctaaaaattcaaattatataaattgttgtttaaatggaatttctagaaaataattttaaaagtcttgaaaagaagatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtcctcttttggctttgggccgaaagtcggcccaaaaccgctttctctctctcctcggcccagccggcccagttcgcagccgcccgcgcgcgcgccctcgctgccgctgacaggtggggtccacctgtcaggcccgtcgtcttcctcgggccgaaaccctagcacgccgccaccgccgttcctttccaaattcggccgttcctttccttctccggccgagtcaatagaggggaaatgatcctcgggatctcctctaccttttctcctttggaatcatcggctaaatcggtttggaaatcgagggattcgagttcgaatcggatcgggctctctctctccaagccgagctttccttcgccgttgccgtcgccgtgggccttcgccgccgcctccgagtccctttaaaaggctccccgtggtctcctctacccgtcgccaccctcgccttcgcctctcgtcgccggaagagctctagcgccgtgtgccctagcgccgccgtcgtcgccgccgctccagccgtgctccgccgccgttccagacgtcgccgtcgctcgggaaggacgtcatcgtggtcgccgttgcgtcgccgtcctcgtccgccccttcgccgccgccgaagatcgccggagcatcatcgccgtcgtcgacccgaagagcttcgccgcttcctcctcgtcgccgtcgccgtccgttgaccttccgccgccgttgtggtcaccggtgagttcgccgcgtcgtcctctacgtgctggtgccttccgtttgcgtcctcgcgccgtcgttcgccagcgagcgtttgcgtcctcgcgccgtctgctccgccgagccgccgccgccgtcggtgacgtcattgccgacgtcatcgaggtcgtccgctgtgagccgccgtggacccgatcgatctcggccgtccatcttagatcggttcgatctcggccgtccgttcgcgtgaaccgccgccgtgcgcccggtccaccgcaaaccctagcccgctgacgcaataaaccttcttttccttttcaaaaataattcattattgcgtcataattcaattttaaccgatataagtgttttaatccgatttaatctttaaaaattcataactaattcatcttagctccgatttagttggttcaagtctctaattttttctaaaattgagatctacatgttaaaaatatccacatgtactgttcatgcttgtttatgtgctgttttggtgattttgttcttttctgcttagattccgtcgtttccggagagtccgttttcgccggagaagagtttgaagagttccaaggccagcaaggcaagtcacacagatcccaaacaaccctttgagcatgttgatcctatttaaagctattgtttctattcaaatattgcatttattttcgaatgtcattgggtggaattaacctattgtttgttatagcccttttgttcttgattactttattccttgataccttgggttattataacttgactagttgggctttatttattggttcaactagatattagatataattgctcagccctgcttagaaacattagcacactattgggataacttatgactcactttatttaatgatggcttaatgatagttcacgatggtcaatcgtgattagttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcaatggattgtgttgtataaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccataatagaagatgctataactggtaaaatttgattagctcctggtttggaatggtatattcctggtttggagatagaactgtgcagccgggatggttgttcagaatggttgggcctatgcaacagggtatgttgtatagcgttggattaatattgtttaattacttaactgttttattaaattctcaaatgtttgctaaaagctgcttttgcaaatgaaaccctattatgccatcctttgttatcctgtgcacttgcatatttgctgcgtggcttgctgagtatgtcatatactcaccttgcaatcattcatcagaggaagagttctacagtgaagctgatggtgtggaggattaggtgtagccctggtcaagctgcctgtggagtggagtcgtccgcgccgtttatctttttccgctgcttagatctttattgattgagaggaactatctacctctgtaatgatattttatacgcttaataattagagtaataactgtactctattatcaatttgttattgtgtgcctcggctgattcctggacgagggtttacacacatgtaagcgtttggaattttggatagaaattccgggcgtgacacaacacaacgaccacagcctacgaagccggagcctacaggagccaagtcgccgggtgatctagtcgaatcaactcgactacgatctcgctggtatcatccagttctattattccctttgtaatttgtggtcatctccatataatcctatatcaactggattagggctattacctatttaggggcctgaaccagtataatctttgtctcttgtttccttcatgtcgtactacgttgatcatcgtaccagtgtaccccaataccctctatatccggtctatgggtacccatcgtcgacagtggcgcgccacgtagggagctttggtgctcaaggttctactactatgacatcaagcttcgtcgacaacggcgtcagcaccggccccattcatggagtccctacttgaacaatgctggtgtggactcaagttggcgaaatcatcttcccggtttacaccacggtgccaatctcggctggtccatcaattatcggaaacgagaacgccgtggctataaccccggacgatcccgcgtctaaggatcctcccgccgtagcagagaatggaacatcgacgtcatacgagcccgagaaggttcctagtgtggccgaaccttgtccttccgacaagaactccgagccgacaaggacaacttctgaggtaaaaaagtcctggtatcctatccacaagtccaggaagcacaacttgcaagcttgctgggtttttctcaacgtacaagctaaaattcgtgcttgcaaagagcgtggaatccagcgtacttctccaactcatgatgtctattgtcctattcacaagacgaagaatcacgacttctcaagctacaaggtctttctccacgccatgaaaacgacgcttcctaaggtccagcaggtaggaacctctcgtaagggcacaaacaaggaacaaggagcgacgttgacctcggatcgatttgttggagtaatcgacattgatccccacgagccatcagtcctacacttgctcgaagactatggctcatcatcttccagtacaccacgcgacatgtttgccatcggtgggactagcacgtctgcacacgctaacgcaggggcggagaaccagacggtcacgccggcccaacatctcggcaccatcaatgcagtactgagagaagctccctatgaccccgttcttaacgatgatctcgcacgatggatagaacgactatgggaatcggtagccaatctcagtaacgcgttcgaggaagccgctaccagagcacaacaagagcgactgatagctggcgctgccaacggcgaaccaccggagcagcggacgtcacctagatgagctacccatccacctcgcagcaccggcgatctccgcgaccatctgaatggccgccgagaagcacgacgcacgcgagacaatgagaatcattcccgacatcgtgtttcttcacaacgtcgcgagaacgaagagcgagtgtcacacccagaaattctcgaaccagaatttgtaagctgaatgtgcattaaatccctgtccaggaccagccagggtacacaaacgacatttgttgacatacagacccacgtcttacaaaaatataaaagattacaaatgcagcgagaaagataaaagcgagctaaaccgggaagcttgacttcagcagcgggcgactccactccacaagcaaaccttgacggcagcgacgaaaccaacctctctgagacggctccatctgagaagaacttcaactctggtgtgggggaaaagagagcaagactgagtactacccactgtactcagcaagtcataccggaaaaggaggtatgatgcaggatataaccaaaggaagctaggggttcttttgcataaagcaggcatttcaaagcagtagttgaaagcagtaaaatagctgtagtaattaatcaatattaaccaattactgtccaacgctacaccacgttgcaacaggcccaaccaaccacctgaactacaccagctcatt

SEQ ID NO: 70602 - DNA, 850 bp, Oryza sativa
gtagccttggtcaagctgcctgtggagtggagccgtctgcgccgtttattttttttttccgctgcttagatttttattgattgagaggaactatctacctctgtaatgacattttattcgcttattaattagagtaatatttgtactctattatcaatttgttattgtgtgcctcggctgattcctggacaagggttcacacacatgtaagcgtttggaattttggatagaaattccgggcgtgacaggggcccacctgtcgggcccgtctccctcctcccgccgatcccggcgcgccgccgcgcccgcaaccatcgccgcgcccacgtctccgcctcccccgggccacgtcgaccacgcccgcgcgtgcgccgaatctcccgcgcccattcccctctctctcccgctcgcgcccgcgcccgagatggccgggattcgaaaatcgaatcccgcctctctctcctccccactcccccgcgtcggccggcgattcccgcctctcccggccacgtccggttccctctccccctatttaagcatcgccgtcgtcctctctcactttttccccatttcgccgacccctcccgagctccccattgctcccgcgccgtgcaaccacccgccgccgccgcttccgctactccggtcgccgctagccgccgctaggctcgccgccgcaccgcgccgtcgccgccgtcgggttcgcgtggccgagatccatcccgtccacccctctttcgtcgaggtccgtcgccggagagccgttcccgtcgtgcgacggtgagggtcgccatgtccgccgccttcggccggcatccccgcctcctatggcccctctcttcctctctaa

SEQ ID NO: 70603 - DNA, 9119 bp, Oryza sativa
gaggtctcccgacgtggctgatccccacgggctgggtgatccgggttagtaatgtcgtgtgggtaaagtgtaccccctctgcagaggttaacaaactgttcgaacagccatgcccacggtcatgggtggatgtgaggtgattcctagcgtagttttgtttgactactgtttgtgaaattgctgttgtggaaaggagatcgatgtttggaaaaatctgcaactgatgggatcagctaggcccgggtggccgtttgaaagctgttggccgggtgccaatcttgatctattttaaagattgatacattgcacatactccgaccggacgagacgcactgtcttaaccgtgtcgtttgagaagcactcacttagttgattttttttaaaagagttcaaataaaataaattgcaaaaacaacagtccttcccttgaagcctgcattaaacactatttcccatggcttgctgagtactcctgtactcacccttgctctatataaataatcccccccagttgctgaagaagatgaagcggatctcgctgacgaggagtttttccaggagcaagccggctacgatgagttttagggtttcggcctagttcccaagtcgcgcctgtgttgtttggcccaagtcttggcttccgcttcccttttataatgcagttgtgagcttgggatctgtccgcagcccaacatgactgtactcctactctataataaagagacctctgttgttgtgatattccgtcttcctgtgataccagcactgtttcctgggactggtatcgattaacaggttaatttagagcgtcacgggctagttccggtcggtactagttcggggcgtgacaaagaacgagagggaaaaaaaaaagaaagaacagacaatctccgcgatttgggtatggtactagctagcaagattagattgtggggaagaaagagtaccagcacgtagcagcaacaaaccgattcgatctgctttgcggtaaatccagggagcgtccggcctgctgcaggataaagatggtatcacaacttcacaagttgtgcaaatatcaaagatgaacaacgagaaaatgaagaataaattggctttccaacggagaggataaagatacaatcagatgtagcagcagcggacctggggcgctcggttggaaggggcacggcgtagctccccagtgcccggccggagaaggagatggggatggatttctaggtctggacgtctggagtttggacgcctcgggactatatagtaaaaaacacagataaggtcatcagatgtagtaaaataagaagagggaaattaagattcaatgaaaacgagaggtggcctttgcgaaattgtgagcaagaagagagtacctgtaacctgtcactactactactacgtacgagcacagcaccacgcagcagcaaattaaaccgaatcgagcagcaagcaaaggccgtggctctcaccggtggccggcggcaaggatggcggcgcggaaggggcgagggagatgggtataaacgaacgaacacgttgtccgtggggccgcccgagtgggcctgggctaagtaggttaaaggaaacggcttcatgggcctttttttttttttctggtttcttagggtggtggtccgtacttttctaacctggttgggaagaacagataaacgactagtatatatgcttttgaagtgtactggagatacgttgaaacaaaaaggcaacagaactaactatatagtgatatcagtctagttattgccaagagctgaatgctgatatgccaacttggctcagagcaatcttttgctattctaaatttctaatctgtactgccaatgatgtcttattttctttgtacgtttccattagctgtggagctaggcaggttaaatgtacgagtaataactgactaattattgtgttatgtgggacagatccacaagtgaatatatagctgagctacatatagttagtacccccaaccatgcaagagattgagacattggcatgtaacaaaaacgacgacaattctcgagccaattgctgtgcgatatgaaatcgtgatcgatgttggcgcaagcacaaaccgcttgggttttttttttctgggggaggggggggggggcagaaataatgatcagcatgactttatcctacagtactcctgggcatggaagacgtcggaaattcagttgccctcgatcggatgccatgctgcttggcgttgctctgcttggagcgccgcgcttcaacagacagcacagcttgtgcaacgtctactgcttcctgggtgtttcagctcagcttacctgctcgtgcatcacacgcagagcactgctagttacgtagaatctgtagttcgctgtctgattctagcggagtatggctccctctagagatgatgaagactctagctctgcttggggatgattggatcattggactgatctgatggtttgttctatctttagctgtattttgactgttatgtttctcctgttgagtttacacgacggagaaaataacaagagagacgttgaaatgggaaaaaaactaataaagcaagttaagtgaaattaatttgaccaacaacttttaccctgatatggtagtaaaaatgaaccttttctcttgaacaattttatttttctaaaaagaagtactgaacaaattagccgatatgtccatttgttctcgctcatttgttacattccagcttttttttattactatgcataagaacagcgtgcaataattgtgctacccatatgtaatataaaccaacctaagccaccaacaaggaaaccgagagcttggaatatatttgggcctgttcagcaagctggctgcggctgcggctgcgccgccgcgtgcgtgtggcattgttggtgccgtctgtgccgcagccgtaaaacaggcagctgaacaaacccatatatagtatactcctcaaatttacaccaacagcaaggaagcatgcaagtttggtatgagaagcatcaggagctccattacgccgtgtgcttgtttaggttctcgtgatcacggaagcaagtgagctgcggaaagcatgaacacaaccgccgaacatcttccagcgtcttctgaaccctgacagacagcagtgctgagagctaagcatctgagcttcgacttgacccaaatgtccatcctttctgctactccatcagctgctatagtcctgatcagtcgcagccgtgttctatcctcccattccagttatagcctacaggcgagatgacaatttaatttggctaaagctggagacaatgcaccaaaccattataacaaactttttatcttcaagggagcaactttttacttgttttcttttttggcagtcaatctcttccttaatttgacttctgatcgacgatcgagaggagacaaagttagccactgtaggtaggtaagcaaaaacaaaagctcgtcgtctaaaaatgattgcagttttagtttaaagatttataattaaaaagttgtatttttagaataggtctacttgacctgtttaatactatattatctttttttaaaatcaaaggtgtttttgattattattctatgatgaacaattgggcattggagattattggttttgttatttggaatttattcacgaagtggttttggagatgattggatttacaggtgaatcatagatactgttatttcatgtgaccggtcaaaccgggcagtggttgccggtcagaccggcgtgtattgcgcggtctgaccagccgacgctgtgtcaatttcggtttcgggttgtttatttggatatccgtgattattttatgattatggcttctagatggatactatacgtatgtaatactgttgtttgctactaatgagttaagttggagatagcttggtctcggaatatggtttctttgtttgttccatgtgtaggtgactcgatgtctcgggagagtatttgcggtgatggaccgggagtcggcttggggataagacgatgttcgtggtggtcagagatcatgcgggatactaaggctagagttgatgcacgtggttaatggaggttccatatggcatacaatggagttattgtgtgcgtatgggatgtggagtcgaatttggaaggagtccaaatttggtacgattggttatgtaaagtttctttcttgtactagagggtttcctaaggtgtttaagactcctagtatgagtttggttcgtggctttaggctgcctacctcgggtataaatagagggggagcgtgaggcttccctatatcgcttttgtatcgcttttgagagcaattgagttgagttttgagttagggtttcgagtttagtcgaaatttttgtaaggagtgctgttggtgcactttgtaaacatagagagaagtaataaagtcgtaatccactttaagagttcttagatttgtgtttcatcgggtttcggcggtctaaccgactatatatcggcagttagaccggcggcacgcggcggtccgaccggcggcatacgggcggtctgaccggcggcggcgacaggcgcggcaggcatctcggcggttcgaccaatcgatctacatcggtcagaccgacgtgttccaggtggtcagaccggcgcaacaacttcggtcagaccgtgatccgtcgatttcgagggtaacttttatttccgctaaaagttttcggtttttgggtataccaaccattcaccccctctggttggtttagttcttgctattcgatcctacgtttttattatcgttttatccatccaactagtactatactgccatgtaaagataaccattcattgatttaagactgtctgtgtgagttgcatcttattttttaagtttagcatacaattatgcgaattatgtttggttcttttttaccttttcttaaaatttcaacattgacatttaatttggactgctaacagtaaaattatgaacgtctaggctaaaattatatttctttgtttcagtcaagtatatttgatatataagggtgtgtttgtttctttgccaaactcaagcgtaccaaaacattgatgttgccaataagaaaaaaggtattgccaatatttttggtttagctgattttgtcaagcacatagtaacactcttgcggagcaaaccaaataatagcctaacctttcttgccaatttttcttttgtagcaatatccaaacatgcaacttgactaaaattttggcaatagagaattgttgccattgacaaaagttggcaagcgtaaacctcaaataaaccaattaaacaggttcatccgccacaatcattaaagttgtccaataatataagtaaatgttgtttgatggcagacaacactacatatgttgtgctataccgtggccataaaaggcagtagaaaatgatgggccagcaaaaagataaagaagaatgggtttatctagctaagtgatgaagtggagaactacctagcaaagtaacaaaagaacaaagcgagataagtgccatgacagaactccacaagtagaacatcatctctcttcatacaagtagaactcattcatacaagtagtaacacatctagctagaaaaccagaggttacagaaagtgaaaaaaatgctcaatccaaatgttgggcgatgacttggtgataagagctagctgggttctttaggaaggtgtgttttcgtcgcgcataaataatgatgagcaggatgatgaatttcctagactcctgggggcatgtgagacgctgggaatgtagttgccttcgatcggatgccatgctgcttggcattgatcggcttggagcaccgtggatccactgacggcgcaccgtccacaacttctacagcttagaggttggtgttctgcatcttatctgctagtgtgccacacgcagagcactgctagttgtgatgcaaatggtcatcttgttccatgtccacgattccaaccaagtatgggtctctcagtctctgtatagatgttaaggagcctagtcctactacttggcgatattggactgagctgtcagctgttctatcttttggtcaattgctcgtattctgtggttgtattctggctgcatttgtttcgtattgatattacacaacggagaaaataaaaggaaaattgagcaataattttatggttatttggaagtaaaaaatcaagcttttctctagcacaattccaacaaggatgtcgaaggatggccattttgtactaccatgtatacgtactccccttcttattggatatccgttagttgatactaataaatagtttggactgaaaggacaggaagaaaatgacattcctttattttcaaatttctgcatgcatgcactcggccggtacatgcggtcaggtttttcctgtacaaaatctaaacgggtaaatataaacaccgtttgatcgggcttgggtttgatggatgttggatgagatcaggtgtacgggtgtacctactcctaggagaaattttatagtctttaaaaaagtacctcaaggtttctaaattttattctaaattttttatatctcaagataattagtatttggaggtaccaattttatagtataaagtgtacgtagtacctcatggtaatttttaaagaatggtaaaattatctactcctaaggagtatagaaccgtattccttcgaacatgtccatttgcaatcgtgctgcctatatgtaatatgaaacgacgtgaaacagaagtatcttgaagcttgaagcttaaagtggatcagaactcagaaaagacatgtaaaatagactctgcccaatccacagtaccacgagaagacgccaacaataaacttctcaaattagagatttgctccgatccaacaaaaaataactcgaggtatcggtacttcacggtacactggtgaagaaaccctttgtagtcccggttcgtaacccccctttagtcccggtttccaaaccgggagtaccaatccgggactaaagatcgagctgacctttttttttgcatgcccctgttgctgcatggtttatatatatatatatattatattatatgtatatacatgcataatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtaaattgtgtttccgtcgtagtagaattcacccttgggatcaaggatttcttcgttgatgaatcccatgagttgttcttgaaccgccgtgataaattccttgtgtgtggtcaggttatccctcatgcgaatatagtaatgcgaataaactatatgaatgtatgaaattgattagtaattaaacaagaaatcgctacgtaatgaaatttgaatttatttgtatgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaaatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacatctgactaagatcatccgcaacgtcgttaccatcagcagctatttcctcctcgcccgtttgatttccttcaaatccaacgtactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttactttttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaacaaaaagtgtgcaaaacataggtgcaaatgtagtatgacaaaaaaaaacattggaggatgaagttgcaaaccttttaggcacctccgatttgtatgtaaacaccaaaataaattcaatagaaattttggcatgacctcccctcttttttgaagtaattttgaagcttgctcgggcagctggaggaggaagaagacatatatatataggggtgggactttagtcccggttggtagcaccaaccggggctaaagatcaccgggatcattagtctcggttggtattaccaaccgggactaaagttaagatctttagtcaccaaccggggctaaagatcaccgggatctttagtcccggttggtaatatcaaccgggactaaagttaagatctttagtcccggttggtgttagcctgacaggtcctgacagcattcgaaccgggactaaagatgatctttagtcccggttggtaacacaaaccgggactaaagatcaaatatgtccgtttcccttttgaaccgggactaaagatcatctttagccccggtttttattgcatccggga

SEQ ID NO: 70604 - DNA, 24178 bp, Oryza sativa
aatagcccacctaaacctacatatagtacctcgtggacagataaacaccctagacattcaacctcttttgagaacccaaatagaagaagcccagaaggacaacgaagaaatccaagaggtgaaggaacgcctagctgcagggtttgcaaaggaattttcgaccgatgagaaagatgtcttatggtataaaaagaggatctatgtacccgaaaagggcggactgagaggattaatcctaaaggaagctcacgaatcagcatattcattgcaccccggaagtatgaaaatgtaccaggatctgaaggaaggatactggtggcccaacatgaagagagatgtagcagaatacgtagcactctgtgacatatgccagaaggtgaaggctgagcaccagcgtccagcaggtttgctgcaaccccttaggattcccgagtggaaatgggatgagataggtatggattttattgttggattgcccaagaccgcaacagggtataattccatttgggtgatcgtggatcgacttaccaagacggcaagattcattcccgtcaagaccaattattgcggtgccaagctcgccgagttgtacatgaccaggatagtatgtcttcatggtgtgcctaagagaattatatccgattgaggcacgcagtttacttcgcatttctgggagaaagtacatgaagccctaggaagttaccttgcttttagcacagcttatcatccacagacagatggccagacagagagaacaaaccaggtcttggaggacatgttgagagcttgtgccttgcattttagcaaagattgggagaaatgtttgccctacgccgaattctcctacaacaacagttttcaagcaagcctaaagatgtcgcccaatgaggcattgtttggtcgacgatgtcgtactccactgatgtggtccgagactggagaacgggcggtatttggatgtcacgcccagaaatttagcccaaatttccagactattttgtgtattaaatccctgtccaggaccagccagggtacacaaaacgacaagtaatatacagttccaaatgtaaataaagcgtaaaatacttacagaagaggcacttagtcctcacaccgaaacaaaaacagcagcagtagaaaaaggcgatcctagcgggcttcagctccactccacaggcaaaactcaactggggtctgagccttggtcctctaacttcgtcttcagctcagaagcactacacttctgaaaagggggaataatagcaagactgagtacaaccaccgtactcagcaagccacaccaacgatgcagacgtgcaaggggatacaaggaggggtttgtggctatttgcataaagacagttgtaaaacattttattgagcaaaacagtaaaactgttgagtaattaagaaaaattagatctccactgatcaacgctacaccacgttgaacaggcccaaccaacccacctgaactacagtgcattgagtcgatttattaggggtgagactaatcacggtgaatctggtcaatcgcccataaccgcgggcacggctattcgaatagttttactctggccagaggtgcacaactgtacccacaagacacaacgcaccggcatgtcaccgcgtcatcatgtgcccatgatgcacacgtcaccatgtcgagtaattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggcaagcgctgtaagtcttccagggtttcccgtgaaccggtccttaattgccatgggtgcgactcacaaaaccatgcacccacagcccaccattcagtcgcattttagttggataattacgaccatgaaacatggccagatgtctcgagcacgcagctcactctgatactaaaaaggtctaatactgtaattatcccatcaactgagctagtggtaattaagcatggctaagcatacagttctagctaggtcacataagtaacatgagctagtcgattcattacccaaggttgacaaagaacagatatcaagtaaacatggcacaagcgagcagataggtaatgcccggatcccatgtaattagcaaaacatgcatatttatttgtaaacggtaaaacatttataaattgggatcaacatgctcaaggggaatgtgtgacttgccttgcttcttcaaaacgatcttccgaactcttttcctcgcgaccgcgaacttccgaaacgacggattctacacgctggcacgcaaaacgaggaaaaaacctaataaaaaccaagaaaatagtacataaaaactaaacaaacatgtagagctcaattttagatgaattttgcaagttgaatggctcaattcggagttcgaatgaattagatatgaattttagaagttttgagccatttaaatgaatttctagaattattaacgaattatgacgcaattattatttatttttacaaaggaaaagagggttgctgacgtcagcaaggggcgccggcgccgacaggcgggccccacacgtcagcgagacgaggtggcggtccaccgtggaccgggaccacaatggacggtccaccgccggtccacgggttggacggcccagatcggccaaggccgatcggacggctggggacggctcggcggcgcggcctggccagcgcgcacacaaggctggcggcggcggcggcagggaccaaagcgacggcggcacatgggctgggcggccaccggcggcggcggcacggcgcgtgcaagcacgggaggcggccggccaaggggagaaacagggaagagggaggagtgctcaccgagggcggcgacgaggggcggggagaggcgggggagggagctcggcgtcggcgctcctcgggatgaaggcggaacggcggcccggcggcgttccgtgagcaggaaccggcagacggcggccggaaggacctggggaggatgggggagaggttaggagggggagagagggttctcaacggcatgaatcgctggtcggaggggagaacgggcggcggatgctcaccggcgcgaggggaaccgtgttccggcgggatcccggccgtgaaaagcggcggccgaggtgctcctcggcgctgcgaagtgagcggcagcgacagcgcgacttggggtggctaggagcggcgccaagcggcggctggagtcggtggcttcggtgcaaggaggcggtgcgcgtggcgatggtgcttcggaggcggggaggggaaatggagcggacgccgggaggtggcacgacgcggcgaagccactggtggcggtcgcgcggaacgacggtggtgggagcggctgtggcgaccggctggagggtcgtcggcgagcggcggcgggaggtgcgacggtggcggggtggttttcgtgcacgggagggctcgagagagagggggaaatggagaggggggtgcggggaatgtttttataggggaggggaggcgggatcgagcccgagagaggtagaaaccggccggcgacgtgggaggagagagagatgcgggaggcagcgacgtggccggattttgcggggagagtgggggaaaacggcgccgacgtgggcgacgaccgcgtccacgcacgcgcgggagagggagtcgcgcgggagaggcggcgacgtgggaggatttggcggccatggcggcggttggtacgacgggaggttggggaagaagatgacaggtggggcctcgggtcccacctgtcggggagagagagagaggagaaaacgggcgagggaggtaaagcagacttgagggagcgagagagagagccgagcgggccgagggaggaggccggcccgagagggagagaaagggggcgcgcaggccgcgggagagaaaggaggggttgggccgaaaggggcccaaagagaggaaggaggattttaattgttttctttttattttaattgatgcaatgatctttgtgctattaaaactatttctcgagctccgaaaattcacggaaaatttcggagagtattttagggcacaaagaatactccaaaatattcccggccaatgatttttaaagggaaaattttaattctcccattaattcgctcgaataaattgctttaacttttagtataatttcttgaaatgcattattaaatgattttaaaacccgaacgaaaatcggggcgttacattggacctgacattatcaaagaggccgaagacaaggttcgcctgatccgtgaccgtttaaaagtggcacaatcacgataaaagagttacgctgacacccaaagaagaaacctggagtttaaggaaggggattacgtttatctgaaggtttctccgatgagaggcacgaaaaggtttaaggtcaaagggaaactagcgccaagatatgtgggaccttttcaaatcatggctagacgaggagaagtcgcatatcagttacagctaccagaaaatatcgccgatgtgcacccagtcttccatgtgtctcaattaaagaagtgcttacgagtgccggaggaacaagctccgttggaagaaattcatattagcaatgatctcacgtatccagaacacccagtccggatattggatgaagcagaaaaaaggactaggaccaaagtgtggcgtatgtataaggtacaatggagtaatcacactgaggatgaagccacttggaaagcgaagaattcttgaagacggaatacccgcatctattcgaaaaccggtaagaaatctcgggacgagatttatttaagggggtaggtttgtaacaccctgaaaattcgaccaacgaaaatcaaaactctaaaaatatgggccttcaaaaactttttaaataaattgcatcatgccgattttattcacctatttcattggaatttggtttcggagttcatagatcgcgaatagagaataattaatgaggaataaagcctaaaattaaacgggaaaaataaataattgaaatataatttaaaataaagattaggtgaggttggaaataaataaaatattatcgcgaccatattagtaacaattaaattttagtgcgatggaataagaattaattctgattaaattcaagaaaattatataaaaataaaatatgggtaatgttaatctagagtgaatcttttggttgaaacaacacaaatattatgtaaacttcatttgtggaaaaattaggaattaaagaataagatttataaagagaataggttaaattagggttaaataagagctagcactgttcattgcgcactaggtgctcgatgaggttccctagccccgtcccctcccctgccgcgcgcgcctcgcgcccctagccgtcgccatcgccacctgccgccgcgcgccgtctcatcgcgctgccgcgccgcgcctccgtcccgtcgcctcgcgccgcgcgctcgccgcctcgcgccccgcgccgctgccacgccgcaccatcgtcgcatcgcctgtcgccgtcacgccgagccccgtgccaaaccgcgccgagccccgcgccgcgccgcccgcccgtcgcgttgccgctaccgcctgccgcgccgcgcgccgcccgtcgcgtcgccgtcgctgccttgcgcccctcgcgcgtcaccgcgcgccgtcgctgttgcgtctcgtcgccgctgtcacgccgcgcgccgtcgccgtcacgtcccgagccccgtgccaccgcacgcgtcgcgtcgccaatgccacttgccgcgcgccgctcgcccgtcgccacctcgagccccacgcgccgcccgtcgcgtcgccattagggccggccacccctcccccgcgctctataaaaccccggcccccccttctccaccccacacccatcccccttcatttccccctccttctccacgtgccgccgccttcgtaccgccgcgccgttgcctcgaagccgccgcgccgcgccgagtgccacgccgtgcgtcgccgccttgcgccaccgccgccggtaagccgccccccccctcgtccggttgccgtcgccgcccgggtaggccgtgagccgagagagagaggtggggagaagccgggagagagagagagaaagaaagaagaggaagagaaaaagaaagaaagaggaagaaaaataaaagaaagaaaggaaagaaaaagaaagaaagaagagagaaaaaggaaagggaaaaagaatagaaaatttgagagaaattgaggaggtttagaaaatttaaaataattagaatttaattatagattaattaaagtgtaggattgcaaaatattaatataattatagattatttttggtaatctctataagtaatcaattcgcggtaggaatttagatttatttaagaactaaataattatgttgaattcttaggaatgtacttctaaatcacaaaatgacttaggttgaatgacccaaaaatttgaataacgtggtttcgcaaactttgtagtcgatatagaatgatcgattcgcgttcgacttctatttgagtttatttggattttatttgaattctaattgaattcaaatcatttcttcgcacgtaattctagagcccgagggagttgtggatccgagcgagggtcaagacccgcaggactacgagcaagacaagtcatcactattcttgaacatgttgatcccaattgcgaaattaatttgtttacaaataagattgcatgcaatgatgaacatcctacttgtgattatgccatgccttgattattgtttacctttaaatccttgtaaccataattacgtatgggtccttagtcaactatgacacatgcttaagaaatgctacactagattcatgcatgctcataatttatcaaatgctatatgcttgggcaattacctttgggaaggtaattgaaatgcggcatgtggagacatgagcgccacattgccatgataatgatgacatgatttgtgcaagtaggaatgaaattaaacactttttttagaccggggcggacggaggatttgggtggtatatgggaaaggctagtaccgtccccggtcaattaaggaccgagccatgaagttaagcatgaaacgacccttgtacaaacgcacttctcgtatgggtatagacctagcggattagatagccgagcggaggcagtatctctgcatagatggttcaccccctgagtgaggcaggtgcgctaccgtgggacagccgttgaggtagggccgagaggcgtgccctacatcggtgtcgccattggtaggactgccatgagtgtgtgagagagagaacttaacttgaaccataatttaatatgtgtgtgagacttctcttttccgggagcgccataactcctctcactgctagaaacatggacgcctagagtgcatgaggatttaagttcatggagcggatactaccaatgcgaagttatcgaaaagctttgccgtgacgcgtctcatgtgttgggacgaggctcatgagttaggcagtcgcggagtgcgggtaaagtgtacatccactgcagtgtgagtagaccaaatctattcgaatacccgtgctcgcggttattgagcaccaggacgtgtattacacttggctagactctaaatccttaacttgtgtgggatgggatattgcatgatgatttttatgctgctggagccacttcctgagaggcgggaaggtggacatcctcagaaaatcatgacgattcaatggcgggaagctatccttgggatcacaatggatggtggacagaaccgtcattatttaaatatgaacactggtactaaaatttgatcagtctatgctaggtcttaggcttgtgaaaagaattacaaaactggctttgcgcaaagaaccatagccatcctttgaatacccctatcatgtgcattgttgctgtgatggcttgttgagtacggttggtactcacccttacaatatataaacttaatcagaggccggagatgaagcttcggaggatccctacgcgtactaccaggagggtgatgaagacgacggcgctcagtacgtcttagttacggtcgttgcctgtggcaatggcgtgccgctgccttaactccgctgccttacctacttctgcttttggaatgtattccggaccgctcggtctgatgatctaagactatgcctgctggcttatgatgtaataatttgcactagactctcgtgtatgtgcatttggtgtttcagctatgaactcgtgtgtaccagactacttgatccagggaaatggtactgtttacacgattgattcctgttataaaaacgggggtccacaccaatagagggggaaccaagcaaagcggacgagggaggtgaggtcgatcagctgcgcatagacaacgtctccacagcttgtgccgagggcagggagctggagaagagctacgagagcgtgatgacgtggtccagtgagaggggctgggcgaagaaggcgttgtaggctgcgaccgccaaccaagacaggaccctcctgaagcaccaacccgagcttgcgcatcaagttgcgttgtgcgtgcgagacagtgtgacttggcctggcgagcgtgagcttggcaacaatcccgttgctgcgcttcgaaactacccccacaggtgcggcgaggggtgccgaaggcgggcgcagtgggaggagtgccggggtcagaggtttggagcagctagcgaggaaggagcacagtgaggcattgtctgcgactgaagtcggcaacaagcgtgccattggccaaccatcaaggtcgaggacgaccaccggcacgtcgaacaagaccccgtcaggcacgcaatccactgtcatcgaacttagtgacagaggtgtgcagacacctgcaacagttgccaccggccttggcgagaagtgggccaatggtctcggcagaggaggcaagcgctacggcaacggcggcggcagcgattgcggtgggagagaccacggcgcatcggctgccgtcaccggcctcggcgaggagatgcccgacagcttcgaatgtggaagggagagcgatggcggtgttgatggcggcaacaacacgcagggcagtgttggtatttcttacaatcacgcacgtaataccattgttgcacttcccattagagtttccaagggtatcgaacacaaggaacgtgtgtgtatcatcaacgatcaagattcgatcaaggacaacaacttaggagaaattgactctagaggattcttatatcttttaattaattaattaagttcaaggtaaaactctaccggatacttcgggcatcggccctcctctggcctgccagcatgaatattgcatccattttatgaatactcgacgaaattcaccccccctgcgttgtccgcgaagcagtggtgtcggcgcaagggcgggatagggttgagcgggggatttagattgggtgacatagggtaggcatagagtgaatcttggccctccaaaacaaaaccaatgggtgaaattcatccacgtctcgcagaagttaaaattttactgggagtaaaatttcaggagttaaaattttactttcaggagttaaaaatttactggagttaaatattaactcgtgttgatgtagatgaatctcagccgttggatttgttttagagggccaatatccaccctatgtcaccgcgtgtctaccctatgtcacccgatctgaatcctgagtgggacgtgtttgtcgactgtcgcgatgccacgaccaatggtgggagccctacctgtgtcgaggcgtggagtctctcggcgggagctccgtctcgtcgaagcccttttgtcttgagttaacaaatttcagactagcatgataagtcgtcaactacatcctggtaaggacatattggattggaggagacacgctttggttcaacggttggcttatcttctcagacttcttcgtgtaattttccactggtaagaagccaagaatgcgtcgtacatgtcgatatccctttttctcttccaatttttactgacatgtggtgcaaaaaactctcttgtgcagtttgggggtgggttccgatggcatccgtcggcacgagtacaggctttgttgaaatgtcaagccgaaatgaacacggcaaaggcttctggaatcaggagccctggatgcctggtctctcatgtcatgtgtgaacaacgtgcacacacaaaaaggatttatgatttctacctagtttcaaaaaggtcagcgtatgtgtaggacctcttttggacgactgactgacttgagtgttttttttttttactaaatcaccggagggggagagcttccccacctgaattttgtcgttgcatgaaaggagtgaaaaagttcattacaacaggtttagagatcttaagggggaggagaaaatgtttttccaaacagagattacatgtctatcctcaatttttaatttctctgcccagagagctgcctcattgatgcatcgatgtaggcaggatcgaatcgatggagtttgtcccctgaatacaacgtcatgccgatgattccagatcacccacatacatagcaagaagaagacgtgatggtgaagctcagggacaattagagagggttttatttgatgaagtagccgcacatcttggattatcggctgcactctaatacgttcccagaaactctacactgactgagtgtattaccttttgtctggactggtatctcttaatatatattggccggcttttcgccggcccggcaaaaaaggtatttcaatcaatcatctcaaagatgagatccactccggtgccttctacttgtagtagaaaataatctgaaccgttgatctcatttgatcatagggttcagatctatttctactaccatcacacttaatggtagtagaattgtagagggatatttttgtccataaaaaattatttgcagagggatattttcgtctttcccgggctccagctggcgccgccccgcgtgctgctcctcctgctggccatccatgtcgccaccgccacccgctcgccaccgcgacgactcgcaaggggaagcttcatgaactggatcgctggaatgggtttcacgcagaattccagcgagatgggcctattcacgttacattagctcgggtaaagaggaagcaaagcacaaatttaatggaccaggctcacggaagttgagctacttcttttcatagcaaattcaggttcttgattctggtatagcaatagagcatactgtccatgtccaaattaaattcttattcagattcagaatcagattcttgattctggtgaagtcatccacgaaaattaacattaccgtgccctgctgatgctgaggctacagaaaactctactctcccgcaccagcctcctcaacagccggctccacgcacgcctgtagctgtcgtcgcagttgccgccgccgccggcggcgtcgcgcgagaggaggtagaaccacgcggggctcctctgcaccgccgcccctgtgcgcacgccggaagtcatcagggcggcgccagaagctcctgcggcggggaagcggacgccggcagagaagggaacagaacaagagggggcgccggagagtattgccgccggcggaagggaacgtgatgcacaagcgccggcagcggaaggagtcgctctctccacctccgctcgaatgcgatggatgaggaagcggtggcagcgctgcttttcctgaaacatccgagcgatccacgacgagaaataaattaagtgccaaatttatcccaaatctatctcagaactttactaatctacccttaaaaataaacggttcagattagttctactcgtagtataatactaacagtagaaagcaccggagcattgctcctcaaagataggtttcaacaaaaaataatacaatctggtgttggaattggttggggaacttgggatgtccaaagtgcttgtagaaaccgactcgctggaggttcgaagatgatttctcaattagagttcaattgttcggtctacagtccgttggtatatgaatggaaagggatgctaaacaactttttggcggctaaggtggtttggtttcagcattcggcaaatacagtactagctcataggctaactaaagaaggtatctcggttcccccggattttatacgatcgttcgttgaggatgattgtaagcaggcttctttagatcatctaaaggatcagtatagttccactaaaaaacaaaaaataataatctcgtaatacaaaacagttatgtttatattttaattaagagaaaatatcttgtgtacccctgaaagttcacctaatcccttctgtacccctgaattttgctcaatcccttacatacccctgaattttagtttggatcccttccatgccctttccgctagttgaccgttagttgaccgttaaattcttatgaaaaagtccattttgcctttggtataaagaagcatatatataaattaatagagtatattgttgaagtatagaaatttgttatatgaaactattatgtttatgagatagttatgcaccatattatttgcgagaaatataattttagatatgacataaaaaattaatacttatttattagttattaaaatattttttagcatatgtattctgatagtaataaacaaatctgttgtattactatgaaaatacatatgctacgtaaaagaacttttaataactaataaataagtattaactttttatatcatatgtaaaagtaaatttgtcacaaataatatggtgcatcacatactcataaatataatagtctcatccaataaatttttacattccaacaatatacttaattaatttattatgttttttcatagcaaagggaaaaatggactttttcaaaagaatttaacggtcaactaacggtcaactagcggaaagggcatggaagggatccaaactaaaattcaggggtatgtaagggattgagcaaaattcatagaagggattaggtgaactttcatgggtacataggggattttctctttaattaacatgtactctctccgtaaaaaaaaatcatcccctcctaattaacaaatctggagattcattgtactaggagaggtgtctttttttcctgacggagggagtataagcgaaactgatgttcgaactagagacacatgtcagaggggtccagatcccctagagttgagtacaactccaccgggtgaattttactaaatctgtgacatctattgcttcctacggctgagatgaagccatctattcttcctatggtttgaatgggaattactttatttttttcatgttagtaatggttaagtttatgcctaccaaagtaacaaagtatacacgttatcttctttcccaaacacaagaagctacgttcatgtacagaaaaaaagtgttaattaaccacatggtacatgcaaacatacataaaccatatacatgcaaaaatagaggcacatgctcagtacggtctttataccatggatgaatcaaaaaatttgggttatgcaagtaaaatttatattctcagattctctaaatatatatattgtagtcggtgatttgttattgttacaagattatgaggacttatttttctttttcaaaaaagactagtgggaagtgggaactaatggcttcatcccaactgttgataaaaaaatagaccgtaaagattttatcaaattcacccgatggagttgtagtgaactccaggggatccggacaccatgtcagagccttcatatttttgaattttgtacagagcaacgatagtttgtttgtaacggttactgtatcaaatcgattttgagtctctagtgggccgtatcttttgtttgggctcgcacaactgggcctcctctctggagcccaaccgttcgttttccttggttagtgtaaatcatgggcacgtgtaattcattcgcacagagagagagagagagagagagagagagagttcatagctgccgggatggtcgccggcggcgactggagctcgccgcccgccgaacagccaaaatgttccccatttttccttcttcaggagccaatctgcttccaccatggcaacgcccttgaggtttccgtatgatttagctttcctactcctactttcgaggatcgccgggaaggtggaggagccgcgcgccctggtggtgcggtggcggtgtctacccctcgtcagcacgaggtgtttgtggaattgtccgtaagcgcgcggtctcttccccgcgaagcaaggatgtggatgttctttttggagaaaaaggatctggcccgccgccttttctgtgtgcatatgggacacgagcggaaggtgttcgtgcaaatgcggcagacagcacaggtaggcagttcttgctttggatgtggtgggatcggagtactggatttcacacaagtttgatgatgctgcacgattgcagtcaacaaggtcattttactagatctctgtcaacaatatgggaatacagagttctccctgtaactgaaatctagcggttaaagatgctgatgatcctaaaatcaagtcaaatgcggctgttgtatctactttctcaggtaacttcttccctcaaatgcatgaacatggaatctttcccatgaagttaacttaaaactatacgtgtctcccaaaaggcagcccctcccatggagatttaatatatacttataagtagttcaagcatgaactagcaggagtgcaagacattaattagtgggtgcattgttggcatcacctcaaagtgtcatttagcttaccactttttcaatcttcttattcctgctcctttttcttttatttttttttaaagacaaagacaatgggggcctggacctggatagtcttgaactcttgatggcaaggtttttcttttggtcctagttcatcaacacatcagtatatattttttcttgttgtgaacttgcgatgattgtgcgggcagttcagaccttcaagcagcctgtcatccatgtggcagataattggtgacctgctgagaagctgcaggcctgagaaatgaagcaacaaccagatatcagggaacaaactgaacaaacaaaattctttaacctgttccggtgggaaacaactaggattcatcatatcatatggcgttagttgagatatcaaggtcagagtgatcaaaattctatcaaataaattttattctacgtgtgttaacacatcacaagaagaaattggagctgctaattgatgtctgcatgtcgtttcagctggactggctccaaaactagttaattaaaataatccacaaggcaagttaattcacttaattcttcttctctctcgttttatacaagacctggaccttgatagtcttgatgccaggtctttgtttttttaggtcccccttcctcggatcaacacctcatctatataatgctgaaaccagcgttggctgaggtgagtggatcatcaaatatccttcatccttcctaagttgctgctgctagagtaaactgatcaaaggcttgtcaaagtaagttggagtggcaaaaagaagttgagctagctagaaattaaggcttgagttttcttttttgatccatatgtgatgatgtaatgtaatatgtagttatgcactgtcattcgtatacatataatacgtatctagctaggatatgatttacatgttctgtaatctgacaggaccttcttgttctgttcacacatgaatcatgatcgtggtatattggcatgcaggaaattaatcaggtatggttatagaggtgtgttgctgcctggggctggctgcgaatgtagcgcagctggctggcctggacgtcatcacgcttgtcaaggtaatcaagagtcgcgtcgagacagtccgccagaacaaggaggactgcgagctgctcgccgaacgcgcggacatgatccttgatctgctacggcgggttcaggcatccaaggtcatcgaggaccctgacatgtggaagcccacagaagggctcaagtcgacactttgcagggcaggtgcaatcgttaaatcctgtcaggaggagtggagctatgcgtaccgtttctgcaagggcggacgcatcgccagagagctgcgcaaggtactcaaggatctcaagttttacatcctccacctgataggaatgatcaccatcatcaaccacgatcaaaacactcgttactattatatcccggagactgatgttgttaagccgcaggtacgtacctgcatacctacaacatctcattaagagctaattctttttgctaattaatttctgtgcaaactgctaaaacctccatttcatgattctgaagtttgttctaacaatatgagaggtaatgtatgtaagtggacaaatgcctgcttaattactcacttgagcctaactttggtatttcaggatgctacagcttccaacgctggaaagcctgttgctctagaagaaacaggtaggagtaatagtgaatgatttataatattcccaaaattagcatgtaaaacaaggccttcttttccaattccctttgtaatgctgacacgaagtttgaaggtaataatcaattttccatgttacttaaaataacaggccttaaaaagttcactttgtctgagttggaggttgctacagataatttctctctggaaaaacaaatcggtataggtgctttcagcatcgtgtacaaggtaatgctttgctcttggccgacctttgcattcaacagaatggttaatgtttaggcagtgaagtcgtttgaaacatcttctcttgtactcagaaaaatattagattttgtttttttctgtaagtatcatgatcgatttgcatttggtgtttacttcttccagggccaactaaatgaaatgcccgaagttgctgtgaaaagagcatcgtatgttaacagaattccatttgaccagctcgaaaatgaggctaaaataatttcaaagcttcagcatacaaatatagttaaacttctaggatattgcagccaagagagagagaagatactggtcttcgagtatatgccaggcagaatcttagattcattcataactggtagggggttcaattcaactagctttatgcctttatctactcagtttcgagaccaaattctattgttcatgttcactcaatgatgcagtacatacatgtttgtcgcatttgattacaggtgagcgagcagaagagttgcctttggactggtctaagcgctcccaaatagttaaagggatagctgatggagctgtatatctacacaagcaatgtgagccacgtattattcatggcgatctgaaaccaggcaacatactcctggatgctgccttgaaacccaagatttgtgactttggtacatcgaaagcacttaggccaggtcaggatatggactgcaccggcattgtggtgggatcacggtaagactgagtttttcactgcaaaatgtttatccatccacctcctgcgtcacgtttgatctgttgataacttgatatttaaattttgttttcatcttctcagtggatatatggcccctgaatataaacagggagggtgtgtctctctcaagacagatgtgtacagctttggcgctacgcttctcgagatcattagaggaagtcgcatccctccgtctacattggagctttctgatgaatcgcgcgattttgggcctctaaataagtgggtaagtgcacacctctctgaacttcacaggccaaccacagtatactcagagttggtcactgattaaccagtagcaattttcctttgctcaggcgtgggaattgtggagaggaggaaacctgatggagttcatcgacccttcgctgcgcggagagactcattctgcagccgagatacaggggtgggttcagatagcgctgctgtgcgttcagcgtgttgaaattataagcacataatgatttaatttattccataaataaatcatgacattgcatatgtgaactagattgaacgcatcattagatctacacatgtaaactaagcagtaaaacatgaacagatcaaatatgcgcaacatgtcgaacgcgtaccgaggtggcggaaagaccggttgctcggcaggaactactcgcggttgcgagcgtcgacgaagtcgcgaagcacgcgagcggagaggaagacgagccggtgcaggatgtcgaaggcagaggttccggagacctgctctcccgatcgccggtgcacgggatggagtagtctacgagcgacggcgcagtacagagtaggaggcaaaccctagattgatgagccggtgcacgggatggagtagtctacgagcgacggcgcagtacagagtaggaggcaaactctagattgatttcgcgtgtgttgcgtgaaggcggcggctcggtttatatagagatatctgcgcaatgttgaggagccaattttgcggaccattcgacgcgtacgtcgtgcacgcgccgcctgccaggcgaggcgacgcgagcgagcgcgcacgtgtgtttcccctcttctctccaccacacatgcttcaagtggttaggagggcatcctcccttttaaggaggtccccctctcctagaataagcaaggtggtactaaactccacatgcatgccatcccatgaggtgggcttttgtgattttccaaagaattaatcttcgaatgggccttagcctatctattaattccaacaatcccccaccaaatctcaaaatcccaatgagatttgccttttctaatgtactgtttatataccagcggttcgatggagaccgattaaggttgaacatccacctagaactccaagctacacttactcacaacttgaacaatggactacgccttgaattgcaagtcttgtgcaagcaagtttcactcagagtcttatctggtactagaccgtctgtagactacccctcgggtggagcgtataagtcatactcataggtctttagtaagcttcctaaagattcacccaaaatctccatagactgcgaccaacagtcaagcttacaaaggtgagtcctttcaagactactctgcaggaccacatcttcgctaattaaagccaacataactcattaaggcatagccaacctgccttgcagctcacgagagtacatgcatcttcacttagagagggtataaattggtactctcctctagtttactaatggtttgttcttcccaggttctaattcacgggatctccgatcacatagactgggttaccaccatggtataactcacatgggtctcaaacccatctccttcgatgcattatctatcacatttcgtgatagtcccttcgtgaagggatctgccaggtttctagctgtttggatgtaatccaacgttataacttcggagtttctcaatttcctgacagacttcaatcgtcttttcacatgtctagacgatttcatattatccttagaactattcactttgacaattaccgtttaattgtcacagttcataaggatagccggcaccgttttttcaacaataggcagatccattaatagatcacacagccattctgcctcaacagtagcagtatctagtgccgtcagttctgcttccatggttgaactcgtcaaaatggtctgtttgcaagacctccacgaaacagcaccaccacccaatgtgaagatatatccactagtggctttgatctcatccacattagagatccagttagaatcactataaccctccagtaccgcaggatacccaatatagtgaagccccaattccatagtacctttcagatagcgcattattcgctcaagcgcacgccagtgatcatctcccggattagaggtaaaccggctcaacttgctcacagcaaaggagatattaggcctagttgcactagccaggtacatcagcgagccaatgatttgggagtattccagttgattcctagcaattcttttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacatacaagcacagaataactccctcacccccaccatggcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaagctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggttcacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaggacttagccgtcctttgtctcttactccttcgaggagcttcacagacatcctcctcagagacatgttcatgtgtatgttcaatttgttctggtggtgtgattgaactgggaattatttcagagggttggctcgaaccactatgtgtatccttcattgggaaaaagctctcaaagaaggtagcatcaagggactccataattgtaccaacatgcatgtcaggtacctcggatttaactattaaaaatctataggcaatgctgtgatgagcatatcccagaaagacacagtccacagtcttaggtccaagtttgcgcttctgcgttattggtacattgactttcgccaagcacccccatgtgcgcaaataagaaagtgatggttttctcccaatccatatctcatatggtgttttgtccttatttctgttaggaactctgtttaatacatgattcgaggtcaacaatgcctccccccaccatgccttaggtagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactcttcaccacgatcagacctaagcctttttatctttctgtcaagttaattttcaacttctgccttataaattttaaaatagtctagagcctcgtctttcgttttcaacaagtacacatagcaatatctagtagcatcatcaatcaacgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaaaccaaaattaatatgacataaacgtgagtgccaaacattagcctcattatccacactgccacaaatatggttcacagacttattgcagaaatcagaaagggaaaagcggaacaggcctccgcactcataacctttaccaataaaatatccatgtttacacacgactactttattagactcaaaaaccaacttaaatccgtctctagtcagacgggagccactaacatgattcctgtcgatagaagggacatgctgcacgttcttcagctgcacgatctttcccgaagtaaacttcagatctaccgtgccaacaccatgaacagaagcatgtgacccattccccattaggacagtggaaccccgtgcgacctgataagaagaaaacaatgagatgtcagcacaaacatgtacattggcctcagtatcaacccaccaattagtagactgattaactgaaaaaacagtaggtaaattaccatacccgcttccatctctagtgttgccaatggtcacattagcaaacttagaagtctgccctgcaggtgccttcatccccttgcgctgtggacacttcctagccagatgaccaggttgcccacacacaaagcaagtcctctcatcctggttaggattgttgttgttcttctctgcctcttgaagttggtggtctgttgagctttgtatttccccttgctcttgttctgggccttgtgcacaacattggcactggactgcccaccatcgccctcagacgcggcgtctttttcccgagctttctcctcaacatcaagggacgctatcaacccctcaacggggaattcatgtctcttgtgtttaagtgcagtaccaaaacttctccatgatggaggtagtttcgcaataatgcacccggccataaatttatcgggtaagacacacttaaggagttcgagttacttagccatggtttgtatctcatgagcctgttcgactacaaaatggttgtcagccatcttgtagtcatgaaactgctacatgatatactacgaactgcattgtgtgttccctcagtgtactacgagtagcgaaataacgagacttttgcgaatgcctcttccttgatggatcttagcagtgtataaagtacagctacagtgtttcagcaatggattagctagttgtcaaaaactatgatgtattgcataactgtgttgactattgttgacttgtgtatcgagggatagtagtagtagtatcaaacgatactgtagcaattggcatagtgggctagtgggcattgatatctgctggcccattcggttgacgggtgacttatttgggctggaccaagaactaccgttgactttggttgggccacatcttcagaggtcaaccacaagtgacctgtggcacatgcatccgtggcattgcattgcatacttatcctacaaatgcagcatgccagcatcattaaccaaaacaacgcggttcaagcaagtggatttgggaaggcaatactgaaacacaatgatactaatgataattgaggatttgaggtggccaaatgaagtacttccctgatttattttttcgcggagcttttctagcggagactttgcggagcccattttttggctgaattgcaaatcatatgcgtttgagaggattaggtagtaggagatcacaaggtttcattttcacttttgtttgctactccactatttgtcagaaaaattatactactcctgtactatttttctcgtttgccgtgtcaccgcgtgagttgcgcggggtggagtgtggagtcgacttgactcccaagtccacttccctccataaagcgagctcggagcgcagccacagcagtgtagagcgcaagcacagcgacggcgagcaaccgcggtgaccggagaagcgtactacgtgtataccggcgtcggtcgatcgacggcaatcggccggattccggtgtgattggctcaccggcgatatgcacacgaagcgtccgctgccggcacaggcgccaccagctgggcttgtcctggtgcccgcgcccaagcgcccgcatgtggatgctgctgccggcggcggcggcggcgtggcgtcgccgcgggggaagcggcagcttcgctccggcatgctcgtcctcttcttcgtcgcgcaagtgtatggcctcgatccattcgcctttggcttgatttctttatgggcgccaatatggactccggtccaatgaaaagtatttcgaggtatcggttcctgaca

SEQ ID NO: 70605 - DNA, 675 bp, Oryza sativa
ccttcgccacgtccctctatcttctgctcttgcgatacacgagccgctgccgtcgtcgagcattgcctccctccccaacatcttccggggcgttcgaggtggtaaggtgctcgatccggtgatgatacgatcgacctcaacggggagaagctcggttaactggcgctacgatcgatctagatggcttactcacaaggcaagcctgtcatcacactgtcctagaatcgggtcgccccagtgacgcccttgtctggtgctgcatgcctcctcatcctctccctcacgcgactgcaagatttgaatcactccggtgagtctctggttcgttctcggcttctcaatcctctgccttccttgattttttcccctttttctttgttctttactttgctgatgtgcataggtgaattctttgttctttactttgctgatgtgcataggtgaacgagaaaagcgtccagccaaccacttctcctcgttgactgtctttatcttccctccagccctggcagcaatagagcaagctcatgtcaccatagtcccatgctcttggggaaggagatactagcatcccgcctacggaaattgccatcgccgctgcttcctcaaggtttgcattatttttcacggccgtatttgttgccacatgaaaaaaaatgttagctgatattgttt

SEQ ID NO: 70606 - DNA, 805 bp, Oryza sativa
attgacctctaagtgtgccattagatagatctgagatttgaggaattttggaagttgaacggagtcaaacggacttacggttggaagatgttgaatttctaagattattggatttttgatctaaaggaaaaaggatttaattaaacccttttgaaaaagaaaaaaaagagggaggaggaacggacttcacgggcggcttgagcgcggcccgagaggggttggcgcggcccggccttgccatcgggctggccggcctgaggggcagcccaagggggctctcggggaggggaggaaagagggagccattgggccgggtccaccttgcgtggtcctgggtggacccgcttgtcggtggctcggctcaccgtgagcaaggtgcacacggggcgtgctagggtttgggaaggggaggcgcggtgcacgcacgtgctcacggtgggtgcggatgaggcgggcccacacgcagcctcacggctctcggtggagcgcgcgcgcgagcggggctgaggggagcggctgaccggggttgtcttgacccattcgcggccgaggtggcaccgacgtggccgctttgtggcagccacgcaggccggcgagaggtagacgaccatgtcggccggaacggatggcggacggcggctacgaacggcggggcgaaccacggcgatacaggagagagcgagcacaccgggtggttgtacgagacgaggggagacgagtcaacggatcagattcaccggagggagttcgtcggtggaggattgtggcgtcggccaccggcggcgagagaagaggggaacgacga

SEQ ID NO: 70607 - DNA, 9153 bp, Oryza sativa
agattcatctgatattttagagcaactttcatatagaaagttttcgcacaaaacgaaacgcaccgtttaacagtttgtaatatttttaacacaaagcaaacatgttaccaaaatatatttaccattagatttataaagttttttttatgttatagatattactaacttttttcataaatttgatgaagcttaaaaagtttgaccaagaaaaaagttaaatgacctgtaatacaaaatagaggaactacttgtaaggatcggtgtgcacacatagcattagcggctctctctctctttttagcgaaaatcgacccgacggactctccctaggattccaggcatgggaggagtcggcatgggttgctccaaatccaagcgctcgcagctgggcggcaagtgcggtttgcatatgcctgcggcttcctcactcactcacgaacaactgcagccagctggttggccctggggtcgattggtctggtgtttgaagtataaattgacaaattgtcccgttgaaccgagggaaatttgggtagtgaaacatccacaagtcatcgtcaggtgatgagtggtttgctaccatctcagcgtagaaggttcgttcgtggagatacgggttaaacatcgtgctaaacagttctaacaatggctctatgaatgatcagttgtttgctttgtttctaacgactgaaagctaatgcagtatcttctgttaaaaaaaaaaggctggtcaatttacgtttatgttaccttccatggtttagtttagtgtgaagctagctataggtcaccagcggttgcctaatatggattgtagccttacgactatgaatgaaaaaagatcgaacaatatatgtgtgtatggaaaattatgatacatattttcactgatttaaaaatcaattatgaaaagtaaattacgatagaagtctcaaaatcatcttaaacaattaagttctaaaaatttttttacagcgacttattagttgtagggaaaatgattagagtttttaggcaagtaaattaacactctcacatgtgtggaactgagtaaaatagtactgatgtctttacaggtagaagacatagatgtactattcaactattcacatgtgagatgatagcaacatttcaagctaatctaccccatctgagtcaggtcgaaatgagacgtgtcatctatataatataatagtacatcgtgtatatttacatgatgcatgacaggtagatggcttaatcaactataaaggtggtgtgcacatacgtacatagcgtctgcagctctagtggccgctctctgttaatttcttgaggcaaattaaattgaccaagtaatgaacctccacagggctcctaggcacgagaggcatctgcaattactcagccaccttgaggtcgacaaggtcagccagctctccgctggtcgatcgctagctgtttgctcctctcgactagtcggggatgtatgatcgtcaattcaatgccctctctacctcttcagtttttaaggctttcatgagctgcagccttcgtgcaatcctctgatcattctccgttgttacgaagagcacagcatcctggatgccgtcgagtggcccgggctttctatcttttgcagtgttgatctgatgtgtcctgatgtatcacccggagtctaggtgttgtgaatttctttttttaatttctgagtggattgtttcatggtcgaggttaattacactgccgagcttaagcctactcttggataaaatttggaaacaatacatagaatctcggctttgaaaagattggatttaaacgattagattatttcaatataataatacatgcaaaccatcgtcagttgatgaagggactagaaaaaagatgcagtacgatcaaatgaatttgacaaaccactccatctcactcaacctaattattcaaacggtgcctaactggtggccgtttctgaaagggaggaaaacagagaagcaaagcacaatgaactttggcaaggtaacgttttgccgtagtctctatggatggtacaagcaacgtagactttacatgttttcttattgaatgggccatttgtatgtacgctgccaccttaactcttgataaataaaacaacttttttatgttagtagcaaaaatcacaaataaatactagcttacatcactttttacttataataaataagtttagtattgttgtacaagtagagaccaccaaaaaccacttagctaagcacaaaagcaacatgaaccaacataaaacagaaagctaggagagtcacccacacaagaaccgctcagagctagcttacctagctggttaaaatggatagtaaagagaaggaaaggaatagcctctgccaaccagagagcgcgcgagaaaagcaacatggactctttggttatgcagaggcagggctgggcatgggaggtttcaggcacacaaccgcgtcaccgtgggatcatgtctcggaggccggcgcgtttgatggtggccttgtgccgtcatgtcgggaacgggtgccctgcctgtgtgctcgtcttcaccagcgaccttcgctcactaggattgctcgtggaggttcaacctggtaggacgtcctgagctctgcaaagcagtcggtgctcctttgtctgacgctaattccagcgccctatcatggcaacgcggaaaaacataacacagagcacagttctgcggtgcgtatgtgggcagcggacacattgttggtagtgttaagttagttgtagtttaattaggataagtatttgattaaggagttcgtggtatacattgtttacgctggccagattgtacatacagatacgtaagggccggagtttgagtcgtatgtagctttactaagttgagtcctacttgttttatgtagtttcagtttgtttaattagcaaacctatataagaccatgacaggctatgtaattgtggtacgtgagttgagaaaaagaaaatggcgatagttgtgtctcgccagaaaagttcctatgtttttggttctagttttcacgtgtgttattcgattctggtgaaatcccaacaattcttttgttactcagaattaatcgaattttcagctattactactggagatgggaaagctcccgtgtgttgccaaatgtaaccgtgtgttttacgaaacacacggtaagttaccgtgcgcttcgcaggaacacggtaacaagggaatataccgtgcgtgaacatgttgcacacggtaacgttgctactgaaccagaaatccatccaacttccgttttcgcgccctgtgcttccgttggcgcgcccgaatttcgtggttggcgcccacggtgcttctaatgccgccgaccagatttcttttttttttgcacaaccaactatatttcgttggtaatggagtgaaaaatcgtaacaccttcatacgaagtcggatcgagataaattttatatgaaaattgtagcccttaatgagatctagaactttttagatgaaaggtttttcatttaagattgtttatgggttcaaatatttattttttctctcagatctatttttgaaattatgttttgagttttcaaaatgatctccgatgaatacatgttctatgttaaaatagagagctatatgagaactataattttgcagaaaaatttaaagatttgttaaaatataagaaattcaaattttttttggtagtaaatgatttcaaatgaaaaagttgtcaacaataaagttgtataactcatcaagatctataacttttactttggtcttttttctatataacattttctgaacagtttgaatttgaatttaaaaatatgaaaacttcaaacagtattttcaaatattaaataatttcaactgaaaaaatcatcaacaacaaagttgtataaatcatcaatatctataacttttattttggtcatttttctatataatatttttttgaatagtttgaatttgaatttgaaaatatgacaacttcaaacaacattttcaaatactaaatgctttcgactgaaaatgtcatcaaaaaatcaaaaataaagttgtataactcatcaatatctataacttttattttggtcatttcttcatccgacaaagtgatactaacattgttcacaaaatcacatatccctcatctggttttataaactataacacagatttgtgaatcttgtgaacaatgttattaacactttatcggatgaagaaatgataaaataaaagttatagatcttggtgagttatacgactttgttgttgatgactttttcagttgaaatcatttagtatttgaaaatgttgtttgaagttgtcatatttttaaattcaaattcaaactgttcaaaaaaatgttatatagaaaaatgaccaaaataaaagttatagatattgatgagttatacaactttgttgttgatgactttttcagttgaaatcatttagtatttaaaaatattgtttgaagttgtcatattttcagtgagaaaataatcttatttcctgattttaggttcaaacattgtgtttttcagaacatccatgaataggagtgaagcatctgtgctggtaatgattgctatacaaacttctttgcaatctcaagcctaaagtatttacttttcctttttcatttatgctcttttcagtgtcattgtgccttttttattgacattctaaaaagttgctcaagttacattgttgactgttcttgaccatattgagataatgagaaatcagagatatatagtaatgtgtggcttaatttggcttatattagagcattgctactggtaaaagtacctagcgacaaaaattgctcatggtaaactacctgcacaatttcactagtaccttttgtgatgcagtagttgtttgtgcactaaatggtggcctctgttcctgaagatccagtcctatatttttgctaggttgatccaaatatgctcatgttcttatttccatctatataattgagcatttggtcttatttcccattaattgtactatgtttgggtttagcatgtaatatagtccaatcttgatattaattcagtttctagctatattgatcttccagtttcttacaagcttatcacaattgcaggtataattatacattcaagcatcaacttcaggatctgtaccatccatttatatcatctttctattattgattgatcaaccgaataatatgttcctagctattgtaactttggttattgctttaactgacatgaaccatgaattgcttgtatgctaattattaattgtaacctctttactgaaatatatatttatgttggaatgtgttgtgctcttgtgtgcttgttggtggtttatattgtgatggaaataagctttgatggatatagtaaacaaattgcaaatagcatatttttttattaacacgttctcttaccgggtgcttcaaacacggtaacgcaccacatgttaccgggtgtgaatgaaacacggtaacacaccaaatgttaccgtgtgtgaaggacactcggtaagccaccgttccgttagaagctccgttacacaagagtccagctacgcacggcagccttaccgtgtgattcagcacacacggtatgtgttttggccttcccatgcgcataattgtaaaacacccgggaagtgcgcacggtaaactgatgaagccgccgagtatctgttcccatgcactagcacccggtaacgtcgttaccgtgtgtttttggcctgttaccgtaggttttgagcacacgagagccttacagtctccagtagtgaaatttatatctctgttaagacccacgttatgtttacggtgtggcactgaatcggaacgattttcgcaggagaacttaccacattcaaagcagggtgggaacgaatacgttagctaaatttatttattcgttctcatatgtgtgtggacatatcccattcccatcacacaatagcatgagagtgctgaattatgagaaggaaaatgttacacgatgacactgaagacatatacattccgtacccttctgaagttgtttttttttattaagattaaagaggtagatgaaattaaatgagacatgattacgattggtggatataaatatggtgtataccgtcgtgtgcgcttaattaatgcgatgatcacaagatcaatcttttcaaaatggagggagacaaccggcaatggtgtctgctgcttactgtttttagacgacaacaatggcggctacatatatagttgatgcaaagcctaaaccaagtgttcaacccatctaacccgctgaaacagcccaactcaaacacaggacttgggggctgtttggatgacggtactttgccacaaaagatttaacaaagtgtgacaactcatatatatatatgcgtggccaaaattttattggtcatactacttgtagaaagcagggtaacaaatcctatggtaagtggcttatttagtcaaatagttaccatcctcaaccaaataaccccatagatactcacagactggaaatcctaatcggcgatcgatcgcctgggatgggggtagcgatcaattcccctccccctccctccctccactggtttccttttttggcaccgcattactttcttattttcgtaaatttatgcacctaaagtttatacacctcaagtttacacatataaagtttaaagacccaaagtttacacatataaagtttagagacccaaagtttacacatctaaagtttagagaacaaaagtttatatatccgattcaaatttgaatttgaattcaatattttttatatatagtatttctatacatctaaagtttatagacataaagtttatagacccaaagtttataagtcaaaagtttacatacccgattcaaatttgaatttgaattatatctgatttaaatttgaatttgaattctatatatagtatttttatgcatctaaagtttatacacctaaagtttatagacctaaagtttataagtcaaaagtttacatacccgattcaaatttaaatttgaattatatccgattcaaatttgaatttaaattcaaatattttctatatatagtatttctatacatctaaagtttatacacctaaagtttgtagacccaaagtttataagtcaaaagtttacatacccgattcaaatttgaatttgaattcaaattttttatatatagtatttctatacataaatttttctaactttttgtttttttaacaaaaattgtatggtttactgtagtaggaagaaaagaaggggaggagaaaggggggagaggagggaggaatgtatcgagtacagggggagggaggcggatatcattcgaatggcatccttacaatattaaaaaaaaccggtggcaagtttgcaaatgctctattattttaagcgacaatgcaacatttacgatgattcggatctcggcgtaaaataatacctttttcaatagtatacatttttattttttgaaaaaggtactggcaaagctaacatgtccattctggctcatttttgccttcttcaaaccagcgttacattctcgctttattttttattttattactatgcacacaagagcaacttggaattgtgccgcactgctattcatattagctctatgaatcagttgtttgctttgtttataaggactgaaagctaatgcactatcttctgtaaaaaaaagtatatatggtcaatttaaattttgcttaccttccatggtttagtttagtgtgaagctagctagtttagatcaccagcggttgcctaatggattgtagccttacgattgtcaatgaaaaaaaaatcgtataatatatatgtatgtatatgtgtgtgtatggcaaattatcatacatattctcggtgatttaaaaattaatataaaaagtaaataacgatagaggtctcaaaatcatcttaaacaattaagttataaaatttagtttttttacagtgacttattagcagtatgtaaaatgattggactttttagacaagtaaattaaccctctcatatgtgtgggaccgagtaaaatagtaatgatatctttacaggcagaagacatatagagatactattcaactattcacatgtgaggtgatagctacctttcaagctaaactaccccatcaaaggctggtccaaatggcgtgccatcgttcatattcgcatgatgcgtgatagatagatggctaagtcaactataaaggtggagtgcacatacatacgtagggcttgcagctctagtggctggtctctgttaatttcttgtggcaaattaaatcgaccaagtaatgaacctccacaaggctcgtaggtgcgagaggcatcaggagttactcagccacctctctgctgctcgatcgctagctgttcgctccactcaactagtgtgggatgtgcgattgccactgcaacgccctccctacttttccagttcttaaggcttttacgagctgaagccttttgtacaatgcgcggatcattccctgttgctacgaagagcataccatcatggatgccgtcgagtggcccgggcttgctatctttccctgttgctacaaagagcacaccgtagatcatttcaatataataatacacgtagaccatcgccagatgatgcagggactaggaaaaaagatgcagtagggataaatgaatttgacaaaccactccatctcaaaaaaggcttctgttacatgtatctaattattcaaacagtgcctgactggtggccgtttctgaaaggggaaacaacatagaagcaaaatacaatgaaccactattggagaaaccatctttggtcagttacccaaaaaaacacaatagtcccggttgctcaaaaatccgtgactaactttggcaaggaaatgttttgccgtagtctctatggaaggtacaagcactgtagacttcacatattttcttattgaatttgccatgtatttacgctgccaccttaactattgataaataaaacaattttttccgttagtagtaaaactgataaataaatactagcttacatcactttcttgatgataataaataaggttagaattgttgtaccggtagagaccaccgatcgaaaaaccactccactatgcacaagagccgcat

SEQ ID NO: 70608 - DNA, 11402 bp, Oryza sativa
gacttcgtcgagtggtgagcagagcagctctgcatctctccatccgtgatctgtctcaccaccacagcgtcgtcttgaatcgatctaaatcattttccccatcattttatactacgatctttttggtagctcattgcatagttatgtgtttgtctactgtagatacgtggagagaatgctatttcccagcaaagggcaatcgaaacatttgattgtgtctttcagaaagcatttgacaatgccttccagaagcatcttgatccaatttaccggtaagcaagattgatctctcactccctgcaacttggactgaagaattacatacttccattcatggactagtagagtggttaaatatgataacagattaacagttcacctgtcttcttgctcagataatatatctttccactcctttctaactttgttaaatccagaaaaccaaaaccaagagcacgcgcttgaaatttgatttaggatcctaatatagttatttttttatgatactccgttgtcttgtaactttttttttctagtaggtatgcaaatttcctgtttaattacactccttaaaaatttcatgcttaatactccttccggtaaaaaaaagcgtttaagacaagattaattcggtcaaacttttggagctttaaccatcatatttatattagaatatgtttaaaaaattcaataaattttatgatattacgatggtacttttcaagacgaatctatgcatactcttgaccatcattctcttgtttttaaaatgaacacttgagaagtagttaatggttacatttagaaatttgatcaaatcatgtcttaaatattaaatatttatgactagagggatacctctaaatcagacaaattgctccaaacatgggcaactactaatttgatcatttatagctcttctatgttgttatgttaacgttgagaagatgaaatattcatgttgttagaccatacatgagagaaatatgaactacgaaggtgctatgaaatatagtaaattgaatcaaacttattccattaatcttgaagtctccaattttgcgtgttcaccggtatcttatctttctatttgtaagagaatgatgaagttcgttatctatttaaactaacctttttttccacttctttggatttaaactaacccttttccttccacttctttggctgcagctcccttcaatcccttaacaagcgcactgatattctcagccatgaagtggttagatttcaaatgttccactgcttctttacagttcaacacttcaaacccttttctgataagggagtcccttttatcgagtttcattgcaagaagctacttggttgaatgcaactcaaactaaaaagttttatcctatttattttttctaaaaaaaacaaaaggtgtttgcctgacaaacttcaattcttagctcataatgattcttcacccaacgtgcaggaacaaatcaaacattcaaattctaaccatcatgctaatcagcaatacaggtatgatatttgaaattatcaaaaatatgcatagatgacttctattatttctagtaccaatgtttcactggttcttcatattgtttttcttttttcggcaaccagttcttatcaatcacttcaaatgacttgtgaactaccatgtatccatggtacactatctatttatggggcttgcctaaacaactttatgatgttcttttcatgctgttgtgagtctgtgacttgtgatgtactaaagttgtgatttttggaaaatcggaagtactgtcagatgttcaaatgacactagaattaatacacaggggtgtttcatactttttttaaaagagagaaaaagcttttcctcctatatgttgatagagaaggggtttcatactatttgtgtatgcattgtagatcaaaggcaaatcaagagtctgctgccatcactgaggaagtgaatcaagaacaaacagctgctagatttgtcgcgagtgaagctcaggaggggcaaagagttgagttgaggttcctcaataagttgaaccctcttgtttttacaaaggaaaaaattacagcggaggatggtacagctatcaaaattgccatagttagggataatcagataattacatctggtccactttcttctgcaagaattgaaattttggctctccatggtaacttttatgatgttgtccctgataattggaccgaatctgagtttgatcaccgcatagtaagtagttcacaaggtcccgcgttaggaggggtttgtcaagtcaagctgaagaatggggaggcctctccttctgatgtatttttcaatataccatcttcgaagactgaaagtggaaggctcattctagcagcaaaagttcatacaagtgacattggtgggcttcgaattaaggaagctgtgatgatgaatcctgttgtggtgcaggtttaccgaaacaaacgtaagttttccttcagaattgcaagctggttattctgtagtttgcatcattttttttggtcgggttagctgaaaaatcgaccaaccaaattgtattaagaagagagaaatgtgccagctacaaaacaacattatactgtcacagggcataagcccccctcccccctcccccccaaaaaaaaataaaaagagggaaaaaatacatatagtttgcatcatgtatttattatgtaagttttgtagtgtacattcatttttgatgtagaggccggtttaatctattattattatgtaagtattctccacatggcctgttaatacctcctagtgaccgtacaaaatctattctttcattggatttactttgaaattacatattgcataatcttcacgatatgatctattgtcatttactttgtttgcttttccccagtaaatagaagtagtgaccgtccgaagctaaaagatgaagtacatcgtttaaagggaatttcaggaaagggatgccgcaccaaatggcttaaagataatcaaatcaacactgtggaagagttcgtaaaggctttaaataaggatgaagaaaagatccgcaatgtaaggcctctgggattccaattctctctcatatgtgcacgaattaaatccatacagaaattctgtgtttatgttaattagagcctattattcatttcttcgtatatcagagcaaatttacctttcaatgccatgaaacagtacaagcataagtaaaagggtgtagctatatttatggcgccatatttttcatcaaaaaatagtcggcatgtatttacattgtaagtctctaaattacatatgtaattttagtgtatttacaatgtaagtctcaaaattacatatgtaagtactaaaattacatatgtaaattcgaaaattacatactaattacatatgtaagtggggtgtaaatgaggtgtaactactgtgtaagtggctgaaaaaaaatcgactgtagcatatggcgccatatttctagcaactccgtaagtaaaatattatttttgacaaacgaactataacatacgcattccttggagttcaggagtgtttcaagctaaagaaggataataagctttggaaagatacaattaaacatgctaaagagtgtgatcttgaagggaattgcaagctgaaattatatagagctgaagagcagcatgttgtactcttctttaactgcgtgcatgacctcgttggtgcgaaatttcgtgatcactatgttgcaaaggacaatttcagttcagatcaacaggtatgcgttgatattggcattcttctacagatgcaaacctttgatgagaacttagaagattacacttcttttttgttttctcaggatgcagtgaatcgtttgaagaaacaagcatatgatgagctggatagcattggctttgatcacgaaatgaaaaataactatccggtgatgacgctcagtgatgatgcttacattcccttcattgacacagcacaaaatcctccagatttgcatgttacatttcaaggtaagacattggttttgttctcttgtctttcatcagactcaactactgacgatttgtttatttggatttgacagttcagggtattgcaggagctgagatttatcatgcacatgaactgcctcaagcatttcctaacaacaataatgattttggacaacactttttacatggctttcaaggttggttctgcttttttttttctgcttctgctggttttgttttgaggaatacttttgtgttggaactaaagtaatcaagcaggtgctctgactcagatggaccatgactatgcgcaatttggcattgctgatatgcagtgttatactacacaggcacctgaagtaagtggagtttctttttttttggctcagtttgtaagaacacggatgaacttataagcccctgttaaaatttgaattttaaaacctatttttttacctctttcatcatagtttttctaccattagcttttaaatcggtaagaatacatatgtaaaagttttacccacaattttttttgttattattttttagataatggaataaaatctaggtctttgctcaaagagctacagccaattattactccaattcaagcaaacacaaacgcacctcaacaattcataaaaacactggtctaataaaacaagagcacacacaaactactaaatgcaacacaagaaagaatcacaagactatgaattctatttgtgaatctctatccgaagttagtgaaaaactgcataaccgttgactcaagattgtgacatgcagctttaacaacagttaacaaattgtatgtacgccatgaaaacaagactgcctctgattgttcagatcatagtatcgagtatctttgtgttgttccacactccttgaatgctaacgggtcattctttcttcagggtacctcttatggaggcaacaacatgatcggaccagcaaatgtaccgcagaatgttattggtgacggctctatggacatgtttgactgttatgcatacatctttccggacaatgagaaccagaatgagaggcctcatagctctgcatatccaggaccagtttaactgaaggctttgttgccagctagtaatctatcatgatttctgattaatttcattctttatttagataatggatattttattgttttattcttgatggatgtattactttcaagaaatattcttgctgtatgtattagcatttgttgatgcagaaaattgaactgtactagtacttatgtttcagaaaaaaaaacatcgactgttatgttacataattcaactgttgtatcacactacggtttcagaactccttctagtactattatttactagttagcgtgcatgttcacggcatcgcaacatatccaatggagtacataatcttatattgttgtttatagtaacaatggaaagaagcactaccaattcacgaaaaaaaaattgaaactcaacttctgcaatgtcgtaaacactaccaattgtgttgaaaggtaacaatgaaaattaacaatgtggtaaacatcttcttctgaccgttggatttgcttcatgttttatctgaccgttcgattctttttttttctggctgttagatgtgcttctagatatgtccgtgtcctaaaagggcatgtagcctactgcttgcagaagtgacctgagtagcaccccaaggtcctgagttcaaatcttcataggagcgaattttagattgggttatttgagggctaagttccctgtttgataagttaagttcctaatttaaaatggctgtacatatccgattgaatattgagtctgggaaaaaaaatacccttctctgcaaaaaagatatgtccacgttgttgggcctggtggtattcatgtttggtaacggatttgctcctctagcacgttaactttgtgtgggctactgggcttctttctctcgtcgtagctgaacccgaagcaccgcttgtccgcttcacctcctcgatcgcgtcggtgagactcggcgagcgttccagccggccgccgccgccgccgccaggctttggcctcgggtctcctactaccaaccagccatggcgcaggtctttcgggcgcggcggcgaggcggaggcggcagggaggagccgatcgccctggtggtgcggtgacggtgtctacccctcgtcagcacgaggcgttcgtggaattgtccgtaagcgcgcggtctcttccccgcgaagcaaggatgtggatgttctttttgcagaaaaaggatctggcccatcgccttttccgtgtgcatatgggacacgagcagaaggtgttcgtgcaaatgcggcagacagcacaggcagacagttcttgttttggatgtgttgggatcagagtactggcgttttacaagtttgctgatgccgcacgattgcagtcaacaaggtcatttcactggatttttgtctcaacaatatcgggatactgagttctccttatcaccgaaattttagcagttcaagatgctgagcctaaggccatccacaatcggtgtccctgggtcgtccccccgctcacaccgtccgccgtccgtccgcgcagcgtgtctctggagggaggcgcgacccccacgcggggaacccctctagctccccagctcgctttttccagagacactcccttgaagctacgtgttgcggcgacccggtgccccatccctaccttctctcctggtgtttccccttcttgcccctcaccggcggcatggcgacgagagagagagaagagagagaggcgacggcgacgaggatccacgacggtgacgaccagatccggccaccagctggcgacgggctcggcttccgcgacggagacgacgacgaggactggcgatgaccaccagccggcgacgggctcggctttcgcgtctgccacctcgacgccaccacgccagctcaccatatctgcccgcctcgcagccggatctgcctcctccagctgccgccgacactggaaccgacgctggaaccacttcggtgacgacggcgggacgcggctggcggagggaggaggaaggcagctgctagagggggtgaggagggaggcgccgcggcggctggggagggcgagggggaaggccgcggcggcgggaaccgccggcgacacgcctcgcgctcgacacgaccggcgtcgcctttgtggaggagccaaggcggcgaaagaaagagtgagggggcaggaccgcgggagagagagagattagggggtagtttagtaaaaataaatatggggttttgtgggctgggatactcattgtgggttggagtgtctctattaagttgctttagattttgaggagcccatccaagggtatcctccattgcgagctgagtttccctagagtgcctcagttagtgagaacactctaggagtggctcacattgtggatgccctaaaagtgaatcagaagcggctgttgtagtactctttgatgaggtaactccttccctcaaatgcatgaacatggaatcttgtccatgaagttaaagctacgtgtctcccgaaaggcagcccctctcacggagatttgctatataggagtactatgcagaagcatcacgttttaagcacttaaatagttgaagtatgagctaggaggagtggaagacattaattagtgggcgcattgttggcatcagttaaaaattggatttagctactttcttacttcattttcaatcttcttgtttctgctactttttctttctttttgaaaagtaagatatcgtttaaaaaaaaaagtaagaaaaagacaatgggggcctggacctgaatagtcttgatggcaagattttattggtttcttattcatcaccacctcatatatataattgtcttgtcgcgaatcgtgatgattgagcaggtagtttggatggattggctccaaaactatttaaaagaatccaccagttaattcactcaagtgctctctgttttacaacaagacctggaccttgatagtcttgatgcccaggtgtttgtattttaggcccttcctctttcacctcatatatataatgctgcaaccggagtaggctggggtaaggtgcatcatcagatatctcctcatccttgctgaattcctgactgcgcaagctgatttgaaggtctgtcaaagtaagctagagttgggggaaaagtgaaattaagaagctagctatctcctgctaattatttaatggcatgcatgcttgagttttctttctgatccatatgatcatttagtatatattgtgctgcatatatgtacatgttcttgtttagaaaggatttacaagttctgttctgacatgcaccttcctctgtctacacatgtcatggcatgcagggaatcaatcagatatgattatagaggtgtgttgctgcctggggtttgctgcgaatgtagcgcagctggctggcctggacgtggccagtctggtaaaggaaatcaaggagcgtgtccagacagtgagccagaacaaggaggactgtgagctgctcgccgaacgtgcggaattgatccttgatctgctcggtcggttgcagaaatccaaggtcatagaggaccctgacatgtggaaaccaacagagaggctcaggtcaactcttcgtagggcatgcgaggtcatcgaattctgtcgggagaggagctgcacgtaccgcttctgcaagagcgaccataccgccaaagagttgcgcaaggtgctcaaggctctgaaattttgtgttacccatcatcaatggtgatcaaaccacacgttactttctggtccagcagactccagatgttgttcagctgcaggtacatccatgctacactgttacttcaagtctacaacagctaagatcgagcttcatttgctaaattacagtgtactgtgcaacacaaatcttttgtgcattccctaaaaatacactctaacgtgcaactgccaaatgcctaaaataggataattcaaacaatctatccgttttgtgattctgaagtttgttccaacaatatgagaggaagtgtatgtgttctgataaatgcctgcttaatcggttgagcctaacttaagttgttatttcaggatggcgtacaagtacctgctctagggttgcctgctcaacacttcaaatataatgaccggtgagatactgatcacagtatgtatgtgtatctaatggcttgatattaggttatggatgtacatttttgaaaaaatctcaaaagttaattatgctattatatttgaattttattttttttttagttttttttccccccaatgcatgcagcaatgataggggagaaacactgggtatttcagggaaagctcaactggtaacagagccttcctctgttaacgagccaggtacttcatttttatgggccaatctacatatcatggataagtacctgtaggtgcttttcttgatttctataattttcatttgccctttttttgtcatgatcctaaaattatcctccatgggaaaaaacgaagaaataaacctcggtttctggtaatcctatttcatatgaattcatatatttctgcaaaatttcccagcaagggttattttcacaaacgaaaacaggctaaatgaacaaaaaactttcttttcttgagtgctattctatgttcttaaaatattgatgcatttagcacagtaaacttgaatcaccgttttctacagtcctacataatattgttgaagaaacatcagcagaaaagaagttatcaagatgctgttggtggcatccctggaagagcattgctacctcttccaatagtggcatgcttgttgcccaaaaagaaataggtaatgatgaatgatcaataatccaaaacttagtagtgtaaaatcatgactgcgtttccaattcggcaattccatttgtaatgccaagggaagtttccaaatactaaatgatacatgtttgtctaaatgacaggccttaaaaggttcgctttctctcaattggaggttgctacagacaacttctctctggaaaaccaaatcggtgtaggtgctttcagcattgtttaccaggtaaggatttgcatatgctttgctctttgctggcttctgcattcagcaaaatgatttagcgaagttgtttgaaacatcttctcttgtactaagatattagattctctttctatgatgaattttaccattattgacttgtatttggcgtttactcctaggggcgactaaatgaaggacttgaagttgccgtgaaaagagcatcatatgttgacaaaattccatttcaccagcttgagaatgagcttgatctaatcccaaagctccagcatacaaatatagttaaacttctaggatattgcacgagaaagagggagaggatactggtcttcgaatatatgcctaacagaagcttggattcattcataactggtagggttcagttcaattagcactatcaatctcagttttgagaccaaattatcctgttgatattgatgtactaccctcctattcatattcacttatatccatatttgcttctcgcatttacaggtgaacgagcaacaaaagaaccattggattggcctaagcgctcccaaatagttagagggatagctcagggagctgtatatctacacaagctatgcgaaccacgtattattcacggggatttgaaaccaggcaacatactcctggatgcttctctgaaaccgaagatttgtgacttcggcatttcaaaagcacttaaggcagatgcggataaagactgcactggcgtcgtggtgggctcacggtaaggcggttttgtacagcacaatcttcaatggttatactttggagtggttttacagtcctcgagtaggtgccataggttttagtgttaatttgtggtccttctttgtacattaatactgaggtgttaccaaaaggcaaaattcactagaaaaaaatgtagtacatcgtctaggaccttaaaatactctaatatttaaccccgtttgatctgcttttagttgtgattgattaatttttcatctttttcagtgggtttatggcccctgaatataaacagggaggctgtctctctctccagacagatgtgtatagctttggcgctacgcttcttcagatcattagaggaaaacacatctctccatcttcactggcgctttctgatgaatctcacaactacgggcctctaaataagtgggtacgtgaacctttccgagtgctactcctgaagaggacttgaagggtatgcaagcctgacacattattcagagttgatcactgattaaccagtagcattttttctactcaggcgtggaacttgtggaaagacggaaacctgatggaattgatcgatccgtcgctggccgatgagaatcatgcttctgagataaagagatgggttca

SEQ ID NO: 70609 - DNA, 15378 bp, Oryza sativa
catcaagtgtacctaaataacgagactgctgcagaagtatttgcgatttgtcaaaactgcgatttctgcagagctgtgttgactactgtttgacttattgagttacatcagacggtactgtagcagttggcataatgggccttgatatgtacagcccattcaagaactcccgttgacctttgttgggccacactttcaggtcaagcaccacaaatcaaccgagacctgctgcacctgcattttttaaaataataaaaataaatcccagactttactctaaaaaaaatacaaccacttattacaaaattctctcaaagttagcaaaacaattcggccacatcaaagcaaaaccaacacatgagtgaacaattattgaagtctacctcctgcacggctgcacctgcatgctttggcaaacaaatagtactatataaatatttctgatgcataggcaccttcatgaactctggcactgtaaagtagtgtttaaatcaaatgcagcctggatttatactggggtccaaatccacgcggtttcagccagttgatttctgtccgttgaatttgggaggtgatgccaagacattttaattgaacttggcaaatgcaagaagcaagagggaattctagcaaccaaccggcgaggagaacaggccgggactattgcctgaattttccggagcttttctggcatacgactttgtggagcccgtttaattttgggggaaatctactgcaaaccatgcgtttccaaaggatatgtggttacgtacgaaggttctcgtttttcacttttatttgctgtttgctctcttgtcattcagtcaccaaaacttgcatataataatgtatatggctgcgttcggatggacaggtgataatgcgcatgtacctttaattatatttgtacagtttctaatctatcaaagtgcaattatttaatttcaagttcaaagttagctgtttcatcctaaagaacaaagagataaatagccaaaatgagattttgggggacggatgtattaaattgtaaaatattgatctagtaattgaacgaaggaatagatgttactgggggatgtcaatttacaacctagatacacatgcactcatctcttgcatatcatttgcatgaatcatgcatgatcatgaaattttatgaaaaatgtgactttatatgtaaagttatgtgatattaactttaatttacataatttaaaacaaaatttggctggaaattagtgtaaacacccttttatgaccagatttgtctctgtgtttcttttcttgatgctgtgtagattgattctggacttgaaattttgcaagatttgaattcctttcatagtttgtgacatttcatattataagttattttgacttattttctagttaagttattttaggtttggccaaatcttatatacaaatatagtaaaatattcaaactaaaaaataatgactaggaaaaaaaagtaaaaacgacttacaatacgtggagagagtatttaggaagtgagaaacaattgagtgtgcgttaattcacttgagcaagtttaatagtatagctaattacttgctctaaatcatttatagtcaattcatacatcagatatctataaacatatactacactattaatacatgttcctcacctgccatacacacattatatcttgaagtccgtgctacagctggctacaaatatatagcccgttgcttctctatctcctattttatctactggacatatgtatatgtttatagctagctatagcttgttattgtatctgcttgctcttgtaataatccaaatccaaatccatgcatgttccagtttatttttctcactaaccgcgtgagcaagacttcgtgctcggccgagtccactccactcgccgctcgacgacacgaccaccataaaagctcgtcgtcgaagtggagtggaggggccggggcggcacagcgagcgctcgacgacgaccggagaagcgacgacgaagctacctaccgtcgtcggggaggagtaacgagagctctgcggcatcggcgacaatccatccatccatccatccatcccggtttcaggtggcgcgcgcggccggcgagcgacgagccgacggcatgaacccgaaacgtgcgccgccgccggcaccggcgcacggcgcgccgccgccgaagcgcctgcagatcgacgcgttccggagcggcgccgaggcgttcgcgcaacaggcgccgacgtcgtctccggtgaagcggcagctccggcggggcatgctcgtgctcttcttcgtgtccgccgcgcaagtgtacgcacgccggctcgcacgcctcctgtttgatttaattcctccgtgggaagctcgttgtctgatcacccgcgtgctttgcggatgcgcaggaaggaagagcggaggaacaagaacaagaacaacgcgcgccctgctcgagtggcggtgagcagctctgcatcgatctctcgttctggaactgaatcaaactaaatcttttctcccatcatttttgctactcttttggtagttcatttcagtgtcctgtgattaattgtgtagatacatgaagagagttctacttcacagagaaaggcacccgaggatgatgcctttcagagaggcattatgaaagcatttgataatgcccttcagaaacatcttaatcctatctattggtaagatctctcagtcggggtgaaagtagaattggagttgaagaagttataaaatcgatccttgaactagcagagtggtcaaataggagtaggaccacaaatttacctctctagctagttgcttagataaatccttttttttttttgttgagattgctcatttgcagtttttttagtaagcatcgaacgtgtaaattccctgtttaatacctctaaaatacttgtttggacaactaatgatttcatcatttacagttcctctatgatgtttttatgttaactgtcaagctgatcaaactttaatgctgatataacacatgcaacaaatctgatctatgcagatgctacgaaattaaatcacacttattgcattgatcttaaattgtccagttttatgtattaatcaatatcttatatctttctctatgtcctagaaatatgattttttaataaaaaataaactagccttttttcttccacttctttgattgcagctctcttcaacaccttaccaagcagactgggactctttctgagcgaattgatactgtcagccatgaagtggttagatttcggatactttattacaaggacactactttatactagtttaattaacccctttctgatgagagagcttcttttattgtgttttatcaggaagttacttggtcgagtaaaattaaaactgcaaagtgtttgcttacattttattatgatgaaaaaaaaatgtttgcctgagacaaacttgcagggacaaataaaaaagttaatttctaaccgtgatgctaatgagcgctacaggtatggtctttgtaactattgagaatatgcatctctgacttctgttatttccagtatgcaatcttacatatcaatgtctcacacacacttaggttcttcctattgtgctgatcagttcttatcaatcacttgaagtgacttctgaattactgtcaactgtgtattgatggcactatatatttatagtgatgttcgtttcatgatgttgtgtattacagttgtgaatttcagacaatttaaagtactgccagatgttagtatgagactatagttaatacacaatggtgtttcatactatttatgtctgtattgtagatcagaggtaaatcaagagaatgctgctgtcactgaggaagtgaatcaagaacaaacagctctcagatttgccgcaaatgaagttcacgaggatcaaggagttgagttgaggttcctcaataagctgaaagaccatcttgtttatacaaatgacaaaattacagcagaggatggtacagctatcaaaattgccatatttagggataataagatagttactgccggccaactttcttcagcaagaattgaaattttttttttgaacgactcgcacgagacggtgcgaagttctattgatagagcaggaaaaaattacaaggttacaaccctggagagtcgtaaccaggaaaaaggaaaaaataaaccaccacccacacggcgacaacgccatcacacaagcccaggagaaggctaacactggaccggccgccgctaagcgtgaccgaccgccactaggccaacaaagggacacagacaaggtcaccagaggggtgagacagcacgacaacgctctcaggaggggggataaccatcgttgtcggtccgaccaaggccggactgggttttcacccgccgctcgccacttgcgaaaccacgcctgacgcaccgatgctccaccaccacacaagctttgccgacatgtgggacccctgcaccggcgtcccccgccggccagtcttcgagcgctgaagaccgcgccacacccaccggcagctcctcctcacccctaggtcgcctcctccaccgccggccgcgccactctgcgccaagccggcctcctccaccggacgcgcctcgcgccaatccggtctccctccatcggccgcacctcccgcgccaagccggcctccatctccgccgcccgcgcctctcgcgccgagccggcctccgctgtcatcggctgcgcttctctgcgccaagccggtctccgacccctccaccaaacgatgccgcgccggccagatgtagtcgcctcccacgccctcagctagccgtttgaggccgccatgcctccagtgactgtagacacggtcaccaccactgcagccgctgctgcctaacgcccagctacctcgccgtcgccatcctcgcctcgccgctgatgtcaccaccgcctccacaaacagccgccgtcgccgctgccaccgactccagcccccgcatccgcaacctgccgctgtgccgtcacccttcaccagcatacggctggctgccgcccgatgccatgtgtgccactgccgccatcgccagccgacaccgcagctgccaactaccgcgaccgccgtcgccgtcgccaactgccgctgctgccgtcgccgcaccgccgccgcaccgccgccgtcgtcgccgcacagccgccgccaactgccgccggccaccctccagatccggccgagaggcgcggatctgggggacaccgccgccgccgccgccgaggagcaccgcgccgtcgccaccacaagctcacacgggaccaccaccaccatcttcgtgcccgcggccggttccttccccgctaccatcgccatccccgccgccgcccggcgccgcgcgcccctgccttcgccgtcgccatccccgccgccgtggccgccgtcctccccgccgccagtcgccgccccgccagatccggccggagcggcctggatctggcggtcaccgccgtcccgcctggcggctcccctgcccgcccggtgaaaggtcggcgaggggccccgccgccgccgtccttgcggccggccggctttgccggcggccgctcgagcggcggcgaggcggaggggaaggaggggagggagaggggcggccgggtcgtcgcctcccgtgccgccccaggggaggacgacgcgagagtcttagtggattaagaattgaaattttggttcttcatgataagttttatgatgctgcccctgataactggactgcatgtgagtttgacgcccacatagtaagtagttcaaaaggggcggtgttaggaggtgttcttcgagtgaagcttaagaatggggaggcctccctatctgacgtctctttcaatatgccatcttcgaagactggaagtaaaaagctcattctggcagcaagggttcttagcagtgacaaagctgggcttcagattaaggaagccgtgatgaatcagcctgttgaggtgcaggttaatcgaaacaaatgtaagtttttcttcagaattgcagctggtgtattcagtagattgtttgcctgatgtttctattttgcaagtattctccacattgtttctcggtacctcccaagtgccaatgactatataaaaagtcttccttcgtaggattatctttgaaattacaggttgcatactcgaatcaactggatttgtatgttctgttggcatttatctctcttgtttcctttttgtccagcaaacaaaaagagtaactgtccaaagctgaaagatgaagtgcatcgtttaaagggaatttcagggaagggagagcgtgctaaatggcttaaaaataatggagtaaagtccatcaccggtccctgaacttgtaccgctgtatcatcccggtccctaaactcgcaaattgatcgttcagatcctcaaacttgttcgactgtgtcatcccggtccctaaacttgcatatcactcgtttaggtcctccaacttatttagttgtgtcaccccggtccctaaacttggatttgaatatcatctgggtcaaataggacggtctaaagactttatatttaaaaataattcataactttttcatgtgaactctaatgaagacaaaccttatatcaaacttgtagccctcgacgcgatctacaactttttagttgaattttttttattctaagtcattttttgtcccaaaatgtaattttaaaattaaaatttcaaaatctataaacatgcaacaatattttgggaccctgaacagttttaattcaaaaacttttcaactacaaagttataggtcgtgtcgagggctacaattttgatataaagtttgtcttcattagagttcgcatgacaaagttataaattattttttgatataaagtttttagaccgtcctgtttagggaccgggtgacacaattgaacaagttggaggacctaaacgagtgatctgcaagtttagggactgggatggcacagtcgaacaaatttgaggacctgaacggtcgatttgcgagtttagggaccgtgatgacacaacagtacaagtttagggaccggtgatggactttactcaaaataatggcatccataccgtggcagacttcaaaaaggctttaaacaaggatgaagaaaagatctgcactgtaaagctcctggactcccaactaatctctctctctctctctcttacatgcaatgtactccctccgtccaaaaaaagacaaaccctggtttccgtgcctaacatttgaccgtccgtcttatttgaaaaatttatgaaaaaaattaaaaagacaagtcacgcataaaatattaatcatgttttatcatctaacaacaatgaaaatacgaattataaaaaaatttcatataagacggacagtcaaagttggacacggaaacccagggtttgcctttttttgggacggagggagtaggccctttcattaatatgtaggacccccaaaatattaggtgcctctttggtatgttgcccttgcatgcaacgttaatttttttaatgataatttttgcatttaatttgggatgtgaaatattaatgaaaggagcacatagtttttttattcaatataataaatcatgaataatcaacagttaggatgactagtatacctcttacctctatagtagtagtgcaaaatttgctacaggactgaaaatttgcagcatttgctgtgagacacccaaagaacatgtatctttttgtggacaccgttaaaatgtggtaattagctgttggacactgctcgtattattttattatatcaggtcaagatggagagagaaaggacattgaaagtaccattttgcccctcggctcgtttggcttgtaaaggcgagtgccaccatctctctgcttgattcttccttcgctgcccgaatagccgcttgattccgccaccacaccccactgctcgaatccgccgccctgctctgccttaatccgaaagcgtcgctataatccgccgtcagcatagcttgcttgtcacaccccaatctggcaccgccgtacaacggcacctgacaggagcgtgtcgtgggaaaaacggcgcgaaccgcttcctacgaaaccgcgatctcagtaccagtcccaggacatagcgctggtacccacggtgacaaatatgaatcattgcaatccttaaaataaatagaggacttatttaccttaacttaggttgcagctcagaacagcccgagattgcaaccgacgacgtggacgaggaaacaccaacaacagcagcagcagcagaaccaacggactaacacccaacaccacaggtgacggctgggaacctggacgaaaccctaatcttcactttacttcatcttcaacttccgggcggaggaactacatatatttatatagagcaagggtgagtactttcatactcagcaagtcacgggaatttaggtgtttaatgcaagcttggaagagaggcaaggttgtttttgcaaatcttttgttttgaaatcattttgaaatcacaaagtgatttatttctttctaagtttgggtcgaaaagagacttgcgtctcgattcgaccttaagagatgtttttcaacagctcatttggtaatgtaccgacctcccgggtcagatcattacttctcggctcctagagccattccacttgattaatcggctcccagagccttttacattttctcggactcacagagtctagctgcccagcagcacaacaatccgcttccactcgggaagcctagtctatgatgccggtagacatcccgaatcacacagattcatttcttgaccactcaggtcatccatctgccacataggctgattctggtaacaattcccacaccacaacaacttttcacaaagcacaggcaaacaaatctacgctacaggaaacacctcacatccgcccatgaccgcgggcacggctgttcgaacagttagttaacctctgcagagggggtacactttacccacacgacattactaacccggatcacccagcccgtgagattagccacgtcgggagaccctaaggctttcataacaaggcatttcgaaagccgacacaggtttaccatatgccaacgagaggggtcccagaccaacaccaggttaggtcccagaccataccgtgccaggaagcccgagggttctccctgacaccaccccgttgaatccacatgtctcttggcatcatggctcccccgattagctaattactcagccaggggcgtcccattgcacccgtgtggtcgcacttattatatgctcagatgaatttcccacaggaatcggtccttatatgcgaatacaggacagtaccacataggcacaacccccgcatcgcgagttttttcaaacacaccgacgccacatgtcgggttttcaaggcttctcaaacccatttcccaaattatcgacaaacaacggtgtatgtggaatagttggtataagtgctcagagagcacggataccgaagtaccacaagggtggagcgacaaggaatcagggtaatacgacctacaggaattagtgcgactactgggtaggtccgtcggtttggcacgcaaaccgaggccaagcatgttaagtgtgtgattctaataatgtgagctgcaatcaaaataataatgattttccaattataggagcaattggtcaaagggtgacttgcctcgctcaaggtcttcacagagcttcacgaatcttcgagaaaacccgcgatcgacgaaaatccgataaccgcaactttacgcaaacaaacaaaaacctaaagaaaagaccaagaaaaagaccctatttagactaaataatagtgccattaaatagatctcaattttacggaattactggaagttgaacgaagtcaatcgggtgagcggttgagaagatatggattttctaaggattatttgattttctgtctaaaggaaaaggaattattaattcccttggaaaagaaaaggaaggagggatcggatttagacttcctcgggcgacttaggcgcagcccgagggattcacaaggcttggccggccattgggccgagcgcggccacggggaggcggcccattagggggcgcggggagagagggaggcccaacggggtgggcgcggtccgccgcgcggggtcccgagatgggcccgcatggcagcggtcgggtgtatggtggggagggcgcacgcggggacgggcgagacggatcggtggattgggtgcggatgcggtgcgccggtcgacaaggaggcggtgggcccacgtgcagcctcatggctcaccggggtccgcacgcacggggatgaaggggcgagggcgagcggctgaccggcttgactgggtcaagccgacgtggcacctatgccaggccacgtgggcggcgagaggaggaagaaggggggatgccgagatggacggcggacggtggccgagttcaccggagtttgatgcagaggtctagggccaaggggagcacaccggaacgatggctaggataagagggagtgagcctccggctcggattcgccgggggggattcgatggcgacggatttcgacggtggcggccggcggcgatcaaaaggggaaatcgcggcggggcgacgagaggtcgattcaaggaggagggagcatctccggggcgcggggaactcatttccggcaccggatggggcggaggactgccgaggagggctgacgacggcggcggcctccgggagcgggcggcaacggcggcaagcctatggcgggcggcggcgagacctggggcggcgtccatgcgtgttcggggggctagccgagctaccacgcgagctagggagggagagggcgagcgagaagggagaacggagggtggcactaccaagccgggacgggcgcagtgacgagcggccgacggctcgggagcgagctctccggcctcgggccggggaaggggaagaagagggatggccggagtcctcgtctcgcgtccacgcatgcaccggcctctgatgcgtgcgacggcgaagagacgaaggcaagaggtgggagtggcggcaaggcgtcaacaatggcgcggtgagtgtgaggcgagcgaaaacgagagaggaaggggtttgggggcggcttgggttttatagtggaggcgatgtcggtttggggagggagggaaaccgaccttggtggcggtcaaggagagcgagctggcggtgagctggtgcagtcgcacgaccagcgtccgcgctttggccgcgagcggctgggaccatggatgatgtcacaccccgaagttttcctcccaggccaaaattgtaatttacaaatgaccccaagaaaatgcaggtgaaatcaggagaaaaccctaagaaagtaatgcaaataataatcggacttgacatgtggaatttttcttgagttctacatgtcaaaattcattaacaggatttttagtggaattttcagagctctagaaataattttaaccaattaaaattgagcaagcaatattttattccagggaaaatcctttttcctttttctttttctttttcctctctttttcctcctttttgtcaaatgggccgtcggcccatttctcctttcctccccccccctctccgctgggccggccgcaggccgaggcccagcccggcagccaggccgccccgctgcctcctctctcggggtcgccgacaggtggggctgtcacaccctgaaaattcaaaatatataaattgttgtttaaatggaatttttagaaataattttaaaagtcttgaaaagaaaatctaagtttaattaataaattccaatataaaatggggccagataaaatttcattaaatactttgcttaattctataattcctagatttttctgggatttatttgagctaagaaagtatttgtaataaatggaattgcatttaagaaataattttaattgaaaaaggttttaaaaagtcttcttttggctttgggccgaaagtcggcccaaaacctctcttctctctcctcggcccagccggcccagtcagccgcgcgcgcgcgccctcgctgtcgctgacaggtgggtcccgcctgtcggagccgtcgtcttcctcgggccgaaaccctagcgcggcgccgccgagccgccgccgctgtttccttccaatccggccgttcctttccttctccggccgatttgttagaggggaaacaatctccgggatctcctctaccttttctcctttggaatctttggctcaatcggtttggaatgagtttgattcgagttcgaatcggatcggctttcctctctccaagccgcgagtttccttcgccgttgccgtcgccgtgggccttcgccgccgcctccgagcccctttaaaaggacccccggagtcttctcttctcgccgccaccctcgccttcgcttctcgtcgccggaagagctctagcgccgtgtgccctagctttgccgtcgccgccgccgctccagccgtgtgccgccgtcgtttcagccgtcgccgtcgctcgggaaggacgtcatcgtggtcgccaagtcgtcgccgtcctcgtccgccgcttcgccatcgtcggagaccgccggagcatcatcgccgtcgtcaagccgaagaactccgccgtttcctcctcgtcgccggcgccgtccgttgcttctccgccgtcgttttggtcgtcggtgagttcgccgtgccgcccgcttcgtcccggtgccttccgtttgcgttctcgcgccgccgttcgccggcgagcgtgcgccgtccgctccgccgagccgccgccgctgtcggtgacgtcattgctgacgtcatcggggtcgtccgccgtgagccgctgtggacccgatcgatctcggccgtccatcttggatcggttagatctcggccgtccgttcgcgtgaaccgccgcccgtgcgcccggtccaccaaaccctagcccgctgacgcaataaatccccttttccttttcaaaaataattcattattgcgtcataattcaatttaaaccgatttaagtgttttaatccgatttaatctttaaaaattcataactaattcatcttagctccgggaaaggctaatgttgtagcagacgctcttagcagaaaaggctattgcaatgctacaaaaggacgacagttgccattggaattatgcaaggaatttgaaagattaaatttgggaattgtcggtagaggtttcgttgcagccttagaagcgaagcccactctaattgatcaagttagagaagcccaaattaatgatcctgatatttaagagatcaagaagaatatgagaagaggaaaagctattggtttcttggaggatgagcaaggaactgtatggttgggtgaaagaatttgtgtccctgacaacaaagatttgaaagatgcaattctgaaagaagctcatgatactttatactccattcaccctggtagtactaagatgtaccaggatctcaaggaaagattttggtgggcaagtatgaagcgtgaaatcgcagaatatgtagcagtatgtgatgtttgtcagcgagtcaaggcagaacatcagaaacccgccggtttgttgcagcctttgaagattcctgaatggaaatgggaagaaataggtatggattttatcactggtttacccagaacgtcatcaggccatgattctatttgggtgatagtcgacagacttaccaaagtggctcattttattccggtaaagacaacctattccggaagtcgcttggcggaattgtatatggcaaggattgtgtgtttgcatggcgtccctaagaagatagtgtctgatcgaggcagtcagtttacttcaaatttttggaagaaacttcaggaagagatgggttctaagctgaactttagcactgcttatcatccgcagacagacggacaaaccgaaagggtgaatcagattttggaagacatgttgagagcttgtgctctagatttcggtggaagttgggataagaatctaccttatgcagaattttcatacaacaacagttatcaagctagtcttcagatggctccttacgaagcactgtatggtcggaagtgtcgcactccacttttgtgggatcaaacgggagaacgtcaggttttcgggatggatatcctaagggaagcagaagaaaaggtaaagatcattcaagaaagattgcgtgtggctcagtctcgtcataagagttatgccgacaatcgccgtagggatttgagttttgaagaaggagattatgtgtatcttcgtgtcacgccttttcgaggagttcatcgttttcataccaagggaaaattggcaccgcgttttgtgggaccttataagattgtcagtagaagaggagaggtcgcttatcagttggagttacctcaatctttggcaggagtccataatgtgttccatgtttcgcaattgaaaaagtgtttaagggtacctaccgaagaagctaatcttgaccagatagaagtccaagaggatctgacctatgttgaaaaaccaatccgtatcctggaaacaagtgagagaagaaccaggaatcgagttatccgtttttgcaaagtccagtggagtaatcactcggaagaagaatcaacttgggaacgagaagatgaattgaagtcagctcatccgcacctgttcgccagttcttccgaatctcgaggacgagattctgtttaaggggggtaggtttgtcacaccctgaaaattcaaaatatataaattgttgtttaaatggaatttttagaaataattttaaaagtcttgaaaagaaaatctaagtttaattaataaattccaatataaaatggggccagataaaatttcattaaatactttgcttaattctataattcctagatttttctgggatttatttgagctaagaaagtatttgtaataaatggaattgcatttaagaaataattttaattgaaaaaggttttaaaaagtcttcttttggctttgggccgaaagtcggcccaaaacctctcttctctctcctcggcccagccggcccagtcagccgcgcgcgcgcgccctcgctgtcgctgacaggtgggtcccgcctgtcggagccgtcgtcttcctcgggccgaaaccctagcgcggcgccgccgagccgccgccgctgtttccttccaatccggccgttcctttccttctccggccgatttgttagaggggaaacaatctccgggatctcctctaccttttctcctttggaatctttggctcaatcggtttggaatgagtttgattcgagttcgaatcggatcggctttcctctctccaagccgcgagtttccttcgccgttgccgtcgccgtgggccttcgccgccgcctccgacccctttaaaaggacccccggagtcttctcttctcgccg

SEQ ID NO: 70610 - DNA, 3644 bp, Oryza sativa
actctattatcaatttgttattgtgtgcctcggctgattcctggacgagggtttacacacatgtaagcgtttggaattttggatagaaattccgggcgtgacaagttggtatcagagctcccttgaccctaggttatgccaaatggttacccatagaagccctctaaaaatattggaaaagtagaactgttctcctccctttctcttttaattaaaccaaactaatggcacatgcacttcataatctcttttaatggttctcattcaaaatttattccagtgttattagtactgtacatctattactgtactaatggctcattttccagcaaaaattttacaatgttgtttcatttaatcttgctgcaataaaataaatttaacaagttgattttataactttcttttatttcttttggaacctgttattcaaaagtataaaacttgtaacctggtttccaactgtttcaacttatcttgcaaacttggtttactttgtttacttaccttttactttgaatttctaaaactttattcaaattaatccaaaaacttgtgatattaattggatagatgtcttaactccctcctttcacttgtgtttagatgccgcgctacaagcctgagtacttgtttggtgttgagggttttgtccaggagttgcgtacaatgtcctttgtcattggatttgggactgcccctttttatgctcagattcctcatgatcgtcatgaagagaggtgccgagtcaaagtcaccttgaacagtaatagtgaagacattctatcagtgatgttcgaagctggaggaagaaactacatccatgcatgtcaggaagtggcaaggatcgccataggagagctccgcgatcgctacagtgatcaattggccgacactgagtatcgttaccatcctcgtcaaccacagggaagtgaccgtggcagttaccttgagactgaaggaattgagaatgatgctaccacaagacatttggttgagatgctatgggctatggatgaaagtcatgcagagactgtgttagcagcccaagatcgtgaagattggaatcgtggtaagatttgcaagctagaagacaaggtggatcgtttggagaaggaactagctgcgttgaagggagaagcaccgccgcagaaggccaggattcgtcttaccgcaaggaagagagctctatttgtccctcgttatcaattggcgccaaaggtccgtgtggtggagaaagaagttgccccagcagatcctccggtcgtcaacgtaagtgatgatgaagaagaagaatccaagcgcaaccattccaagattgagtgggtagcaactcaagatgatgaagacgagccgaacgagccttcaatcgacctccgatgctcggaagaactagagtgacttgttaagtcgttgtcttagatcgttgtgttagtttgcttgttttaagtttgcttgtgtgtgggtcttgcatgtgatttacatcagtggtaggatgtaagtgcatgcgtttgtttgttttttttgagtgttaggaagttggtgagtttagtggtgtgagagtcttcagtttgtaataatgaaactcagttaagatcaataaaagttaaagtaattctctgtcctaagtagttttccccggtttctcttcttgtgccctgtccatgccagatggtgaacactcgcagcaacgggaatggtcccaacctcaacaaccccaacaacaacaataacaatgaggggaacccaacccttgctcaagttcttgctcaacagactcagctaatgcacatgatgatgcaacaacttcagaatcagcagaaccaaggaaataaccatgcacctcctcagaataagttagcagaatttcttcgtgtgaggccgcctattttctctagtaccactaaccctgttgaagctggtgattggctgcatgccatagagaagaagttggatttgcttcagtgcactgatcaggagaaggtctcatttgcatcacaccagttgcatggccctgcctctgaatggtgggatcacttccgtctgaataggactactgctgaacctatcacttggcttgaattgaccgctgcttttcggaagacgcatataccatcgggagtggtgtctctcaagaagaaggagttcaggtcgcttacccagggatctcgcactgttacggagtatctacacgagttcaatcgtctagcccgttatgctccggaaaatgtacgcaatgatgaagagcgtcaggagaagttcttggaaggacttaatgatgagctttcttacccactcatgactggagattattctgatttccagaaattagtggataaggctattcgtcaggaggacaagtataatcgcatggagcagaagaaacgccagattgctcaattcaagacgcaacaggggaataatcagaggccgcgtcttactttaggaccccagtctatgccacatggaggttcttcgtctgtcgttcgtccgcagcgtcagttcttcaacaacaatgttggcaacaacatccgcaatcaagttccacgtcttattgcagctccaacacaacaacagcctgccaagagggagcaaggtagcaagcccgtggtgtgtttcaactgtggagacccgggacattatgctgacaagtgtccgaagccccgacgcgtgaaggttgtccctgtccagagcaactctaccgcaccagcatcaaaggcccgtgtcaatcatgttgcagctgcagaagctcaagatgctccagatgtgattttgggtacgttccttgttaactcagttcctgcaacagtgcttttcgattctggtgctacacattcatttctatctatgagttttgcgggaaatcatgggatggaagtagaagatcttagacgtcctttgatggttagtaccccaagtaatcaagcactctctttgcaacgtagcccctctgtcagaatagaaattaagggagtaccatttctggccaatcttatcttgttagaatccaaagaccttgatgtcatcctagggatggactggttaaccagacataaaggtgttatagactgtgctaacagaaaagtaactctcaccagtagtgatggtcgagttgtaactgttcatgcattatcttctgagtctttaaggtcaagactgactcagataactttggaagagattcctatagtccgggagtatcccgatgtgttcccagatgatttacctggtatgccgcccaaaagggatatagagttcagaatagatttggtacctggaacaactccgattcataagaggccttatagaatggcagccaatgagttggcagaagtcaagaggcaagtggatgatttgcttcagaagggatacatcagaccgagttcatctccatggggagctccggttatttttgtggaaaagaaagatcatacccagaggatgtgtgtggactatcgtgcattaaatgatgtgactatcaagaataagtatccactacccagaattgatgatttgtttgatcagcttaaaggtgccactgttttctctaagatcgatcttcgatcagggtatcaccagttgagaatcaaagaggaagatatacctaagacagcttttaccactaggtatggattgttcgaatg

SEQ ID NO: 70611 - DNA, 1155 bp, Oryza sativa
gcaggtcgactctagaggatccccagatgcattgatcttttttccttagaaaataggcatgagagacgttgggagttcttttaattttttcattgctgcagtttctgtcctggctggctgttactactatggtgaattgaggcatagagcgacactgcagacctaaccactatggtgaattgaggcatagagcgacactgctgacctaaccaaattttgctacttactctaacttttaaaatctatctttctaaagatggtcgtctcgagccatcccattaggccacatggcagtgttaaactttgagataaatctaaaaaaactatacataaaaaagtagcaaaaaataaaagacacaacctagagacttcccaattatctatcctttttagataaatatagaatatttataaaaaaatttatctatcctctttgagataaatctagaatactcatacaagaagaaataccgagaagcaaacaaaatatctttcccctttgcatctatctatctcctgttgattggtttcatgccagctgattgacttgagcgacacgtggcgagatacaagcggcggaaagatcgtcgggtaagaaaccatctataaaacagacaatcttaggatggtgaagaagagccgctccatgtgcatctcgcaagttaggatggtgaattgaaaagaaaaaaacaagaagaagagcggaaagatcgtcgggtaagaaaccatctataaaacagacaatgttaggatggtgaagaagagccgctccatgtgcatctcgcaagttaggatggtgaattgaaaagaaaaaaataagaagaagagcctctccatgtagttgggccacatggcaccacaacccaacagtgtgtgatcggaccagtgcaaacatgtaaaagagggaaaaaagaaaaataaagagacaaaaaattactttttaaaattcttcacaaattatccagggcaagtattgtgaccacatatcttatgtttcgagaaactaaaaataatagatagaaaactaaatgacagaaatatctgctccttctttctaatattgaatcaaactctataatcctaataactattttttaaatattgtttttttttgcttacattataaaataaataatatctagatctttcaaattt

SEQ ID NO: 70612 - DNA, 11044 bp, Oryza sativa
  unsure (1)..(11044): unsure at all n locations
gcggaagaggaacggacagcactggcgacgaggttgaagcggcggcggtcttcgggtcgacggtgacggcgatgctccggcggtcaacagcgacggcggaggggtggacaaggacggcgacgacttggcgatcccaacggtggccttcccgagcgatgacgacgaccggaacggcggcggcgcacggctggagcgacggcggcgactgcggctcgaggtctcacggcgctagggcgcttccgacgacgagaggcgaaggcgagggtggcgacgggtagaggagagctcggggatccttttaaaggggttcaagggcgacggcgaaggcccacggcgaccagcgacgacgaaggaaacttcgggaaaaacgaatccgaagcaaactcgaatccatcgatttccaaaccgatttagccgatgtttccaaaggggaaaaggtagaggagatctcgaagatcatttcccctctattgatttcaccggaaaaggaaaggagcggccggatttggaaggaaacggcggcggcgcggcgctagggtttcgggcagcggccgacgcgaggaagacgacgacctgacaggcggaccccacctgacagcgagcgagggcgcgcgcgcgcggctgcggactgggccgacttgggccgaggagagagagaagggttttgggccgactttcggcccaaagccaaaagagactttttaaaacctttttcaatttaaattattccttaaatgcaattgcatttattaaaaatacttacttagctcaaataaatcccagaaaaatctaggaattataaaattaagcaaagtatttaatgaaattttatctggccccattttatattggaatttattaattaaaattagatcttctcttcaaggcttttaaaatcatttctaaaaattccaattaaacaacaatttatagattttgaatttttagggtgtgacaatatacacctcgaccagacgattgccaagaatgctaagaatgcatcccacaaagagagtagtggcttcctcgaattgcttctgctgatcagcaataagaattccttcaggtttgccagtactcacccagaagcatttcatagtcgtcagccacagagtgaccctgatttgctgtcacgactggaaataacccaacgggcattccttacgtgcgtgcattaatccttgtcccaggaggcaaggtacaccaaaagttgatacaaatcagactctaagaatcccaagcgtaaatagttaacttattacatgggcagcgaaggcccagcacacacaaagacaaacgagaaacagcggaagactagggcgacgaccacaggcgcttgacggcaggcacgagctagacaccaaagccttcatcttcaaggagctcctcttctgggcttgggaaaaattgagcaagactgagtacaaccaccgtactcaacaagacacacccataaatgcagaataaatgcaagggagtacaagggaattataatataaaggggatagggttgcagtaaacagcatttaaagacatttagttgctcaaagccaatttgtaaacccgatcctagaactatacaatattattaatcaaggccgtgaacccacacgaacctgccttaacccaaggcctatgatgattcagaccgaactggcaacccgaccctgggtcccagctcgtcctaagccaacccaggccaaccattccacattttagttgttaagcaggttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccatggtatacagacggaagacgtgacatagtttccaacccatcctagccatagacaagagtaccgacccaatcctgcctgcggccggaacccccgggacaggcaggcaagactgagcccctagcagcagggcaccaaccctgtgccaatgacatctcgactaccgggccgcagctcgtgtaaccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatgtggccgaggtgctactatcaaaaccatgcaccccgagcccagcctaaaaccattttaggggattttgaatagagggggcggtgtgaagccaattccacaatgatccaacaattccagtgtgtccaggtgatgagaatatcccaaagtctagagttgtaaaaccacctaatgttacctaattaaattgcgaagcatctacctaaaattaaactagtggtgccatgagtagagtgtccactagttgaggttttgtttgatctagggtgaacaaggtaataatattaacaataacaataataatatggtcataacaaaggtaaataggcatggctaaataaaacagtggtaacgcgggaatttaaataaagcgataatgcaataatttaaatcaacataattttataaactgggattcaatatgctcaaagatgatgtgacttgccttgctcgcttttccaaccgacggcttcgactttcacgaagagcggatcttccgaagctgcagcgtctacacaaccaacggaaaagaaaaaggcttttactctaataaacttcacataacagcagaaacaaagcacaaaaatgggttcttgacttcttaaggaaaaattagagacttgaacggtccaatttcgagttcaattggccaagatatggccatttgaagtttatatgctcttaaatggatatttacgaatttcttcatttaaatttaattaaaaaccgggtttattgcgtcagccgagggagagggcgcgcggaccgagtccaccggagtggggcccacgcgtcagcctctcggtccacggtggaccgggcgcacgcggccgacgggagggggacgcgcccggccccgatggtcaccgccggcgaccaccggcgcggcggagcggcacccgagagagaggagggaagggggaagcgaatggagcggtctttcgcttaccccggtcgacggagactacgggaacggcggccgaagcggaggaaggcggcggtgcggttcgggacgacaaggacgacggcgctccgacggtcggcgagcgaaacggaggagcggactgtgtcgacgactactcggcgaaacccaaggaggcgaccccgagaggggaggaagtnctgagcgaccgcggncggcgacccggaactcgtctgcgactgctgatagagagaanagctgtgcgagcgctatttccaccgtgagggcgagcggcgaacggcggaaacggaggagagaggcacggggaacaattaaatagcgtctggtgagagggaaagcggcctgaggagggggaaaccggcgcggagatctcggccgccattgattgcgccggcgaactttgcgggcacaaaatcggacgaatcctagggagagagagaggggaaagtgggggaatcgggagagggaatcgcggggagtaattccccccactttaatgcgcgcggggacggcgggatgcggcggattcggcggcggcggcggcgctagggcacgggcgggcggcgggcccggcgcgaggaagccaatgacaggtgggccccacccgtcagcgagggtggcgggcgggcccgcctgtcagcggcgcgcgcgcgggggaggagccgatgggccggaggagaggagagagagggagggaagagaagtgggccgagccggccccagaaaggaagggggggaaagaggacttcttttagggtttttctttttataaaccttttcaactttgtttatttcttctcaattattatttgtgctctgaaaattccactaaaatttatttacgcattttaggcttttaggaaatatacaaaaatcctccaagccttatttgacttttatctttgcacattttaattgttggaggctttcacatgaattttaattattctcggcacaatttcgaggatgtattttagagtcgatttgggacgcgacatttgccatctcttaaaatgcacacctgtgaatttatccggtcttctacctcctgaagttggtggtctgttgagctttacatttccccttgctcttgttctgggccttgtgcacaacattggcactggactgcccagtatcgtccttagacgcggcatctttttcccgagctttctcctcaacatcaagagacgctatcaacccctcaacggagtattcctgtctcttgtgtttgagtgcaataccgaaacttctccatgatggaggtagtttcgcaataatgcacccggccacaaatttgtcgggtaagacacacttaaggagttcgagttccttagccatggtttgtatctcatgagcctgttcgactacaaaacggttgtcagccatcttgtagtcatgaaactgctccatgatatacagatcattgctagcatcagtagcaccgaatttagtattcagtgcatcctacaactccttagcgtcggtcatatgcatatacacctcgaccagacgatcgccaagaacgctaagaatgcatcccacaaagagagtagtggcttcctcgaattgcttctgctgatcagcagtaagaattccttcaggtttgccagtactcacccaaaagcatttcatagccgtcagccacatagtgaccctgatctgccatctcttagagtgcacacctgtgaatttatccggcctcattgcatcggcaaaaccaatcatagtaaaatcacagagcctataataaggtttttggattgttataattataagcacataatgatttaatttattccataaataaaccatgacattgcagatgtaaactagattgaacacatcattagatctacacatgtaaactaagcagtaaaacatgaacagatcaaatatgcgcaacatatcgaacacgtaccgaggtggcggaaagaccggttgctcggcaggaactactggcggttgcgagcgtcgacgaagtcgcgaagcacgcgagcggagaggaaggcgagccgtcgcagacgaacagggagcagtcgcgcgaagcgcttcccaaaaaccttattgccaccttctcccgatgcaggacgtcaaaggcagaggttccggagacctgctctcccgatcgccagtgcacgccggcgagcgggatggagtagtctacgagtgacgacgcagtacagagtagaaggcaaaccctagattgatttcgcgtgtgttgcgtgaaggcggcggcttggtttatatagagatagatcgcctgatcagggtgcccgcgtaaaccgaaccggataagtcgcgcgtaacctatccggactccatgccgttttcacacaccggatttttcggaatgtttccaaaacaaaacaaatccgaatcccgcagcaaaacaaaactgcaaaaggaggctgcatctgcgcaagggtgaggagccaattttgccgagcattcgacacgtacgtcgtgcgcgcgccgccggcccggccaggcgagcgagcgcgcgcgtgtgtttccccctcttctctccaccacacatgcttcaagtgactaggagggcatcctcccttttaaggaggtccccctcttctagaataagcaaggtggtactaaactccacatgcatgccatcccatgaggtgggtttttgcgattttccaaagaattaatcttcgaatgggccttagcccatctattaattccaacatggatctcacgacttgtgtatacaaggttcctctggtctcaacgaaggatgccctacttggtgccaaaaatctattcaccataaaggtgcagtttagtgccaagaaatgtccaactacatgatgtaccagctatttgtgaatcctgggatgctattggcgggcagcaggcgaaacttgttcactgatgcctacaaacaattgaagggtatcgtcaaggagaagaacctgtcactgaatgaaagagaacttgcccagagaattatcgtcaaggttcagcagccacacgaggagaatgaaggagagctcatcgatgatgcttggtccattgcagaagagctcctgaatttagaagatgaggagaagatgtggagggtgattgaaggagtgtgggtagagatgctctgcttctctgcagccagatgcaggggctacctgcacgctaagagtctcggcacaggcggggagttcctaagctatgtctggctccttctgcattacatgggaatggagaccttggcagagaagctggcgagagcagagctcccaaacggagcacgctcaggtaattcatccactaaacatgctggagactcctatggcaaagagcaagctcctggtgcatcgacttctcatgctagaggagcctatggtgatgaagatggcgctggtccatcctcctatcatgaaatcgaagttatggggcatgaaaacgtgtgacatgatgcatacaagatgtccttttttctctttaggcgagatgcatacgtgatgtcagtcccagtttgacgcttttatttgtgcgttctgcttaaatggttcaaattcttctctcaatgtaatgtcttgtgtgagtcatgtatcctagcaacttaataaaccatggaactaataaccatgaactggatccagactcggattgaagaaaaaaaatagaagttcacataatgtggttctaatgtatagtactccctcctgttttttttatatgacactggttagtttaaattttaactagccagcgtcatgcaaacaaaaatggaggtagtaatatggaagaaaaaattttaaaacacgtttatgttcagaggtcctcgcatgatgccccattatcggctagcttcctgacagctagcgggacgagattgaggcgtcagcagcagcccaagtggtggtgcactagaagtctagcacagtgtagcgaggagcagcagcagctgctgctcttgcgaggatggcaaagtcgtcgttcaacgtgtgggccacagtgctgtggactccgcttgcttgatggcatcatcctagtcgcgttgttgcctaagagcaagtatattaggagaatgtaagtcggctaaatgctgagatggaggatagaagagaggagggagaggagaagcgagctgtaaacttacagctggcttggacgcaagaaccaagaaactctgtgagaaagacaagtgtgctctgtattaattgtaaatagctaactattatatgtgtgggctaagagaaggttgtaaaaaacattataaccaacaagtcggctgtattattagccttactctaagcaaggcgctcgacgtgggagcaagggaaagtggatccctcggagctcttacctcgaggggacagtgacactgtaaaatcaaagtgtttgattattattttgtgatggacaattggtatttcagattatttgttttgatatttggagataattagtgaaatggttttgaagatgattggattttcaggttatggacaggattgagttgtctaatgattgcagtcaaaccggctgggttaggccagtcagaccgaggctatgcgagcagtcagaccagttagcatgcggtctgatcggccgacgttgtgtcaatttcagtttagggttgattatttggatatccgtgaaaaattcatgtttatggcttagtcaacccaccgtgacacgggaccactcaaacggtcaaccgaaccggcagtttagaacgactctattagtaaataacgacttgggatgaccgaatgaacgaggctttggactatacttcgtgcgaacgaacgattagcggctagcgaatggctccggcacaacccagtacacttaactcagtttgcggaaatggcccggtacgacaacgataggctagtagtgattcgagcttacggctgcggctaggcaactcggctaccaagcgacaagcagcggctaagcagcgacgtcggcgcgaaatggtagacttaactcgtttgcggcaacggcccgatacggcaacgttaggctggtagcgactcgagcttacgactgcggctaggcaactctgctaccgagcgacaagcagtggctaggcagcgacggcggcgctcggctgcagcggcggcgcatggcacacagcggcaggagcagcggtagcggcggctggcggctagggcacagggtgacgcggcagcggcgcggcagggcgatgcggagcggcacgacggcgcggtaggacgacgcagcggcggcagcaacagcgacagcggcgcggcactcggtggtggcggtagcggcggctagggtttaccggcatcttcaacttgatttttttatcatacttgcagcatgtggttcatgagtcgattatatctcttgactgcactacaactatatgttagtagtactacttaatttagtactacctccatcccaaaatggtagtcgctttgactttgctttaactttttcttgtaatgtttaaccatttgtcttatttaacagattagtgcaaatataaaaacagaaaagtcatatttaaagcacttttgataataaagcaaatcataaacaaaagaaatgataattccataattttttgaataagacgaaagatcaaaagttacaaacaaaaactcaaagcgacaactatactgggacggaggtagtatacagttttcgaccccaagtaggttttaaagtgtttttttcacatacagttcagttttacgcctaataaacagaaaagatgtgaattgcagtcaaattttgcttgattctgaatctgaatgcaaccatggttgctaattccatttcatggtgttgggtttagtcccggaacgatttccatgggtcacatggtggggaggccaggtaacaagtcttcggggtcacatgggttgatgtgacaggggagattgttagacccgaggctcaggtaacaagtcttcggggtcacattggttgatgtgacgggggagattgttgtgtttaatcccacatcggtaattgatgatgagggagcacgacttaaaaggtggggcggtcctcatccattagactagtctttttggttgtgtaggctcaggacctaaagttgtagctccggttgggcctgtggtggagcaggctcaatataacctggggtggcccatagttggtgggctgggctgcgcactctaacacatggcattcaaaaaacaggttcaatatttacagagttgtaggacattaggcatccaaaaaataggttcaatatttacagagttgcaggacattagagaggatacatgactcactgaatcacacaaaacatagcattgaaagaagaattgaaacatgatgtgcaataaaagtgacaaaatgggactcactgctctcataaccaccatatgtgatacatcacacatgttcttccccaatgacgcttatctctccgatggcagatggatccgctactctttcatcacaatgagatctgctatcatgagaagtcaatggaccagcaactcgctcaattatgccggagggctcaccaacatgggtagtggatgaattagctaagaattctctgttttggaggtctgctcttgacagcttctctgccaaggtttccatccccatataatgcaggagcaaccagatatagctcaggaactccctcccgtgccgaggctcttagcatgcaggtaccctctacatctggcagctgaaaagcagagcatctccacccacacgccttcaatcaccctccacattttctcctcgtcatctaacttcaggagctcttcagcaatggaccaagcgtcatcgatgagccctgttccatcggatggtggtgtgtcttcattggttatctcctcgaggggctgctgccgcgaggcgattattctctgaataaatgcctccagtttgttgtagacaattctaacaaaatttggcgtagttcgtgccacaagtgccttctcaatcaaggcggttattcgatgcctaagtgcccttagtggctcatgcaccaaagtgtttcttatcttcctatgtaccaaccgttcctgctgcatccaagtgattattctctgcatacatgcctttaactggttgtaggcaattgtgaagaagtttcgcctagcgtctgctgactctactgggttctgcacgaaatcaaatattctcaagacaagttctttttcattcaatcaaggattctcatccttgatgatgtcctttagttggttgtaggcatttgtgaataagtttcgcctggtgcctggcatcagcatctcaggattcacaaacagcaggtacatcatgtagttggatagttctcggcactgaacagcactcttgtggtgaatcgatctttcacggccatatgatccactagtgtaatagcagaaatcagtggcaagatgccagagaaggacactctcatcaaatgccccctctaagctccatcctagttcctgaaagtacccctcggagcgaagagtccatttccccttgttatcattgaacaacctgtaaatgtgaaagtgttctcacctcccggaggaggccgcgtaattatatttatactgtcaagaacagcccttgacgtggcacttacaaaggatatgatcaagttgttacaacggatgttatccatctcaactaccctattatctagccagcaactcaactaactagaagataagatgtacactgttttacactccccctcaatcataacttggacaagttaagattatacatgaaatgtcttaaactctgtatagacagagcctttgtaaatccatcggctatttgatcttttgatccaataaacctaatatcaaacatcttatttgctactctttctcttacaaaatgataatcaatctcaatgtgctttgttcgtgcatgaaagaccggatt

SEQ ID NO: 70613 - DNA, 13575 bp, Oryza sativa
tccccctacgacaccaacgtcgtcgccatcggcgccttcgccgccgtgcggaggggcatcctcgtgacgtgctccgccggcaacgacggctccgacagctacaccgtcctcaacggcgcgccgtggatcaccaccgtcggcgcgtcgaccatcgacagggcgttcacccccaccgtgacgctcggcgccggcgccggcggcgcgaggagcatcgtcggcaggtcggtgtacccggggcgcgtgccggccggcgccgccgcgctctactacggccgcggcaaccggaccaaggagcggtgcgagtccggcagcctcagccgcaaggacgtccgcggcaagtacgtcttctgcaacgccggcgagggcggcatccacgagcagatgtacgaggtgcagagcaacggcggccgcggcgtgatcgcggcgagcaacatgaaggagatcatggacccgtcggactacgtcacgccggtggtgctggtcacgccctccgacggcgccgccatccagaggtacgcgacggcggcggcggcgcccagggcgagcgtgcggttcgccgggacggagctcggcgtcaagccggcgcccgccgtcgcctacttctcgtcgcgcgggccgagcccggtgagcccggcgatcctcaagccggacgtggtggcgcccggcgtggacatcctcgcggcgtgggtgcccaacaaggaggtgatggagctcgacggcggggagacgaagctgtacaccaactacatgctcgtctccggcacgtccatggcgtcgccgcacgtcgccggcgtggcggcgctgctccggtcggcgcacccggactggagcccggccgccgtccggtcggccatgatgacgacggcctacgtgaaggacaacgccgacgacgccgacctcgtcagcatgcccggaggctcgccggggacgccgctggactacggcagcggccatgtcagccccaaccaggccaccgaccccggcctcgtctacgacatcaccgccgacgactacgtcgccttcctctgcggcgagctccgctacaccagccgccaggtcgccgccatcgccggacaccgcgccggctgccccgccggcgccggagcagcaagccaccgcgacctcaactatccgtcgttcatggtcatcctcaacaaaaccaactcggccacacggacgttcaccaggacgctgaccaacgtcgccggctcgccggcgaagtacgccgtgtcggtgacggcgccggcggggatggcggtgaaggtgacgccggcgacgctgtccttcgccggcaagggcagcacgcaggggttcagtgtgacggtgcaggtcagccaggtgaagagatcaagagatggtgacaattacattggcaactatgggttcttgagctggaatgaggtcggaggccagcatgttgtcaggagccctatagtgtcagcatttgcccaatgagaagaacagatgttagcatagcaggatcaaaaataagagcatggaaatagaaaatgacactaaaacaaagtatactacatacaactaataatcatgatcaggaatataaagagtacatataatggaaagagagaaataattctcaccaggatactgatattgcacgtgtatttttgtactctctgcttctgaattctagttttgttactgttcttctcaacgtatcaaattatttacacaagggttacaaacagagcatcaataaggagcagcttgtaagatttatatacagcaacaaccttaaaagggaattacacctgatgcactacgtttcatgcagcaaaagattaaacagaagaggaaaatcctaataagtttttctaagctagaatgagcactactaaatagtctacatgcttcagcaagatgttatatgtattatatctcttatcaacattggggtctacaaattctgtaagcgggcaatcagcaggtgataattaaggatatccaagcaattcttccagagttacagcatattcttgagctatttccttgatcaactcctatgcactactgtagtcgaaggaaaatgagatgacatgaaaagcgattcaataggatatcattaacactaatccattcaatgttgaaggaatccaaatctattgtgtccttcactccacttagaccacttgctatgcacgagtgctcagtgctcactgttcagcatgaaaacattgaaaattcatggccatcttgttgctattgtgctaccaaaatcattgcaggtcagcattactggccaccattcctatacatagcataaaatcctattcattttgtattggtatgttaggtatacgatctttctgagctgaaaattgaaaaatacctgtagatgatcatcctcatatcaaagccatctgccaccaacttggaccttcgagctcatcatgtatgatcagttgctcaacttggcagccatgttgcttctgggagtcctaccaccttctgtccagagtcccacttagtattcagtcattgcatgaaccagcattctccaggctcagtagcagtctagcagcgcaggacggtaggagcactgatgagcagatcccaaataccagctctgaccaaattgcgagcttcagtaacaaggtatatcttttgttctcttctacttgtgaggaaggggaacagctcagaatatgagatgataccaagatttcgactcatcagtctgcagctaaaaatccatcaagtcattctacctgaaaagccttcacgccaacatcacagtatatctagtgatgacaatggcaattcacccagggactagaacggccatcaatcacatatgccagctatattaactatagttggttctctctgctatcaaagggttctacaaccagtattacctccaacaagtaaagtaattcactaagatatactctctgcagggtctacagccacaaacgtctaacccaccatgctgacttagccagaaaagagaaaaacaagcaccatgggttccaagcattgcctgacttacatcatttacaagtggaatgggatccatgctttacctgagtatcagcgcttgctgcctgagtgctagtacatgcttgcgggttgccactatcatcctgatatactcatatgcaatactaggatcccccctgcataagtaccgtggaatagtgcagatccatgtagaagcgctgggttcagaagcagctcaccagatcgcatgggttcctgagctgacccgaaggtagtatttcagaagcacaaatcctggtgcaaaaaaggctaacaaatataacctgagcagaagcaacaagtacacaagattgggcagaatagctctcttagaattctccatttaattttcatctttcaaaaacttcatctcttattctcaacaaatgcatcctcctgttttcaatctcttagaaaaccgacatggagtttcatatatagaacctatctgattgattaccatgggtttattttgccagttgattccagagataccgcagaggcacagattaacgagaaaaaaaatgtggaattaataaccacaaagtttaatagtgcataccttgtaaagctacttgaaagagaagtgacataccatatgagaagaaaaaccttcagctgattagctgcatctgcatgcataaatataactgtaagaattgtggaatctaaaataataccagatatctacagcttcaataaatagcactaaaaattaaattgataaaggtcataaaaaagcaaccaaacaacaccacataaagaagagtggaaaattaaggaaaatattagtctcctttcattcaaagatatttctaagggcttaaaaatatgctgccctgttacacatcgatgacaacaattatgcattacaatctttcaagggtaaaaggaaactcagtattctgttttctcagaagtacatcaatatttacatgttacactgcaatcgcctagcaaaatgatcacggatgctcctaggcaagaatcccatattctaaactctcagaagtccaactttaccttcaatactttctgcaatactcagtagtgattaatcaagacatcaagtatactggtacagtggaatataaatctgaaccagaacacactatgaagtatctagccgaattgatcattgctctgagtctgagatagatttctcaatggctctcacataaacagccttcggaagagtcccagtaatgctatgcgttttctctccatccttaaagagtaaaacagttggaatcctctcgatgctgtaagatgttgcgacttgtgggtaatcatcagtgtcaagcttatagcattttatccttccagcatattcttgtgcaatctcatcaacaattcggtggaccattctgcagggtccacaccatgaggcccaaaactcaataagcacaggtatatcactgcagatcacatattcattccaagaacatgccgtaattgttttggctgtacaaacaaacaaaacagagttgtaagataactcctctatatttgaacgtaaaactaaacaacaaatgatgttatatgtcacaacagttgctacactcaagtaactacaaaagatgctaaatataaccctgacactatccgcttgctgagagtaacagttgctatccagcagccctatgctcatgtaacaaagttaggaaaattgaacatcttaaaatgtgttgtagctactagtatttacggaggtgaatatgagccgagttaattggtttgcctcaatggtgcagtttgcaggaacagaagcagcggccaatatcctggaaatgaacaactgaacggtagagctgccgaaaactaagagcagccaaagaaagaataattgaagaattgaagtttagtgatatttcactacagctccaggattttttttcgaacgaaccggcactacagctccaggatcaatcatactttactagtaacgtgtttatttcaagctttcgacatgtatcaaggtttcaacttttctgtggtactgaactggctgacccatttcttgtacggttacactacccgaaaaaatggtatacccctacattgcattctctagcaagtaaaattaagctgcttccttacggcttctcccttgaagagtgcatccatcataccactgttcaactacattagactactacatggaactggaagcaatgaacatgagaattgtcactaatttgtcaaccacacaacacaccaaagggggcaagggcagttactacacgacaccctaaaggcagcagaaatttttggcacaagcaaacggttagcttcagggggagggggggggggtggatcatcatcaaccagcgaggaggcacactccctttacctccgcgaggagaatacgcgcagctcaccgtgcggatccggtgcgccgcccagcggcgccggcagcccggccaccggcgtgcggcggaggaggaggcgccgtacccggccctccgtcggccgggcgccgcgagcgccacgccgcggtagaggctccgcggcggcggcggcgcggggcaagcggtggcggtggcggccatggttgttggtgttggttttgggtggagactcgtgcgtgcgtgcgtggcggaggatgcgcggtaggtaggaaaatttacgaggcaaatccgcacgcgacgcgagcgagcgagcctagcgcttatgatgatgaggacgacgctgacttggaggtgattttggagtgtgatgcaattcactcaaaccttattatttcctccgtttttattatatttatcaatagttttaactttttttacaaaaaaaatatattaaagttaatcgattttataaaaatatatgatagtgatttgaccacaaagcaaatatgttatccaaatttacattgtttaatgaaactaatttggtctatcttaacaaagtttgactaagataaaagttaaaaagcgatatattgcatccctgtgtacaacaatgttcaactaggccttcacataacaattccattggaccatgtgtacctcatcattctcatccttcaaagaccaaaccggatgggcaaaaactcatctcgccctgcaatcccctgcatgactgaagatctgaaagttggtagggcaagaatgtctgaatctcctacattcttcagggaacaaggttctcgcagcaagcaacgcctccatatccaagaatctcacttacgtttgcacggtagaaatgatgaaaaaccaggagcttttcgcaaaaccttgatttgttcgtctcgagctgcccatgctgctgcgtcccggtgtatcgtaccatcagattcagagagagcacacttggtttcttgtctccctgatcaagactcatgaaatggaatggacacatgacgaacaccagagaacaaaaccgcataggcaacagctacaaagtcagagagaaaacactggaggatgccgtcctggaagatcttcatgttctgcacctgcagaaaatggttgtgctcatataaaacttttgcgacaaaatctgtaaaatggaaaaatgcatgtggtcatcggttcacatacacatctatatttgagtgcagaaagattatttttaaaacccattttttataaaactgagctcttcgtacaaaagtcaaccttcactaaaaaaaccaagtggagtaatttttttatgggataaaaaggcttagcgcccagcttttctgggaagctcaacgggattttttaaaaatatccggcatttgacacttgaaacaagacaataagatgacaccagctttgccacctcatcatcaaactacctatcagcacccaaaaaaaaagaaaactccatcatcaatatgtgactatgtgagcagtgttagatgctacaccaccagatgacaaaaaaaatccattcaaatgttttgtttggtagttcagactctctgaaaaagaaaaaaaactactccacaaaactgatgtttttcctattggattaacaactaactggagatcacccaacgttagaaataaagggctcgtatcctttaccataatgacatttttatcataggcattgacatataaagcaatatgaggatggaacctacatgccactgactgtaatgttagtgcaatatgcgatgtttagttcccaaacaaaaacttttcaccctgtcacatcgaatgtttggacacatacatagaatattaaatatagacaaaaaaaactaattacacagattgcgtgtaaattgcaagacgaatcttttaagtctaattacgccatgatttgacaatgtgatgcttcagtaaacatttagggcaaccacaatgtggggtcttaagcctctaaagtggtccttatacattgtgaaagtagtccatatagtagtctttagtatgaactacccatatgcataatgcctacccataagaataaaataggaattgtcagggttatggataccacatacctaatagtagttgactaaatctcggcagggcccaccacatatcatgtcctatacggaaacaacctgcggatgtaggaggagttccggataaggaaagacaaccggagttctacgtggaaacgataaggactactcggattgtatccatattggtttccctaattctacttggacaaagggactcctatgagtataaatacaaggccccctaggaggagaggggggacagacaatcaatacccaacacaatcgacatagaagccacaacatacaagccaacatactccaagacaagacgccggattttgacttcagggataggcatggctattcccctacggtgtctccggataccgtcaggagagacgaaagcgctatctctgatctcgccggacacggattcgaggagcaaggctaccctgttgtcgactacgagtcagaccttcagaccgccatgtcgacaacagttagataggctaccccacatattgtactggtgtgattatggtgaataaaaagcaacatcggcttagggctacctgaccgctcagggacccaaacctgtataaaaatcttcgtctccatctcttttacctcagtctcacatgacatacaacacatgacatacaattgagtgggacccaggctaatgccttctcttaccatatacattatagcaaacagtataactaatgccgggtcccaccttattacctaagtagacattatacattgagcatgcccttactaataacgatttacaggcgaaatttataatttattttgttattagactatgtttaatatgtgtcccgtatattcgatgttatatgcagaaactttacatccctatgactaaacagggccgcccatgattgtaaagcatcgtaattcgtaaatgaagtgaattggatcgagtgacccaggtgggccccacgcggcagcgacccaggctccagtctctactccacgtcgacggctcgttgacccccaccggctcgtgcgttggcggttttgtcggtttccccctctctctccctctccctctccccctcgccgcgctcgcctcgcgtacgtacgtacgtcacgtcacgtagccgcctgcctcgcctcgccccgcgccgcgtcgccaactcccccacatgccgccgcgccgccgcgctcccgagcaccacccacccgccacgcccgcgcccacgcgccaccagctacgaggcggaggcgtccccagtgtagcaccaccactatggcggcgcggcggaggcacgtggcggcgggggcgggggcgccggcgccggctgcgagggagtgggcggcggtgacagccggtggcggggctgcgtgggcgttgtcgccggtggaggaggtcggacgaagcaggagctgatgcggcggacggggctgccgccgtgggacctccgcgcgctcgacccggcgctgttgtcggcggcgtcggcgtggtagtgccgcccgtccgccatcacggggcgggaccgagccctcgtcgtcaacctggaccgcgcccgtgccgtcatcaccgcgtccgaggtgctcgtcccgtccccgcgcgaccccgccgtcgcgccgctcgtccgggagctccgcgcccgcctcgccctcgccgcctccccaacccccgcgccgtcgccgtcgccgccgcaggtgacacatgcatgccccccaccctaccttccttcttgcattgcatcgtacgtcttcttcttaagcaaaagctctgatctctcactccttttcttttcttttttgaaagcatggcatggcggtggggatggacgggagcatctcgccatcgcaggcgagccgcggcggcgaggaggccgccggcaacggcaaggatggagaagctctgggaggaggtgacaaggctctgccgttcgagttcagggcgctcgaggtgtgcgtcgagttcgcctgcaagtctctcgaacatgaggtgtgtgttcttctaccttgtctccatgctttttacctgcagtgctatctccatctccaattctccattcagaattggatggaaatgcaaccaatacctgatctttaagtgcagtgtagctatgcataacatgcattaaaaaaaaagagatttgaagagagatacatccctccaaacatttttcaagaagaaattataagcgtattgaaaattaaacacggaaccttggagttataaccacttactcattgctactgcactatcaattgcatctcaacatgcaatttgcttgggttgaatttaccatgaatagtgagtggctcaccaaactatgcaaaaagttatgcattgttgtatatttgtattaggtttgacattgtaattgtagacatatgttcaattcctatccacattgatttttctaggtatgtcatatgatcttttaacactcaactagacgtccactatcagtatcttgcacatgtatatgtctttccttgctttggtttatatcaccttcagaaggggaaaaaaagaagtggatttgtaccttgctacatttcgacaattctttagcggcatcccttctaatccaaccttttttattatatgaaaatgacttttgttcttctgccctgcaaacatgcttctccgattttcatggttgttgagatgatgctaagtatccatgccgtgccggtaacattcagtcatgtgtctcacccttttttacttcctgatagcactataacaatgtgaagacaaaattcatttctcgagcacattaaaacggtagtgtgtttagcaacttagcattcaggcaattctgcactgaaattgcagttcctaagaaaaatttgcttgatacatgattgcatcagacttgcacattggagaaagaggcatacccagctttagatgaactcacctccaaagtcagcaccctcaatcttgagcgtgtgaggcaaatcaagagccgactcgtcgcaatatctggcaaagttcaaaaggtcagcttcagtatatataccacaagcatatgtgaaactgaaattacttcctccgtttcacaatgtaagactttctagcattgctaatattcattaagatgttaataaatatagacatattaaattcattaacatctatatatatgtgggtaatgctagaaagtcttacattgtgaaacggagggagtaacatttatgtataccatggatcagatagtccattaggagtaattctgaagtgtttaagtaacattgccatgtgtatctcgtctgacaggtcagggatgaactggaacacttgctggatgacgacatggacatggcagcattgcacctaacggagaagctcgcttaccagtcatcaagattcgacatcgataaagaagcaagcgagctcgaagatcacaggtaagaaatttttttcttccataggttgatgacacaagtcgatatgcttcatccaaccgttgtcaacatgctacagatgtgtcgtctgaatgtctgaagctctgaatgcagcagcagggatgaagaaggagtcgagggaggcggcggcggcgacggcgacgacgagacgatcgccggcggcggcagcttcagccccaacaccgacgagctggagatcctgctggagtcctacttcgtgcagatcgatggcaccctcaacagcctctccaccgtgagtagttcctctcgccgatgaacgtcaatcatatctggacgtccacccatttattgtatgtcaactaaattattataatttttttttaaaaaaattaataagataaatcaatatataatatatcattccacgaatatataagctatcaattgtaacaaaagtgacaaataaaactcaaattagcagttaaatttgtttttttttacaacttatagaagtagaatttacttctataatttaaacttatatgtttgtgaagtgatatattatttattaaactatatgttaatttttttataaacatttagtggacatgtaataaacgggtggacgtcccctagagtgattagaatccatctcgatttttttataaccactaaatgacctgcattaaacgggtagacatccgctcgagtcattaaaacagattcccctctctcgccattgctaacgaaggtgaaattaaccatctgaatttatctctctctctctcacggatgaaactgaagctgagggagtacgtggaggacacggaggactacatcaacatgatgctggacgagaagcagaaccagctgctgcagatggggatcctgctgtcgacggggacgctggtgtccagctgcgccatcgccgtcacgggggtcttcggcatcaacgtccacatctccctctacgactcccccgcctcctccgccgccttcccgtgcgccgccgccggcatcgtcgccggcagcctcgcgctctacctcgccgccctcctctgctacaagcgcgccggcatcctccagtgacgttattactagtactacatgtaaaagaaacattgtttttagtattaactgtgaccatgagtgattaagaacgagtaattatgcgtgtgatagtgtgattacggtgttctaggcctctttgtttatatttattattactacctctatcccataatataacccataaaaaatgcatggtcaaacttaacacggtcactaatactaatttttgtcttataatttctcatatattataataaggattatagtaataaaattataaccatatgaaagtaaatttaaatatcaattcaatgatataatttttagcaagtaaaattcaattcatactatacacaaaatattttgaagataaaatctcaaaatgtgaacacctaggatggagggagtagttttttttttaagtttactacttcctccgtcccaaaatataagaactttcggttagatgagacacatcctagtatgacgaatctggacgaacgcatgtccagattcatcgtgctgtactatgatgtgtctcatccaaccaaaacttcttatattttgggataaagggaatatgatttataagccgacgaatttaaaaccatgtggaatgacatctctatatttgactatcttacgctattttttttcaaactactactccctccgtaccaaaagaaaacttaacttatggagtttgaattttgtcccacaaaaaaccaacttctaccatactacctacccttagcaatgctttattacttcgataccatttacctattttaatgatgtggggtattttgatcatcttcactctttactactgttgcattgggatgttagggttggattttacatgggatagagaaagtaacttttagaaagtaatataaaaatgatttatggctttaaataagaaaatgctgtttatctgtttagatgacttttcggttcataataaaccgatttataagtctaagtctatacaaagagtattcagggttggtttggtttatggcttaaataggcattaccaaattttgtcagtgccaaattttgacaagttttggcatgattaattttggtaaggcaaagttgtgtttggattgaagccaaaatatgctaagtttactattgaaatggcctattttcttaggcatgtcaaatttcgggttcaaaccaaatagacactaacactattgaaattgtcaaatattgataagtctaatttagacctcaaaccaaaccaacccttggtgtacaggagcttaatgatgaacactctcactgacaaccctggcccagacgtgtgtgccccaactgtcagtgtgtcaccaacaacccagcatctacggccccacgtgtacattccatttttctcctgagcgcagcgatgacgacgaccaggagctgaggagcagcaaaaaagaaaaaaaaatcgattagttcacgcaaaacccaaaaacgaaaaaaaaaaaatcttcattgagtgttaactacggaaaatatctgacgaattcgtcgcgaaatttcgtcctctttttttcgtcagaaacgaactaagcagcggggatctcgggatagcgaatccccagaaactcgttcggactcgatctcgctcccctccgatggtccgtctcccggctgccggcggcgacggcgacggcggcggcgactgcggcggcgtcctcaacctgacc

SEQ ID NO: 70614 - DNA, 5346 bp, Oryza sativa
atcaaaaaacacacaaactcgatcaattccacacatgtagcaaaataagggattcgactgctcacaggctatacagcacggagcgaactaggacgaaatggaagggatcacccgaattccgcgacggatcaccactctccgctcctctccggcggcgccgcggccgccgtgggctcgccgcgacgggaggagaacgacggcgaagtcggaataatgcgaaactgcagccgaggcgaaagccgaggggagagagatcccctctgtcgccccctatggcgccacacggacggccaggatcaaccgatcgccgagatcggacggtccacattgcaccgtccgcgacgaacgggcgtgatgaagcggaggttgcgtacacgggccgaggacccatgtagatccgtgatggcccggagtttgggccttattgggcttgaggttttgtggcccgtaaagggaggggtgtatctgcatatttgacacccgcggcgctgcgctataaagagtggctcactagggtttacctccgcgccgccgcatcctccttcgcaagcctcgcctccactccccgcgccgccgccgccgccgccgactcgccggtcgtcaccctcgccccgcagccatggctgagcaggtaaggcccggcacctcctgttcttccgtcgagcttctccgtcgcttgctataggagtcagttctaggtgggggcacgttgccatgtgatgcgcgtgttgcgatgtgagactcgatttctcagttctcgtgatttgggctggaacgctagcgatggaaagttagtgtgatagtgtcatgaatttgttgaggtcttcttgttagatgtggatttgttgaacggtgggtttgttatatccgcactcgtaattctctcgtgttaaattagcaatagaagttttgggttactggatcgaagttttgctgagatatagttactggatcgaagttttgctgagatgttccaatagattaacgcaaccgtggatgtattcgatgtttgggttcattaccgctgccgtgttcatggtaacgaatgataggtctgtgcttaatattcgtgatgctgcagttgtgtgtttgtcacgttttaacctcttttatggttgatgtggagcttatctgctactgaattagatacagatttgtattcttgtttcccatttgttcaatccaaataagtgatgcaagtggttctagctatgttgtgtagagtgttgatgtttttcatccatttctgttgtgcagactgagaaggctttcctgaagcagccaaaggttttcctcaggtagggttcttctgctctttcaatgctttatgtattctgtgagcagttcacatgtcttaacgatgtttttctgcttcattttagctcaaagaagtctggcaagggtaagaagccaggcaagggtggcaaccgcttctggaagagcattggccttggcttcaagacccccagggaagcaattgaaggtacaataggttatttgcctctttgtttagctgattctgtctaaaagttgtatgctgtacagaagaactttggtgttttcactgtagccactgaatgatttgtagtgcgttaactttaaaattgtcactgaaagaacagttgtttgtcatgcattgacagtatttgttaagttgtttttatacactactattgccggtatgtttgactagcaatttaaattcatctgaatattacagacctgagataaatgctactatttgttttaagtattgaacagttgattaactgcaattctttctagggacatacattgacaagaagtgcccattcactggaactgtttctatcagaggcagaatcattgctggaacatgccacagtgccaagatgaacagaactatcattgttcgcaggaactacctccattttgtcaagaaatatcagaggcaagtaaactaccatggattatatacttatgtttcctttccttttctccgttctaacatagggtgcaaacctcccaccttgcaggtatgagaagaggcattccaacattccggctcacgtctccccatgcttccgtgtcaaggaaggtgaccatgtcatcattggccagtgcaggtaaaacttaactcccataccttagtttttgactccttagaatcatcttaaataacagaggtgctattagttcaaacattgtcagttcacccagctagtactgtgagatttggttgctgaagtacaatttctgcattttcaacaggccgctgtcgaaaactgtgaggttcaacgtcctgaaggtcatcccagctggatccaccggcggcagcggcggcaagaaggccttcaccgcagcatgagcttgtactcgcattattcatgggtagtttatagacagatccttttgcttgaagtcctggcagggctggtgttttgaccctatcgatttggatattgttcccaacaaaacgaagtcttatcatcagaacgtgttttatggaatctactctatgcaaagttttgttaagatgcctgttaatgctcgatatgctgtgatccttgattttcctggctggctatgtgttgacgcttgtttgttgtgtttcttcgaaagagtattggtggatatgctgtgcctgtgcatgactgagattctgaataaggttttcccaaacccaaacctgacctaattcagtttttttgacaaggcttgaatcttataagtttatcaatggacctgacatcttcgccgcgaggcgaggggggtgtgggcggtggaatccggtggaatctgggcgaggcgccacccgtgccccctcctctgacccccgccgcgcgctgcctcgttgcgttgctccattccgcccgcgcccccgtgctcgtgccagtgtggtgtgcggtgtgccacccgcccccctttcccaatccctccggtctcccctggaaaaacattttttctcttcccaaccactaacacagcaccggcggccattaacgcgctccgccgcctccgccgatcctcggctccggctcctcctgcagacgcgtccgccgcagcggccacggcggtaagttcctcagttgtccccttctccgcacgaatcctagatcgttctgctgcgtggggttcggaggtatctgctatccgatcgcgtgctcgtgagatttgcctccgcttttgattgggagtaatcccagcgagcccccggcgacggcggcgagcgctcgcgaagctgcgagtggaggatcgaactgtcgaacgtcatttcgtcatcaagcatagcacgcttttttttcccctagtctagtcgccgatgcattatcattcccacccatgcttcatcgcgcatcttgtgcttgtgccatcctcaggctccagtaaagagcaactgcaaatcgtatcgcatcgcgaatcacgcatgacgcgtacattagatttttcagttttcccgtttatgtccgcttcctcgaatttccacccccccccccccccttttttttaccagcaatccacgggaaagcagatgctaaagctggagtatactacttttcttgttttcttccctccttttggttcgtgaggtatgcatccaaatttatgtacgcctcatgcctatgcatttctctgtgagggaccactagggatcatgcgggtcatgtttttaccccaaaagagaaaatctgacttttttttctctgcatacaggatgctatgaatttatcagacctttcttcttgatgtcatgagacagtccgcctttattccacatatttagaattttagatagtagtgccttgtggataaggtgagttcgcttgtgctgttttatttgttcatttctggtgaagtatatgcttgccgaactctctaagctggctcaatgcaaagtaatgaatgatgatactacccacttgattccacagaatggtagcgggagagatagctgttctaagatgagactgcggttgcatctgctgattctttgcttgatcattttatttctggtttataacatggcgagttaccaacataaacagacaaaggtaacactcatctacgaaatgtctccctgtagtttgcttgacagatatgactgaccttattatgggttgttgcagttggaagcaaaatcccgtccatttgatacaattacggtatgtaaaccaatcagctccactagaaggaaaagaactttgtgctatgttaatctggaagcatattttcatttgttgctgggacgctgattttgtcttctatgtaaatatttaggtgtctgacaaagtgtcttctaaggtgtctaaaagatctgccaatagggttggttttttaccccatggtatagtggaaccttactctgacatggagttgaagccattatggctcacaagaagtgcgcaatcaaaggtaatttgaaaaccaagcctattcttgtatacagtgtgttgctcagtacaatatatttgttggttctatttcagttttcatacataaagcaggctttagttgctccacctttctgagtacgaggcctgaatatctagttatctgacgctctgcgaattttggctccacaggattctagccagaaggatcggtgcttgcttgccatccctgctggtatagatcagaaaagaagtgtggatgctattatgaagaaggtacttaatttgctacctcaggaagtgatagtttcctcatgatggtaactcttgaatgttcagtttcttccagagaattttacagttatgttgttccactacgatggtaatgttgatgggtggaacgatctaccttggagcaaaagtgtgatacatatagctgcttctaaccagacaaaatggtatggcatctttctgcccttcctctgtgagaagagcctgactttgagtgctcttgctgttgaatatactttgcttcaccttgcgatttctactgatctggtgtcgtcttaattcaagataagataatgaggcatctattttttaggtggtttgcaaaaagattcctccatccttctgttgtctccatgtacgagtatatatttctttgggatgaagatctggaagtagataactttcacccaaggaggtatggtatttcataaatacttgatgttgattttgagcctcacattgcctagctgttgtataaatgatgttgaggttagacatactgaagtgctgaatcattcctagtacaatgtactgaatcccgtaatcctggttcaagaaactttgtataaaattatcagtgcatcttttaaatgtaagaatcaactactgactgactggtatgtgttaggctgcaaaagttaatcttggcaataatgtgatcttatgctaattttcttctcgagta

SEQ ID NO: 70615 - DNA, 5897 bp, Oryza sativa
ttagatctcgcccgtccgttcgcgtgaacccccgcccgtgcgcccggtccaccaaaaccctagcccgctgacgcaataaatccccttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagatttagtcgtttccggagagtccgttttcgcagaagaagagtttgaagaattccaaggccagcaaggcaagtcacacagatcccaaacaaccctttgagcatgttgatcctatttaaagctattgtttctattcaactattgcatctattttcgaatgtcattgggtggaattgacctatcctttgttatggccctttcgtacttgattaccttattccttgataccttgggttattataatttgactagttgagctttatttatattggtccaactagatactagatataattgcttagccatgcttagaaacattagtacatttatgggataactaatgactcactattatttcatgatggcttattgatagttcacgatggtcaatcgtgattagttaattaattaatgtgccaactaaaacctagtaatggtgggttgtgagcacatggttttgatggtcgtgctcatggcaattaaggaccggttcacgagtttcggttgtgaaacatttatcgtgccaaccacaagccagcatgggcaacggctttatcttttgtatagcatggttcattgcggggcaccagactgagaagtggcagagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactggtaataatttgtttagctcctggtttggaatggtacattcctggtttggagatagaactgtgcagccgggatggttgttcagaatggttgggcctatacaacagggtatgttgtatagcgttggattaatattgtttaattacttaactgttttatcaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttattttttttttccgcttagatttttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagcccttgaccctaggttatgccaaatggttacccatagaagccttctaaaaatattggaaaagtagaactgttctcctccctttctcttttaattaaaccaaactaatggcacatgcacttcataatttttttttaatggttctcattcaaaatttattccagtgttattagtactgtacatctattactgtactaatggctcattttatcagcaaaagttttacaatgttgttttatttaatcttgctgcaataaaataaatttagcatgttgattttataattttctttcatttcttttgaaaccagttattcaaaattacaaaatttgtaacttcgtttccaactgtttcaacttatcctgcaagtttggtttactttatttacttaccttttactttgattttctaactttattcaaattaatccaaaaacttgtgctattaattggataaaggtcttaactccctcctttcacttgtctttagatgccgcgttacaagcctgagtacctgtttggtgttgagggttttgtccaggagttgcgtacgatgtcctttgtcattggattcgggactgcccctttttatgcccagattcctcatgatcgtcatgaagaaaagtgccgagtcaaagtcactttgaacagtaatagtgaagatatcccctcagtgatgtttgaagctggaggaagaaattacatccatgcatgtcaggaggtggcaaggatcgccataggagagctccgtgatcgctacagtgatcaattggccgacactgagtatcgttaccatcctcgtcaaccacagggaagtgaccgtggcagttatcttgagactgaaggaattgagaatgatgctaccacaaggcatttggttgagatgctgtgggctatggatgaaagtcgtgcggagactgtactagcagctcaagatcgtgaagaccggaatcgtggtaagatttgcaagttagaagacaaggtggatcgtttggagaaggaattagccgcattgaagggagaagcaccgccgcagaaggccaggattcgtcttaccgcaaggaagagagctttatttgtccctcgctatcaactggcgccaaaggttcgtgtggtggagaaagaagttgccccagctcaagtggatcctccgatcatcatcataagtagtgatgaagaagaagaacccaagcgcaccaattccaagattgagtgggaagcaacccaagatgatgaagacgacccgaatgagccttccatcgaccttcgatgcttggaagaactagagtgacttgttaagtcgttgtcttagatcgttgtgttagtttgcttgcttaaagtttgcttgtgtgtggctcgcatgtgatttacatcagtggtgggatgtaattgcatgcgtttgtttgtttttgagtgttaggaagttggagagtttagtggtgtgagagtcttcagtttgtaataatgaaactcagttaagagcaataaaagttaaagtaattctctatcttaagtagtttccccggtttctcttcttgtgccctgtccatgtcagatggtgaacactcgcagcaatgggaatggtcccaacaaccccaataacaacaacaatggagagaatcccactctggcccaagttcttgctcaacagacacagcttatgaacatgatgatgcagcaatttcagaatcagcaaaaccaaggaaataatcatgcacctccccagaacaagttagcagaatttcttcgtgtgaggccgcctgttttctctagtaccactaatcctgttgaagctagtgattggctgcatgccatagagaagaagttggatttgcttcagtgtactgatcaggagaaggtctcatttgcatcacatcagttgcatggccctgcctctgaatggtgggatcacttccgcctgaataggattactgctgaacctatcacttggcttgaattcaccgctgctttccggaagacgcatataccatcaggagtagtgtctctcgagaagaaggagttcaggtcgcttactcagggatctcgctcagttacggagtaactgcacgagttcaatcgtcttgctcgttatgctccggaagatgtgcgcaatgatgaagagcgccaggagaagttttttgggaggacttaatgatgagctttcttacccactcatggttggagattatcctgatttccagaaattagtggataaggctatacgtcaggaggacaagtacaattgcatggagcagaggaaacgtcggattgctcacttcaaggcacaacaggggagtaatcagaagccgcgtcttactttaggaccccagcccatgtcacagggaggttcttcgtctgttgttcgtccgcagcgtcagttcttcaacaacaatgctggcaacaacatccgtaatcaagctccacgtcctgttgcagctccagtacagcaacaacctgccaagagggagcaaggcagcaagcccgtggtgtgtttcaactgtggagacccaggacattatgctgacaagtgtccgaagccccgtcgcgtgaaggttgtccctgcccagagtaactctgctgtaccagcatcaaaggcccgtgtcaatcatgtcgctgctgcagaagctcaagatgctccagatgtgattttgggtacgttccttgttaactcagttcctgcaacagtgcttttcgattctggtgctacacattcattcttatctatgagttttgcgggaaatcatgggatggaagtggaagatcttagacgtcctttgatggttagtaccccaagtaatcaagcactctctttgcaacgtagcccctctgtcagaatagaaattaaaggagtaccatttctggccaatcttatcttgttagaatccaaagaccttgatgtcatcctagggatggactggttagccagacataaaggtgtgatagactgaaccagataactttggaagagattcctatagtccgggagtatcctgatgtgttcccagatgatttacctggtatgccgcctaaaagggatatagagttcagaatagatttggtacctggaacaactccgatccataagagaccttatcgaatggcagccaatgagttggcagaagttaagaggcaagtagatgatttgctacagaaaggatacatcagaccgagttcatcaccatggggagctccggttatttttgtggaaaagaaagaccatactcagagaatgtgtgtggactatcgtgcactaaacgatgtgactattaagaataagtatccactacccaggattgatgatttgtttgatcaactgaaaggtgccactgttttctccaagatagatcttcgatcagggtatcatcagttgagaatcaaagaggaggatatacctaagacagcttttaccactaggtatgggttgttcgaaggtttatagagaattttttcaagattgctaagcccatgacacgactgcttcagaaagatatgaagtacaagtggtcggaagaatgtgagcagagttttcaagagttgaagaatcgcttagtatcagctcctattttgactttgcctgatccaaagaagggtttccaagtgtattgcgatgcatccaaacttgggttaggttgtgttctgatgcaagatgggaaggtggttgcctatgcatctcgacagttacgtccgcatgaaaagaactaccctactcatgatcttgagttagctgcagtagttcatgcgttgaagatttggcgtcattatcttttcggtactcgtacagaggtatataccgatcacaagagtttaaagtatatctttactcagccggatctgaacatgagacaacggagatggttggaattaattaaggattatgacatgggaattcattatcatccgggaaaggctaatgttgtagcagacgctcttagcagaaaaggctattgcaatgctacaaaaggacgacagttgccattggaattaggcaaggaatttgaaagattaaatttgggaattgtcggtagaggtttcgttgcagccttagaagcgaagcccactctaattgatcaagttaga

SEQ ID NO: 70616 - DNA, 1267 bp, Oryza sativa
ttagcattatttgacatgtagaatccaagaaaaattccacatgccgattccgattattatttgcatttattaattagggaattagctctaggttaattaagataatttcttcggacgatttatttagccaatttttaaagcaagcaaaggggggaaaacttcagggcgtgacaaacctaccccccttaaacggaatctcgaccccgagattcggaagagctggcgaagaggtgcgggtgggtgccttcaactcatcttctctttcccaagtggcctcttcctctgagtggtggctccactgaaccttgcagaatcttattactttgtttctggtccttctctcgctggtttcgaggatacgagtcggcttctccatatacgtcaagtcttcctggattttgatttgatccggacttgcctgttcctcaagaactctcaaacatttcttcaactgagagacgtggaacacgttgtggatgccaagcatgttggagggaagctcgagctggtaagcaacttcacctttacgttccaagatcctgtatggtcccacaaagcgtggtgccaactttcctttggtttggaaacggtgtactcctctgagcggagtgacacgaagatacacataatcccctgtttcgaaagcgagctcccttcggcgggtggctgcatagcttttctgccgagactgcgcgattctcaatctttccctgacagctctgacttctcttctgcctcattgaaaacttctgtaccaaacaactggcgttcccctgtctgatcccagaagagcggagtacgacaccttcgtccatacagtgcttcaaatggtgccatctgcagactagcttggtaactgttgttgtactagaactcagcatacggtaagcttttgtcccatgctccaccaaagtcaagcgcacatgctctcaacatatcctctagtatttgattgactcgctcagtctggccatctgtttgtggatggtaagcagtgctgaaattcaaccgggttcctaattcttcttgtaatttctgccagaactttgaagtgaattggcttcctcgatcagacacgatcttcttaggtacaccatgtaaacacataattcttgccagatagagttctgctaatttcttccctgagtaggtagtgtgcaccggaatgaagtgagccactttggtgagtcggtcaacgactacccaaatagaatcatgccccgatgacgtcctgggcaaaccggtgatgaaatccattccgatttct

SEQ ID NO: 70617 - DNA, 745 bp, Oryza sativa
acgccccccgtacgaagatccgaaaagcttgtacgcccgcgggcacgcccccccacccccccggagaagccgaagaaaaaaaattaaaccagccgcgactgcgacgtctcgatcgtgtgcgcgtgggaagaaaaagcacgcaaaaaaataaaaaaaaaggcggccccgcgacgcgacgtgtccggtgccctcccggcgtttgacgcggcaacctcccgcatcgggccccggccgggcacccaccgggagcctttcgccgagccaacgagccaacgcagcgtacgcacggcacgcgcacgcgcggcgcgttgcaggatttctcggttgatgacggggaaaaaggtgcggtggtgtggtgcctttgcttggtgaaagatgggttggttatctggagctacaagtgataagggggtactgtagcagatgatgttaaacaccggcgtatggtgttcggaagtagcggagttctgcatcagcaaaagctaaagccttgccagttttaatttgccaccacgatctgttttcttgagctgttggtgattgaaaggttgggagtccttattacaaacgtaaatgctcaaaacacacgtacatttatccttataaacatatttaaaaaacggatcattatattttgagattaacaaaatcatcacaaatatctcgatatcaatacgtatatcgcatattaccgaagaaataattagccgtaaatatgagcattcgtaccaattctaatatttaa

SEQ ID NO: 70618 - DNA, 6727 bp, Oryza sativa
tataagtataataatagtatgtgcagtgttactacacacattttagtatgcgtctttttttttcgaggtgaaatagtatgcgtcttatgttcataaatatatatatttacatgcacagattagcagcgcaacgttttagtgacttcgtatttatgtacgctctaatttttcacattatcacagattcacagtgaaataattttacttatattttttcatcataaagaataaaaaaagatgtaaaatgtcaaatctagtactagttgcgcacataatagatgtttccgtttatttttcacagcttctctactgttctacagtggtatatatactggtatctatcagaccatcactagtattatccctggagaaatgattaatttgagctacagcattatctcgttccacactagcttgggtatttttcttgccgatgtaaccccttttgtactttgtttttccaacactaaatcttaatgaaattagtaggcccttccttcggccgacccgagaaaaaaaaatctgtatattcaattctgatgagtatagaatggttgacggacaggttgactccatgtctccatcacatgcacaacagtaaaaagaaaaagacaatacgagtttaatttttttcttacgtaccccgatcctacttttgcacatcatcgccgatctgggcggtggcctcggtcgatcgggccaatattgctggagttgttgactactactttcgtttcaccgtataagtctttataacattacccacatttatataaatgttaatgaatctatacacatatatatgtctaaattcattaacatgtactccctccgttttataatagatgacgccgttgactttttctcacatgtttgatcattcgtcttattcaaaaattttatacaaatgtataagatataaatcacacttaaagtactatgagtgataaaacaactcataataaaataaattataattacgtaaattttttgaataagacgaatggtcaaacatgtggaaaaaaaatcaacggccgcatctattaaaaaacggagggagtatatgaatatgagcaatactataaagtcttataatatgaaaagggaagaagtagttgtcttcgcccatgcatcaaggtggcatcgttttattggagccccaggcgcctccctgctgcaacgactactcctgctcgttaaattcgaccaaattaaccaccagccggtgaagccgacgcgtatagtaatttgcaaattaaacttgtctgtaacttcttcagagtaaatgtcttagaaaaattgtaaaacctgtctctaggtgcatgcatgcatgacagataaaatataccaacaattaataacacgcaaaagtcctagctagtggtggtagatagatcgatgattaattattagaggaggaggagaagattaacaagatcacctgcgctgcacaggcaatcgtgtgaccactgcaaaaacgcggtttcactttcacgtcgtctcgtactaacttctgtatcctgattcattattggacgtactgaaattggcccagttttattaatgtgggagtagtttccctgatgttttctagaactttcttagctccatcgacgaaagtggactgaaattaattagggttgtgtttagatccaggggtcaaaagttttgacgtgtcacatcggatatacggacacacatttgaagtattaaacatagactaataacaaaacaaattatagattccgactgtaaactgcaagacaaatttattaaacctaattaatccgtcattagcaaatgtttactgtagcaccacattgttaaatcatggcgcaattagacttaaaagattcgtctcgtaatttacacgcaatatgtgtaattagttatttttttcgtttatatttaatactctatgtatgtatccaaatatttaatgtgatatagtgaaaacttttgtcatgggatctagacatgccctagagtgtaatcgaacgattaacagcctagctagctagtgatcagtgttgaccgttgactgacacagaaacgacaacaaccgtgacacggttaaaccgttaaacgcgctgccacgcggcttacacgcgtatcaagaattaaactacctagctactcccgtatatatatataaccgtgcaggacacccatgatcaactagtgattaattacactgagctggaagctagccttgacctgtccgtctcgaggtcgaggctacgacgacgatatatagagatcgattagagagagataattaagaaacagggattacggacagctagctagctccggcgacatgccccccaagcgtaagtcgccaccgccgccgccgccgcatggccccgtcgtggtggtgcctcccccaccgtacaggcggcgcctggagatcatcgatcttccccagggagctgctgctccgacaactccaactccggggaagtggcagctgcctcgggtgcccatagctttcattgccctctacttcatcgtcctcgtgtacgcctccgatctcgatctctctctctctctctaagtaagaagggtacaagctttgttcatcatctgatgcgtgttctttgctattgatgtgcagcgaggggaagtccaaccgccgcattcgtcgagtggtgagctgctaacaaatctctgaatatatctctggatccgtcacaccgcggcgtccccctctcgtgcgctcatgctagccgcatgctcgctcacgggggatactcagctcgctcggcctatctggccttctttgtaggccagcactcttttgcttgcgtcgacctactttggcaggccaggggctctgcgaaatgtaaactttttcattggcttgcgttgctgcatgactaatcttcttctacagaagcgagatatagacagccacttagcttgccctttttacgcccagaaactaagaaacggtgaatcacattcttctcgactgcgtgtttacccgcctacagatctggcaccatgtcctttccccctctggctgaccaaaccttgccccctccaacggctgctctcttcaagtttggtgcccttcgtctatggtttgtttgccggagcatcatcttcataaaggttacgactccctggttttactggtttcctaacagttgtggaaggagtaatactctggggttttcgacttctctcttttttcggtcttagtgattttggattcgtcctgtaagagagccgtctgtggtcggcagcgggcgccgccacgtttggggatctgttggagtctagtggagtacaccacaaacctccctttgtttaggagcagccttttcttagttgtaaaagtttctttcctttttttcggttttccttttttttttctccattgtctcctagtaagggccattctgccggttatgtcatgtaattgaaactttaatttcttgctgtgcaatccttttgcgcgttcgcgaaaacaataaatcatgtgttcacacatgtcacgccccgagctagtcccgaccggaactaacccgtgacgctccaaactaacctgttaatcgataccagtcccaggaaacagtgctggtatcacagggagacagaatatcacagcaacagaagtctctttattatagagtagaagtacagtcatgttgggctgcggacagatcccgagctcacaactgcattacaaaaggaaagcggaagccaggacttggaccaaacaatcacaggcgcgacttgggaactaggccgaaaccctaaaactcatcgtagccggcttgctcctggaagaactcctcatcagcaggatctgcttcatcttcttcagcaactggggggggggatatttatatagagcaagggtgagtacgggggtactcagcaagccatgggaattaagtgtttaatgcaagcttcaaggaaaggctgtctgtttttgcgattggttttatttgaactcttttctaaaagcaactaagtgagtgcttctcaaacgacacggatgaggcagtgcgtctcgtccggtcggagtatgtgcaatgtatcagtctttagattttgaaacaaggttggcacccggccaaaagctttttaaacggccacccgggccaacacctttcaaacggccacccgggccaacaacttttaaacggccacccgggcctagctgatcccatcagctgcaggttttccaaacatcgaacccagtttctcaacagcaatttcacaagcagtagtcaaacaaaactacgctaggaatcacctcacatccgcccatgaccgtgggcacggctgttcgaacagtttgttaacctctgcagagggggtacactttacccacatgacattactaacccggatcatccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgacttatgtttggatgaaattccaaggaatcggtccttaagtgcgagagcgggaaaccgtacacccggtacgttccccggtccgcggttttggaaattcatttagttcacaagcaccgacccaagtgtcgggttttccaagtcttttgtaaaactccagttttacccaagttgttactcaaattttaagtttgaaggcgaccgtcgatattcgcacagagtgcacgattatcgaggcgcatctgggtggttacaaggggacatggtgtagcaattttcaacggaatgatcaattgcaacaagttaggtaggtccgccaatctgccttgcagacgggacaacagattaagtgtgatcctatcaatgcataatattttgcaagcaatataattaaatttcaaatataggctcaagatgttcaaaggtggcttgccttgctcgagatctggagcttgatcctcgaaatcctcgcactgcgggtcttcgggctccgaaactacacgcgaaacggaacaactcaacaaacggcgaaaataaagccctattaatgacctctaagcgtgccattggatagatctcgagatttgggaaattttggaagttgaacggagtcaagcggagttatggttggaaagatattgaatttctaagattattggatttttggtctaaaggaaaaaggatttaattaaatccttttttggaaaaaggaaaaagaaatgatgaagggagggaatctagactttcctcggacggctagggcgcggcccaagggaaatggagcggaccggccaagctaaatgggccggccggcccaaggcggcccaagcgcgcgcgcgcgcgggagggaggagagagagggccggtggaccgggctcaccacgcgcggtcccgagtgggacccgcttgtcggcggctcggctcaccgtgagcggggtgcacgcggcgtgctagggtttggggaggggaggcgcggcgcatgcgcgcggctcgcggtgagggcggaggcggcgggcccacgtgcagcctcacggcttaccgcggaccacgcgcacggggagaaacggagggagcggctggtcgggtcggcttatctggtcgcggccgaggtggcgccgacgtggcgcctacgtggcagccacgcgggtcggcggaaggtagacgaaggcccggccgaaacggacggcgggcggcggcggcgatcggcggagcgagccacggcgacacaagcgacagcgagtacaccgggtggttgcacgggacgcggggaggcgagccaacggctcggattcaccggagggagcttgacggcggcgaatcgcggcggcgacaaccggcggcgggaggagagggaaacggcgacgaggtcacgaggggccgattcccggcggtgggagcatctatgcggccacgggaactcgatgctagcgtcggatttggagggaacacgccgagggaggctggcgacgtgcgggtgctacggaactgggcggcgacggcggcgagcacatggcgagcaacggcatcggtcggggcggcgccggccaactacgggaggtctactcgagctaaaaccgaagtctaagggggggagacggagcgaggagggagaacgaagcgaaacatcaccgcggaaaggagaggcgctgtgacgagaggccgacggcgcgggagtgatctctccggcctcgggccggggaagaggaagaagaggcgcggccggagtcctcttcggcgtccttgctcgtgccggctcctccgacacgcgcggcgacgatcggcgacggcgaaaacagagacggcagtggaggaggcgaaaatggggagggaaggagaaggggaggccgggggtttaaggaggcggcaatgtcggtttggggaaccgacttgcgcggtcaagagcgcgagctggcgctcggctagcggccaaattggcgacagggaggatgacgccggcggagaggtaaaggggaaaaaggaggggagaaagggggcttgcccctttgccggttcgggaaaaaggaggaggggagcggggcgacgcggcagagggagggggcgctgcctccgtccttggcggcttgcgcgcggag

SEQ ID NO: 70619 - DNA, 1152 bp, Oryza sativa
caaatctgacagacagaccttgcaaaggcccattaaagcacaattaactgggcctgaaaagcccagcccgtccactctgacgattctacccctctaaccctacaccggccagcgactatataaaagcggacccgtctcgagccgctagggttcttcgatttctccctcgcgccgccgcctcctcctcaccctccccgccccaggcgcaccctacgcttggagctcgtccgatccgctcggcgcccgccatggtaaacgcgcgaagctctgaatccatcctctgttcctcgcggtctcgcgtgcgtgccgtgctgcttgctggttgatgctaatctcctcactcgcgtttcgcctgtttgttgttgcagatcatcccgaagaagaaccgcaatgagatctgcaagtacctcttccaaggtcagtggttcttggtccctatttgcacctcgtaatcgtactagaggcgtagagccgccgccatgtttagtggagattgttgttttaggtttgcaaaacgaggagattcgtgttgctccgtacaggagcacggttcttagtgcaggaactgccctcttgttaaaaggagaagcttggtttagatgtaggatttgatatgctagtgataatttttcattctaggaacccaatgaactattggttatatactagcgaaatctgtgcacccatgaacatcaacttaaattgattgtttcggtcctggtgttgtgaaaatctgtgtgtaaaaatttcaagaaaaatgatatcgctgttggtgtatgtcagtacagcgttcgcatgccaagaggctcaaactgaaagtgattgtaggtgctggttttaacttggtgtatgctgttgttgcagagggagtgctgtatgccaagaaggactacaacctggcgaagcacccgcagatcgatgtgccgaacctgcaggtgatcaagctcatgcagagcttcaagtccaaggagtacgtcagggagaccttctcctggcagtactactactggtacctcaccaacgatggcattgagcacctgcgcaactaccttaacctgccatctgagattgtgcctgccacactcaagaagtctgccaggccacctggccgcccatttggttctggcccacctggcgaccgcccaaggtata

SEQ ID NO: 70620 - DNA, 3808 bp, Oryza sativa
taaaaagccaacggtgtcaaacattttgaaacggagggagtacgtactttcatcaagttctcgtacacaaaattaattggtttctatgcatgtcctaattaattaaggatctcttaaacatttattcttttgctaggtaagaatctcccaacaaaatctgcaggttcgatggctaatctgctctgtaccgctaattaattagtttatttttttttctcttccgacaaatttgggtaattgggttgtacgtcgtgctgagttatatatgtgcaatatactactagtagtcatttacctctaagttagaactgaatattaattaattaaacatttttaaaacatgtattataaatatgtacttggcttctaaagtcacatacataatccatcctcacatgtttttcattagacttgttttaattgttcagtattttcataattaaatataaagttgtacttaatttgcttggaatctgaattttaattttataatactataataatgaaattggagtgaatcattaattgtgaagttgtacttgctttgactcaagtttagtattttgcagatttttttggaactattttgtaaactaacaagtctaaaaaatcaattaagaagtgcaaagttgcaactgatgtgaactctctcttaatctgagctagtattataattcggtgtcatctagagatggccatatgcattcaatttttttccaattgattaacatggatgtttgctcagattaatttattaatagagggaggatagcaaacaggttaattgtaaagctactatatgttttcttttttactaaacactgtaaaactagtatagctggaggatttgtttatttttctctattttcttcctttaggtaatttgtctgttctgtgcttgttaaggtacgcaaagagaatattatttcccaggaaaaggtgctccaagcatttgataatgcccttcagaagcatcttaatccaattcatcggtaagatatgtcaatcaaagctagggtgatttttagaacaattatgattcaaatatactaaccctttttctccttcacttctttggttgcagatcccttgaatcccttaccgaacgaattgatactctgactcatgaagtggtattggatctaacacatttcactctattaaaaataactactccgtacctcattaaaaataacacatttcacctcattattgatttttatcaacaaacaagtttgtacataaactgcaatttcttagggtttgctcgagacagacaaatgtcctagcttataataattttccttttaatttgtagggacagatcaaacaatcaaaccctaaccatcatgccaatgagcattacaggtatgtcatatttgcaactatgcataaatgattcctatcagtcgtgcattattaattctaaattatagaattatcaagtaaatgaactaaagcatttaaagtatcggtaattcttttttttttcaaaatttggaactgtctaataaaattaaattacttatgccaaaatttaatactccataattaaagaacaataaatgtgaatatatatgtacattccataattaaatattatgaattaataattaaaatataagtttttcatatatgagtgcattgaaagagaaaactattcaataattttgttaagtaggaatcaaatcatgggttaacatttttttcctttcttgtgagtgacgcggtttaacaaataacaattaatccatactaatcacttcagtgatctactatagtaccatatatgttcgttaaaaaaacattatcctttggaatatacttaatgaaaaaatagattcgttcaaaaaaaaactcagtactatatattgatgacgctatctatttatgtagtttctttaaactattttgccatgttcattccctgttctggtagtattgtagttgtaaacttcagacaatttgaagtaataccatacatttcggatgacattggtgtttcacactaaaaagtactgtgcttgtgtctgtactgtagatcagaagcaaatcaagatgctgctggatttgctcattatggggaagctgttgagttgagattcctcaataagttgaagcctcgtctttattatacacaggaaaaaattacagcagaggatggcacggttatccaaattgccttatttaaggataaccagatagttaaatccggtccactttcttctgcaagaattgaatttgtggctcttgaaggtgactttaatgatgttgcccctgaaaattggaccgagtatatgttcaatcagaacatagcaagatccccaaaagggcctgtgttaggaggagtttgtcaaatcaagctgaagaatggggaggcctctccttctggcatctctttcgttgtaccatcttcaaagagtagaagcggaatgttcattctggcagcaagagttcatagcagtgacaaagccgggttccggattatggaagccttgatgaatcctgttgaggtgcaggtttaccgaaacaaaggtatatccttcagaattgcatcttgctgttctgtagtttgttttgatgcgtgtgctattatgcaattctgaacctctcagtcagtgactgtagaaaaactcttctttcatagggttatctttgaaattaaagagatcgcataatcggcattgtatgatctattgacattttctctcctgtttcctttttccagcaaatataaatagtgacactccaaaattgaaagatgatgtataccgtttaaagggaatttcaaaaaagggaactcgcttcgattggcttaaacataatgggatcaacactgtggaggatatgttaaaggctttaaataagaacgaaaagaagattcgcactgtaaggcctctgggattccccaatcattctatttctcaagcacacaaaaattaggcccttagaaattagcattgctttgcgtgtttatgcaaattagaacctttctttgtatatcaggacagcaagcaatttacctttcaatgtcatgaaatagtagaaacataagtaaattaatgtctcaactccaattctaaaatgatatgtttatcatgcagtaaatattcgttttgacaaaatgaaattatcttatacatttcttgacgttcaggagtgcttcaagctagagaagaacagcaaggattggaaagaaacagttaaacatgctagaaagtgtgatctcgaaggcaattgcaacctgaaatcatatagagttgaagagaaacatgttgtactcttctttaactgcgtacatgatctcgttggagcacaatttcatgatggctatgttacaaaggacaatttcaattcagatcagcaggtatacattggtatctgcattcttctaccgatccaaactttgacgtgtgaactcagaacagtacgtgcaatttctatttcaggatgccgtgaattgtttgaaaaaacaagcgtatgatgctctggatgacattgccttcgatgacaaaatgaaagacaactatccagtatctttgtcttcagctatgaacacaagcattactgatggtgatgcttccattcccttaacagacagagcaggaacaaattatccagatctccatgttacatctcaaggtaggtcaatggtcttcttctcttgtctttgatctcagacataacgcgtgatgatttactgtttggtgctgcagcagttgggaattctcatcatgctgagatttatcaagaaccttgactgcttcaagcattactgaactataatagtgcctgtgagatagaacca

SEQ ID NO: 70621 - DNA, 4889 bp, Oryza sativa
tttagttttggccgtggcatctactatctgaaagtgctttattgcaggtttgcagatgtactgcttcccttcagttcgcatatggagtaagtaatgcaaatgttatatgatccgaggttaattagttgtactaaatcatactttttctgtatcgcatcttgagaaaactttagtatggaaatgaaaaagactaacgtatttcttattaatatttaatagagaaatagtagtagtggattggttaagatattgaagagataaaacttatcgatttatgggagataaaagagtaaaaatcaacatgttttctaaaaggaggtgcttatactcattgttcattttttgcttaatttaagtggcaagagtactagtctgaattttggcaaaataagacaaaacaggctggatttagtactagtctgaattttggcaaaataagacaaaacaagctggatttccagcaccactacttcttaacaacgaacgctatgtccccagagttctgcagatttgtcggcattttttaacagatatatcacccattggaagtcaacgacagatgcattagtatttactactatattcctattataatgttagcaaatctgaagggaaatataataaagagaagagcgtgagcacgtctatgtattgtattggtgcgcaattcgatacaaccggctaacattttatcaaatataatcaaaacaatccatccagttctcccggcaaaaataaaaaataataaaatatagaaatttaaacaatcaaatatttaacaaaaatatgaagtgagcgtaacttaacgagttagtttccttatggtgaaaccaacccaccctaattcaagacctagatttgacgttggtgatctcatttacagttaattattctttttagtgataggcgacctacccgtaatggtttcgtcgatctcaagatacccaaacttctaaattgtacatttttgttaaatatttttatataaatttctttcaagcaatcattttttatttttaaattttataaaattaatattgaattaattatgtacttcctctattttataatataagactttctagcattgctatgaatgtggacaatgctagaaagacttatattatgaaacggagcaagtactattgattaatctcgttttatatgtcactaaaaattttagccgattagccaattcgaacatagctgaatttcaaggggtagaaacttgcatggttttatggattttgcagcccatatagcacctttcaagaaggcccagagagcttccacattgcttgtgtggcccagctccgtgccatggtcatcatggccttttttcttaaaggagactcaacaccatggaccatgtatcagaatgcatggaatattattattgtttaaatttcatacaacctcagatattattatggtttaaatttaacaaaatcataagagtttttatatgtgatacctcatcatgggtattataattttaagtttacgcaaaacatgccgttagcccatctcacttaacattgtatcaattttttaaaaaaattgattaacttgcatggctacaacatatgtacggtggattaaacaacccatgaattctggatataggtttacagctcatgtatatagtatattaaagaaaaactagttgatggtgtagttttttcaaaatgtaggaccaaaaacacctgtggttatatgcaacgggccaaaactcatatggttttatgcaatttgaattattataatatcttgattttttgtgaaatttatataaaaaaaataaatgacctttttttctctcagtttgccctccaacaaggagatgtaaagcagcttttcttatgctgaagattcctaggagcacgattgacatatatttcttagataatacgattgacatatatacctccttttctttttcatgatagctgtggcatatatgctacagttgggtattgtcatcaacacatttcatatgatcttgagagagaagaacaagaataaaaagccttttttttctatcattccctcacaatgaagattgtaaacatcttttcctgtatgctagtacctgggagcatggattgtaattgcacttgcacccattaccctatctttttcttttctttttgatgagatgcattaccttttctttttgatgatcataactatggcatgtactatattatagtacagtttgctagtgctgttagttaaccagatgggcccagacaaaagagagagaacacatcttgggcctaccctaccaccttctattcctttttccagttctttttatggcagaattgtcatggccaagacaaagaagataatctgagttggaagttgattcattacacaatcattcatgttctttgataacattggcatcaaattaaacctttttttggtgtggtgttcaggaatctttaataagctttcattaggttctttgaaacaaagtgatcgcctccttttctttccttctccatgccatatatctctggtctccatgacgagtagtaaaagagccgcacgcttgatccaccaaccggctatgagtaattgagcccaagaaagtactaatcatcactataatctctgcatcatgctgccaatgttgcttgcttgacatataatgatcatataataccaataattaatcaccattggaaaagtatttgccaggacaagcctaccttccaagccttggcaagtactttcttctgcttaatattcgagtttcatattataagttattttgggttttttctaaggtcaatattttattttgggttttcctaagccaatatttttaagtttgattaaatttatagaaaaacgtaacaacataatctctaacatcaaattagttttattaaatccaccgttgaatatatttttatagtaatatttattttgcgttggaaatgctactgtatttttctgtaaacctggttaaactcgaagatatttaacttaaaacaaacctgaaataacttataacatgaaatagagaggaagccacatttatgaagtttgatatatccaaatggcgacgagttggcgggaagcaagttcttgagtgcagtggagctgcaagatcgattatcagatggagtactcaaccgaaacttaatggaacaggatgagaataatgctagctacacgatatggtgtactaaactcaatgtttccagagattatcctgtctttgatgtgaagctcacatcaagcaagatcagtggtgcccccacaaacttttacagttttacctgatgattgctcattgctgcagaaatgtgcagggaattttctcatcattgatagttttcaggctagcgatcgtcgtcaggaactaaaatccggcacacggccctgaaggctgaattcagtttggcgtgcaacctgaactattattatctctgcaacaattttctccagtcattttcgtggctacagtcaccgtcagctttgcagtcaacccccggtcgtcttcctcgtctccatctccgtctgcggcggcggcgaggagagtgcgcgctgcgcatttgcggcggcgacggcgacatgcacgcgcgcggccgtggagcacgaggccggaaaggagcacggaatgggtggaggcaactcggcacaaagactgtgaagcagccaagcagcagcagctcagcccagcctgagtgcagcgtccaccaacacagcctgtgcttcttttttgctcttccctgctgcaatcagtttcatgtggtcatatcaccaattcatcaccaagataatatttatcccaaaagcaaaactttacctttcgaacagtggcattgcttgactcgccacagttttacacaacctattcttcattaattaacgagtacattattaaaaaaatgatattgcttttgtttttttgttataacagcgagagcaacttttacggtggtctaacattccaacaaacgtttctattataactagcaaaatatttcgaacagcaaccacaaactaaactgggccacgctgttcgtgatacgaaagcgaggataatttgctactactactagtatatgaaatggaggcacaccgaacacgatacgtccgtgcgaagcttagtgttcgaccctgtgaaaatgattgcaatgtcgacgaacatgcatgccacccatggatcacactggccatggcttattagctagtagctcactgtcttttcacttcctttttcttgctaaactattattatcatttatcttaagaagattcttaattagtgtagctttatgtcgatcgccttcgatcaaagagcgagctcaaataccatggcctccatcgatggacatggacgactccaatatgtatataatgtatccggtccattgccaccatcgccatgaacgagtgcaatccactcgtgtcatccactcactctcgttgctcttcttaagaggacgaagacgacgacgtcgaacacgaagacatcatgatggcatggaggagcttgtcgctggtggcgttcatggcggcggtggcggcggcggccgcggcggcgggcgatgaccggaggccgtacgtggtgcggatggacgtgtcggcgatgccggcgccgttcgcgacgcacgacgggtggtaccggtcggtgctctcgtcggcgtcggcgagggacgcggcggcggcgccggcggcggagcacctgtacacgtactcgcacgccatgaacgggttcagcgcggtgctgacggcgaggcaggtggaggagatccgccgggcggacgggcacgtcgccgtgttcccggagacgtacgcgcggctgcacaccacgcgcacgccggcgttcctcgggctcaacgccggcgccggcgcgtggccggcgt

SEQ ID NO: 70622 - DNA, 14597 bp, Oryza sativa
ttaattccaacagaagaatactgcaggatttatttgaagaatatttttgttttgataatgatgaggtctgtaaaaaaatttcagatgaaggttatcgagcaggtgctgtggctcagatctacggtggattttctgaagttgacatccctattgggtgctatattggtcagacatctgaagtaagtgttgtttctgttcaatccactcagtatgtaacatcctcactttctagaaaatggattaaaagccagcctctacatcgaaaccagacatacacagccaactgtaacattcttactggaacagagatgaaattattgtcgatttgtcatgctactagttgaacataactcctgaaatcatccaattgctagctttttcatcccaatataagttataagttatttttcctgatgccaataaggtctacagcttgaacatatgtaaggcatacccatgaatatgagtctgtctctaagtattattatttttttaacgaaccggtacgagatcgtgccattttcattgaatagagaagaaaacagttgcatcgccaagggtccatcagtatcaatctattcgtgatagactgtgtctgtctcttattattgagatcactgcatttctgcatctttctcctatcacgcccacactcattgcatgctaacgagtcttctttttttgtagggtacttcttctggaggcaatgccttgatcggactgatgaatatgtcacagaatggcagcgatggcagcaatattgcagaactgattgacaacgacattgatccttatcagtacatcatttaactgaaccagaacaggggcgcatgctcacaactctaggaccgtttttactgaagtctcgtcgctctgcatatccaggaccgtttttactgaagtctgaaggatctgtttctagccagtacgcttgctggctatttatcttctccctgttatttaccctaatgagcagcgggtgtattagcatatttatatatacaccttgaactgtaattttctgacaatggtttcataaattaaattgttagtcatcgctggaactttttaagcaactgtaagcatattacaaagtatttcttccgttcttttctacacatggctgccttgcctccatcaccatctcctgaatcactggacgtggccccatcatttcatttatacttatacttatcttttttttaagtaaacggattttttccactacaaatatcaaggaaaagtaacataaggagaaaaatctaagaaatactattgacaaacacccaaatccaagaaatatcatcgatgaagtgcaagttccataaaatgctattgtacaagcgatttggttctagaaataacatcgtcattagagttctatccatctcgcgtcgttaatgtatatacattgtttatcctatagcacttaatggagggctattaacaaaaccctagtagcgatgatatttctgggataaagtcttgcacaatggcattcatggaactcgtactcgtcgatggaatttctttttggaattgagtgcttgtctatagaatttcttagattttctctataaggagaaaactcggaggaatagaaacccaggttataaagcaactagaagaaacaccctcctgcgctagcatgtgtgctaccgtgttcgccgttcgacggacccaacaaaacttcgtctcttggaaaccaactaaagtgtacttcaaatcttgagtggcttattagcaacaaaaaaaaaatgatttgtgggtaaacttttatatgcgtatccatagcaattcaaaaataaattatgtaaaataaataatgataaaagaaccacaaaaccaactcttgattcaaatttgggcttataagcataataattgttgtgcgttgggtttagccgtatttgaatttgatcatctcaaagttaggtttccaacaaaaaaaataactatttcataattctatgcattcatatttatattttttttactaacatataaaaaccaaactgatattcagaattagagcaccatatcagagattcagggcttgtttggatgactactccaacttgccaagccacaagctagctcgtgccacaagtttggcgaatgatttgagagccacaacttaggctaagaaatttgtggcaaagtagttcatgagcacctaatttcttgtggcaggctaatgtgtggtaagcaaacaaacatatgctaactacctgtggcacgccgaacttgaggcgcggcaaactgtggcacctatccaaacaggccctccgagcctttgttttggctaagatgacaaaatcgattttgaacctaatggtgggccgcatcctttgtttgggcctagttgtcggcgtcacacaactgggcccccacactggagccaagtcgacccggtggtggggcccataacgcgatccctctggcctccgttgcgacgtggcctcatcgtgacgctcggatttgtttgaaacgtccacctgtcgtgtgattcagtgtgtgctcctctatctccgatctcctgctttgttttctctgctagtgaggaacacagagttcgccggagcgagcttgcgcgggagaatggaggcgcggcccagatgccggcgggagggttctcagcgtcggcgccgccgcctgcacggagttcgaggcgaagatcacgccgaccgtggtacctcctgcgtcatggcggccggccaccggcggcctcatatatattcgacatcggctacgacgacatatgaacaacataggctctcatcggatggcctaatcagctaaaaaaaggcaaattttaaattttcaaacttagttttgaaattgattttgtgatatttttaacgtagtttctttttcaatattagcttttaattcaccaagaacacatatataaaagttttatctacaaatttatttttattccctaataatttatgttttgatttattggggaaaaagccaaacgatggggccaatagccactagcacagccccagctagtacaccgatttttttattataaaaaatgacatacacaggtaaacaaaagatgataatagttggagaatggaattatggaaacatgtagaatgtctggttccacatatatatatatatatatatatatatatatatatatatatatatatattaaatttgtttggtgtcctatatatatatcgtcaacattgccatcgagctccaccgcaaatcgtggagaaagcacaccaagtatatgaacaattaattatacacaacagaatgcattaccagcttaattatgtacttatggcacaaatattaggagttatgtattgaaaaaacactgaacatgaaagtaggggttctcatatcggaatttgttgagaaaaacgaggcttgaacttgagctggctagctgatctctggtgctagcctgaagacctccagaccttttctcaaaagttctgtattggggcagtttgtcataaacagctaacttatactgcaccattttactggattaaggaagtcgttgctaacttatattcataattagaactcgtccgcgtctaccggcttgtgaccagtgttcctttttgccgggccatgaccgtgaccagtcttctttaggggcaagggtagtaagtaaatttcatcagggcaccagtcttggctagaagttgatgcttcatacatattccaaccttcttcaaaagatatgccattatccattacaaaaggcatgtccatgtgtggatgaagtacatgtggattcatctcccaatctgacgaagccatcgccgctttattagaaattccctgcgtaaaatgacgtcggcgtaagctgtgctggtgcgccaaccttgggctcagcaggctacacttactaaatcatgttgaatttaagattacgtggagatattattgatgcataaaaaaatatttaaacgcaaatgagtcgggcgatataaattgaacttgaagcatactggatgctaattaagatatagaccgaaataactaaattaattctcagttactgaaaacaactaattactaggactacttattagctattacaaagaggacaaattttacttaacaaaggcaagttgctatctgaaatccaagaatcttccatacacaatcctgaaatgaaaacaacaaacaaaaactccagtcactctctgtcccttccctatggctatgagtcaatgctcaagaatttgcacgtactttataaattatcgtttacctctcaattagtatctttgttcattaccactctacaggaccatttgccgccaaaaatgcaccgtaccctataagttctttctaattctgtagccaacttactgtaagattttattatcaaatcttggaccatatatatgcctatactgcaacactctttttgttttcgtcaaaaaaattgatctgatgtactagtgatcgggcattcaccgttataaattactcctcgcctcaaaccaccgaggtggtactaaactttgccacaatatacttctgctgctggctgttgccgatctgctgctgctcgcgaaatgggccaaggcccaatgcccgctgctgcaccactactgctcctgctgctgcaattgatgtttgctgcctgggaaaaagtccactttgactcccttaaatataggtaaaatctaattcgtacccctcaactggaaaaccgggtaggacgactcccccaactattgtaaccggtgcaatttgactccctcggcggtttcggatagcggttttgctgacgtggcgctgacgtggcgaaattgacccagtcttcgtcccacgtggcattcgaattaaaccaatatatgtgggacccatctgtcattcacagaaaaaaaaatatattgtgggacccactgacatgtggggcccacatgtcatcatctctctctatctcttcccttcatcggtttgcagggacgggagctagacaagcggcggcaggcaggcaggcgacactagggcggcggcggcggtcgagggagtggacggcggcggggccagctcttcctcctccctctctctccctcatctctttctcccccgtttgtcttcacaggagcaggggccacataggcattggcggcggcgacggacgggggtcgggttggcggcagcgacgaacgggggtcgggttggcagtgacggcgggccggtctccatcgcgccatcgccatctcgtcgctggaatcgtgcttggcggcggcaagaacctccggggtgaatggcgacggcttgatccaccgatctaataaacatgtatgtgctctgatgttattagtgaggtccctagggtggttcatgcgcaaggaattgacgcgagactcactggagcggcgggaatcgaagatttacgccggcggccggagttggagaagacgaagtcgatctccctcctcggtgcgccattctccgggatttttgaggggaaacggagaggaggacgatgcgaagtcgacggcgcagtggcttggctccggccctcgcccgcccgtcctcccgccgccgccgccgccgccggctcccgcccaccgccgccgctgccgctggccctcgtcccactctcgtgaagagaaagagagggggaggatgaagaaggtagagaagagaggatgacatgtgggccccacatgtcagtgggtcccacaatataaatttttttaatgacagatgggacccacatatattttttaattctaatgccacataagcgccacgtgggacgaaaaccgggtcaacatcgccacgtcagcaaaaccgcccccgaaaccgccgagggagtcaaattgcaccggttacaatagttaggggagtcgttctacccggttttccagttgaggggtacgaattagattttgcctatatttaagggagtcaaattggactttttccttgctgcctgcacgctagctaggttggcccaccaaagcagcacaagcccactaactcagcagcttttatcttcttctccttttcttttctctaattatcgtggggcgtcatacatatcttctcttttatcatcctctgcttgataaattcacacagtcatttattatttgccactgattttaatggaatgatgagtagcaaacaaaagaacagtaaaatttcagtggcattgagaaattcagctccctagtgtttggcgcagcagcaagtggaagtggttcttgactgcttgtgggtgctgtacatagtaacatgggtaatttaactatctttgagaaggtatgtaaatcttggtacaggtaacaaaatttttaggtactttctcaagtagaaagtaccgtaaaatttctttagaaatattatataggatgggggatgaatgcattgtaaaagtcaaactattgcaagacgtagataatgaagagaaaagatacgataaaacattctgtgaccttgttgatgcgctgcattgtaatcagaatgatttggtggttgttctgcttcttgcattggtacaaatggttccccatgaacacctgtattctcaaaaatattaggcttatagttatataatatgagttaagcgataaattaagagagtgacttctataaactttttgggtttatcccgtcaagaaatcaggtataaagagcagtttatgggagagcttaccatcactgacagataggtcattctcagagtcagcaagcaaaggatttgatccgccacctcctggaactggaatacgtgcagcagtgttgcagttttcaagtgaaggacatgtttgagagacgtgagtaagcccggggataaaattattgactgttacaaaaaaattgtaaatgtcaaaactattttaagatgtaaatagaagaaaaaagctatgataaaacactttgtgaccttgatatgctgcattgtgattagaaggatttggcggtggtgctgcgtcttgcattgacaaagataggtcttcagaaacatttctattaggggaaattttagtaggggcgccattttcattcattatgtagtcaaatggaatgctctctaatgcattgtatgcttcctttctctgactatctactatggcctgcaaccaaataacatcaggacagagttaaccgcaattgtagccagagcaactgtagggtaagatttagagtttaacataaaccttttgatatcgattgaaattctcctttgcagtgtacttgccattaaattctgctcccacaatatcatgtacgcaattgaagaagatcacatcattaatttggttacctacaaccttgtatgctttcaggtaatgattttctttgagatcacactccctggcatgctcgataatggttttccagtctttatgatcttcctttatacctagtaacttcatgccaatgaataacaattaacaagtgtataaattactctattgacaaaaatatatacataggacctacagggtattcgcatggttatctgaaaacaagttttttttttctttttctaattaagcatggaattttagttgttcgcaaagctatattgaaggagacggggtactttttgattatggtttaatattaatcatattaattaataattttatgtgaggatgtctatatactaccagcacaaaaatacttccgcataggaaaacttgtcctctttgtaatatatatggataattttatcatatttgagaaggtattgagaggcatcatattttctagtgtaaaacttaataccaaaatttttagcgtaaaatcttagtatcagcaggcactttcttaaaaactgtaaaatttttcaatatatataagtagaaaaggttgtagatctaacatttctttaaaagagtagatgcattagattccgactataatataagaatgcagagaaacataaaatgggatatttacatcattgagctcttcaggatttttgttgtaagcccttagaaaatgcccgacagtcgtgatgttctatgatcggagcttcgggtagtatattcctttctttgcaattttcttcagtctatatatctcatcatcgaattttggggcgttactttttgcatttgctgcaagaaaaaaaatatgtagctgaagatatatatactactataataagaattaaaggtgtttaacaccagttataaacttataataacacgtggatcagtggaatcttttgctacgcagtgaccttttaagattggtgttcccatgatctatactttctataaagttacaacccactgaatctaaaacttaacatgcaaaccatgccacatcgttattcactaggaataattacatatcaaatctcatacgagcatgcaacattatttataatttattgaattctacaaatcaacatgtaagtatatccaattaacacagctcacatcattttcacaatatatcaacatatctatccattatttttataatatttaatatataattatcaatatattccacatcaaaaatttttacctagagatactttctcaataatcgtaaaatttctcaaaaaacttacgcttgtttcggtttgtttgcacaacgacaggacccatgaatgcttcttgaacccgatggcctccagtggcctcgttcctattaactcttgctgcaatggtgaaggttcttctcaagctcccttccctaaactggattccagggaaggagcaagttccctcgacaagcctgcgagcaacaactcctttcaatacagaaatatgtccatctcgggtcttcacttccttttcgtccaactgctccgtggtgcagttaccaacgacgtcgcaagcgaaatcgtcccgtagaaccaaaagctcgatttttgctgaagagagtggaccggatttgatcacatttccatcggagttgatcatccgaacctccagttttatttgacagccggtgaaaaggggactctccaggttggaagtaaattggagacggtagtcgtctgaagccatttgtctgcatgcggagcataaaataataaggatggaaagtaatcaaagtgagatatatatgtaaatttaactcatctatatgccacatctactttaaacatgagtagtaagacatgatttctaattaatgcattcatcctcctttttcctctaaaaaaaccgctaactctaaaaacccaatcatcatgcatggaaaaccagcatagaaaaaaaactgaatcacttttctatctcctaatcctgttgccaataaagtgtaactagtgtcaataaagttgatggaaaagattttgtggttgctaagaaaagattgtagtctatgaaattaagaaaggaaagtatgtatgtaacccctacataacggaaccttttaacaaaacccttcatcagttaaaagggtaataaaaaatctgaccaaaacatatgggattatccaattcgacaattatttgatcccaactgaaaagtgagagaccatcggattcaaaaagcgttttagggcaagatgatgagacaacttaaattgaaagagggaaagcatgcaaggtactccaccttggaagatttgaaccggtatgtatgaatcgtcctctcaagccccgatggacgtagaatctgctaggatgtaatgacttaattaaggaagagatcttgcatgttcgagcacaacgtagtactaatacttaaagcaaatctgaaagggcgcgcatacttactctagagatcaataatgtttgaagtgatgttgcaacataggagtatatatatattattagcttccgaggggagaagcaggcggatttaaaggaggagaaaccgcgtattcataaccttattaggtttttctcatcaccttccggtagttttccaggcattttcgtggaaggcaaccaaccgcgacgatatatatattaattggtacagataagtatcgatcgcgagtcgcgactgctcacgcaatatagtgctgtaagttgttaaggaaaaggacacgcgactacaagtggtaacgcttcaggcctaaacagctatacgcaaacgtacttacaaaaataaagcatcatgtcttcctcagacgtagcttcgttgaaaaaaaagatgtgtgcactagtaaacagtaaacatgctaacagagccgagcatcattccactagtaattttaaaacctttgatggcttatatcttttaaacaatatattgtttttaagatctgattaaaccaacgtactctactgaaaatatatgacaaaacgagtccaatattgaatatattcagaatatttacttgtgtagcagtgttgttaattcaaaatctatgatgaagagttaattctctctaccagtgcagttatttctaacaccataaaatgctagttccattttttcagttactttcttataggaatgtagcaacttctaatcctttcttcctatatagttggtacccactacaagtcatttatgctataaagctcaaattctatgaggccacatcatcaagattatattgaccattagatcatctcgcgtctatgcaaatcaaccgttagatcaagttcttgtcattcgatggcatctgagaggaccaatgcttgaccaatgctttttatcttcctcttaattacctcatgcatcattatatcttcctttatcactaaccactaatacatctcccacccgaaagcctacaccactatatttgtgtgtacctctttctcattccttttaatttttctaatgcatctactagccatatctaggttgatccaatggattttcttggaatatttatgcttgaacgtgcttcctcaatcatctaaggaggaaatgtcaatggtccaatgaaatttggtttgtcactgtcatagatgacatcagaaatttgtttgtacagattacaacattcgatgatctttaccaattgcaaggatgtttatctcctctggtgattggtttttggtactctatcatgatcttgcttctttttatatctgatttcttcgttcatcaccaagcttcatatgctaatgtaacacaactatggtaacttcaatttttggtaactttaagtattgagggattggtccactctcacatttgactatctacatttgattaaaaggctatgccatatctttgtgcttttcataccgataatcactaaatttgtttctccgtagttcctcccatttacttataggtgaacatttttcttgaaattactagattcatgcacccaatagttgttttttttaagatcatataccaacatatgcatgcagctttatccatattttctctttgttttctcgcaaaaagaaatattttattagttgtttaaaatatctgaatgagatgctaagtcaatttagtacataataaaaatagtgtcctctttgcttaccgttcatggttcttcgaattgggagtatctcaattggaatcatgtcatttctattcatatagcaatataatgtaaagatcgaacgttcaaccatgttgatcatgcaattttgataaatttacaactatttgttcccttctgtgtaatgataatataccaatagtcaaaagttctagaattacatcttccaaattcacgatatagctatcccgcagcaatgcgcggggtatcaactagtattataaagagttacttctaatactgtgaatagttacttctattttttttcgtgtgcggatctcccgcccatctgcaccgaagtgtctgcaaaaatctgatttttttcgtgcgggtctatttctcgcgtgcgggtggcttatgttgcctgcactaaaaaacctcacaaaaaagaactccaaaccctaacccgccgccgggggagcatgaggccgcgctgccgctgcccgccgccgctctcggccggggttagccgtcgtcggccgccccgtgcccgtcgcccgccgagcctgccgccgcccgtgagggacgagagacgagaaagagagatagaagaaatgatgataaaaaaggagacttagtcgagcttgacgagcgtaggggaatcacgctcattgctccaaatgaaacgatgaccgtggagcggtgactcccaactcaacaataagtagatggaagcggctcatcatgcgccaattgaggttcatcctgttcttgtattgagcctcaataattaaattgaaatcgcatgcgaggacccacggtcctatgcgagaagagcacaatgaccagagctcgtcaaggaaccgaagtttctccgcatcctcctttggttcatacactttggagagccaccagggagtatcatcggagtggtgtcgaaccagtgctgttaaagagaaatcaacgaggtgaacatccgtaactattgatgtggaaacacggcggcctgggagatctgcttaactccagtgcaggtccaaggctagcctcgagtgtgtccagggcgtgctagctgatttgatcctgcaatcagcaagaaaaaataagggcagaatcagtcagccgatagccgatcggccgaaatgccaatagagtattgttggtggtcttagccgatggagtcagaccaaatcggctatggattgagtatatcaaagaatattaagctctaaacatgcctaatcggctgtaataccatctatcaagtttaataaattggtttaagacaatattatgaaaataatagatgtgacaatgtttagagcaagagagataatgcactagctaatactctagtacaaatctatataaatttactctaaatagattgatccatataaacacatcaaatagaaataaggcatgagggtgcaaggatctagctgatactgactaaaacttgatatgcttatataaaacgatctatctatataagtggcgaatatacatgaaacaggtattgaaacatgcatattaggtatgatcagctgaaaccccgatatactatcctcattatgcctaattgcaggctagtttgcacggttcaaagcacgactagggatgatgcatctcaaagtatgaaaagaaacatgcagtctagataatcaagcaattaaacacttttcaggatgatagatgccttagctaatctaatctagcaagacaatttagccaaaaccagcataaatcctaaagcgagaagcagccgatagagctaaattgagaagctaataatagattaactaaaacatatgaagcaatgactcacgatatcgagcctaacacgtctaaagcgacattttagcctcgatagaacgggccattgagatgggttatctcttgcgaagaactcgccaaaaacgagaaaagtaaaagggtggcgatgcaccgaagttgtattggattggcccccatattataatgctatggggttcatatttataccccgagtacaaacttagtctattatggacacgactcaaacctttctaaaattaaggtacaaacaagaccatatacgacggtctcttgccaaatatctaacaaacctactcaatatcctaactaatagatacaattgccttatccgagctctatctctaactggcaatgatgtttatcccaatctaggcccaagtcgagcccaagtcatgttgtatcggccgtatcggccatcagacttctcaacttgttcagtcttcaacttctatttccagccgatacagtatccagccgatgcgcaatccaatactgagtccaactcgattcaacaccaaatctgtttcaatcttccttcttcttctctgaatttgatgcaaaattccgttgttaacagtaatagaccagacaactttccgctaggcaagtaacatcccccacctcagaccaacaacagggcaaaaagtaatattcaaagttcaggcttaaggtgaacaggcaaaaagtatccactaccacggattgatgatctttttgatcaactcaaaggagctaaggtgttctctaagatttaccttcgatcaggctaccaccaactgaaaattaggaccggggatatacccaagaccgcgttctcaacacgctatggattgtatgagttcacagtaatgtcgtttgggttaaccaacgccccggcatactttatgaatcttatgaacaaagtgttcatggattacttggacaaatttgtggtagtattcatcgatgatatcttaatctactccaaagacgaggaagagcatgcggagcacttgcagttggtactcgagaaacttcggaagcataaattatatgcaaagtttagtaaatgtgagttctggttaaaagaagtcacttttctaggccacgtaatctcagccggtggagtagcagtggatcctgccaaagttgaggccgttacggaatggaaggcacccaaatctgtgactgagattcggagttttctaggtttggccggatactatcgaaggttcattgaaggattctctaagatagctcgaccaatgacacaactactcaagaaggaaaagaagtttgtgtggtcagaacagtgccaggaaagctttgagcagctcaaagaaaagctgacctctgcgcctattctagttctcccaaacaatgggaaagactttgttatatattgtgatgcatcaaggcaaggactaggaggggtactcatgcag

SEQ ID NO: 70623 - DNA, 5395 bp, Oryza sativa
aggtgcccaaaccacctttaggatgctcctgttctgtgtgtatagccatcgtctttctttctatggcgattgaagagtgttgcaagtgcatatatcgctagggcatcgctgctgaggtatgcaagccagataaagtatctcaggtagaatttcataggaatcttacgccgaggagacatgatgaggaggatgtactgaacaacgaggctgctgagggcgagtatgcgcagctgccactcctcccaccgttgcagagcacttgagatacccatcctcttcttctcctcctcctagtctctttgtctatgtgtctgtcttgtatactcggtggaggttccattcaggagtaataacaactagtgcatcaataaaaatgcaagatgcacaatcgttgtgtggcgcccctaatattccaacgatccggcttttagatagattaatatgtacgggaatatcactgagtagtggcatgaaaagcacacagacactttctgtcaatcgtatatgtgtagatagttatatacttatatattactcccccggtttacaatttgttgtcacttttgatcgcattatttgcacacaaatacttgccgagtcatgcttcctgatacatgttttcctattttcccatattaataacccttattactattttctccaccactggctattttgtggtctagaattatacgtttaaatttttttgaagggtaatatatattatattttcacatgaaaacaaatgtacgtagatatacatgctatggttaaaagtgacaagatataacgaagtagcctgatgaatcctgtttttcttgacttgaccaaatgttttgagcactcctctttaaaagttcttcctttatataattatatgtgatttccacctagtggccagcagcagcgaaaatgctccaatgtgggcgcccgatctgaccccaaaaatcggacccttgcacccgcacgagccaattgtttttttttttttttttttttttttgagaaagaggaggcagagccctctcccattttcattaaagaaaacgattacaaggtccataaaatctgttaactttgatcatcttataaacaaacacaaaacacctacaagaatccttagttcttcaaaaaaagctagtaaaactttctcacatctatttatctattatattaataagacagctcaaaaaaagacaccacgtttatcgtggaggctagaaattctcacgttaatcgaaaaaaatataaattatttacaccgttggattgtaagaggcatagatttcaatgtgtgagatttaacacaaacttgacatgttaactgcattagaatcaatctctaaccaggacctttacatgcaaacggactcaaaatagttttgtccaatttcctaaacttaagttaggttctagattagttaggctataatgtatagtagcaacggaaatctacagcagcgggtcgagccccgcggctgcacgatgagcaggaattggacgatgcacgttaacaaacagaaggaacgatggcatgtgcacagcagctagccaggtgcgcaccttaagcgatacaattaaaaataaaatttagaataaaaatgtaataccagtaataaatatgtaaatattctttgccaaatatgtatatttatctatatatattattaagaaacatagaaatctttattattaagacaactcgaaaagaatgtgccatatttattctaaaggatataaattatcacgttaatcgaacaataaattccaagccgttagactgtggtggaaccaaattagaatggtgaagattgataacagaaatatatgtaatataagtgtatctttagaactaaacaatggtatatagaggagtaagtgacagcatttgatgaaacttctaaatattataaaaatgaaacgaaacaagataataaactctaaaaagtataaggtccaatttttaaaggtttgggactttagaaagtaaaaaaaacaatgataataaagttccaatttaaatcacaatgataataaagagaggagggagcatgcgagccatagaatagtacaatggcaaagccgataatggtttggtgggacttatagaaagtaaaaaaatgaactcaaacaataattatgtttgatttttagaatcctaatgacaataaagagaggaggtagcagatgggccgtagaagagttcagtggtagcgtttgatgagactttaaaaatataaaaatgaactcaacgagaaaataaactctgaaaacaaccaggtcctatttttaaagattcggaacttctaagaagtaaaaaaaaccaatgataataatgttcgattttaaaatctcaacgacaataaagaggggggcagcgggtgggccgtagaagagtacagtggcaaagccgctaacggtttggcgggacttctagaaagtaaaaaatgaacccaaacaataattatgttcgattttaaaaatcccaataacaataaagaaaggaggcaacggatggacattagaggagtcgagtggcagtgtttgatgggatttctaaaaattataaaaacgaaacccactaagccaataaactctaaaaattataacatcaaaattttaaagtttccaaggagaatgaataggaaaagtgatagatcgagcaagcaaataaagaatagggtaacttttaaagactataatattaaacacgaggatgatatggtttgatttttaaaagttttaaaataatgagataactattcaataaaatttaagtaaaatcatattaaaaatagataatttcatatggatgctagccgcgcaattgcgcgggccacccagctagttaaaactaaaaacatctcgaaacaaagaccacagcttctcccctgcatcccaaactgtgtttttctccataggtacaagaccctttcaagatttcgtgccgcaagcgccgtgtcgtccatcccatgccgcaagcgcaggcctccacggcgtagcggccaacgcaccggctctatccccggtctctcctgatctcctcgcctttcctcgtcccacttggagaagctcacgtcagccgtcctcaccgcacagggagccaccgcagagcaacagcactcggacccagccgcccggtcaattggtacaccaccatccatccccgtgagcgagcccatcccatcatcccacctcgccaaggcgccacgtgtgtttccatttccatattttttgccatttctatttttgtttcggtcgattaccaatttcacatggctcggccggtagaaagtcgaaaacaaacaccggtcggctcacccctgactaggcttccttatttctcgatcctatcttatctctttcccatgtatttctatattattcaacatcatatcagagcggatcatctagtcaactctctcacgcttccgccgccattgtccccgagtgggttctaatctcctggggacagccatccccactcgtttttttcttcatcgatgtcgttctcgtcctagagagatcaatctcctggtgctgtgcgtcgtcgtcttcgtgtcgttgaatcagcagcaacagcaccagcgacctccacacgtgcccggccagtcccttcatagacactgttccgttatcaaggacatgtcgacgctggtgccgagtcgctgctgccctggaacccctcgaccccgacctcatgccgtcacgggcggatcttgtcagccctcgccaaccatcgatcccgccgcccgatctggaggacgagcgcgccacctccggctcgtgcagcccaggttgtcgccaacacgctgccatcgactcctctgcagtcatcaccgccactcttaattaccaccactagccctcacctggattccaccggtcgagcacgcctgccgggccgcctcctttatcgacttcagccgtgatctgctctgcttggcgccctccaccagcccccacaactctgggatcctctactccatggccactgacttctcgctcgcaactatcaaacctagcaaacttatatcaaggtgggctatatatggctttcattttggcataaaagcaagttttagttcacaatcttttgcaaagggattttataaagcaattcaaaccatgaatatgaatatatcacaatatttataattgtaataacataacacttgttgtcctccatggcaacaagtctcatgatcatcgtcatagtcaccaaaactcaacacaaatcatcattccaatgccccattttcataaacacatttataaatcaagtactcatgacactccaccaagtcgctcatgactctgcctatttggtacaactttaccaacatgatgtgtatcactctagtctgtccggtacctgttggtaccaccgcacaatacacgttgaatgtggtctagaggtcacaacacaacctttatattatctaatgcctagccttgcaccagcacgatgcatgttactccacattacacctagaatgtagtgtcgctaggtggtgggtccatgccttgaacctaacaacgtaggcacaaccaacgtggtcccctacgaagcacaacaccattgtattcgataaacttagacgcccatgccgtgaggcggaatagttagtcgtcccctcccccgaacacacacacgaatgaatcatccgcacatcaaacacacatacacacatggatagctcctctagacaggtcattaaataacttaattggctaaggccaccccataaatagaacttgtggatgcacgatatactttaattggtgacacgaagtttagtccttaacagaggaacttgccttattctttggataaatcggacaactcctaaatctctccttcaccactaacgcaattaatctatacaaaatgacatgatatgcaaataccgagagatgcaaaaaaaatccaaaatgctctaaaatgcatgatttgtgcgcagtgggttggtactgacctatgatgaatttaagtgagagaatttctattttatcacttttcttttgggagttatgaattttataattatgctctattaaattttttatgcagtttagaatcaagtttttttaagtttcgggtcactgcagtatagagtgtattcccttagagtttaacaaggtcactgcagtatagagtatgttcccttagagtttaacaagatttatttcacaatttttagagatagcatgaatttattagagatattattagaagcacaacacctcctaatattctgagcgcctaattgtgtccacgtaggacacgcgtacccatgttcttatggacaaggcactattgacagtcgttatcaatcagtttcgactatcaatattacctaaatagagaagaactagtgatgcttgcaatgca

SEQ ID NO: 70624 - DNA, 8550 bp, Oryza sativa
cggccgaattgatagaggggaaacactctccgggatctcctctaccttttctcctttggaatcatcggctaaatcggtttggaaatcgagggattcgagttcgtctcggattcgtttttcccgaaccttccttcctcatcgccggccgcagtggcccttcgccttcgcctccgagcccctttaaaagtttccccgagctcttctctacccaccgccaccctcgccttcgcctctcgtcgtcggaatcgcgctagcgccgtgagccctagcttcgccgccgccgccgccgctccagccgtgcgccgccgtcgttccagccgtcgccgtcgctcgggaaggccgccgtcgtgttcgccgtcgcgtcgccgtcctcgttcgccccttcgccgccgccgaagaccgccggagcgtcatcgccgtcgtcgacccgaagagcttcgccgcttcttcctcgtcgccgtcgccgtccgttgatcttccgccgtcgttttggtcgccggtgagttcgccgtgccgcccgcttcgtcctggtgctttccgttttcgtcctcgcgccgccgttcgccggcgagcgtgcgccgcccgagccgtccgctccgccgagccgccgccgccgtcggtgacatcattgctgacgtcatcaaggccgtccgccgtgaaccgccgtggacccgatcgatctcggccgtccgtttggattggatcgaatctcggccgtccgttcgcgtgaaccgccgcccgtgcgcccggtccaccgaaaccctagcccgctgacgcaataaaccttcttttccttttcaaaaataattcaatattgcgtcataattcaatttaaaccgatttaagtgttttaatccgatttaatctttaaaaattcataactaattcatcttagctccgatttagttggttcaagtctctaattgtttctaaaattgagatctacatgttaaaaatatccacatgtactgttcatgcttgtttatgtgctgttttggtgattttgttcttttctgcttagattccgtcgtttccggagagtccgttttcgccggagaagagtttgaagagttccaaggccagcaaggcaagtcacacagatcccaaacaaccctttgagcatgttgatcatatttaaagctattgtttctattcaaatattgcatttattttcgaatgtcattgggtggaattaacctattgtttgttatagcccttttgttcttgattactttattccttgataccttgggttattataacttgactagttgggctttatttattggttcaactagatattagatataattgctcagccctgcttagaaacattagcacactattgggataacttatgactcactgttatttaatgatggcttaatgatagttcacgatggtcaatcgtgattggttaattaattaacgtgccaactaaaacctgataatggtgggttgtgagcacatggtttttgatggttgcgctcatgacaattaacgaccggtttgcgagctactgttgtgaaacatttaccgtaccaaccacaagccagcgtgggcaacggctttatcttttgtatagcatgaacattatagtgtgccagactgtgaagaggcgagaagtccatgggggtcgctggggagtccatgcctctggttgtagagggggtgattatgatccacgaatggtgcactgtggtgagttgtgttatgtagggggtaatgtcacagcctctattcgggtactttccagtatcgcgacgcatggttgacatgatgttgaggttgtgtcttgtgggtatagtggtacacctctggccagagtaaaactattcgaatagccgtgcccgcggttatgggcgagttgagcaatgtttttcgtgattagtctcacacctctcacaataattattgatgattaactggtaataatttgcttagctcctggtttggagttagatttgtacagccgggtacggttgttcaggatggttgggcctgtgcagcatgggtgtgctgttcagtgttgattaaaatttctgattaattactctactgttttacttctcttaaatgttttgctaaatgctgcttttgcaaatgagcctatattttgccatccattggaatccttgtgcacttgcatatttgctgtgtggcttgttgagtatgtcatatgctcattcttgcaataataaatcaacctcagttgaagaaaaaggatccagaaggagaagacgtttggcttataccccagttgagctgcctgtgggagtggagccggagcttcgctagattttattttttccgctgcagttttcttcttggtgaggactaagtgcctcataataagtatttatcgttttagtttattatgatggatttgtatattaaattgtcagtttgtgtacctcggctgattcctggacgaggattttatgcacaaataagttcggaaattattagtgaatttccgggcgtgacaatggagtacgggtgaagtgtacatccactgcagtgtgagtaaaccgaatatattcgaatagccgtgctcacggttattgagcaccgggacatgtattacacttggctagactctgaactcttaaaatgatgggtgggatatgcataatgattttttgactagtggatcaacttctcgagaggcgagaaggggtagaccccagaaaaccatgacgaccagtggcgagaagctatccttgggagcacaatggatggtggacagaaccatcgctgtttaatgaactatggagataaaatttgatcagttatgctaggtcttaagcttgtgaaaagaattgcaaaattgactttatgcaaataaaccattagcctttcattgaatatcctctatcatatgcatcgttgttgtgggggcttgctgagtacggttggtactcactcttgctatttacaaatttcatcagaagccggtgatgaagtctcggatgacccacatgcttactaccaggagggtgaagaagatggcggcgcttaataggtcttagttatggtcgttgcctgtggcaatggcgtcgccgctgccttgattccgatgcttatctatttctgcttttggtatgtattccggaccgtttggtcctatgttctaagactccctgcgggtctatgatgtaataaatcgcgctagacaatctatgtatgcgcaattgatattccagcaatgtaatcgtgaataccagactacttgatccagggaaatggtactattaacacgagagattcctgttataaaaacaggggtctacactcgtgcaagcgggggcagctccggtggcggctagcgcaggtgatggctcagcgacggaggagggggatcatgaaggtggtggcaactacccgggaaggcgacgacaaggagaacagcttcaccgccgggccactgggggcacggatcggccaccaccgggctcctcctcccttgtcccaggtctagtaagcagtggtgttaacaataaaatttggtaagccccgaagagaattctcacatcgccaatagtcgaattcatgctatattcggttaaggaaattaatctattaaaggaatcttatccagaagtgattgacttcaaggaggatgtggtatgcaagttatctattaattaggaatagtttgttagtttccttttatctttagggaagtgcgtttagtgtcctataaggactttatgttttccttttatttttaggaaagtttctttcttgtcttacaaggactagtatctccccatgggtataaatatgtacactcggggtcatcgtaaactatctctcgatcaataatactctcggcgcatcgccaccctctttaccgaggttttccttatcattcggcggaacttggcacctgatgtggggttgcataagctttcgatctccggcgaaggggtaagtcctacgttccaccggccctggcaactatattggcttcatcggcgtcgttcaaggctgcctcagtacgttcgatctcttggattgctctggttcggtcgatatatttacctacttatttatcatatgtctctattaatctagtcttagcatatcaatttagctctatcggccgcttctcgctttagggtttccgctggtatcggctaaatcgtgttgctagattagattagcttagacatccaccaccctgaaaatcagttaacggcttgattgtctagatattatgtttatttttatacttagtgctgcatcagttaagtttgatctactaagtcgtgtttagaaccataatctctagcctgtttcttgactgccaataacggtttcatcgggattttagccgatgaggtatctagacgttgcatcggcctacaaggattgcatataagttggatttagccgatgacatccaaggtttttactgtttatctaatcttgtggattttatgacatcggacttccagccaatgtatgctttaaccttcagatcattgcttagtctatcatatcattattagccgattgtttctactggatattattattgttatattatatcactatcagccgatcatctttatttatatcaagtgtcatattctatatcaaacatatagccgattgttcaaaaccctattgctatcgactggtatcagtatcggctggaatcactccatcggcttgtcagccgatcggttatttgatctgctatttgtatatcttgtcagttgcaggattaaactggctggcacgtcagcatctcatcaacctttggatctgcactggagctaagcatatctcccaggcaagtgtgtgtttttcacgtcaacaggtgggtcggggcgtggaattatgcgggcagcaatgtctgcagcgaacacagcgggcgtcacacatcttctggctggcagtgcagatgcatagatttgctttgtgacttgttcttggatttgctttgcaattgtgctcattgatgtgtggatttgcattgtgacttgttcttggatttgcttaatgcaaggctgctgcatctgggcattttcaaattttgtttgaacatctttgctggcggtcagagcaaatgcgtgtgctttgttttcaactttttctaaaccaaaattgaactttgcaggcggccgtcgtaagacagatgtcactggaaacggattattgtcggcggcctgcggaacacaccgctaacaaaaactgattttcacttgcagcccacgtaacacagccgccagcgaaaacctattgtcgctggcggttcaaatcccatcaatgatgaactttgattttctctggcctttggtcgcaggcggctagcctaaccgccagcaaacgctgattttagccgccaggaaaaaaatgtgtttgtagtgaatgggaatttagcaaagactcctaataatcccttctttctatataaagctatgtgcactaaacacctaaagctcagcatgcaaacaatgtatttattagcactcctaaaacccagatgcaagcataccacatcaacccattaagcacacaaagctcaacgtgcaagcatatagtaattatatctacaatttatttcatttaaaactaaacatacacatgctaaaccatcattctcaaatcattttcataatatttgaatccaaataattttatcatttctccattagctaacatatatcctgcagcaaagcgcggggcatcatctagttatagtatggagtagtatatatagtacgtatagtatccaaacataaacgtaacataacaaagttatttgttaatgaaggtgggatgtaaaaaaactccatcactactacaacatctattttcgcaagatgacccccttactgtacatatggttctctgcagcctactgcgccttttcgccaaacctggtggttttcaccacttctaacaatcttcgcccgacgaaacaatatccatctccagtccaagggttcgatgacctttcctccaacggctagcatattttctttgctttgggtatgcctagtgaaacactgccatcaaataattattaccttttgcaactgtcaatgaaccaggtgtgtccctagttgtttgcagattgtcacagtgatcggatggcagcactttatgctgagattgctgctgaaccttagtctttggttgtataatccacgtttgctgatcggccgataaccgcgcatcctcccgccatgcggcacagccacgtggtgcgcggagagggggatggcgggagggcgcgggagagggggcacgtagcggttttttctattttttcagtattttttgttttatatatacatatatatatatatatgtatacaaactttgtatacgtgtatatatttttttatacgtcaaaactatatactgttggcaactttttatgacaagtcgacaagcacgatcgcaacacctaaacgccttgtggtgatatagagtcgccaaccacctcgatctagccaaagggccaaatcaagatgggattcgtagaaaaacagctaaccgggctagcgaagccgatttaaagatcaaaatcagcctctaggccgatttagatcgatatgaggataactacccgtctcgttgggcaaaacggaaggttttcaggacaaacctacaaagaggtgtcgcactctcgcagcggcggcggacggtttacggcgcaaactgacaaagatggactaaactagggtaaaatagaaaacatagtaaaagaacgattcaagtagattgtattcggggattttacaatgaaccggccttgtcccttaaataggggttggtcttgccctctacatgctcttctccacatccaactcgggatagaaaccaaagaaaacacgaaacctgccttcccgagtaaggaaacccgtcactttccaaactttggcaattttcccctatttcgtccataggtgccatatttgggtgtaaacacatgccccctgcctttttggtgaacagacgtgaacctaaaagcatagaacatgttatctccgggcgataatccaattaccggccataggacttcctaagcatcttgccaaatgctcgggaagtatttctttaagtatttcccattaattgatctctgaaaacaccgtcttgaagtgtcttcatctccctcaaagtcttcaaacgctcgtcgatgacatcttcaaaaattacttcccatcaaggtcttgtaatcttcaaccgacaagtcgccttgcttgaaataccgaagagagccaagatttacctcaactggcaaaacggcaatttcaacaatgttttgttactcgactcggcttatccattagcccgagcgtagtaaagagaagaactcaccaacttaatatcataagattcggcaaaacttctcacttccttggacataaaagaagctcctttaatgttttaggaataccgaatctatgaacgatatgcttcaaaataaagtcaattacttccgcataagtaatattctcgagcggcacaacctcggcccacttagtgaagtaatccattgcaactagcacgaaccaatgccattttgatggcgaaggataaatttgaccaatgaaaaccaaagcccaacctcggaacggccatagtttaatgataggattcaatacagcggtaggcgttaattgaacattgccgatccgttaacaagcttcactctctctatagtatttgaaacaatcatcaattattgtcggccattcacccccccactctcttaagcaaccaatttatcttacgggccgattgatgaattccacaaatcccttcatgaacttctctcccagcaactttagattgatcattatctaagcatttcaacaatactccatctatttttcggcgatataatatttgaacatttgccgccgaatcttccgatcaatcttaagtgtaggatctttcaaatatctaatcaaaggaattcgccaagctatttctatctcatgggcacaaatgtccgaattcacaattaattcggccttttaatcaattgtaacgtgccccccagcctcctgtctgggttcggtcagaccggccacgcaatgccggtcagaccaccctgtctgcccggtcagaccggccatgcagagccgatcagaccgcgggtaccactggtcagaccggccgtgcaatgccagtcagaccacccctagtctatgactttgccaatttcgtccaaacttttgaaatcaagcatcggcctttagtatataattttttttttcacataatagctagatgcttggtatatcaaattattggaccaaaattccttctctatagacatatgaaaaattataacattcaactaatatgtctagatgaatactaattcaattggcttttgaaacaataatcatcatgacatcaaaacacttagccaattgaagcataatcaataatgaatcaccaaagtcatatgtgtcacatgcatatattccaataaactaaaaatgtaagtaatcggcttgagcatgtatgcaaaatattaacaatgccaatgttcctaaagaaaaccactctaga

SEQ ID NO: 70625 - DNA, 10796 bp, Oryza sativa
tttttaacatctataaaccttttaatataatcagcaacagattcattgtatttatgcctaactgatgttaaatcagacaacttaaacttagtttcattagcataaaaataatcatgaaattgttcttctaattgagcccaagtatgaatagaatttaaaagtatcactattagcctcaccacattgcgccagaaattgacctaaatgctcccatgtggtcttaccatcctcaccactaaacttggcaaattcgggaactctataatttcgaggaaacggcacattatcataataatcaggatatggctttttataagctctagcacgattcctagtttcaatcctgaatctattcctcataatatcactaatcatatcctccatgctattaggcccttgtggatttggtggtgggtttggtggcctaataggttgcgtttgcggcgcaatatgattatattggccttgcctagtatcgggaggatatcccctagaaacatcattataagcattaggaatatgtgggggaacttgaggattacttgtagcagtagatacaggaggatcaaatgttctaaagtggtacaaataactagcattagtcattggatctataccctgtattgggacaattgcgccggtctgaccggccgagggcccggtctgaccggtgtcattatgcgcggtcggaccggcctgagggccggtctgacctctggggtaatacccggtctgaccggccgtttggttggtcggaccgacggctatattgcggtctgaccggccgtcaggcccggtcggaccgaccgtgaacgccgtcccgtcggttttactacccattggatctataggagattgatcaacagtggtataggctttatcctttaatgtgtaatcatccataaaagaatctagcctactccttaaaaatccatcaatcttatccttaaacattacatctaatctatctttaaaattagccatagatgaatctattgtagatgcaatttgttgttggatagattgtgatacctcgtcattgcttaccacgtcgggagctagcttgggacgcggcccgggcttgatgatcacgccttgacgagtcctagtagtggctctcatcaacgcctcccgtgtgagctcgttgatgtactcctccatagctttacgatcttctccttcgaagtcatccaatgtgactggcatcacattagatggctccacctccgttttggatgatggcttcgtcatggcgaagtcgaagttgagttgacgatgaacggatctcttccccagcggagtcgccaaaaatcgtgttggcaactttttcgactagtcgacaagcacgatcgcaacacctaaacgctttgcggtgatatgtagtcgccatccacctcgatctagccaaagggccaaatcaacatgggttttgcaaaaagaaaagctaaatcggctagcggagccgatttagagatcaaaatcagcctctaggccgatttagatcgatatgaggataactacctgtctcgtaggcaaaacggaaggttttcaggacaaacctacaaagaggtgtcgcactctcgcagcggcggcggacggtttacggcgcaaaccgacaaagatggactaaaactagggtaaaatagaaaacatggtaaaagaacgattcaagtagattgtattcgggggttttacaatgaaccggccttgtcccttaaatagtggttggtcttgccctctacaggcccttctccacatccaactcgggatagaaaccaaaggaaacacgaaacctgtcttcccgagtaaggaaacccgagacccgacgaaaacagactcggacttggaccctgacggtctgaccgcccacatacctgcggtcagaccggccctactagccggtcagaccgcccacatacctgtggtctgaccggccctatgaaggaaacccgtcactttccaaactttgacgattttcccctatttcgtccatagatgccatatttgggtgtaaacatatacgtaaaaaaattgtttatagtatatacgtatgtatatttctacgtacgtataagtgtatgcaaagctcatacatagtatatatatacacgtatatacgtatagagaggagagcagaaagagaggggggggggggggactcatcgcgcaggcgcacgaccgcccgcgagcatgtgccacccgctgcataatcgacagtcaaataatggttgccattactattaatacaaacaggagaggctttgcctctctttctaaaaaaaaaaaagaaaagaaaataaaaaacaaacaaacaaaaaagaaaccggacatcgcagccagctaacagtacaaggaggaccattagttagctgcactactgcaagctttggtttgagtccaccacaagcaagagtgcagatgtcaaccaccaaatgctgagcagctatgagttaagctgtgacaccaggtgcaccttttcatcctgcagcaaattagttcatggtcacactgtagttgtatccaacttgcaatgctaatctgttcctggaggcagctaatcgttcagcagttgcaattaacaagattgccagtgtcgcccaagcctacaatttgccggtctttctagtttcttgcaactattggccaagccaaatgctgctgttgatatgtagaaagtcatctgctctatatgagttcgatatatcttcacacatattggtctaatatatagctgataagaacaatggtgcttgatcaaccacccttcatttagtgccctatagcttccatgggattcgattttattcattacaatgtcaaagggaacttgcttttatcgaacaagttgtttagtacgctgtgacatttcaaattatacgagagtactacttgaattggtagtgtagataaatatagtccttggattaaaaaaaaaaagaagatgaatgacttgatttaattctgctgctagtagaaatcactctaaaatttgtccacaaattaacactaaaaaggcatagtacaagtgccaaaacgttcctaagcagggctgctggtagaattaatcttttgaaagatttctgtgtagtaattaaacactacacgtctgcatacatgtcatcaacccatgtgtcgtccatgtgccctattttattgttctattaatgaactatcaaaatataggtatatataccaaaaaaattctatctttcttgacttacgtaaataacaatatagcaaatcgacttatgatgggcaacaaatcatctgctctattccattacaaattaaaactcgtgagagcttcagaaactacgtactgattgtccaaaaattctcagagattctatgcatgctccttctgcagtacaagtagaggataggcattagaggcatagggacattgattttgttacaaagcaaacagattgctctgctaagcctatctcatggtcaatagtgacacagaatggtatcaagcagatgccttcccatttctgaggcaaactcacctgcattacatgcaggcttcaactgaccgttatcagatggatgatcgtctagcttgatccaatgcgctcaactcagcaccaaattaatcaaaagcaacccgttcattcacacgaacaaagtctcctggaaactcgagctgatgatctgaaaaatagtacgcattatgcgattcaatcctaaacttgaacttgtaacctgtgcatgtgcttcacttttacatgtagcaggatgtacaaacttttaaacagcatgataaaagtataagtttgaatatcgcgtctcaaatcgcaggggatgcaatgtaccatcatggagagatctgaagttcaaaatctattttagcacaactatcactagaggtttcaagaaggggatacagcgagtagtatcctgatctgccttttgtaccaaggattgacaaaaatacaaaattcaactagtgctgtctggttttgaaattttaccaaaatatgcaaaactttgctatagtgtctatgttgtatactcgctccagcctcaaaaacatattgttctggaattttcagagtcaattttcaatatacaactttgactacctagttctttaccataaactagtaggaagcagacatccagtacgtagccagcaagggagaaaagctacgtggagtggagaccaggtgaatggacacggagaaaagctaccgtgaagtgaagaccaggcgaatggacactagcaaacaagctgcttccgacaatcacaaatatgcatggtaggatgtttctactcggtggggtgcctatgttgtatgtgccatacatacttaggaacgtatatatcacatcttatactatgattattgtcaattaatatattaaagctgcaaacttgtaagcaattattacttaggtcataaacatacaaatatatggttttcttttttggaaaaagtacaccaaaggtcccacaacgtgtcatcgagttacaaaatcgtcctccaaaaccagatatccagcgtcccttaactaaccaaaaccggtcctaataggtacttcggtggtttttaccccggttttatcatatgtggcggctgaatcagcgtgggacccacgtgtcaggctgccacgtcacatctctcttccttcagtgtactttttccttcacgggaaggaggagtcaaaagggtgggtcccacttcctttttctttcctttctagttttattttcttgtttttctctgtttcttctcttcgccgttttctctctctgccctttttttcctcctcacgcgcgagtagcagagggagggcgccggcaacgcaggtgatggccagcggcggtggggaagacggcaacatggaagggggagagcatggcagcgcggtcgcgcgtagggggagagaggctgcacggcgcggcagctcggcagcgttgcctggagcggtgtagagaggaggaatcggagcggcgccgagcagaggtggtagggaagggagtggcgccaggaggaggaggtccgggcgccaattggagggggcggccaacagtggcgtcggtgtcgcttgggcgatggccgggcacatcagtgcggcgcgatagtcggcgcccgaggggaaagggtggctaaacgacagcacccatctaggcgtgacgacggtttgggggtggatgaagacgacgacgatggcggctttagtggcggaggaggaggtggttgtggaggcggcgcttgtgtggctcggtcgcgctcgggggctgcactcggcaccctggcatgcggcccgtgcttagcacatcatcctcctcgtcgccattctctgtgctcatccaagcatcggcctcgcgtgtgcaatgccgaggactacggccgccgccgcgcccgggctacttcgtcacaggcgaggacgccgcctccttctcctgcctcccgggcctctctgaccctgagctcccttccttctcccccgtggtctccaccgctgccaccgttgtcgccggcgtggcgccgccctcctcctctcctaccttgccccagcgacctcctctccgcccaccagcgaggagaaaagagagagaaaggggagagatgacatggcaacctgacatgtggggtccacgtgggtctcacgctgactcagccgccacgtaggacaaaaccagggttgaaaccactgaaggacctattgtgaccagatatccggttttgcggttgggggacgatttcgtaactcgatgacaagttgagggcttctactcccttagtcccaaaatattagggattataatgaatctggacactagtaacgccaatgattattaatacaatgctattatgtctatcgtgattattttgggcattatatgcttgctgtttgacccaagatactatgacattttcattgatgtttttgttcttttaataattagtagaaaatgaacacaaatgttggtgcgtcacactggtggagaaaccctttgaagtcccggttcgtaacccccttttagtcccggtttccaaaccgggagtaccaatccgggactaaagatcgctatctttagtcccgggtgaaataaccgggactaaagatcgatctttagtcccggttggtaacaccaaccgggactaaagatggctcagccacgtggccggctgagctgacctttttttttttgcatggccctgttgctgcatggtttatatatatatatatatatatatatatatatatatatatatatataaaccatgcatatatatgtttcaatacatatatatgcatacatatatatatgtatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgctgcgataaattctttgtgtgtggtcaggttatccctcatgcgaataaactatatgaatgtatgaaattgattagtaattaaacaagaaatcgttacgtaataaaattttgaatttatttgtacgtacatcgagctctcttgtggtgatgatttggtctgcaaggcagtggcaatactcacacacgtagtagccgcacaagttagttccctgcttttgctttgcgcactacaaataaatgacaaattaacggcgtgagatctaattaatatatagttgtatgtattaatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctttgtttcttgtggatattggtcgagcattgcgacgtttactttccgagggtcgatgaatccagtatcgaaaaccctccgccgtcgggccctttgaatctccattccacaacgataaaagggagtatattattttctatagtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtctgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctacaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccctgggtccttgttcttggcggcgtcaactttcgccttcttcgttgcccttgtgtgggcaggcgatggagctggggggggcccttgactttgaaggtgccggaagaggagcttgcggaggagtaggtgtaggagcccgaggaggagtcggtgcaggatcctgaggaggagtcggtgctggcggagcatgaggaggagacggtgcaggatcttgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaagtcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttcaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcatcctggatgctctggagtctgcagggcgagtgtcagctcgtccctatctctgtcgggtcagaacgtgccctgagaggaggcttccactgcatctgttagtcgtcgcgcagcctctcgtatctgaacgccgaagaccagtgagccatcagctgggttgagcgttccaccgtgagcatagtaccagaacttcgatcgttccggccaattggctgttgccggttcgatacccctctcaatcaagctagcctccatctcctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccctactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcatgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaagtaatcttatattaaaactcaaataatattacatgctaagactaaaatagtcatgtatgctaagtgtttcgtgcgtatatgctaagtctaattaagactacaatagtcaattgctacttgtcgcaccacttccgtagtcaataattatatactaagtctaattacaaataaagtaatcttatattaaaactcaaataatattacatgctaagactaaaatagtcatgtatgctaagtgtttcgtgcgtatatgctaagtctaattaagactacaatagtcaattgctacttgtcgcaccacttccgtagtcaataattacatactaagtctaattacaaataaagtaatcttatattaaaactcaaataatattagaacactacacaatcttatatgataagtctaattacagg

SEQ ID NO: 70626 - DNA, 146667 bp, Oryza sativa
  unsure (1)..(146667): unsure at all n locations
ctccccctagccacctcagcatcgccccgccacgtcggcagggggacggcgccaaagaggctggcgccgtcctgttgaacgacggcgccagccactctggcgccccaaaaaggaccatttttgggataagtttttctaggggtctacttgcgaaataagttttttaaaaggaccaaaatgtgaaaaatccagcacctctctccatgcaattatgtaagagtagttagctgcacctttctgacagatccataccaagcggccagctaaccatcggttgggccccaagtgaaattatcacatagaatctgcaaggctagtgacttttacttgatgtaaaagaaaaaaaagtcttcctcggatgcgaggtgagcttcttgcttgcttctgcggacatatttatgtcgctcagggcagttttcttcagagagaatggcctgcattttattgcccatggttagttatgtcagtcacctgtccagtgccatgccactgcctgactggcataccagtagacagtagtaggagtagtagcctttgatcataccaccagtactagtagacagcagtactgtactcctactccctatgtgcctccctccgtcccagatattttgattttttctcgcactaccattcgtcttatttaaaaaaaataaagttattatttattttatttgtgacttactttatcatccagagtactttaagcacaatttttcgttttttatatttgcataaattttttaaataagacgagtggtcaaacgatacaaacagaaagtcgaattcccttatattatagtacggagggagtactggatgtggcacatcctattactacgaatatggacatacatctgtccagattcattgtactataatatataacatctatttctagatttactttttttttacggagggagtatgtgcttaagttaatgatctcttttgactactagctccaacctctcctattacaacttcccttgagagcaaggctaataatatagctgacttgttggctataaggttatttgcaacattctctcaacccactcatataatagttaactcgttataattaatacagggaccacttgtctctctcacatagtttcttggttcttgtgtccaagccggctgtaagtttacagcccgcttctcctctctctcctccacctcagtatttagtcggtttaaagcctcctattatatttgctctaagaaatagaatggcacattgcatgataatacatgcatgacgctgttgctgctagcactctaagggcaagtactataaacctctacgcacttgcccctaggtgccatgcttaagctcacacgataatgtggatgagagatatgaaagaagagagagaacgagccacctcttatgcaaagagcaacttctacacaaactccaagagagatgagaacaagagaccaatgaattgataggaaacaaataaagtaaaattaatattgtgtattggggcaagtgtactagaggtaatttgttgtatatattgcctcttaattaatgagttgatgatgtggactaaattaagggtgacctccactgtaaaacctgactgctggttatcgtttgctactgccaactccctctgtccatttttttaaaactagtaacatcccaaaaagaacttaagcagaaagacaaaagataaaaatacccctaattaatagaaaaattatattggtggatgcgtatatgagagatatggaggaatgaaatttctcaatttacggaagaaggtaggagtttgttatttgggaaaaaagtttaaactaagttggaacggagtagtactcttcagttcaggaaaaatacatttgctagtgttgacgtataattgtgccgccacaccttaagcacgctatgtgcaacacggagacacacacgcgcagacacgccgccgtagggagtaggtagatgccgccgaacgaacagccgggaaggacctcgttaaggtgaacgtgcattggtttgtcctaaactcggcaggctagctaggacgccctctaacgtcgtagagatgagagacaacgagcaattaggggatttgaggagaatagactttgggataggtagcaagaaagagggagatgtagaatatagagggtttggataaataaattgattttgacgattgattgattgttatttcaatcgaccttaacccccttatatttatataggaggggtggacttacttcccagggtctttttcacatccaattaggtgtagaaatcaatcaaaactctaaaatctcaggcattagcagaaacccgagaaccaacaaatcggactcgagtcggactctgccggtctgactagctacatgccgccgatcagatcgtccccctgtcatcggtctgaccagcccgatgactgcgatcagaccggccttcgcgtggcaagtctgggttgtttttgaatttggctgtagtttctttttcatactctaggagtcaaatttggatattaacaatacaatttatgttcagagtaaaaacatttgccactattactggccaatgattgtcatgctgtgaaagtgttgatttctatcattctatggcaaagctttactactaataataatcagtctgaatctgcattctctctacgtccacgaccatgagcgaatagtacatgtgcctgtacttacctgacagagtagtcttgagttcttggccaccacatcagcttctttggtccccagcaggcagggatacagtagtacggcaatgtgtggaaagtggtggtaaacagcataggattttactgcaagcaccggcaaagataaacaagaagcatctgatctatataatgggatttgcattgtcattattacactagaaaattacagtacttctttacaaatgaaggtcagaaaaagatggcgacatgaaaagctcgcttgctccaattgtacgtccttttgagatgctctttctgcaagctctcttccaagcttactaagatctttatcgtaggcaaagacttgcgatcgatgtggatctgtctgtctgtctccctttgggcacttgtgatcagcttttcaagttcagacactgcaaatactatgtagcacacagaacaatggtcatgcactcttttgtctctactactatcttttgatccttctaatcgatcttacgtgcactctcaacattgccttttatgccgttccgcatgagacgattgctacactgagagcttagctaagtttaaagtgtgttcactgcgcttttgtgccaaaaaagcagctggaaaagcagcaacaactttgtcgtatgaattggatggaagtgggaaatataataaactacagggccacaaggttattcctcaatttcatcgtataatcagataggggtatatatactgcatcgacattgctattccctccgttttacaatgtaaaactttctagcattgtccacatacatatagatattaatgaatcaaacacatacatatgtctagattcattaacatctaaatgaatatggggaatgctagaaaatcaaatcttacattgtgaaacagaggaagtacctaaatatcacatcagatatacctgaagaatgtaatcagatattactgaactacacttcttttcagccacaccatgcatgtaaacactagaaaaattatgcgactgtaaaatctgaataactaatgacggatcgacaagctttaaaatgaatcatgtcaacagaacttagtctgagaggctgcagtttgctagtagcatgaaatcaagaactaacttatctgacaagagggagtatcaaattaacaaatcagagaaggatgagcacatgcgtaacagcaacagtttcttaatttactcctacgtactaacagtacatggatagaaaacagttcataaacatctagcatcagttcctctgaaaaccagaaaaagaaggtctctatcacattgttgaactcataataaacgagtacaaaaccataaacctgacagggaaagatctaaacggattaaaagaaataatgaaaaaaacatccttacataaacaaacgagcagctgcaaaggcgacgtgatattggcacggctcaatcaaagagtggagcccctcgccttcggagcacaagctttctgattgaaccgcaccaatatcccgttcccacatagagagcagaacaatcccccaacgatcagcattcagatcagcaaaacaaggcaaatcatcagagataaaaacagcaatccaatcaatacactccctctcaagtactctcacctcactaggatcaaacaagagttcatgaggacatgggatcagagaaacacaacagctagctaactatgcaaagcaagtaagcaactagtttttttttcttggtttcatgcagaagcagaagtgaaggagatgagaagaggaggagcaggagggagaggaaggagtcgtaggatcctttaatatggcttcttggaggcaatgcaaaagtgagggagaggtagttgtagatgagaagaagaagaagaagaagaagaagacgaggagagcttagctaggagcaaaagcacaacatggctagccgctacaacgtgagtgatgacatataggaggaggagccgaggaagggggggcgagttggaacagcaacggcattgttgggaaaacgaattgaatgggccaacaaccaaacaaagaggaggttggagcatttatgagacgcaatgaatttgaacaaggtgagagaagcagcacagtacaagtagtactacgctagaggaggtcgtcacgctaggagatgcctcgagcgagagacgatcgatcgatgtggacgtcgacattaacgacgattcgatcgattccaataggcggcagtggcagcagcagcagcagcagcagcggtgtgggggcgtggctggcttgaatgcactgcagtgatttcccatcccgtctacagcctatgcaggcatggcatgggatgtttgcctccccccctctccctgcagctgcaacctgcatctgcatgccatattgccattgccacccccaagccttctctctctctctctttctctacgcataccatgcatccatctctcgatcgcttcttatgttgcgtcaggttcgcgtgacgccaatggctagctaggagtagtgccgtgtgatgcgtcgtttgccggcaatggctggcttccaaggaaccggctagtctttgtactacgtcgtcgttgacgacgacgacgacgaccaatgtcttctgaattctgatcatctctgatgagctgtgctgctgcagcagctagaagaagaagaactgatcgatcagatctcagtgattctgcgtagtacgtactagtagtagaatgcttgaaaagggaaattaattgccgttaaattcttgaagcgatcgatgaaggcgggcgtgtagtcaggatcggagtatacgacgaccaccatatgtgcatccatcatccgtgaattgatgaagtgtttggccggtgcgtgttgcgtgacgccatgggctgctgctgctgccaacaacaacacgcagtacaattaattatgtaaacggcaggcaggcaggcatgcacgacatatatatgagtttgatgtctctgcatatatggccatgtcgacaacgataatcgagtcaaaatggcaatgatacggggagattgatcgatccagtggccaaaccaatggcgatttggtctgaaacaatttttcgtcgtcagcgatatctgtgcatagataattctcataatgttctttaggcatgtggatcgacaaagggaatcagttcatcatgcatatgaacctttatcgctggcaatctcacgggcgaaatatgattaattatctctttttttttctgaaagaatacatgtctacagtgaagtagctgtagttttttcgtgatggcgctttcagtgattgcgagctttagctagcaatgcagcgctacgttcataaatgcagtatacagtatactgtatacgtactggccatgcatcgtgtacgtttagaactggagtagcggcaatgaatgatctgcagtccatatatatacgtacgaacgcatgtgtagcacgcagacatcatgcttagcatgaatgaatgatcttgcaagccccagccagctttaatttaagttttctgattctggcttgcttactcttaattactactaaagtgacaactaatagtctggggttggtaaggaaaaggattcggctctcacattattcttagcttatcggtaggacctagggtcctaggcttccattgatgggtgagtttcttgtgaaaatggaacacacctcattgatgtttgataagctacaacggacattgttttcaaaaaaaaaaaaaaaaaaaaaaaaaagctacaacggacatgacttgcccaattcacgagcttggaagccaaaaaaaaaaagaaaagaaaaagagaaaaaaggttaacaatgaaacaagcacaattttgcactccacccaacttgaccaaaacacagttggttgtaaattgaatcgcttcctgcattgttctcttctgcttctacttggccaacaaatcaagcacacagcagctagctaatatacattccaatattaatccatcatcccaggccacaggcaagagcaaccaaaaataagatcgatgcagcagattgatccctacaaaaccccaggaaaaaacaatcaggattccctgctcgcggcgcagcttcatcctgacactgcacacattgaatgccagtgccaggatgaagaaccaccatccaggctctgcgaccagcaacagaacccaaacgcagtaaatttaaggacctcgtgccggcgaccttttccatcagcagctgctgctgctgtcggtagagccaggcaggcaggcaataaagcggcaacagcaaccagattaatgacacactgagatctagattgacctcgtcacagcaacggtaaaagttaagagaccacaagagaacacattcaccagagccacaattacttgggagtattatcaagcagcgtatatatgttcagaacaactgagaggatcttggcattactactattagagtttaaagatttgccacgaggtaagcaaagaatatacacttgtttggcaagtcttatttacaggagttgagagcgatattgctgccgcgcctagagcagcccaaaggtgttctcgccactgtaggtcatgtagaggaacccatcctcatccttgttctcctcgtaaattgcggacatcagagcagctgcaaatccaacaaagtgatgaaatgagataacatgaaccatgcaggttctttgagatactgggatcataaaccatgcagtagtatactattcgaccaaagtccttgtgttttcaaaggaaaatgattcaagggattttcagacctgttggtggaagagtattcttcacaaagatgaagattgctttctcaggactgagcttgatccgcttccgaacaacatagacaaactgcccaacggtaagatcagcagggaccaggtacctatattagaaaatcataagctactaaggatgatacggtaatattgattgatacttgatgtaacatgtattaaagtttcagagcaacaaaagtttcgagcttgaatgccatagccataccggcatccttgcaataataaattgaaacacagtcagctgcttttggaacatagagttaggactttacagtgataaatagtaaatactactacatgtttaactaaaaagagcataaaggatttaatgtgatgcaagtactgtaatgatgctgtactgctagtaccaaaaaagtttataggacaccgttaatcatgactttaagtccttgaaacaattataataaaatgaaatatgcccccaaaggacccacaagcaataccattgcatcaatgcagtcctagataaggataaatgaatggcaagagctactagttgctatcatctgaacacctgaagtcctccactagcatttacttgatagcaattaaagacaatattccttcctttagcggttcaatagactaactaaataaaaatctaaatgctatggtttcgtaaatgcttggaaactgactttttcttgtcgatgtcaggaatatcacttctttcagctttctcaacaatcacctacattacattagatatgtaacaaattagagcaaaaaaaccacaatgaaggaaacaacataactgagcaatatgaagagcaagcttacaggaattctgtcactgtacttttctctgatacggttagcctcagcctgcctcctctctgaaatacatgcacaagaagaacaagattttggttattatgaactgactaaaaggctgaaacatctctaaaatgtatacataaatcaaggttgtagaagatggagaacgagaaatcagagatttcaaatcactgtagagaaaactataataacagagtgattacaagaaagggcaaccaaaaaagtgcaatacttatgctgtctatttctcaaaaaaggaatctatgctatcatgttggcacacacattaatcaacttaaatattgttcaagcacaaaaggtaaaagataaaaaattagacaggaagaaataactcagtgaaaaaaagcatgatactaaacatcagggccctttcacagaagattgggcaggatttacagcaacccctaaacatgcaatagactaccaaaaccatgttctcaagcataaagtgttgggtgattgaattggaaagtctattccttatacgatccatcagaaaaggaacaagaccacataagtcttaaaaacaaatcaaagaatcagctaatgatgctggattgtcaggtcaactgttaatttatagtctacaatactagagatattgggttttacagccttacataatagttaaaactggtgtatcagaaattcagatagacacattgaggctctttataatttgattcatcagtaatgatgacatattttccccattaaccatccctctatccatccgcacagaacctactattcccattatgaaaaggcatgtactactattattactaccaaattcaaatcagtcacacaactttgtagcaatcgcaacctactcctactcccagattcgcacagaacatgcacaattcaataaacagttgctaccacacacattcagatgttttggtaagccatccccttaaaccgggggaaaaaacatattcctgtgtctctttctctcgtcttcgcacacattcaatcaattatcgaacaaataaacccaacacgcaatcatcgcagccacactactaaagcacatataggaaaaaataaaaagaggaacacgataagaaaacaaaccgaccgagcgtgtggtccagcttgaacgagctcttggccatggcgctccttcctgcacacaatcaccaaatcagcgccccccaaaaaattaaccaccagaaacacaccgatcgaagccaatcgcgcaacgaaacacaacaactcgatcaaacccttacgagagactgagctggtcctggagaacacgagcaaaaacacgaatcaaccaccaaatcggacaaggaagcccccctgatcggcgaacccgatgccgaatcgacggaagaggggagcggaaactcacgcgactcgccggattggattggattggattggggagagggagggggagggtttcttcttccttggcgcaatggagatgtgtgggttgcggagacgggtggtgggtaggagaaaaggtgtggggttgcgttggtttttaagtaacgaaaaggttatacgacttggacgcgctgcgcacgaaacgtaacgaaaaggaaaccttgattaaaaactcctctacgtttcctccaagaaaacttaggcttctgtaatccttaagagaataatattgtgacttacgttaattcatgaacaatgtttcgaggtagtaatgtataaggtcgttatgaaatttacatcgagtacaagcagtaatatacgagttgtttttcctttatattagctactccctctgtgtcaggttataaaatattttgactttagtcaatattaaactgtttcaagtttgactaaggttgtgtttggatgggaactaatcctttccgcacgaaaaacgaaacgatctattagcatgtgattaattaagtattagctatttttttttaaaaaaaaagattaatttgaatttttaagcaactttcgtatataaactttttgcaaaaaaaacgtaccgtttagtagtttgaaaagcgtgcgtgcggaaaacgagagagaggggttgggaaaagagggtaccgatcacaccctctttataatactaaattagtttcatcaaatcaataattgaatatattttcttaataaatttgtcttgagttaaaaaatgttactattttttctacaaacttagttaaacttaaaacagtttgatttgtaaaaacgtctcgtaatctgaaacgaacatagtactaagtaatgtataaggtttttatgaaatttatatcgagtacaagcagtaatacgaattcttttttcctttatattagcaacaacatgagatcaatacgccgagaaaatgttcagctgtccttttccaataagcactcaagatgcataatgtttataactttatttagatcgttttttttattttaaagtctttgtcgataaagacacgacaactccatcctagcaataacaatcccaaaacattttaaattgacgtattcgatgacggcccggatcggcccagcacaatccactgatcagcaatactcggcccactgtgttcagtgggcaaagctctcatcccaaagcgcagacaggcctcgttttggtgggcctcaatacatgtgtataggccaaaattttagttcaatctcccggcctatacatgtggaagggccaaattgaggcccaaactagccatcagggcagcgcaaattctacaacgctgcagaagagcacacctaccaggctaccaccgaccaccgtaccacgtttgtatctgatcaacgctgatgcaaagacgacggtcactcgttcttcgctgtcgccgttttgtcagccatcaatattttccgctgggggacagcggaacgacgccaaccgctagtcattcatccagtcgcagtcatgtgacctactccaaccgtttcatattaaaaatcgtttgattttttatcaaacaatttttttagaaacacagtacaaacgcaggcgctcacaacgtgcacacactcacccctatgaacatttttatatttgatcaaagtttacagaaaaatactctctccattctaaaatgtgtagtcttacactatttatattcaatgatcaacaacgtttgactgttcgtcttatttaatttttttattagtattttttgttgttattagatgataaaacacgaatagtactaacattttttttgtttttttataaacttttcaaataaaacggacggtcaaacgttagacacggatacccacaactgcacttattttgggatggaggtagtataaacaaacattgcatcaaaatttattcaatattaaattcaatgggactaattccgtgttgtagatgttgttagttttttttttctataaatgtggtctaaccaaagaatttgacaaacaacaataacgataacaatatgtacagttacgacgatggaataatcatacatctgaagtcctttctttaaaggatcaatcctaaggaagccaacagagagagagcatacatttgaaactagttctttgttcctgaagcaatccactgttgatgacctcgggatggtaagcggccaggcacaggcagacacattcacggcagacagcgtcggtggcatcctgcgcgacgagaaaaatggcagcggccgtggtcggcggatccctcgggcatttggatacgagcgacagcggacgggcagacggctcccagctgcggacagacgacggcggacgagagaggcgacggtgggctcgcaaaacaggaatagagaaacggcgaagaagaaatgtctgacatgttggggacggtggtgggtggggggggggggggacgggcccgtatgcacagagattattattttccagtgatcacacacgaagtcacgaactaaactggctaatgaaaaccatgcacggcaaattccaaaataatcaacctataattacgtaatcatgtgtacgtaagatcaaattgtttaatacgaacaaaataattatgatgtgtatcagatgatttcgggagcaaggaagacggagctgttcatggggcagccgtaccgtaccatgccggcgaccagccggaaccgaggctgggcaccgttgagcactcgagcatgtgccgcacggccccgtccaccaatggaccggcgatcagaggcagccgaacgacgaggacatgggcgcgcaccttactcggcggcacgcgacccggttttcttcgcgcaccacggcaacatcgaacgcctgtggtattaatagagcaggagaaaattatattgagatatatacatggttagatttttttagataatggaatataatatcccggcctttgctcaaaagagctacagggttagatgaaaaaaacgaaacaaataacctgcaaaaggagaggcaaaaggcagagattaagtgatatctcccaaaatttcaaactcctgcaggatagaagcccctgctttgacccatgctctctcttcctccttgatctttgctaggattgaggatagcgaatatgcattgttgcggaagattcttgcgttcctttcgcaccagatttcccacgagattaaaatcaccagggtcctgagaggtttgcgtggagtgtttggagatttcgttacaagtgtccaccattactcgactgagtgatagctatgccagttgttcatctgaaggtcagtcccggtccatctctgcatttctgcccatatcctctctgtgagtcacatttggccaggaggtacagggccgattcatcaacattgtagcaaagtaggcaaatcttttggttttgccatcctcttttttctagcctgtctgccgtccatactctattttacgtgactagctaagagaagaacttgcacttcagcggcgcccatgtctttcagattgactgatagaagatagatttggcagcccttgccttcctttaaaaaaatcgagcgcctgtggtacatccgccgtggccttctcttccccggcaacaccaacttcaccgtgctcgacgcgagcttccacttttacaacgaggatgcccgcctcatctgcgtccgcgactccctcgacgcggcgcgctgcgcttcacgtactaggatgtgggtctcccgtggctgatcaacgccagctgtccacaccggcgcccacgacaggcgcctgccggggaatctggacaagaccgtgcgggtggcagtgatgaggcccaagacgtcgaggagccgcaaggagaaggacgccgaggaggaggtgcttgtcatcgaggggatcgaggtcagccgaccactccacgtacattaagttcgacgtgttcgtgttgaacgcgccagcgagagcgggaacatcgcggcggcgagtacgtgcaccgggagcgtcgtgctaacgcagacagtgtccaccacgacgagaggatgcgttctccgaggaagacggtggcgaggtcactactataaaactaattttcgcagtggccaaaactaatttttatagatgggagagaggtccgcctacaccacaacgactgcgaaaatcatcgatttttgcagttggggcaacagcccgcctgcgaaaatggaagggacgaaaaaaaaaaatcgccggcccacgccgggagccgccgccggcctcccccccctcctccggccagatctcggagggaggggggaagggagccgtcgccgccgcccggccagcgccgtcgccgctccacgccatcgttgtcgctgttggcctcccccctctctcctccggccagatctaggagggaggggggtagccgccgccgccgcccggcccgcgccatcgctgccctcgccagcctcccccctccctcctccggccagatctgggagggagggggaggggagccgccgtcgccgcccagcccgcgctgtcgtcaccgccgccctcgccggcctctcccctccctcctccggccagatctgggagggagggggcaggggagctgctgtcgtggctgggagccgcgcctcctcgccgatgtcgccctccgccgccaccggccgccgcgctcccccctccccccctgcgcccctctagatctgggagggacgggccgggccatgccgccctcctccgtcgccctccttggccgcgccgcctcgcctcctcgccgctgccgcccttcgccgccaccgcctgccgccgtcggggagtgtagaagtgaggggaggggaaaggaggagatgtgtgaggacttagaaaaaaattacggcccgcaagtctatttatatctctatctctactacttaaaaaataagagatgcttccatcgtccgaaaaaacccagcgaaaaaaccggacgagagagaaaaaaaccggacggaaaaaccgtaactgtccggcgaaaaaataatccgattctgtgaaaaaaaaagggcgaaaaaccggtgaaaaaaaccgtaactgtccgataaaaaaaggcaaaaaaaaagtccgattccgtgaaaaaaagggcgacaaaaaaccgccccaagaaaaccggacgagcgagaaaaaaaacggaactgcccgatcccaaaaaaaaatccgattccgtgcaaaaaaaaagtgaaaaaaaatctctatctctatctctacttgtctatctctatctctacacttaaaaaataataaaagatgttttcttcgtccgtaaaaaaaagctaaaaaaaataaaataaaaagtccgacttctatccgattccctctcataaacggaaaaaaaactccgactatagatccgattctcaatctataccgtgatatctcacagatcttggtgaaacaaaatgatgtgtcggattgaagatctgtttaataaacggaacctacaggtcgatagcattccatttttatatgatttcaatttttgggtttgtacttttgcttttgagtccctgtaatttttatatttacatttgagtccctataatcctgcaataaggtacttgaggccgtgtttgttaaaaataataataaaagagagagaacaaaaacagaaacgtgcatctctactacttaaaaaataagaggtgcttccatcgtccgtaaaaaaagtggacgaaaaaaagaaaaaaaccaaacatatccgattaaaaaaaccagaaaaagaaaaaccaaacgtaaaatagggggcaataaaaaaaaccagatcggtccgataaaaaaaccagaaaaagaaaaagaaaaagaaaaaccaaacgtaaaaaaaagggcgataaaaaagaaaaagaccagatcggtccaataaaaaaaaccggaaaaagaaaaagaaaaccaaatgtaaaaaaagggcgataaaaagaaaaaaaaaagatcggtccgataaaaaaatcccgggcgaaaaaaccgggaggaaaaaaatgggcgaaaaaaataatccaattccgtgaaaaacaaggcgaaaaaaataaaaaaaaaagaatcggtccgattctaaaaaaacgaaatcgggcgaaaaaaaacccgtgaaaaaaaatcaggcgaaaaaaagaatccgattttgtgtaaaaaagggcgaaaaaataaaaaaagaatcggtcgaattaaaaaaaaaagaaatcgggcgaaaaaaatcgggtgaaaaaaccgggcaaaaaaaatccgactatgtggacgcggtaaaaaaaggcgaaaaaaataaaaatgaatatgtctaatttgatcaaagaacgtgggtctgattttttaaattaaaacccgttggataaactcctgagtagactcgaaaaataaattctaaatcatatactaattcatcaaattagtctcggttctacctatttgttaatatatcaaattaaacttgatttttaccgatttgaggtttttaaggtgtcacattatcaaacggtgtttctcccgttgcaacgcacgggcactattgctagtaaaaagaaaaaggaaagctgcacaaaaaaaaaagaaaaataacaacaacaaaagttccgttttcccttagtggcgaaaaaaaaattgtagatccgaaccaaaaaaatccgagtcctataaaaggcaaaaaaaaagtggtgaaaaaaaaatactagattcaattcctttaaaaaccggaaaaaaagtctgattcctataaaagcaaaaaaaaaactgaaaatacatctaaaaaagtttgtccgattccctaagaaagtggcgaaaaaaatagttcgtaaaaaataaaaagcttgttcgtataaaataaaaaatgcacacgagaaaaaaattgaaagggcgaaacaaagtctgatttctaatcgatatatatctcttctctatctctaatataatctaactatttaaaaagataaaatacacgagaaaataaaaacggttcaaataaacgcgtgagaaaaaagtcagaaaaagtgcaaaaaaacaaacactccaaaaaggttttccatcttccataaaaaaaataaaaaaacgggcgagaaaaattatttccatcgtcggtaatttttttaaagaaaacatgcgaggaaaaaacagtcagaaaaaacgcgccaatttaacaaatggttttaaaaaaccgtgcaagaaaaaaacaccgtctattaaaaaaatcgctctgagtcggatatgatccatcgatgtttttgccacctactacacggcttttatttcgtcatatattctccttactgaaaaaaaaagaaaaaagaacatttgaaaaaaaaacaagcaaaaaaacgcgcgagaaaataattggcaaaaaaaaggcaaaaaaacacacgagaaaagaaaagcaaaaaatggagaaaaatatggttttcgttgtaaataaaaaagcaaaaaatacatgctagaaaaaaacttttaagaaagaaatacgccattcaacttttaagaaagaaatgcgccatttctgaatggtttgagaaaattgggcaagaaaaaaacaccgtttataaaaatacaagccgctcattaaaatacaaacattgtcattgacatgattattcatgaaaaatatatattatcattagaattttttcacccgttgcaacgcacgggcatttttgctagttcaagtctattttcgcaggtgccgtcgcaggcggacattaaatttcatcccgatttctatttttataggcggtaatttggttctaagggtcatgtccgcttgcgaaaataatacaccgtgtctgaaaaaatgatttttctattagtggttcggcatcggcaacttgctcgatgacatcggcgccgacggcgaccggacgatcgtcgtctcgatcgtgacgaggtccggctgcgattcggtcaccatagtgtttgatgtgtaactaatgaataatacggtataaataatgacataattactgactagtcgttctttgattaaatggcgtcattagtcgttctttgattgaatagcgtcaatagactcccatgacgtaacgttgttccttagtacccgtactacttgttgtaattaataaggaaataaatattgactcgtcgttctttgaatttaaatggtgtcaatggtcaataaaaaccttaggggatgattaaaatggaatggaaggagtaattagtaatgtcaagacctaaaaaccttaggggatgattaaaatggaatggagggagtaattagtaataccattgcaaatatagaagcatagtaagaaagaaaaaagtgggcgctacactacagtatacacactagagtggattctaaattcttaggatcaggcattctttcgttatttgcatatcatccaaattattatgaaaaaaattaaaaaaatttaactaaatagattaatatgtgatagatcattccataagcatgcaagttaaaattcaaccattacatgttaaaaaaaattaagctataaatagttaacgtatattcatagttaaattttgttttttttccattacaatctgtagaagttaattttggtattgcatgtttatggagtgattgatcatatattaatttattttattgattttttttaaaaaaaatttataaccatttagatgagatgtaaataacgagtgatctattctcaatagtttagattaatagtttctcgtatacacacgcattgccctataaaatacacacaccactgcaagaactagtttacagctgaatgccgccatggagagcatcaatgtagcacgaggtgcatccgtgacgcctcgcatggcgctgccgtgcatcagcaacctccagacccttcactacaacctgctcttgcaccgcaaccgcaagacgaacgggaggaaactgcggagcgtgtcatgcagggcgagcgccggccgaggcggcggccgcggcctcgaccgccgcgacgtgctccttggcataggcgcagcggccgccatggtggccacgcagggcggcggcggcgcgctcgcggcgccaatccaggccccggacctcggccactgccacgagcccgtggacctccccgaccccgacacagcgccggagatcagctgctgcccgacgtacagcgccggcaccgtcgccgtcgacttcacgccgccgccggcgtcctcgccgctccgcgtgcggccggcggcgcacctggtggacattgcgtacttgaccaagtacgagagggccgtgtcgctcatgaagaagctccccgccgatgatccccgcagcttcaagcagcagtggcgcgtgcactgcgcctactgcgacggcgcgtacgaccaggtcggcttcccgggtctggagattcagatacacagctgctggttcttttttccatggcataggtacggtacgtgacaacaacattatactccgtcccaaaaaaacaaatttctagctacgaaactagacacatacacatgtgtccagattcgtaggttggattgatattttattagacggaggaggtatatacggagacgtccgtcgatgattcttacataccacttaccacttactagtaaatagctataaattttctaaaataattaataagaaaatatgagatatatcatttcacaaattaacacataagctcaaatttgaaatctacaaattgtaaaaaaaagagagagataaattattaaaactagtcaacttacatccgcacctttatttttttttctgttgtaaaatatagaagttgtgtttgaacttatataaaaaagtaatactccagctaatgttaatttatcttatttttaaaattttctgttgtaaaatgtagaagttgaggggtatattagccttttgagtatatctcacgttaatttatcttattttttaaattttctgttaactatatattaaattaaatgacatgaaaaagaagggatacccctcaaaaggctaataaagacactttccccaaatatacatcccgtctcgtctggttcgtgtacgggcatccagctatatgtgctgatgtggctgtgattctctgcatgcactggacccatgcgtatgaacgtgcaggatgtacctgtacttccacgagagaatactgggcaagctcatcggcgacgagacgtttgcgctgccgttctggaactgggacgcgccggccggcatgtcgttcccggcgatctacgccaactgcaggctgtcgtcgctgtacgacccaaggcgaaatcaggcgcaccagccaccgttcccgctcgacctcaactacaacggaaccgacctgtcgaaactagatttcggcaataataaaagggggtggctatcaagctaggaaagtgtatgggtttggagacaaaggatttatacaggttcaggccttcttacaaaagaagtaataccctactcctgtccggggatgaatccgccgagtgtgttattgattgtatgatttggagaaaatccaacctccgcccctagaggcacccggaccccccttatatatgggaaagagtccgtgttacaaaagataatctatattcctaacggaatatgtaaatacagataaaatacagtcgtgaccgactaagtctcaaggtgtttccttgatgtacaagttaagaaacaaacccaggatacacataagatattctatctatattcggtatcctatatccagtccaaatatcatcgccgtgtagatatgggatatccataatctccacagtagcccccgagacctttgcagtcaaccatcatagccttctcaaagataataatccgagtgcttcaaaacttatcatgccaagacctgccgagtagcgaagacgaagactgtaaagggcgaaaagataaaaatatggtgcatcgaatagatgcacctaattaggtgtagcccccaactatgtgattagttaacgaactaaacatatagttgagaaacaaaataataacacaattgtgcatcatatgacaaaagcatacacggcgcctagataggcatgctagccgactgctttttagccataatgaaaagagtccgagtggtttacactctaaaaggttcacgaatgaacacactggacaggcatccgaatataaaactctaaagattacccaccaagtattataaaaattatggtaatgaataagtctaatagcctgggccatgactatttaccataatgaaaataggtatataacataccaaggaagtgactatgataaaaacaagtcattccaaattaacccagacagcttttgtagcctaataaagctaacaaaaagcagtataacacctttctgtcgggcaccttttaatttgcattgcaataattccaaagaattatatgaccgcataaaaaggattttatcagcattgggcaacactattgtgcgcataatattgccaaagcaaaatatgcctaagtccctaaggaacacaatgggccacgctgttaaaagtattgggctgaagtactgttcaggcctaggcccatttgctcctccgatacccttaacaagaaatcccgagatccaagcaacgcttcgtctcccccgccggaactctcgccattttccccactccttgctacagtgcagaactgcgccggcgaactagggttcaccactccactcaaatccaccttcgaaaaaatgcatcaaaatccttcccgtgatccaccgcctcaattcctcacctctcccaagccatccctcgaatcaaatcagcgcattcggggaaaatcgatggcggaggaaaaagaaagctttgaaggccagtgggcgccatccgacgtaacggaagagaacctgaaggagatggtggcgcacggcgttctccctgccaaggagatcatcgggtggcggccagcgtgcggtgagacttttccgacccccgatacacatgagattgtggtcttctctcatttcttctatggcggcttcgcccttccgacctcgaaatttttccgcgggatattaagcttctatggaatcagcttgcatcacctaaacccgaattccatagtccatatcgccaatttcatccatgtttgtgaagcctttttgggaattaggccccacttcgctctgttttgccggatcttctttctcaagccccaaccgaacaagaataagccatgtgtagtcggaggggcaggatttcagttgaggggaactctgagtcagaagtacttctctatgcccttcaagacctcaaacaaagggtggcatgcgaactggttttatgttcagaatcctgagcctgctcttcccgagtattcttgtcttcctccggtgtaccaagatacttggaactctcttccaatcggagatgaagctgcccaagctttggaattgttggatcgcatgttaaaactcaaagaacaaggcttgcaaggagagcagatcactcggcatttcatcaaatgccgactggcgccaattaaagaaagatcccgtacagcttttgagtttgacggcaagcatgatcctaatcgcgaagaaccagactctctggatttcaaaatcatgaaggagagaatgtataaaatcttctcaaatgccatcgtcgtcagctactcacatcagctgccagttgtgccatataatgcattcaatccgcctccgcaggtatgcatctgaaatcttcaatctatgaccaaaacattatcttgtcttcatgttgaattaattaaccgtggaagcatctcatttaggaatatgcattgatgaaatctgatcccccaatcactcagcgccggtcacctcgtcagcacaccgttcagggaagtggagggccgacaatcaggtcagacccacaacctcaaacctccaaaccggctgggcagacaggtcctcgcaagagaaagctggtgcttaatgacgatgagggcgatgacagcaacaaatctggggacaagggcactcccaacaaactcccaaagcataccatgcccgggaaaaaactggctggccgtcaaattccaaagattagaacatcttccaggtataaacctctcgataccattttatttcggcatgcttctcttatagaaattatgctaaatgtcaaaaggacactttgcaggaaaccatccgacatagatccaactggaaaagatcctgatccggctgtgacagagccaaatttatccaaagacgctgagccgactgccgaaaatcagccgaatgccgaaagccagccgactgccgaaagtcagccgactggcgcccaagcttcggacgacaaggccaatccgagtgatcagccgccgactggaaaccagtcggcagcaactgaaactgcaacaacccgagagcccccgactggaaaccagtcggatgtagatctaaatcaagagattcctgaagctgaagcgcagacaacttctcaaggaccaaaagttggtaatgactcagtgattgggtctccagataaagagcaaggatcccctcacgctcagccaggcacatcctcaggtaactcaacttctcaagtgatgccactctgaataactccagcttgttcgtctaatatcttgggaatacatcaggtccactaggcggcgacgaagaagaaattctccgcataaaggcagctaatgactctcgtcctcctatcttactcaaatggtgggacgagaactctcaagtttccggcattgttataaatcgccaaaaagaagacgaggaagtgtgccagctgaagaaagtacttggagaagccactcgcattgtgaatgtaagtcttctaggtgattgcctttgatgactttgtttttttgttagcaaaactaatccctgaaccaccgtgcagagaatccatcttcgtaatgaagccaagactgcaaccttagaaaagctggttccacatttgggaactcttgaagccgttagggaacagctacacgaggctaaggagcatgccaagaaaacggagaaggaattaagggagcgaattgcacagctccaggactccaacttcgagctgagtggttcatcaaaaggtaatctctagatctgtcccatttgtgctgtcataactggatcctcaaacatttggattttaaacagcgcaagccaccaggatgactcaaatggagaagcaaatagaagccttgaaaaaagacaaggtagaactggctgcggaaagggactcagccttgaaggaggttgaaggtactgccagctgacaatttgaactgccctctctgtaaggcagcagattcttattataaatgtgttttgtagaccgtaaaatcaaatctcaagctcagtttgatgtcctggttggtaagatcaagaagcttgaaggagcaagagatgaagtcgccaatgtcgctacaccacttgtccaagctatgtttcttaataacagtggtccgagtgcacttgatgcaaccgagatctttgacaagctaagagttgcaccggatgtgtacttcaagaacatcaagaaagctggaagtatgggagctagcatggcattggcaatgaccaaatccttgtacccgagaatcgaaattgataccattgatggctttgcagacgggacaagtgaagaagctgctcttgatcttatcagtaatgctcaaagtgcggctgacaagattgcaagtgatgttgtagagcaattccgcaacaacgaccttcagccgagcaataataactctgatgatgaaaggactgattctgactgagtgtaaatgtagcaaatggaggctcaatttgtacaatactggtgtatttatgctgtgcttgatagttctagccaagtctttgatttcttaaaagcttttatcaagctttgttgagcctaaaacccaaagaagctattaaaaactttcagtcctcgcagactaagtagaaaaaatcaaacaaggcaatgatagaccaagtaagcaaattaaattgataaaaaatcacactccattattatgatgatagcccccgactgacaacggcaagaagaaaacttgatgttgacagtcaagatagggaaatacaatgataagcttaagcatagaaacgacgaagatgttcaatgttccaagagttgtcgacgagagtaccgtcttcgcgcttgagtcggtaggaacctggtcgggtgacttcagagatgataaatggcccctcccataaaggagataacttgtgccgatcccgtgtagtttgaattttcctcaaaaccaggtcgccgactagaaaggcacgggatcgaacattgcgattatgataacgccgcaacccttgtaaatatcgagccgaccgaatcaaagctgcttcgcggacttcttccaatcggtgcaagtcatccactcggtcctcttcgtagcgttcttcacggaaatttcgaaagcgcaaagattcgaattcgacttcactcggcaacattgcttctgccccatagacaaggaaaaaaggtgactggcctgtggcccgactgggtgtagttcgcaaagaccaaagtactgatggcagctgttgcacccatttgccggcatagggttttagccggtcaaaaacacgtgctttaatcccttgaagtatcatgccattggctcgctccacctgtccattgctcatggggtgtgccactgaggcataacaaattttaattccaaagtcctcacaaaagtctttaaaaactccaccagtgaattgtgtgccattatcagtgatgatccgattgggcactccaaatctatgcacaatgttgatgaagaagtctcgagcattatctgctgtgattgtgacaaccggtttagcttcaatccacttggagaatttgtcaatggccacaaagagatgtgtgtaaccgccgactgcctttttaaacgggccaaccatgtcgagcccccaaaccgcaaacggccaagacagcgggatagtttgcaactcttgagctggcaagtgaatttgtctagcgaaaaattggcaaccttcgcacgtgcgcacaatcttgtcggcgtcggacactgcagtaggccagaaaaaaccctgccggtaagctttgccgacaatggtgcgtgcagcggcatggtttccgcatatcccagaatgtatgtcctgcagcaattgtctcccttcctctaaagatacgcagcgttgcagaattcctgaagggcttttcttgtataactcagcttcatgcataacataaagtttgctccgccttgaaatccgctcggcttcatctttgtcttgagggagttcttgagaagtcaaaaatcgtatgaggggttctcgccagtcggtttcaaccatagcgacgtcatgagtgcccgcaacttgagtggtatctttgtgaggtactgtcggcgtataaaggtgttcgacgaaaacatcagagggcgccacctcgcgcttggatccaaagttggcaagtctatcggcggcttcattattatgtcgaagaacatgactgagctcgagtccatcgaacttatcttccaatttgcgtacctcttgtcgatatgccatcatgttgtcgtcaaggcaggaccactccttcataacttggttgacaaccagctgtgaatcgcctcgaactattagacgctttatccctagggaaattgcaatccgcagtccatgaaggagggcctcatattcggcgacgttgtgggacgccgaaaaatgtatccaaagcacgtagctcaatctttctccagttggggaaatcaaaaccactcctgctccagtgcccgaaagtcgtttggatccgtcaaaatgcatggtccagtgctccatgttctccgcgggggtatcctcctggcactcggtccattcggcgacaaaatcagctaacgcttgggacttgattgaaattcggggcttgaatgatatgtccaaagacatcaactccaaagcccacttagcaatacgtccgtttgcttcgcggttgtgcagtatatcaccgagtggaaatgatgtgaccaccgttaccgagtgaccttgaaagtagtgagatagcttcctggtagtaattagaataccatataacagcttctgaacctgagggtacctcgttttggagtcggctaggacctcgctgacaaaataaatcggtcgttggactttctggacatggccttcttcctcgcgttcaacaaccaagactgtgctcacaacctgggaggtggctgatacatacagcaacaacggctcctgcgggtgtggtgaggctaagactggtggctcagtgaggagtttcttgaaatcttcgaaggccttctgtgcttcgggtccccactggaagttatctgttttcttcagcagcttaaagaagggcatcccccgctcgccaagtcgtgaaacaaatcggctgagcgccgccatgcatccagtcagcttctgaacatctttctgggtacttggcggtttcatgttgaggatagcagtaactttctccgggttggcttggatgcccctatgagacaccataaagccaaccagcttccctgacggtactccgaaggtgcacttttcagggttcaatttcatcctgaaagcacggatgctcgcaaaggtttcttctagatccgagatcaaatcatccttttgcttggtcttgacgactacgtcatccacataggcttcaacgttgcggccgatctgcgttgagaagcatctctgaatcatgcgttgataagttgctcctgcgttttttagtccgaacggcatggtgacgtagcagtatgccccaaaaggcgtgatgaatgaagtcttcaagcagtcggattccttcagtcggatctgatgataccccgagtagcaatccaaaaaactgagaagctcacggccggcggtcgagtcaactacctggtcaatgcgaggcaacccaaaaggatctttagggcaggatttgttgaggtcggtataatcaacacacatgcgccattgccctgttttcttccgaactagaaccgggtttgccagccagtcgggatgaaggacttctttgatgaagcctgctgctaacagcttggttaattcctccttgatcgcgtctttcctgtcttgtgcaaatcggcggagtcgttgtttgataggcttggcgtcttctttgacatgtaaggaatgctcaatcacctctctaggaataccgggcatatcagatggtttccacgcaaagatatctttattgttctgaagaaaggtgatgagcgcgctttcctatttacaatctaactcggcgcctattacagcagttttagcaggatcagagggatctaggggaatcttcttagtcttggcttcgctttctccactctttgaaatcttggtagcgggctcttctccttcgctcgccgtggctgcagccagtcggatatcctctcgggcagacgccatctcgcgagtttgggccatgtcgcaactctccttgtcgcatgtgacggcttgcttgatgtcactccgtagggataggactcctcggggaccaggcatcttcatcatcatgtaagtgtagtgcgggacggccatgaacttggctaacgccgggcgtccgagtatggcatggtatgctgtctcgaaatcagcgacttcaaagctgatgttctctgtgcgaaagttttcccgagtgccaaaagtgactgggagggtgatctggccgagtggagttgcggataatcctggaatcactccgtgaaaaggcgcattgcttggttttaactcggagtgagggatctgcatatcatccagggtcttggcgaagaggatattgagtgcactgccaccgtcgatgagggttctgcgaagcttgacattacggaccactgggtctagtaccagggggtaccgccccgggtggaccactcggtcaggatgatccgagcggtcaaacttgattgcgatctctgaccatcgaagatattggggcgtgtcgggctgaacagcattgatctcccgttcagtcaacttctgcttccgtttagactcataagccagggggccgccgaagatatgattgagctccttgcggtgatcttgaaaacctgccggggtgtcgccgtcgtccttcttcctcgacgtgctttgttcttcgtcagaattcttccgtgcagtcttggtgtattgatccgcgaattgcttgtagacgaaacaatctttggccacgtggttggagttaggatggtgcgagcattgggagttcatgatcttgtcgaacgtgttgacgcgcgaacgctgtcgagaagagtgactggcggttgcaacaagttccgcaggcttacgcttgcggtccttatgattgttacttccacctcctcccgtagccggcgtacccttgttttgcttccaactgggacccgactgctttgatgcggtgacggcgtcttcagccttggcgtactcgttggctttttcaaacataagcttgactgtcatggggggcttacgcccgaacttgccgaccaattcttcgtggcgaatccctttggtgaatgcggcaatgatgacgtcatcggtgatgtcggagatcttgttacgttgctcagaaaatcgccggatgtaatctcgaagagattctccggacttctgaataacgttgtagaggtcgtattgtgtgccgggtcgctcaaaggtgccttggaagttggcgatgaagtggtcgcgtaattcagcccaagatccaattgtaccacggggtaatccatggagccaagatcgggccgaatccgctaaagccactggtaaatagttcgccatggccttgttgtctcctcctgctgcgcggattgcgagaccgtagacggtaagccacgattctgggttagtggtaccgtcgtacttctctattccagtcggcttgaagccggctggccaatccactcgacgcaggtcgtcggtgaaggctgctactccgtcaaggtcgtcgtcgtggcggttcggcgaatgatgatggcctcgagctgctcggcgctgtatgattgtgtcgcgaagatcgacggggcggcgacgaggtggtgagcgaggccgttccactcggcgctccctatattggtcgggaggtgagtgaatggaccgctcgtcgtgacccctgctcctgcgattggatcccgcgccggtgatgctgaggcttggatgacggtagtcatgagatcggaagtgggggactcggctgccagtcggcgtgtggacgctttcggagttaactgggaccgaagccgcaatcatggtcttcgtctggttcaagatgttgacgacgtgatcggattgattgagctcgttttggttgaggagggtgtcgagaagggtgatcgcggcaaccgcattctgttgaggggtgcggaaaaccggtgtcccttcgacatcttgctggtcgatgagatcacgcgctcggcgccctgcttccaaagctcgctgacgtcgatcctcagcctccttcgcggtccgctcacggtcctgctgctcacgccgtagccgttcttgttcttgtgcttgatgctcctcctccagtcggcgacgttcttcggtctcccaggcttggcgttgctcctccgtctcattattggccatgaaaacgccaaagtagagaggggtgtagttgtcatcaaggcttccgtcgaagtcgtcgaagtcgttgtagcgagaactaaattcgtcgtactccacgatgtcagtaggacgtgagtcgacggtgggagagctgttgtagtcatccagctgatccgtcgaaaccgtgccgagtggttggaggatgacgccgacttccctgaagctaggcgaaatcggtgttgaagccgacttccgcctaggcctacgggatgaagacgttgtcgtggtggaaacggccgctaaatcgtcggggagcttcatcaggactggtgggtaagccccatcatcttgatctggtgtcgttggagaagatgcgatctcggccgagtggtttgaagccgactcggttgagatggtcttgaagtagctttcagccgcgttcgggaatccaaacgggaccgaaatccggttctctcccgactggtctgattccgagtcgaggagagaaatcttgccgaagttgttggtgacgaagtcgaggctgccgaaccgaaacgtctgcccgggcgggaagacgaggtcgtcgatgccggagacgaaacccattgcactgatcggcgaaaagcttgacgctacccctacctggcgcgccaactgtcgaaactagatttcggcaataataaaagggggtggctatcaagctaggaaagtgtatgggtttggagacaaaggatttatacaggttcaggccttcttacaaaagaagtaataccctactcctgtccggggatgaatccgccgagtgtgttattgattgtatgatttggagaaaatccaacctccgcccctagaggcacccggaccccccttatatatgggaaagagtccgtgttacaaaagataatctatatccctaacggaatatgtaaatacagataaaatacagtcgtgaccgactaagtctcaaggtgtttccttgatgtacaagttaagaaacaaacccaggatacacataagatattctatctatattcggtatcctatattcagtccaaatatcatcgccgtgtagatatgggatatccataatctccacacgacccaaccatcccggaagatcagctgatcgatcagaacctcaagatcatgtaccgccaggccagtaatcacatacacagtttgacacaaactaggaattaattgaagtagctactgaaaaccgtagatagcaaactccaaattaattagtcgactttaaattggatcgcgtgtctaatatgaacagtataatttatgatgtatcagatgatttcgggggctaggaagaaagagctgttcatgggacatccgtacagcgccggcgaccagccgaaaccgggggcgggcaccgtcgagttcgtgctgcacaacaccgtccacaactggaccggcgacccgaggcagccgaacggcgaggacatgggcatgttctactcggcggcgcgcgacccggtgttcttcgcgcaccacggcaacgtcgaccgcatgtggtacattcgccacggcctcttcccccgcgacaccgacttcaccgaccccgactggctcgacgcgaccttcctgttctacgacgaggaggcccgcctagtccgcgttcgcgtccgcgactccctcgacgaggccgcgctgcggtacacgtaccaggacgttggccccctgccgtggctgaacgccaagccgtccacgggacccgccggcgccctgccggggaccctggacaagaccgtgcgggtggccttgacgaggcccaagacgtcgaggagccgcaaggagaaggacgccgaggaggaggcgcctgtcatcgaggggatcgaggtccccgaccactccgcgtacgttaagttcgacgtgttcgtgaacgcgcccgagaacgccgacgtcgcgtcgcgctgacgccacacggggtccaccgcgaggagaggaagcgttctccgagaaagacggtggcgaggttcggcatctccgacttgctcgaagatatcggcgccgacggccacaagacgatcgtcgtctcgatcgtgccgaggtccggctgcgattcggtcagagtctcgggcgtcagcatcggctacgtacgctaagtgaagtacaacgtgaacgtaagaatacgtttatgtacaatgtgtgacgtgtgattaatgattgtatgagtgtgatgttgcgtgtgtaatggtgtaggcgcgtgtgggtctgtcattaaaaaatgataccccgcgcgttgctgcgggatatacaaatcattttagagatgtgaacttgttgaaccgccgctaacatcgtgttgaactaccgctaacatcttgtttaactgccttacaggattaaattaatatcattacaaaagaaaagccaaataacaaagtaggtatgaatccaattgagtgtaaggcataaaactcaatgaaaaacttgatggtccacatcgttgatgattgatcaatgataaaaactatacatgatgtaatttggtctcgatcagtactggcttttgttataatcgattgtcaaataaaaaactcagttcaaacagttcaaattaatggattgagaatatataatttgcaaggaaaccaacttaaaaattgtaaaataataattaacaaaagggccgcggtgtaaaatagcacctctcatgtcttatctgaccagaccgaatggacgatttagccgatagtgatcagaaatgatgttgtcggccttacttagctgcatatatatagtggtgaagacaaacaacaatctagctaatatatgtataacaaccttttgtttttttcttttaaaaataaactaatgcaacagaaagggatattgttaccatgtatttgtacatcggtaaagttgatatatccggtagaaataaatagaatatgattacagagattatctccttcaattttgtacccccaactgcccaagtcagaaggaaattgcaatttgaccggtgattgatcggcgatgtgatgttgatctacatgaggcaacttgagcgaagctcccagactttgcaagcatggcaacctcaatgcccaccggtggtagttaggattttagggataacgatgatcaaggtgatgagaggaacatccaatcgattgaacttgtaacccctttccctgaatgaatatgcttctgttttataggatagacatgacttttgagctcctcttggggaaaacggtagtgcaatcacttatatcgtattggactacttggatccttggcagtttcggccacattagttacccgtatgtcattaatcatcgagctgcggcagaaaacgtatcattccctgatagaattgaagacggcagcggcaagcgtgcggaatgcatgtagcgttgggtgcaacgttcctagcatgtgacgctagacgcttaattaacatcgaatggctgaaagaaaagagggtggtgacgtggaagcataagaacaaagagaattgctaataactacactaagtaaggatcacttatatagtattataggatatgattgtataaaaataatgcgtgcatcagcgtgcatgaactgatgatttggtaaccgctgccaatttgaaatcattttttcagataacaacccgaggaattaaggcttcagagatcagatggcatgccattaggcatgcacgctcttaagatgggtagaagataagctaaagagagcatccgtccaaacagggccggctctacaatttgaagggccttagggcgagcttgatggtgtaggctcttaatatgtgttttctatttatatatttttaaaccatatattttctgatgaaataaacattgaacatcttctgtatataactaaagaacatcaaaatggagctaatatgaataccttgaataaaggtcaaactctaactgtctaacgactctatcaataatacctcacaaataaagagattacaaatatccatggcttctcacgaaaaaaatacactcctttaaacatttttgatgcaaaatctttaaaaaatgtaatgagattaatattatccatcacattcttctcaacttagcacacagccaagccttgtcatagggcctaaacatagtatgttctcgtggtaatttggcctttcaccgagcagatgagatagttaagagacatactccttagttacttcttacttgaatacaaactcactcaagaatagtacctgaaaactgaaggttgtgaggtcatgtttccacggaggcagcaatgacgtgatcagttggacacggttgctccgtcaccacaaacaatcgccacgcatttgctcgcagtatatacgtatgtagtttctaaaggtaaacgcacgtatacggcataccagttcgtacttacttacctgatcttgggcccctacttacgttgggccctaggccgtcgcactcctcgccgtagctctaagccgggcctgcgtccaaagaatctaatctttgagttacagaggtggtgtttgaatcccctgaatatgaagataaagataaagatgaaaatgaagtgtttcacacaaaacgagttggtaataacgtgtgattaattgagttttaattattgcgaacttgaaaaatggattattctgatagaaaattttagaacaattttcatatagaaaattttcacagaaaacgtgccgtttaatagtttgaaaagcgtgacatgaatatccaagacttaatccacttttttttaaggggtaacatgtagtagatctgagactgcagaatcgcagaactttgggcagaatcagcatgtccatccgtacggggcgtcgcatggtcgcgaatttgcaatagcaggacaaaagccattggatggctaatgaaggaatgtttaacgttgtacttgcctgtcaagggcgtacttcgatggagtagccgtaatgccattgttgtcagctccttcgaaactgaacccattcggctccagtgagatccggcgacttgggccttgtttagttctaaacttttttttcaaacttttaatttttccattacatcgaaacttttttacacacataaatttctaattttttcatcacatcgttccaatttcaaccaaactttcaatttttgcgtgatctaaacggtgtgcagcttctgcttcaaggtggtggtggtggtggtggtggtgggggttgtgacttggttagcgaccgcccataataacggaactgactccgagcacccgcgaccaagcagcagcacagctcgtaggggagcgttgaccactcccctgctcatccctatgcctaaaacgccgttgttactacttatgggtgtttacggtgcgccgatttgtcattcagcccgagcatgaaacgttgaaaaatacggtgccatgtttgcctctgatgctactcacctaaagcccgcacattaaaagagagacacttgttcccggtcagctagcattgccaaaaaaaagcaagaagatatatgtcgcgccttcggaaaggggtaggaagcttcagctcctctcctccaatatttccgccaccattgagcagtagagaacgatgatgccactgtcgaggaagctgccgtcggccgagctcccgatctgtgtcacctgaggaggggactgacggcggcattgactggagactcaggaaggccgtcgccaccgcgtgggctcgggatagccgagggagaagtccggagaggaaggggagaggcgctcgctgtcatcaccctcgctgccaacagatccgctagggagaggaaggggagagggcccggtgccgccgcgtcttctcccaagcggcgccggtgggaggagagggggggcgggggagtcgtcgccatgggagaggacggagaggaggagggggcgggaggcaccgtcgtgggaagccaagtgagggagaggacaagagagagaaatggggaacaagcggcggaggttggggaggtgggtgtgggagatgttgctccaggaaggagatgacgatgatagtaattttcgtggtggggccaacctaaaacaatggtggtgggcccacctaaagctacacgaactatggatatcggagcatcattttttttcctacgttgatacttgggtttcttgatgaggctgggacacactgctatagtgcccaaggtgtggagtcctgaacccatctctatcatgatatcatcctggccctaatgcccacctctaccgtcagacagatctcctcggttccatggcaatgatatcctcttatcccctaggtccctcaatgccaccccctaggaggtgttgagaaaattaaggggagagagactggagggagggagaggaaaaaaggttctactatttttctttatttttgttcgagagacttatacgagggtttcatctaactttttttattgaaaactaaaaaactggatcaatataatattgtcgagtgattttatttgcaccgttttaaaaatttagaggataacatatatatggttttacagttgagagatgtgaattaaattcgaccatagttgaaggatttgaaatacactttttccttaagttcacgaggagtgtcaacgatgacctggctcggcccagctcgatccattcagcagcaattctaggcccactctcttattctctatgctgactgcagtgctctatccttttcgctagtcaggcctcgttcggatgggccacactcccagaccatttatgtatgagagaattccttatatgccactctaaattaaccggttttcttatatgccactttaaattgacttctcccttttatgccatcggttcaagtttctcctcccttttatgctattgccgtcagtccaccgtcagttgaccgttaacttcattgtaaaaagacgcaattgcccttaagaattagtatacaaccaataataggtattttagtactaatataactactggatacaacatatgaaaattgatttttttctgcatcacatgcaattttagccattaccatcacaaataaattttcaatgtaagcatgaatcatgcagttttccaacaatatttttaatataaagagcatttttcactagttctgacaaaattttgttcactcaaaaaagatttaaaataaattagttatgattttttgaagtttacacattttttagttgagagggcatattggtcatttacgaaaaaaaactatcctttactaacagtcaactaacactatagtggtgggagttgcataaaaggttggaaaaacttgaactagagagaagccaattttaagtgtcatataagggaactggtcaaattctagtggtatataagtaattctctctttatgtatatgggccaaaatttaagttcaatctcctggcctatacatgtggaaggaccagtctgaggcccaaacaagccatcagggcaacgaggcagagcacactgcacaccaaccccgtttatgtcaacctttaagaacttaaaggtatgtttggattaaaaccaattcttgccctaccaattatttggtagtagtgttgtagtacttgttagctatttagattgaggttaaatcttactaattcaatagagttagaaacaacatagccctaccaaaatttttggtagtgccaaaactagcccaagatttggcaataccaaaattttggtacggcttcaaaccaaaatagctctataagtgttgctgccacgtgtttgacacatcgcatacatctgatctgattgggtgaggatcctctaacataatatcactatcattacaatgactgttatgtacttccttcgttccataatataagagattttaaagaaatactccctccgttttaaaatatttgacatcgttgactttttagcacatgtttgaccgttcgtcttattcaaaaaatttgtgaaatatgtaaaattatatgtgtacatgaaagtatatttaacaataaatcaaatgatatgaaaagaataaataattacttaaaattttttgaataagacgaatggttaaacatgtactaaaaagtcaacggtgtcaaacattttgaaacggaaggagtatgacacattctaatacatgaatctgtatagagagcccgtctagattcatagtgctaggatatgtcacatctcttatattatagaacggagggaataagtcttactctcctattgtttcacatatcagtgtctctaatgatattgttattatggtaaaggacccgatatgatcaacgacgttcgctcgttcttcaccgtcgcagtttttgtcagccatccatttttttcgccggggacggcggaacgacgccgacaagtcatcagtcatctagttgcagcgtccaaacgacgtacgccgcccggcctgaactgaaactccggccgttttaggcaagggttagttgacctgggatgaactgcctccatcatccatgcatatccgtgattccgtagcggagttggccggatgaattgcgtgtatattcagacgattcacgcacaggatgatggagtgtttcgcccaacgctctcgtaggtcaggtcgtttgggagctttccgatttgcgtaacgacagtgaaactgttgttgacgggtgcatagttattaactggttcacttgacaatttcgagccgctgggtgaaaggttaatctctgaactacttcgagctgacatgatatctctcaacgggattgcttaagtgacggatatatgtttgacttggtatatgtggtgctaatgtgcactaggtagagatgtagcaaagtgacagtgtgacacgacaccagtagaaggtgatcggtgtgtgttcctattttaattaatatatttcgatgtgatcttttaatttcacttcgttttttcaaatttcctctttctgttccactgaatcgagtagaaagaattattttctctctgctccaataaatgttcgatgataagatgaactgtattccgtgactatgataagaatgtgttttccaggtaataagaatcatatctcaattttctatttagtgagaaacttaattactacaacaatagctaagcattagattgatactagttttcctaatgtatagttggagggccactagttgtcatgaagattaatcaaagagcagtggtagtgtagagacccattccaatatattaaaaaattatacagtcttggtacattactcccttcgtcttagaatataagcatttttagtatagtgatagatcaaacattttcaactctaactattaatagaaaaaaatatcactcatataaaattgatgttactagatgtatcattaaacaaattattataatatataacctttttatttaaaacatcctacttttatagatattgttagttaaagtaacatctcggaaatcttgttagagtctaaaaatacttatattttgggatggagggaatatgtgtgattagtattttttatgaataagatcctattttataatagtcagtctcccaaattgttagtgcgcggccctgcaaacggtcacaccaaagtaccaaacaaccagtgggctactacagtatagtagtatacacattgccctataaatacacacgctattgcaactttgcaagtgcaagttcacagcgcagtgccgccatggagagcatcaacgtagcaccaggaacaaccgctacgcctcgcatggcgccgccgccgccgccgccgtgcatcaccaacctccagagtacccttcgctacaacaacctgctcttgcaccgcaagacgaaggggtggaagccgcggaacgtgtcctgcagggtcgaccgccgcgacgtgctcctcggcatcagcggcgcggccgccatggtggccacgcagggcggcggcggcgcgctcgcggcgcccatccaggccccggacctcggcgactgccaccagcccgtggacgtccccgccacggcgccggcgatcaactgctgcccgacgtacagcgccggcaccgtcgccgtcgacttcgcgccgccgccggcgtcctcgccgctccgcgtgcggccggcggctcacctggcggacagggcgtacctggccaagtacgagagggccgtgtcgctcatgaagaagctccccgccgacgacccccgcagcttcgagcagcagtggcgcgtccactgcgcctactgcgacggcgcgtacgaccaggtcggcttccccggcttggagatccagatacacagctgctggctcttcttcccatggcacaggtacgtgacattgtgacaacatggctgcatcacgttcacgtctcgcgttgttcgtgtacagttgcatgcatgatatatatggggagtggattttttacgacttcctcttattttgtacatgtcattcaaaaagttatcaaaaaatttaaaaaatttgtcaagatagatcaatatacggtatatctttttcgcaaacatacgagttaaaattcgacttatacaattcgaaacaaaaacaacaaatttgaccgtgatttacgcagttaaatttgttatttttgtttctacttgtataagttgaatttgaatttgtatgtttgtgaaataacatattatatattgatgtaatattgatctatactgctatatttttttaatttttttgatgactttttacttgacatgtaaaaatgagaggattatttgagtggctcatgagattctgtgaacgctggacgcatgcgtgtgaacgtacgtgcaggatgtacctgtacttccatgagaggatactgggcaagctgatcggcgacgagacgttcgcgctgccgttctggaactgggacgcgccggacggcatgtcgttccccgcgatgtacgccaacaggtggtcgccgctgtacgacccgcggcgcaaccaggctcacctgccaccgttcccgctcgacctcgactacagtggaaccgacacgaacatcccgaaagaccagctgatcgatcagaacctcaacatcatgtaccgccaggccagtaatcacatacaaattttgatataaataataatagatgacaaaaactccaaattaatcgacttatgagttaagattggacgaacaaaattttatgatgtttcagatgatttcgggagctaggaaggcggagctgttcatggggcagccgtaccgcgccggcgaccagccggagccgggggcgggcaccgtcgagagcgtgccgcacaaccccgtccacagatggaccggcgacccgaggcagccgaacggcgaggacatgggcatcttctactcggcggcgcgcgacccggtgttcttcgcgcaccacggcaacgtcgaccgcatgtggcacatccgccgcggcctcctcttccccggcgacaccgacttcaccgaccccgactggctcgacgccagcttcttcttctacgacgaggaggcccgcctcgtccgcgtccgcgtccgcgacaccctcgacccgtcggcgctgcgcttcacgtaccaggacgtgggtctcccgtggctgaacgccaagccgtccacgggagcagccagcacgccggcgcccgcggccggcgcgttcccggcgaccctggacaagaccgtgcgggtggccgtgacgaggcccagggcgtcgaggagccgcgaggagaaggaggaggaggaggaggtcgagatccccgaccactccacgtacgtcaagttcgacgtgttcgtgaacgcgcccgagagcggggacggcgcggcgacgtgcgcggcgacgtgcgccggcagcgtcgcgctggcgccgcacgggatccaccgcgaggggcagctgtcgccgaggaagacggaggcgaggttcggcatatgcgacttgctggacgacatcggcgccgacggcgacaagacgatcgtcgtgtcgatcgtgccgaggtgtggctgcgattcggtcaccgtcgccggcgtcagcatcggctacgctaagtgaagcacaacgtgaaccgtggacgtatatttatcatctatacatgtgaacccagatggagagacggatttgtgtttgatatgtgtgtgactaatgattgtatacaaaataatgccagtaatataatgagcatggatgatattggcttaaaaactttgaaacttttagagtattcaattgatggtttggttcacgctgccaatttgaaatcaattttgagatgtcagcacgagaaattaaaaagctacacaggccgtcacatgccattctgctcgcacttcattccttctccgagtgagcagaaaataaaccagagagaacatccgccctacaaatctaatctgccttacatatgtacatccgaaacactgcagaatcgtaaaatggaacatatttgcatggtacatgtttgcaaaactggctttaagcacgatgagcttcctgcatgtcacatacgcacgggcgccgtacgatggcgaactcacaaccgcaggataacggaaagattaattgatctcttactgacgctggagatcaatgtagaagccgggattggattctcctcattttctttctgtctaaagaatggtacccagagaaagggtatgtactgggatgccggcatgtcccagaaacctggggaaacctacttcccaaaatccatgtgttcttggggctagaaaggtctcagttcttgcgagcggaatggtacaattccatatagtccagagcaggtcggttccatgtccaatcttgctccatcaccctcttgcagagggagtggaaccaatcgcgagcatcataccatgtggtgatcgctctgaaattggatagcaaaagaatgaattattaacgtcgtagcattaaaatttgtgttaactcctatgggttatacttacctgtcaagggcgtaatccacaccgttgctgtcagctccttcgaaactgaacccgtttggctcaagaccttgttctcgagctcgatccttatcatcgtcgacgtcaaaaacggtgtcataaaggcctgcataatgctcggcgtatcttttatcgatgctagaaataccaaaaggcaatgcaatgtcagggagatatcaagatgacaacgcacctccagttttccgaactattgggatagatccataacgcatagcagtaagctgggttaaaccacaaggttcaaacatggaaggaacaaggatgaagtcggcaccagcataaatctacaatacagtagaaccatagatttagtacacaactataaatcagttttccagttctaacataagttgctattggtagagtgtgaaacttaccaaatgagatagtggctcatcataggttaaacaaagctttacacgaccatggtattcgccatgcagtttactagctaagttggtaaagtcaccttgtatgcgatgatctggagctgagcctagtaaaaccacctatttaagaaagccaatgtgtttcagtattgaaaaatagaataacagatagatggcaagaaacatatgcatcaaacagtgtggcatctatgagcaagatatagacctgcccattgcgttcaagagttcgataaattgcatgtttgataaggtgaattcccttctggactgtcagacgactgataattccaacaacaggggtatcagtttgctgtagtccaagcctctgttgcaatgcctttttggcagcactcttgccctcaacaacattctcagaggtatagtggaccttaaagaaacaccccaaaaaaatgttaagtgagcaaatacccgtacaactactaaatcaaagaattggatatttgatcaacagcgaatataagcatatgtatgctactaatcaaattagctgcagataatcaacttcttaactagacatgcactctttatacactttacagatccaagaagatagtaaatgcacagttatggaatatgaatgaatatactgaatggtgattaatataccgggataaaattgtcactgtatggatcccaaatatctggatcaattccgttacgaataccgtggaatttggaaaagtgaggggcaatagcaccatgtcctgacacttcccttgaatacgtatatgaaacctgcaagttatggccaaaacagttaaaaacagacaatgagaagcacacattagtgatacgttcacatagaaaatggtatcttgaagaatttgaaaaagaaacacgatagtaaaaacagaacacggccaggtcactcacagttgtagccttatcacaacgtgccattgctttgccgatgtgatgtgcaccaaattcaaggttgtggatggtaaatacaacccgcccatttgacagtccattttgagcatattgttccttgaatagccaagcaactggagcacttgaccaatcatgacaatgtataatatcctgtcagaatgacagcacttgtgtatgagaagggtggaagcaaaaaaaaaaaaaaaaggtaacagtacaaaatctgtgaacagtgatggttcaaacgttcagcgatatagcaaaaactagctgctgcttggaatcaatttgtgatgaacagaactggaaaattgactcattagttcttttaagatgagttcacatataaattgtgattagttcatggccaagtacgagaacggagaaaatggcatggtacaaaaaacttaaatcttttcctacactataatcaaaggggcagatctcttgcacccattttcgaaataaaagcttaaatcttatggaacaaatcttgcacttacaggagaagatccattttggcggagaaactctagagcagaatggcagaagaagccaaatctactctcgtcatttcttccatagacacatccaacccaaaacatcctgcaaataaaaatgtcagaacaaaccttattttatgctaaaagacaaggtaatagattacttatcataaataagggtgcattgacagaaggaaaaagaattatgtacaccctccgttttttaatatatgatgccgttgacttttagacatatgtttaaccattcattttatttgaaaaaatatatgcgactatcatttattttgttgtgacttgttttgtcattaaaggtactttaaccatgacttctatttgcaaaaaagaaaaatcaaataaaacaaatggtcaaacatatgaccaaaagtcaacaatatcatatattaaaaaacgatggagtgatcaagaatggtctacacgtgtgtaataaggtaaggtgctgtatacccattctgtggttccaagaagtaaacagggacgtcttcaacttttccaaaccatacttttatctctgtattaccccaagtaaaactttgacggtaatgtaaatctttcacctgaaccaaaagacaagtaaattaatgagaaaaaagcccccacaaacagcgatgttcacactctcaccagcgaaggaagcaaatgatcgtaaaaataaaagcatggactatagttgatttcacgagaaatgcttcagtgctctttcaaaagtgaaaagtgaaaaccacagaatttaaagtgtttagagggactagttgcaaccattgaaccacctattgctccagcacttacagttgatttgatatttgcactttgtttttgccagtatctttaagattccacaaaaccccagagctacatatattagataaaacaagaaagaaaccatctgcactgtgcatatacatagcatttccatagaattccattgaaacactgaaaagaatgcaaccgaaaaggaagacgccaggatgccttacattgcttaggtttaaacagtcatacttgggaagaataacctcaacattgtggcctaaatcttgaacggctcgtgaaagacttgtaacaacatcaccaagacccccaacctgtgacagatcattttttagtacctcagcactttctgtggtccaaaagaattggtaaaaggtgtctttacctttgcaataggagccatttctactgcaatgtgcacaatatgcataggaggttcttttgcaacggaatcagtcacaggactatgatagtccatgccattcctgttgtcatatattccaccttcttccgactcagagaaaacaaagtccatcatatatgcatccaaaggaaccctaactagaaaaaagaacagatcacgtcaagcaaaggaaataaagtcaaacaacatcatcatacaaaaatgtgtgtgtgcatctgagagagagagagagaaagagagacagagagacagagagagaaccatgacaaagaagccaaatttcttttcctacagctcctaccacctcttattagtagtacaatattactttttatatattatcattattatcttcattttcttgtgtggctccacttgggtttcatgtcgatcctacattcctacccaaggttgctttgggactaaaagtcattgggaatatcattaatattgacatattattcaaaaaatttcaaaagcatgcggtgaaaacaagtgggattagatttttacacaaatttagtatgtttgaaaaaaggtaactcctgctttatcaggtttgcatgcttattagattctttctggtaaccatagtaagagaggaagagtagtttgaactagtctcgaagaagtctaatgaccttttaattgaggtattagtatgaaaaatgcaatcagaaaaaagacccccaacaaggacacacacctgttgctcttaagtgtgaaccattctccgcattcaccatcttctgtggcggcaaaggaccacttggatgagtccaacgattaaaggaacatctgaaccaaacctctggctttccgttcagcaccgtgttagacggattgtatagaacatccacggtggttcctgcacgtacttcgagaggctcagtgtacacaatgtgtttctgcgagagaagaaagtctctcatagtcttttccttcatctcagctttcatttttgcagttatctcagactgaaacaaacaaaaggcaaaagtcaaatgatgccctcctggatgtgttattgaacttgaaccagggccataaattaccatttatcaacaaagagtagcaagtaaccaagtatatacagtaatataggtttaatgctcctaattaatatgcaaacattctcttgaactgacctttcttcgatcagcatcctccctttctttcctttctttctgaagccttttaaatatcatgtgctcttcttccacccaaaacaggtcctcagatatgttatttggaacaacagcatggaaatcctggcgtccattgttatcataattccttgcattcccaggtggcccatcagcaaaaacccagtctaacaccaatgccccttcaggtagagtaactatacatggagtaaagtaaggagtaagctacctgagtaatagactaaaaaagcaagaaaacaccaaagatccaaggcatgtaattcactcatgagagatacacatttattctaggaaacaaacatcagtaggtgtcttcaagtcatatacgatttccaagtcaacgaacttcttaatattgaattcgataacattttaactctttgcatttctaaattaagaaagctataccatgattaaatgtacatactatcatgttacgaatcatctctcaagagatgaaaagtgtgaaatagcataccatctgcataccaccaatcaccatccttttcatatgatttgattaatttttcagcaatagagagcccatcactccaattattgtaaccgccatgcatccaaatctcagtgttatgcattagcggtcttgagcttctgttgtagaacaatttgaccctatcccctgctttgtatgtgtgaggctctatataccatagattatcagcatatctgctggctgaatttaataaattttgcaacttattcttgttcatctcgacttcagcctttgcttgtgccctgtcagcctccattgcagccctttcttcctccttacgacgctcctcctcagcctgtcttttcctttcagcttcttctgcagcaagcctttcaagctctctttgtttttcttcaaccaagaagtcctcaaatgagtgttcattgatttcgctttctatttgtaggacgaaatcattatgattgttattttcgtagatggtgtcaccattaaagaatacaaaatctaatctgtaagcctgcttgggtatatggagtttgcagcaccaccaatcccctgttaactcacttttatgcattttttgggtaaattttttccatctccaaccattgaatgcccctttgataagaatatcaggctcactggctaaggctgacatgctatggttcaagtaaagatcaatgaccgaatccgcctgtactacttcaggaaaaacaaaacacttattcccagccaaataatttttctcagcaagctcttcaagccgcctcctgagcacttgtggatccacatcatcctgtactggtgctatatcaggttcatactgttcatccttgattatcctagggtcatcatcagcaaacagaactttctcagtttctctacttaatggttccctctcaatactcttgccagttatctcttctggtgcttcttcggtgacatcttgtccactaataatggttttctcttctgttggattttgtccactgacaccactacttggctggctttgttcgggaacagagacaattgatctatcttgctcatggaaactaactacagatttttcttgttcatgaaaaccaacaattgatctgtcctgtacatgagtgctagaaactgatgtaggttcaggtttcgaacttattagtgcacttattttaccacggtattcatcaagttttctgtcaattgcatcatcatccatagattcagaagacagttctggagactgattttgctcgacctcttcttcagtctcagcttcaaaagcatcatccattccctccaagaatacactgctcgatacatttccagagaagtccacctccgatgattcttctacattactagtttgctctgttgcttcactactgagcttcccattgcttgtgccaagatcaccttcatctgtgccgctttgtccaatcttcttcatgctggattcaacagtaggtctcggagcatatgttctagaggcagcacctttaggtttcggagtggaggctctccttgggtttctcttagaataatctgaacaatgcaatgtcaggaaaaaaaaaacatgatcaaagaagtaccacataaagacagttgtgctttgaacaaaaccattccaccaacctgcacttgccaccaagcatcggagaagccttgtccttgtaaatctcctgcaccttatgatcggctggggaaaaaaaaacagaaaatggtacatgtgtgtgagtgcagatcatttacctttcctgaactaatcgtacttaatacatgcatttcagtgaaaatatccctgaagcagaaccgcacaatccaaattcccacccaagctacaaaaatttccgacaatgttcaatgcgtggagcaaatcagcaaaattgtcataaagttcacttcagtcttcagatacacacaaagcctgaaatgaaccaaccgaccggaacaaattctactcctagaaagtagaaaccaatcaaaggaacggaacaaaacgcctcgaccacgcatggcctcatcttctaaagcggcatggcctctcagtggtagcaccaattaaatcagaacccggagaacacgaacaaggaggaggccaaaaccgacacagccgcacccaaacagctccagagacgcacctgcgcgaagccagtggcggccgtcgccgggcggacgacgagcaccggccggctccgggagcagagcgggctatgcgccatctccattgccagcgccaaaacctccctcctctccccctgatcccctcctcctccctccctctccctctccctcctcagagctgactcccttcccttctttttcttttctggtttccaaaaactcgcatcgaaatgcgcagctgtgtgctgtccgcagacacacacacgcgcgcacgctcgatcgaaggagaaagaaaggctcccgtgctttcccgtgaaattttcgcgatctttttcttttttattttctgcggcgagagggaggatttgtgcgggatttgtgtggacggtgtagggtgccgaggtggtggggccctgagcgcagggagacaggagcaaaaggctacaaatcccaaaggagggggccgcggggttgcaaacggccaaacctggcgcgtcagtgagtgggccagggggcgttgcaacggacggctgctcttggttgggggagatatggatggggacatcggatggatggcgagagccgtgtatgccttcgccgttccggtggatcggcatctctccctgctgggttctggaacattccatgttagatctcgccgactgcccagtttcaagcagtcacctgttaacgtctatactgactttaagatagctataacttttttttcagaatcaaaagtttgcccaagcaatttaacatttcgtctagaatataaaaatatgtagttgtagatttcagaagataaactagaaaccagattcatagaaactagctatcaactaactacttcttagaatattaaactcctaaacagacccttagtcagtgaaatctattaataatattgctgctacactgatctaggcttctagttgtagtgtattagtactacagtgctttaacaaaatcaagaatcagacacgtgatttccaccataagagcaagaagtgtcttaaagtatcactagtgttgtctcacaatccaagagcatgaatacattatgacatgaataacacaatcgagaaattaaacattcatcttttctacatatatgacaaatgcattagtacgttgtggtactacattgtcagattcattctgcttaactttttagacaaaagattaattttcattggcccagcttttaggagaaagccaaaagaattcatacagaagttcgtcctgcttattgtttagtaacactgaagttatatttgaagcaaacaaaagataagggaagaaagaaacgtatctgagttgcttctcagctctcacggtctcacctagtcagttctcgactcgtctaatgtccatgatgcatccagcagttgtgcctgaatcattgcttgtaaagatcttgattgattgatggcttatcctctcctaaaataacagcaaaggggggcaagctgttcttgtcctcatgttaggtccatctcctgcaagtccaaatggaagtaagacagaatagtagcagcaacaactcaggactcaaatacgtccaagttccagaatcattgtacagagaaaccgtcgacattgaacaagattgcttattgctgaagcgtgtatcaggttaactgtagaacgtaggccgtaaagtagcagttacatggaaacagattagttgagtgcataacaaattcagaagaaaaaaaaaacgtaactcaggaaacacaaactgtctgtcctttttcattgcagcataacaaatacccgattcatgcttagaagttcagtaaacagattgatggggagcatatggtcattggaagagttctatgagttagcaatactaattttgctgcctagaattccactttcattctgttagctgaaagactaagagaatgcaacagttctgccatattatttttcttttgtagtgtgaggccgtggaacataaataggtcttcaaattaatgagacaagataagaacatgagtgaagaaatttgatttcaggccaatctgcaaattacacatggcaatattaggccgtctaaagaccttcctgagtcctgacattgactagagaacgataataccctaacagtatagtcacaagacaatcatttgtgggctttctatgagttcttatgagctaaagaccagaacaaaaataaatgcacaaaaaacagtaggcaccattatactataagcattcaatcaccacatcagtattgttcatgggtttaaccacatcaggtggcccaaattcgaaagcactaacagactgaaacttgagatttgttcaaggtatcaccatacttgcagacagtaattgcaagcatcatgctaacatgactaattaactaagatgtgatataaactgagaagaaaataatgtcattaattacaaaaggcggataggcattaagcagctcctactagggaaatactcgaaggattgcgacatttgcacttcaacagaaaaacttttagcaattatgccaagatgtaaatgattcaacagcaacacaccatggaaatcaatgtcgaccagaccaattcataaatggatcagtaatatcagttgataatatgtaaaaccccactgcttactaaagcgatcaactataaacttaacaagatgcaaaagaaggaaacacaataaagaagcgaagtagaacgtaccatccgttcttaattgtcttaattagcagtaccctacgattcacctcactatacaaactaaatgaagaaagtagaaatggctggtccgaaaacgaatcatgttccaacaaaacagtggaacaccattatgtatacaagtcatagatggtatataacagcaatgcatgacataagcccaactcacatttctcagaagttggaacttgaaagcatcaaattgattgctatggatgacgacatcacgacactaatggctgcagttgaagatgctccatgttagtagtcaccgagaacaaatgaacctaatacatcagtcacagaaaaggcaatatcatcaaaaccaagcgagaatttggaaaacatcctgaatatgctcccaaccattcaatgtgaatttagcataagccactattgctgcaagtgaactgataacaagagtattttcacaatctgggcagaatgaagttctattaagagcatacgaaatgtaagagaaaaacatgaccaaagttaattcgaaggcagctctgactaatgattttggttactagcagttacaaccaagaaagcatactaagatttatgtcagataagagggtagttgccaaacaaatttacttactgtagacaaatagctttcaatttctgaagtaataccagctcctctttactttcacacggcaatgaaaaatacaacatgctatacccatagaaaaatcaagaacaaaatagcttcaattcacagagcattcaatagatcacagtaagagcatccagtcatattgcaactcttttctgtcactttcgtatttttttagcaaatcaaagcataagtattcttttttgtctttgttttcacatatcagtacaaccaaacaaggaaaaaaaaaatcataaaccacaaaactatcgaaacaagggagagctagatccccaaatctacaggtctatcgcagcaaatacatcacgatccgccctcctagtgagcggcgaccaccatgtccggcgagccgaggaactccatggccacctcgacgggcaggtccgggctcggcggcggcggcgcgaagagcatcaccctcttcgccgccgcgagcttcttccgctgggggcaccgcgggccgaggagcctcgatacgggcacgaagtacggcatcaccgcgccgccctcgccgtccccggccgcagcaggagggggagacgacgagggcgcggcgggggaaggcgaaggcgacgagggaggggcggggcgggagacggcggggttccggcgccggagcctggcgtcgcggaggcgggcgagggcgccggggcggaggaagcggtggtggtcgacgacgcccgcggcggcggcggccgacgaggaggagcggggcttgcgtgtggctgccatgtgggcccgaggtgtcagtgagagccggatgcgggaggcgcggattggtgggaggcggagggagcgggtgggggtatttgaaggggttagggttgggcggggacgcgcgagccttaggagggaaaaaggtttgtgccaaaaatgggatcgcgccttcgttgctggtgacgcgtttacactatgacgagtgggtcccgtatgtatgtgggtcccacatggcggtgggatagatggcgcgtgacgtggagggagtaaattggggggaccggttgctcacgttttgaaacgagcgggcggcggatggcgcgcgtgccgcgtgatcgatcgcgcgcctatcacggtaacccgaccgatcgtatgggccgggttcgttgaaagcgttggatcgcgagaagaaaaaagtccactttacatcccttacaaatggatcgagttttaataatataacttgaacgtaaaatcaggtatactgtgcaactcgagtaaaagtgcatcataggaattggatgcaagccttgtccacaattcaacagttcgactagaaatccatccacaattcaacagttcaaggaattggatgcaagccttgtccacaagtcaacagttcgactagaaatccatccacaattcaacagttcaagtagaagtgcatgatgttccataggccatatttgcataggaattgccgaattggatacaaagtgtgtctgcagcaatagtctaggataagaaaaacatttgagcgggcaacaaacagacggcatacttgatttgttctaaggatacaactgccggcacagtttgtttcacatataagaaagtagtgcataaaaaagggacctagaatacaaatgtggaccaaaactgcacaaaaacagtaacgaaaaggtgatcattacaatcttaaaatctggaaacaattgtgaacgatatctgaaagatggcaagttccacattataagctgaatcaaaaacatcaccggcatcccacatccatatttacattctttgaatcgaacacatcatcagatgaatccctcggcattctctggcttctttggagttttggtactgttcacatcagtagtggccgtgcagacaggaatcgttgcagggcttcctgggatatgggttttcgacaattcgctgtacgggttcctgtgcttttcacttttcgcggccatcgtgaaacttccaggtatatcggccttaggtaaatcagcctcctgatgcttatgctccttcccggttatttgggcattttcttgcgcatgggctgttgggattgcggcctcctgattttccagctcccgtttacccatttcaggtttttctggcatgttcttctttggtcgttcaccttcctgatgcttgccctcttgtacaaactctttagagcttataggagaatagtcctttgccggtttatcatcttgatgcttgtcatcctgctcagccaccaccatttcctttgattttgctccagcatcagttgcagtggttgcaaccttgctataggcatcggttacccatgctgcccctgtaaggatgtatctgttactcatgattgcagagccagcagtagagactgtctgttctgcagctgctaatgctgatttggtcttctctgcaacctggtatttctgatccatttctttcatcttctcatttaccactaaggtaccagtgctgaacttctggcttagacccatcttcctatcaagcgaggtaactttcgcagttgcggtggatgtgagctgatgcttttcatcaaaagacttggccctttcaagggcatccttcccaaggacaaatcctttggccaacatggaaacaacagcatcctccgccttccgaagtgcagattccatgccaccagcgttcttagactaacagttcaaagataataaagtctagttactgaaagcaatttgcgaaccaaaccagagatgcaaaaattccatagttctacctcaatatcagctaaaacggctgccggcagctgataattagtggccggtgttatgatgacagacatatccactatagtcgcaccctgcaccagaaaagtacagttttacatcatatagagagcacaaccaataagacaaattttgaatccatagcttcttattacattaagtcaattaggcaatgtataggtgctaaagcacaaaagcacatcattatcaattactggaagaaaagaccgttacatattaccgtgagaagcatagccctctctgctccttcgtcatcttcgaaggtgatgtaggcaaactgagaccgctcgtcaccactgaaaagcattgcaaaaaggttagagccatatatcctccttcgtgagctgtctttgaaggttagttgctctgtataaataataagagatgtcatgaaggacatagcactaacctttgcatttcaacatgtacgatgacaccggaaaaggaaaagaactccctgatatcttgttctgatgcttcaagtgagacattgtggacctttattgtgctaaccatgcttgctttcaaaaaagagcataaacagaaaggcactaatcagcacactggttagggttttccatttttagatgcctctctagttagaaaaccaggacggtgtagaatgaacttcctcttttagtaaacaaatgaattttatggatcaatcaatttgggaactttctcacagacacacaaccgagaaattaattttatgcaaaactatgttacttgtcagcaagcgttatcaatggatcatgtcttcatcaaataaggttgaaactcacccaatttcatgaaagtaatacatttgaatggtgcttaacaagtaaaagagggagtgccagtattacatgcattattgggtctcagtttctaacagcttttgaaaatggaacagtcaacatgtgctcatttctgtgaacaaaatatagtatggaagagacagacatatatgttaagactaaaagaagaatgaaacattaaaagatcttctaaattttataaactggcaaaatatatcatgatggagtggtaaaaaaaatgtgacatgccaaagatttatagtgcaggtaaggatactaccgatctatgcagcagacaaccttttttagatgcattagatgttagaaacttagaatcatggtattacattgtgcaaattgccaaaacaacatgcatcgggtagcacatcaggaataaataaatcaacatatactagaaaaaagaactttagacatccagaatttcagagtaccaatgctgtctcttttcctcacatgcgagaagctgcagcaataatattcagacaaacatcacaacgaccagaaagtatgagccctaaagaatgtctaaccatgcaaccaaatgagttccaacaaagaatcataggacgagagcacttcgatctcgaactcacacggcatcaggaacaacgggtggtaggttcctcacctcaaacgagaaattgtgcgctcgcctccacggacccaatccgatccgagcagcgctcgctccggactccaatcgctatctcgaactggggagagggagagggtcgacggaaacgggatccgttgcgcgcgcgcattttgccgccggtttcgtcggatcagagtggtggtgatgccgaaaccctggaggaggttggcaacgtggcgacgcgcaggggacccgatccaatgggccgtgggccttcttcttctcttgggccgcctcaaagcccaatgcctcgctcatcaagcacacgcttcctccggtggtcggcggcgagccgaggcggcggagggatgggtggggggatgatctgagcggcggcggaggacctggcgcggagccggccggtggcgctgtcgctgtacaggcggatcctgcgggcgctgaactcgccggagctgccgctggggcacgcggcgcggctggcgaagaaggcggagtgccgcgccatcttcgtcttcggcgccgaggagaggtcgctccacaacatccgcgacctcgtcgacgccgcgcgccacaccctcggcctcctccaccgcggccgcctcccttgagttgggagaagaagcaagctcgcgagctacagctatggtattattacgcgtctatttcagtgttttttttcttagccattctagattgtaagattcagttcgtccctgtgtgacatgaactgtgttggagtgaactagtatatgcccgattttagatttttctgctatgtatgtgtaccacgcataacatatctattccaaaccgaaaaacggttagcattatgaatttatttccactggagtcaatttgatgttgttcttagatttgagatgtaaagttctcgatggtacgaactgataaaaagaaaatttgaaacattcaagcactagcatagatagataatgtttccagattccttgcacaactcctaacaatttcatgcagccatagccttgctagacataggactacaagaaataggcggggacgttcgatttctgacagaccaatgaagctgcaacttcatatttacacctttgtgatccgaggtaacagcaattctctcagcaacattgttgatcgatattactaatactgtaccaagctatgaaaattatttactcttcatttctgtgaaataaataactgtcaccctgttaacgttgttacaacttgcaaaatggaatcttaaatgtaatgaggcttctaaataaaaagcagttctctgttcaatgtaacggaactgttctaaattacagattgagtggatttatggttccttacagaaggtatactcagtgaattcaagatgcatgcatgaggctacaggccaatcttgcacgtaaagcccagctttaagtgatttcaaagctttggttcacagttggttttgctgaaattattttggatgtagattttttttagccaagattatgttgatcttagtgatatatatttggtcaggacttaaacattcttagatatctcaaaatagaaatatcacaaatacctctacaattaccatcaactgattcatttttattccatctcatatatacacttataccatctcatagagactcatttttattccatctctaggctgcgttctttaccgctggttcccaacccatctctctcgtttttcgcgcgcacgattttcaaactgctaaacggtatgtttttttgcaaaaaaaagtttatatatgaaagttgcttaaaaaaatcaaattaatccattttttaaaaaaatagctaatactcaattaatcacgcgctaatggatcgctccgttttccgtacggagatgataggttcccaaccccaactaacataataatctgataaaattatacatttatacaacattttctagtgccaacctaaatttggccctgtacacaaattctcctatccagttgtccatcttgagcagatgattgcaacgcatccagtttttcctctttcttctgctcgcgtgcatctccattgtcacccctacttcttgttgcacatggttccttttctggagacgaatcaatagccgtaacgacttacgaaggccaagaatcaagatatgttgcagatcgtttcttgattatagcaccatgcagtaatatgcaggaacatcttttaacacaaacaaaaacatgcagacaaacaatggccattgagtactgcagcagcattgcagcatggggagaaggaagataaccatgaatggctaaaacagtaatttgactgaacactgctgcttctttatgtctatattatacatcataatggatctcacagtagcctatcaaatggaatcaatatcaccaggactacagtgagatacagaagcagcaatgctccagctggcccacaaaggccaacctgatctttttcttcagtactgtagtgcatacattacaagttaccctaaaacaagagaaatgaagcatggaaatactcttggaattattccttggattaaattctaggcttacaatgttttccctattcggtggtcgtggcaactctagatcttctgcttgagcacttgccggagctggaccttctggctctccatccgtgcctccatgagcttggatttcaggctgtgcttctgggatgtccgtgggtactccatgcagcccttgaagccccggttgaattgcatgctcattgaatccggggagctccattgccctatgctcggcgagctgaggcctatttcttgaatgccactgtcaatggtagaatgggtcccaacggatagccgaacattagatgatcttccattgatcgtctccacagcatctttcttgcagacgtcattgttctttggacgggacgacttccagagctttgataaggctgattctttcttcttgggttggttcatgtttgtcaggtatatatcagtcgaatcatccttcagtttctcagcttccttgtactcaaaatcgtttcggctcgtccaagagatgcttccatcacagatcttgttaactgacggttcacttccatccggtgaaccacttgaagcctgcatatcttcatggcttattgtctcccagctgctgccatcttcagtgtcactctcattctgagggcttttacttgagtacaccttggttggcttttccaggaatatatcagtcattgggctagcctcttggatttctgattcgcacatagcagagttgttcttgtagcatggctcaatctcctttatgacaggctcttcacttggacgcagctcttcaaaaatggaaaatatgtcttctgattgtgccggtggctcatatctgaattcaatatcttgtgctctaacagatttgatcgcctgtattatgttctctgcttcttccacaaccataatgtctcctctagcacaactgcatgcagcaataaaagcctcaacatcctgttgcagtttgctcaattgtgtgtatttggcatcaagagtaagttttgcatcaacaagcttcatctgcacccgttcttcacgccaaacctcagccatctgtagcatcttgcgctcctcatcaacctcctctcgcagcttgagggaatcatgtttcaaggcttcaatctcggctttgtcttcctccacctcccttgccagttcattgcacacctcctcagtgagctcgcgtgctttcctctcattatcatattcttgcagtagctgctttgctgacatcttggcttccttcaactcattgacaagcttcaagttaatcatctccaggcgtctcctgtttttcttctcatggtcaagatctgccttcatatcttcaagaattgcgcgcactttctcatgctctctactccgccaagctgccttttcctctgcaagtttcttgaacaagtgatccagcttcttcttagccgcacgtcgctcggtttccagttcacttacccgatcacgtgcttgctggagctccatctggaggttagcaacataagttgcatcttgctgctcgttgagaagatttagttgactagctatcagataggcatcatgtgcttccattccctccaagctctctggctcccattttgttgccttctccatagcggtgactggtagcacagctgtagcagcatgaagcggtacctgcagaattaaatagatcagtgatcttacatgctggtgcagcaaaaagtatacagaggttttaacctcagtgcctcaccttatggagctctccactctttcgttccaaaacagaaattgggcttgaaatctcattcttaagggtttggtgatgaaccaaattattctgtttaataagctggacttgtagatgtcttgggatatgctgtcacaaaggcacatgcacaaataagttacaagaaaaatagatccaccagattttacagcaaatccatccagaattccagaaagcaggcccctcccccctagatatgtataaattcatgttactgtttaccactggggctattccatatataacaaaacagtgaattgtcatgggacgtcatccgaaacacagagaatccagaggggcccaaactatcatgacagatagacccctctaaaacagaaacatatgcactgaacctaaagtccaacctacatgaccacacttgtagcgttggtaacatcgatctcatttgttggctaggattccccatcagacctaaggttcaaagttcaaaaaccatttgatgtagctaggatagactccaattggatgagacaagaagctgtatggtcagctagtggctcacaagggaccacatagctgaacccagcttgcatatgtttgttgctgcacgggataagagttcaatcatttggctcatcggatccctcttaaaccaatcaacccaaccaagatccaaattccaaatcacacacttccaatgcaccattcatttccgtaaaacggagataagctactaccgttttcaccaacgaaatggcctaagccatacggacaattcatttgtagccatacgggcaattcgattgtactagttgcacgagcatggagaatccaatgactggggcccgaccaggttcacatgaggggatccgggagcaggaaatgcaactgccctttttggatcagtaaatttatgcgacaaggatcacggccatcgcccaatgggctcagcacggcagctctccataaatgtccatgcttctgagcgacgcatcctgcgcttacgacgaccactgaatgcgtcgatgctgagcgactgacactagtactgctaagcacttcaatgaggagaatggattaatggatttgactacggcagtcggcaggcgagtttaaggcagaaataagcagatgaagctagcaggcagatggtacatgctcctgcatggtgtaatgaagaaatcgcccagaaggcgaactccgaaatgttttgcgtgagatctgaacatctctgcaacaaatgagtgcgttttgacctggaatcttagcattttggtagtaatggattagtcaaaaaaaggataaacatgaccctagccaaagtttttgtttgttttttctttgattcaagctgaaatagcatgagaccggaacaaatccatcaaaaagcattgaaaatgcgcgctttcttagctggacttgactaggagattgacgaacgatacagcaaatcagctcagcgaaaaagcagacgaagcacgagcttctagtgagctcaccagcactgcaacgcatatttgttgggggaaaaaatcaaaaacgaaaaaggggaaagggtttaagcctccgtgcacgtacctcgaggccgacgtgaaccctcctcctctccccgctccccgcggcggcgcccccggccaccgcctccggcggccgcagccgccacactccagccgcgagcctcctcaccgacacatcccgcgccgcagccgccttctccgacgggccacctgccttctcgccgccgccaccccccttctccgcgccattccccacatcccacttgagcagcggcgtggcgggcccgctccgccgccccccaccgccaccgccaccgccaccggaccccgacgccgtcttcagcgggcgcctccgcagccttcgaggcgtccggacagcagacggcggcgccgccgcaggagcagcggcggcggcggcggagcggtgcttggagctcatctgcgacggagggtgcggctcgggtggagagcgcgctccggcggcatcggctcggagacaagacagggagagagacgcgcacgcagtggagctgaacagcagaggagagcggagaagcagggacgggagagagacgttgggggtggctggctacttggctagtgaggaggcgttgggaaacgggaggtaaattagagagagagagagggggtggtggtggggagaagtaaactagagaggggaggtgtggagtttttggggagtgtgtggagatagtggaaggacggatctgggcctggccgcggtttaacgtgggtaaggctgtgtttggttccatgttaaaataaaattggaagtttaaagaaattaaaataatgtgataaaaagttagaagtttatgtgtgtattaaagtttgatgtgacgaaaaaattagaatttaaacagagcctaaatggatggggagattttggatgcacgcacggctttgttttgttatcaactctcttgatgttgcaacaaaaaaaaactgtctacgatttttgggtgtgtgatctactgcagtacactataggttcaccaagaggctgtcatgtgagtttttcttaaaaataatccattgttctcatgtcaaaattgatcaatatttaagcatggtctcaaaatagcatatatgtgtttttacggatcagatcctctatagtaatgcataggggcactgtttatgtgaggagtacagtaatgcaatgcagtgaacaatgtcgattcattgtagcaacaataacgaaacacattgtatagcactattgagtattgcggtagatttactgtagcacgcacgatttggacggtctccattccccctaataccggatattgtaaatcctctccattacaacatgtaatgcagaggatcttgattcgtatttctacgttaacgtttctctacatctttacaaaatatctcaataaccactcctttataaaatgtagtacttatcttattacgagaacaacgagttactacttctccatcagaatgtgaaggaaaggaactatggctgtgtttagttccttccaaagttataaatttgggttgaaattggtatgatgtgactgaaaagttgcgtgtgtacgacaagttgatgtgatggaaaaagttggaagtttggatctacacagcatatgtgttggtacggtacatcttccgtggtggaaattcagacaacttttatgtgttggtacggtatggttacaaacttaaaaacacgttacgtcctctagtatttattgtgtgagaaaaaatatacgaagttaacaaaacaaaagcaaattaatcacataaaagaacatcaattaacttaggggacaaggtccaatctcagatgacgcctcctatatctctagaaagcgcaacagcacgtcacatgacatatcgccgtcaccggctcaccgccgcaggtccccctccaaaacggagggcaataacggaacagccctcacaccccgcacgtcgccgttgaagattgaagaacccatcatcaaatgatcaacaaaatcccaaatccaactgcttcgctaacctctccagatgaccacagatccgaacacacaccacacgttcgacaccacgacacacctccacgtggcggcatcccgcacgagcgccgcgctgtccggtgtccggactccggacgcgagcaccggccgagagccgcgcgggaaaaaggcatccgaggtcaggagcacgagggtacggggagaccccccgccacgtcggaccggacgggcccagggccccacccgtcagagaggacgacgtggctgcacgcggtggtgggccccacctgccgcccgcgtcagcatctcgtccttctccatccatcgcggccgcggggagcagtaaaaaaaaaaatgggtctcgccgggaggaagacgacgacgaggccgtgcgcccgtgtcgacgcaacgcacgcagcgctatgactttttctctttttttttttgacagcagcgcctgtgattcttctgcgagcgtaacagtggagggtgaattcaaaatttaaaccttgccgcaaaggtaaaaaacgcaaaccggcaaaaccccattgtgatctgtgaattcttcaactttttttctctgtgttcggagctctcctcttcagattctttccctggttcatgtggatggatccgattcatcacccatcaagcgtggagacagctcgttcgtaaacaataacgccgtgtctgtgataaggatctagcaggagagaatactatgccgcagcagtagtagcagcatccgagctttctcatcaagggggaagaaagaatacgatgtagcactagcagcagcgtgcagcatgcttgacccgacacacacatgaagatgagcatttttaactgcagatcctctcgtgctcgtgctgcgtggagtatgcatgtggcgtagtcgaatgctctacgggggtctaggctagtagtagaataattctctttgtatcaaaataaaccaatatcgtatcggatatgatacatcgttcaaattcatcgtataaaaatatgttacatctaatattatattggtttattttgaaacggagagattagtatagagcctgttcactttgatgtaaaaaaaaaccttttttggtaaagttgtcaaaatttcagtaggatttcttatatagttaccaaaatttaatagcaaactaaatgtagctattttttttataacttaactaaaatttggttagattgaaaatgtgaacatgcccatagatttgcctcgctggtcggctcggtgccgacttctgagctccgacgaagatcaggtaggtgtagttcaggtcaggtcgcatgattagtcttggagcggcgttttgctccgtaattatggctgcagatcgatcggtcaaggcgtaccgcgtacagtatgtactactcgtatagtctactgtagaagtaacatgctggtggttggcgatgccttgttaatcttgggggcacggtggttagatcatgattcggaaatggtagttgggcttgcagaggagacaaagcaattacatgtgtaaaggggagcgattttttcttgcaggtacaggaatgccttttcaactggtgtagtacgcattagtagctcggttgttgcgtattctttggattccccctatttatgttctgtattgtgttgctctcgacgctgcttgttctttgggcttaggattccccttaagtattttatgtttatcctgtattattattgcggagaagcaaagcttgaaacttcctggaaggagtacaaaaatctagaattcggcctgccttgatgtggctgagaacgttggcccaacttagcccaaacaaatttaactggctttggcccatacaggattcaaggtttttgggtcccacggaaaacgaactgaatgtatctctatctctgtcaaagttaaaaatatttctaccacaattttagtacgtcatccgtatttgagttagttataaatccatacttaatttgaatgtctaaaataactagtatatacttttagggaccacctattatgcagttaattgaaaaaaacgaaatcatcagttgattttggtatagcgttcaaatccaacggttgttgagtaaaacaacccaactcaactagctcaacctttctctctcccaccctaactcgaccgacccataccatcccatgcgtctccaatcgacgccacgtgcaccttctccgaccggcggtctttttctctcgctaatcctgaccctctccctctacttccaatctcatctcttttctttttttttctcttcgaaattcctcttctcataaatattttccttttgaatttatcattgtttaaaatgtgaaatgtagtaagtttgttacattgcaaatacctttccatctagagtaaaagaatgtttactaatgaataaacaaaatttcaacatttgattgacgaggtatagtaaaatgcgtcaacttatgtaatagacacttgattgatttgtgagattatagaaaagtgtacataagggattgttcgttccatgatgcatgaagcacgtgtaacccgcaatgctatacatggtttctaactttatttgctgttgttttatttgtctattttcgatttttatcaatcgtataagttatctcactggttaaaacgcatacatttttgctggttcgataaaaactgcgaaaaaaagagcagtggcgatcgagactcttcgaattcgttcgattccctccacgaaatttgcccaaaaaacagttctcccgccaaagcgtgaatcccccggccaaattttccccaccggatcttcatcctgcgaccgcggctcaatcccaatcccatgccgatcccctcctgcttcctctctcaaatctccctgccgcaaccctagcctcgccgccgccgccgccgcctccggctcgccggctcccccctcccccgcggatccaagctatccaccaaatccctccctcgccgtcgccggcggatggacttcactgccccttccttctccctcggctccgagttcgacgagccagaggaggcggtagggtatacggcgcccgatgccccgtccttctctctcggaatcgatttcgagggcgacggcgacgagtcccacctcaccgatgccggcaatggaggggaggagcagaagcgttatgaggctcccgatgcgccatccttctctgtcggcatcgattccggcagcgacggcggtgaggagcgccgccgggaggagcaacggcgaagttacgaggctcccgacgcgccctccttctccctcggtatcgactccgatggcgacggcggcgacgagccccacctcaccaacggaggccaccgggaggagcagcagcggcgttacgaggcgcccgacgcgccctctttctccctcggcatcgacttcggcgacggcgacgacgaaccccgcctccccaacgcaagccgccaagctccgcgctacgaggcgcccgatgcaccctccttctccctcgggttcgatgacgacgaagacgatgttctcatcggcggcagccgtcacgagctcgggactgtcgaggaggaggacgacgacttcgtcctcgccgacggccaacagcaacagcaacggcggcacgaaactgttgtccccgacccggcgccgccgccgccagagatgaatcgattcaagcggctgcggagaggccccgcgccgccatctcaagcgccaacaccacctcctcataggacaccagcgccggctacgatggaggcttctccggtggtgagctcgaaggccgtcttgggggatattgggagctttgaggatgagatcgaggatttcaccgacgaggagagattcatgcgaggtgagggaaccactgaccctactttcttgaatttttgtgcttacttatctttctaggcatttccgtttcttattctgaatctagtaatacacacgtacacactcctggtcaatgaatttgtaatttggcttcttcaaaaagctgaaggttagccaaattactggaaccagcacagcacacactagacatccaccaaaacttgcagtctgaaaaatagagagagtgatttctagcgatttggagtcacatgcctgttcatgtaacataagagtaatccagtagtcaaccataaaaccacacactcagtagatctccaaaataacactggtcagattacactgaagactgaacaacccgtagtacttcctcaatcttcagaactaacttcagacaagaaattagctgggatatcctcaaccaggcttgctgccatttcacaccaattatgccttcagatttgttgtatttgttgcttgattgcttgaaatcctattaatatatttttctggtatcgccccttgactagacattccaacatgtgctgtgtacatctgctggatgaggaacttatgccccttccaataccatcctgtttgttgtcagccaaagagcccaacaaagagctagcagcccgtataacataatagtttttttggctaactttttagcttcccatgtctcatctgttctttggaaaattcagaaatagagttaggaacactgcaaatttgccatagagcgctgaaacaaagaaaatgtggccagcagcacccaattatccacacaatttctattgtgattattcattcatcatgtatgtggtatatttgtctgcagctggctaatctctatattttacggaactttcttcatttccttgtgtggattgtggaacatgtaacaacttctctgcttgcagacgtaccgccgtctgttggtagctgcatcacttctagcagctcaaggttctctcatgccagcaattcaaagttctcgctgatgaaccatggtgtcctgatgagccaatcaacaagtaaatcaaagaaatttgcacaaacacctaattattctgcttcaaaatctatggaagaaagcagcaccaagaaactgctccctaagacagcattgagcccaatgaggaaaattcatttgcttgattcagatagtgactcggatgataacaaggaaatgcctggtttgcagcaaaactgcaaatccaaagtgagcactgttcaacataagggcaaggctgagatgaatgacagttgggcgacacctgctcttgatgagttctgcaatgagtatttcaaatccgtggaagactcgagaccatctcagcagaaagaaggcaacagtttttgtggccccaaagtcatacgttctaactactctgttagtgaaactggaggacattttccacatcaatccactccaagtggggctgtactagaggacaatcagacagatagtcatcctcctgcaatgcattattttttccaccatgaccagttggttcgtgacctggtccgtcaaagactcaagcattttgttcctgttggagtagacagcagaggaaatgagcaagatggaacacaaaatctccagtacaggtaattgcggttcacacatcaacaaattcacaatcatatcctgcagtcctctgtgcaatgtcttcgctgatcttggttactctgtttcatcatccttctacaggagtcagaccggccggtgtgctgctgaaaatgatcggtgggtgactccgaacaagaggatgcctgttgcaactcaagttggcagaagaagagtaaatcctgctggaatgtctggctctggccattggttgactggagacgatgggaagaaggtaaacctgcatgtttgttttcaacactctagttgatttcttgatggaaaaaaggctctgtcgcatatgcactgtttttcattatggaggccgacctgtttccccctgtattttggttacgtattcatcgttgtgctccattggatttgggctgcaggtctatatctccaaagatggccaggagttaactggaagggttgcttaccgacaataccaaagggtgatatgctcattcctttatgattaatttcaaagcattatccttgtttgcaccacactagtttcatacacaatattagcatattttgatttattttcaatttaagcatatagtggttacatatgcctagagttgcacaaatatatttagtttggaattcatagtgaacctggcatgaggatgttatttttactgcatggtggcatgccatctaatttaacaaatctgtgcggaacaggaaagtggcaagggatttcgccagtcgaagaagaaaagttcggctggaactagagcaaagaaagccactactaaggtgaaacaagagaaaactagagcaaaaagaaagcgctgaattcaagacgtgctggcctcgtattcacagacgaggtggtgccaatgtaattagtcaatgagaaatcatagtcattatttgttcaatccatttcataaggagttgttaaaaacatagagcagagtagaatgacatggtttatgtcggagaatataatcacataacaaagcttcaactgttcttctttgataaggtaatttgggtgactagttatttgttaacttgatcaggctttgctactattttacacgtcgtgctcgtggttctctcatagcactaatgcaggaacacaaggccttggggctttgaagctgttcactgctgggtgaaccttgattggcaaacgaggtctccatggagtcatggagagaagaaaacggtcagacaatagcggctgcgcagcctgggcattcgtgaccgtggctgatagctgcggcgcactggtgttggcctccctgtttcgcgcttaaggtgttgtttcttcactagatgagctgaattcgctaggatacgtagcagccaaactagtaggcctaaatgggccttaacatttatttcacaagaaaagcttcaactgcagctctccttggataaggtgatttgggtgacgattgacttgtactccctcttccctctgtccaaaaaaaaaaaaaataaacccaactataaaaaatttttatataagacggacagttaaagttggacatagaaacttagagtttatcttttttttttttggacggagaaagtacgtcgtacgcgtggttctctcctgttgccacactcaattgtttacttacccttgattagttgtttgtcgtgtcgtgtcgtgcccgtggttctctcctgttgctgcactccatgtctattgtttttaccctcggtcaattgtttgggaacccacggtatcgagctgttcgccagccgaatcgtaagttagtacagagctaatgcagacagcaaacatggttgcggaacatggccatcagcagttcagcactccccaacgttctcacgcgttctccaacccttctgccagagcaattctcacgcgtgcacgcgtcaggccttcgatttgtttatgttgtgcacttgtgcttgtgcgtgcggtgtgccggagtttcgccggccactctttccactccataaccataatctctccgttttgacagtccacccgcggaagggaaatgcctggaggcgcggctcgtgtgctggcctgcccagtggccgagtgcttccacgccgtgcgcttgcttccagtggccgagtggcctttgcctttgctatgatcaagatgagcgcaatgacgggacgtgcagctgcatcgttcccgcgccgcgcgtccaacggctaacgcctccaaccgccaacgaaatccagagtcctaactaatctcgcgcagggttcggttaccttacctgcactgagctgccgaccgattattggtagaccggccggaacaattcaagtccatatttaaattttaaattgcatgatctacagattccgtgcaacatatatgttgaggtggatctatagaaaaaaatgttatgcattacatcatctctactctctagtagtatcctctactttagagtccctaagagcacccgcaatggtaaagtaaggtgctctctataaaacatgtacatctcagcaatagactagataatagtaaactacttcaatagtatgtctacatgggtatctatagctctctaatgcattgcctcgtttttctctatagactatctccaggttagtagatagctgtgctctctctcttcatttaatctcttccaagtaggaaaatatgctgacatggatctcttgtagagagcctatatataaccattgtgggtgccttaacaatcaaatgggggttgcctccaattctttaaaaccttaaatatgccatcaactttagtagtagccctcatattttagctcctatttcttttcctcttttattttagcatataatttatgtttatatatagtttaacaccaaaagtttgaattttaagttttgaagtcaggaaggcggattattttttaacctgggtttatcggcagtgatcggctcgttatccgtggaaaccagtttttcaattcaaaatgttattatattcaaacttttgtccacaacaactggccaattaccggtattttttttcacggaacttcaccgtagcatggcaccacgggtccacgaccgtacatggcccgagtcgcgactcgcgagccccggcccccgcacatggcacaccaccctgcgcgcgcgtcatctttcgacggtgtcggtaaccagtgaccacgcgcgagccaacatccgccgcccacccgctcgtctgatcggccggtgtcccgtatgacgcgccgatgcttgcgtgcaccgtgcactgtgcgggcgggtgcatgtccatatcgatatcgagcatcaccaacaatctacttatcttattccaaaactaatttttcgagattttagttaaaaaaacagttccaatatatacctactctcctacccgaattttgagttcccttctctcgattcctcactctatttatatgcgggtgtgaaactcactcccaatcttgcactccgcctctctctctccagttaccgcgtgggagatagcgatccttacatgtgtgaaagaaaaaaatggaatattctattagtagtttgacagaagggcccatttttaagttttagacggttgaatttaggcggttggagggatgagtctttcactttttattttcagtttagaaaaccaaaaatacttttttttttggaatgtgatgctcaccaaagctggattgaaacggctctccatcaatggcctgagcgctaaattttgcgaggaagttttggcggatgggaaccggtcgataaaacagagacgatcatgctacccgatacaacgctgccacatgttagagcaggagtttgtcagtttttggctaaacgggcaggattaccggtttcaaccgatgtatttggtgtaaagagaacttttacggtacaatctcttagtatatactagtagtatatagaagacatgttatctatgatcgggatcagacatgctgtgaaagttaagctatcggaaatagaaaaagtctatacgtactaaatttttcttacaaaatgtttacaaactctgatatgtcaaactgtgagtaaatctagatttcttacaactttcatctagttaaatcaaacggttgagaaatttgttagtaaaagttttgtaagaaaattttagtacgtgtagcagtactctcggaaataagcaagtaactaatcaggatttgatcccaaggatcgtatctacagattacagaatctgtacgaattacgtataactgttaatacgaaacccttaacagcatcatcttccaaatgctacagtagtagtactacattatatgttcactcgccattattgcgttggaccttgcttgatcgcgcgttcgggaccttgattaatttgttctggtgtacccgagttcagtcggtactcggcagtgacgtggttgcagcaacgtgagaaatccaaactgcctcctctccagcggccgctcgcccgtccatctgctttgcccatcccaccccgagggaccgagagcgtgacaagcagggcaacctgctctcccagccgccaccaccatcaaagtggccggggcccgagccgcgcacggcgcagcgcacggttcgcccctcgtccgcgggacgctgaccgcgcgcgcgacatctaccgatccgcgcgggcgtcacggtgcgtgctgcccaaccgatcgtgcattcgcgctcctccccgctgtgcgctagcttcctctggccacaggccgcgcgcccgtcccccggccgtttctgccacaccccatcccaattcccaccccgcttcccctcgtgcagtcgcgtggccagtgcccggtgaaaacgttgcatacgcgacgcgacgctgctacttccaccgtgcctcccgcgggaggcccctcgctcgctcgtctgatccgccagcttcgtctcccggcgttgtgcggtgccaccctctcatgcgtgcgattccatcgatcgatcggtgcgccactgcgtgccggccagtggccgaacgagaaagtgagcaaccagccgaccgggcgcgctcgtttttttgcacaaggccgccgcccgtacgtacgtctacaccgctctaaccaagttggatcggaatggctccttcagtggccctctgcccctctcgctctaaatttcgcgagggggtttcgatggaaagggacccgggtcggccgagcaaaccgagacacgacgtgttacctgacgcgacggtgccacaagtttaaagttagctagaccaggtgtttgtagctaaacgggcactgcttagatacacgtgatccggatcgaggcagcccatcagggggctccaaatggcgtccatagaaggggcagatggaccatcgacaggtttccatcgttttcgaatccaaatgctactgaagaacttgttccccttcaccacaattgcggtggacctgacctgttattagcttgcggagttgtggtatcagtctctcttcgaactttccagattttcttcctctcggcaggtgatgtacgtgtgtcagtgtgtggtcctgacgggctgaattaatcccctaacaacggcatgcatgcatggattgatggatacgccattaaacactgaacatccgatactttgttttcgcatatttattatctgacagtgtcggcgctccgggttatacaagtttaccatgtcggagaatttaaggggagagcggttccattcttctctctcattctctcttcctcaatactaaggtgtgcttggtttgttactatgccaaaatattggtaaccaaaatctaggcaagtttttgtagtgtcaatattttggtaactttttgtgtgctattggtagcaaaccaaacactattaaaatactaatcaaagtgctaaacaatttggtagggcacattttggcttcaaaccaaaatgaccctaaaaatatggacagagtgaagtccggtgtcggttgttagggttgagttttggacaatctcactgtagtttttttgttggccaagcgacgattggtcacgtttagcaatgatcggtccagtgttagctttctcacgagtttaagtgttaacgatgttggcgcgtggggtggttattattttttttttctggttacgatctttcaggactgtagtcttgtaaatttttttattccctattaacttcgtatttcgtattgtcttgtgcgagtgggtgaaaaaaaggttgtttcattctagacaggccttaaacaccttagttggaattctacgatattacggcgccagcttcagaaaaaactgtagtatactgcagtcctacacagatgcacaacaaataattttccatgtttatggcatgtgactagtcaaagtcctaacatactagcagccacctagcaaagcaaaacatttctagtatgatctccctatagtcaaacaaagcccttggagccactgacagtgggctccacttcacaaatacaaactccctggattaaataagcaccaccttaaatacgtgtccatcaacaatcaaaaccaaccaacacgctgttcaactccagaacctcactaagtttctggcaaggtctaatcttaaaataaattttcttaatgggtcaatttatcaaaattgctgccagaaccttctctattagctctccacaaccacacaaagcttcgcgccacgacgctctctcgcctctctgctgctttagcgttcgcgcgcgcgcgctgcggctggctggctggaccaagctaatagctatggacaccgtcgtggcggccgcgacgacgggatcgagacggtggctgccgtgggcgcggcggcaggcggcggcgtacctggcggcggccgggggaggcgacgacgggtgggcggcgtgcgcggcgtcggcggtgcggatcgtggtgtgcttcgtgtccatgatggcgacgacggcggcgtgggcggtggtgatgctgctgctgctgccgtggccctgcgcgcgcatccggcagggcaacctctacggccacgtcaccggccgcatgctggtaaccaacgctgcgagaagccaaccgatgtttcttggactatacgaattcagcgaagctgaataaactttttttttttgcttgcagatgtggattctggggaatccgatcaagctggaagggatggagaacctgaacacgaggggaatcttcatctgcaaccacgcttcgccgctcgacatcttcctcgtcatgtggctggctccgaccggcactgtcggaatcgccaaaaaggaggtagatagaactgtatatacacagttgtgctagcatgcaagagagtgagaaaatcatctgcctagattgtactaataacgtggctgaaattgcaatttatgcagatcatctggtacccactgttcgggcagctctacgtgctggccaatcacctccgcatccaccgctctaaccctgccgctgcaatcgagtcaatgaaagaggtataattaagttcagtgatgtttacacactcctgttcatgtcgatgcatcattgtgcttgtgcatttgtgctgtttcgtagcatgctcatatttcttctgccctgctgttcccaggttgctcgtgcagttaccaagaacaacctatcactgatcctgttcccagaggacacacggtccaaaaccggaaggctactccccttcaagaaggtactacaataccaatacagattcagcaactcctcatcatcatcgtaatatcagctgaaaaactcaccgatgaatctcgatgcgtggcacgcaggggttcgtgcacacggccctgcagacgaggctgccgatcgtgccgatggtggtgaccggcacgcacctggcgtggaggaagaacagcctgcgggtcaggccggcgccgctcaccgtgaaggtgctgccgccgatcgagacggacgggtgggtggaggagaggatcgacgagtatgtggagatggtgcactcgctgtacgccgacagcctcccggactcgcagaagccgctcgagcctgtgaacaccgggaagaagaagatgagctaagttcacggttagttaacgcacacacggtgacaatgggtgtagttttgtgcatacgcgctgtgctgattgttgtatagattggtgtgtgcgtgatatacatgcttgatttggggatttgtagatgcaacagaaggttaaaaaaaggttattgattttgtgagcacatgaagcattgagcttgtatttgggtgccaatgctgtcttcagcccttctgcggatcatattttcgttcttttctttgctcgctctccaagcgaaacactatctaaagaaaacagagctaaagaccgatacaatgttgtactcattttctccgtgcctggattccctttatgtaatttgattatcccaagctgcagccttcgtttcttgaaattgtatggagatttttttttaatattatcaactaaaatacgatttagcacttaatacactaagcattcccattaccaaatgctccaagatcaataaagtttacccagtgaaaatgactaatgcaagagatagtgagcaataataatggatgtccttgtcacaaattaagagatcgattgcattgatgagctcggtacaggtatactcagccgtttatagaaggaagaaaaaaaaaggcacaatcaacctttacgatccaattgaggaccaggcgttcttttgattatatatgtatacacaggtcagttatgcagcaaataccaatgttaggttcgtattggcagatgcttgcttcaaaactgagagttggaaatctttccaggcatttatcgacctggattccctgaacctagcagcaaaagaagaaatgtcgcattaattcataactgcaaaataaatatcaacgcataatagaaatgatggataatagtgatatattaccacatcatcatatagagtcctgtagtgatgactgatgaaataaatcattatcccaatttctgttttgagttacgcaaacacaccaagtcctcctagcgtaaccgttcagtcagttggtcagttgattgccattgggctctgggaaattaaagaaccgtttcaacttcagcaaactgaagtttacgtctatttaagtatggaatgtctttcccactgaaataggccagacttctcaacatcaccaagtgacaacacaggaaaacctgaaagcccagcactgaagctgttagaaaacataaccaggaggctttggcaggcctgctcttcttctaggtgctctgcctcattgcgatgcatagcaggatccttccaaggttgataataatgcctgggagaataaacatggttagatcctgcagtacaaaaatatctaatcataagagaagcatagacaaatgtaaatgatgtggttttacacactagaggccataccatctccatgcaggattagcttcagccggacattgtatctgtgagcacagcatttcgatttgtccataatcgccaatgaagtttctgataactgctttaagaaggttaaaaaaaatacgagtgcaaagcattagcaagacgggcgcatgttagacctagaattgatagattaaaaattcaaatcacggtaaacataccttgtttattggatctgtcaagaagcaacaagcaaagagcagccaccacagatggcaaaaaatctcggttcattttcagatgtttttgcaggtacagtataattatagctagtgcctcatctgcactgtgactgccaacagtttcaaccttttcatcatatgtatagttcaagaaagattcaagagatccaaaattgttggcatcccttgtaaggtctccacacttttcatgagagatgcaggagattttcccaagaattatggaagccactaaccagcgcagcatcttagaaagtaggcactcgttttttagtggctcttcatgtggcattttcagtacagatctttgttcatcacacaaccagaagatgttagaagttgcccatgaaacaacagttgctgtcatcgacttatcctgccattgtcacaaaaaatataatttataaatcccattacacaaaatgcatatgaagacaaaaaagaaacatgttactgcaaattatattaattatgaggtccacattgttcatggcactgcacattctcagttattaacagtaccacatggttaggcacaaaaatatatacagtaaaatcttataaattccacatgaatcaagagtatgcaagaatagggacagatagagacaaggcaaggcacaaatgaagtaccatttcagacaaaactggcagaggaccattcataagaatgacatcaatgccaagttgcattgcaagcttaacttctatgcttcttgagatgccaccaatagttcggcacaatttatgtatgccatggagggataaagagaaatgtggttggtaaatcttccttttcatagacaacctcatcgttgatgcaatcacatttagcactgaagttagcaatggaacatttcctttcaacaatttcatatcttcaacaaggacataaaggtatttagatattcttgagagttgctcaagggcggtttcttggagccattctgcaattaatcttgatgatgtcaaatcattcactacctggagagaggacataaaatcatatgtatagattaaaaagcagattcacaatactatcgtaaagaaaatgatgtgcaaaacattgctaaaaaaactctccaaatcataaaataatactagaccattgaacaatgtcgttctcatagaaaaacaaatgttataatctgtgatggttaatggtatgcaggtgacaaacggctaaaatagtgtgtttgtatcaatcctatgggttcattgactgttttctaaagatatgatttagtgactcatgtttcagtagtagttgcttgacagaaacaactgactggcattatcaggagtgtgagttgcaacctacttaacttgtctaaagaaacagcattactaatgagtgagaaacatatatttagaactgcatgcaccaattaatgttataaactaaactaggacagctgcaataattatatatacttttaaagtattgacacaaggaaacagcaaatatcactgcagagtgaatttgacttaaggaacaaaatcaacattaataaatcagtcagttctagtaatatcaagcaacggcaagaatcagtcccacaaagtagttagttgaaatgatcctcatggtcaccagcagagatcccatgaaagaaatgatgggctacaacctacaatcaagattcatgaaaaaatatgacaaatcctagagaaatggttctccaagtgtatatatgtgggtacatgcactgtcctgcccagttatagtgcttcaatatctgtgcaaaggtaacacgatagaatgaatggatagggaacatgggtggtttggtttgaattttgaagattttacaccaatctcaaggcatatgtttgactgcagtgatacatgcagaaaatacaataaccaactcgtacagtcaagaatctcatctataaaagtgttatagaaagtaatgtaaaacagtgtttacctccaacgctgacccaattactgtagaagaataggagttttttacactgtccagcccttcgacatgagatgagattacagaggataaccacaacagaaggccagagtcttttgttaaatgatgagccagaacgggaagttttacacacttctttagcacctaagttacaagggatattataaataaaaacaaaatatttgaaaattcgaagtagttactggattcttggaaggcaaaataaagtatacaaagccaaaatggataagtgaagcaaattacagtaaaaaatacacatcaagtgctgcatagtccatggcttccagtgtggtgtagcaggtaaattaatgtcaagcgacatgtcaaactcaaagtatcatatattgctaatttgttatgctcttatgttgttttgtgttttagactgcatgcagcaaacaagatactaagcatgaaaggtttactagatataaatggcagcaggctaactactaatgtgcatagtaatagtaataataataactactatagtgcaccatcttgaaatcggtttataacgagaaaattacagagttacctggagggttaaaagctttgtttcagaatctgaaacagccgaagaaccataggaaagagcaagctctaaaacacctcctcttttgtatatcttagcatcatctgctaggtttgatccagcatataacaactgaagcatccacaagcggtcagatttgaaatgcacagcattactcctaaacaatgctggaaataatggaatgctctgcagtcacaacaaaatagtatatataagtatgacgctgtgttcattattcaaagctagttaataggtgtaaataaacataacgcacctgaaggttgacagaggcagaatgcatcaaaaacttactaattgtagcaaactgagtatgagagctatcaagtagtgtcaaagatgcttctgcggcaaaaatagcaataacagaaggtatcctctgccattgttcagatatcccattctgtagatatgtcaaaagaagctggagctgccatgtttccttgcttttctgagaagcctgtattatatagaagcagtgattcttcaagaaaattacagattattgtaatgaaaacattctttattcatacaagctttacacacttacacctagtgactactatagaagataaccactctgtactcagatctactgtaatgaaaccattctttattcattctgcatgggatatgactaaagagttaacccagatttccttgttatcccttttcaggcttgttaagttatttgtcaggcttatcatatgtattagttggatcagttaaggagggtcctcaactcctcatctcttttgagttaaggaagaaatgaattagcccctcaagttcctctctctagtctggttcctctcgactctactcaccaccctccagtttttccttcaaaccatcattatcagtctatttctacagaattttagtcccacatctaccagaaatcaaactgctcccagaatgtcaatacaaattatcttttcacagtggtttgagacaaataaatatcaaaaccatgagcccatgacattacatatgtgcctagaaagttaagagaacattcaatgtgttagcattacaaagacatgtttagctggcagtgtagcaatataacacaacaacaagaaatcaaagtagggctgccactgccagagtaggcaataaccagtggcatttgaattcaataaaccagtatgacaaaatatcatatcaatattcaataaatagcagctgttcagtacctccaatgattttttgaatgttcctagagattcataacccagcttccttaagtcttcatcgggagatgatatgctaactaatgttattgcaagtagccctagtcgggaaaattcaacaggttcaatatagcccatcagaagagtatggattgagaagtgcaagataaacacaggatcataaatccgaaccgcatccatgctttgagatgttgcctgtcaaccaatacaagtgtggtttaagagcacaagggagacaaatataccaggaagataaaggagtgttattctgaaagaaaaaaaaaatctagaacaaaaatggagtcaaaacttcaattgacacaaattaccttgaaaatatcgccaaaattatcttgctgaagctgttccagtgaaaaaatagaagctcttgaagatctcctatagcaaaattgtaagacagtcatgacacagagcttagaatcaatgggtatgttctcgcggaatagcgaccttcgcctatcactaatttccgcattttccattttgtgcgtatcagatgctgaaaattctagcttcagttcttctctaaatttcacagctgcctttccccaaagatgatccacatcagtaatggctttgcactcagatgactctatctcattcataaggtgaagtatctctagatctgtttcactaagagttgcaccataaacagataaaagcaagaaaccaagctcccttgattcatccaataggctactgttatgttgcctactcttaatatcatacagtaccctgagtaacctgatgatttctactttcttcctttctggaatgcagtcttggaacttgttttcttttgcaaaagcagaatcaactgattttaaaatacttggtgctggctgaagcaggcccccagtgggattacaagcagatgggcactcggaaactccactgcaggttattgtcgacacaaaatgggagtgacccagtatgagttcaagaatttcatcagcaggaaacttcccttcagataatacaacaattatgcatcggattgcttttattacaacaggatcactgaatctatgtaagagggatgatctgatcaattggttgaggaaaggtattggcttcaactggttcagatgtgactgaacctccgaagacaactcaacaatgttcttgaggattgcatactccaaacaactgacgacattttgttcctcaggagaggaaagtaagatgccatcactatgagggaaattcctgaatattttatccaacgttctgaccaatatgcttataaaactcagctttgcattgttgactcgcttggactccttctctggggctatttcattgttcaacgatcctctaggaggagataacaacatcctaatcagtgatatctttgcaaataactcattagtaagcttcataataccgttgcatgaaacaggagtaacaaaactgatgtcagaatctaagagctcagatgattgtgggcaaattgaagcaattatctttaatcgttgcttccgaggtatctctttcgaatagaaataatagcatagcatagttattgacttccccaagagagtgtcaccgaaataattcattatatcttcaactgatgtgtgtctaaagtcactaaaatcttcctcaaaaatacttctagtaacaaaacttttccaacatggaaagccattatcactcaaaagaatttcacgatagaagactggaactggctcaaggaagtcaacacactgtctattgccaccactatgatgctctatgtatgataaggcagcaggcaacaaaagtataaaactatcctcatgagtccatgaagcattagaatcggaacccacgacttgcataacagaagtgtcttttttcagaatatccgtgagcaattttccaaaaaggcgcatgtgcataggatttgctcccaaaagcaactgtatagctttagctttaaccttagatgtgggaaacatgcagtgatgaagaatgtcaatgggagtgttggccaccattgtcgataacatcatgtgtaatgcaatataatcagtgttcctaactgcagatatttctgtatggtggatacgaattaacatcttcagcaagcaaagatcagcaaattcaagattcaatttagtagcaaaatgaagaatgatattataaacttgctgaatggtggcaatatcacaattatgaatctccaagccccataatcgacagggtcctgatctctgatcaatttgttgtaaatagtcatatagcatttcgaaggcaatatcggcagtgtatagacaacaaaatgcagcgggagcatatgcaggtgaactggaactgaaaccttcaaacgttgagaacatccagtttgcaagttccaggagtctgacaggagatacaaattttgccagtgtacggaacatgtaaaaatttggcaaaaacagtccaaagttccttttctccatgcagagttcaaacttctccttgaacaacagtagtattctctcaagcagtagcttcggagggccaaacagtgactcaagggattgatcatcattattagagtagttagctccaaaactaccagctaataatacaaggccatatagattactcagaagatttaaaacaaaactatcagcaaggtgtagcttttccttagaaaaactagcaaaatcttctttcacatattccacactcccatctgctaagtcttgaaaattggataaagagcatgacaaagacaggccaattataggatgctggacaacagactcaacaatgccattaagacattcaactggatagaatgccactgaagattttgagttagcagtatcagcagtcaaaactcgaatgcgctcgaagatgctgtcaataagagagaagcaaacaccacacaactgtgcaagaatatctgaacacttcacagtgtatgatgacagcaagtgatggctccaaaataagacgactctcaagaaaattgtcaactcacttaatgggctttcagaaatcttagcttgaagaagatgtacaagctcatcttgaagtaatggatgtgcctttgtgatttcatctggtgctgaaaatgcgaggcttaatactgatggtaagagtgcacaaaatggagtcacatttagaaaagtacttatcacagctgattctgaacaagttgagtgctttccccatttgtcctcaacaatattgacactatcaacatcaagatttcccttgatctgcctgagactgctgaagaacatgtctgggcaataactagcaaccttagctagataatcatgttgcagaaaaagaactgatgacaagaacggcaaattagaaggaaaatgtgtcttcagaacatgaagaagcttcggaaagctactgataacatcatctggtggtgcacatatgactgaatataagaatgatgttgctacatcatctggtaaattggtgggttgctgatttgacatttcctcaattgttctagttacagaacacaaagaatttccataaacttcagacgaatgctcaagggtgctgaacaaactagaactcttttggtcagaaatactcctcaagatatgcaacaaatacatcagtggcctccattcagcaaaacaaatcctagaatttatttcctctgatgaaaatttaccgagtctctcatttaggatggtgcctacaagatcaggcaataaaagcacatctacctgtttatgatcattggatcagtgaaagaagagtagaagaccatgcaagacaggcaaataggcgagagaggacataaatgcaatacctgtgactgcataataaggtagactgtgttgcacacatataatgaaattgtagacttctcatgtaatttcacacttgcagactccgagtctagtagcctaagacatttctggagaacacaaacaatcaaaggactgaaagatggagaatagcctacaaatcacaagaaaagtttgagcataggaataagttggttctcattaggtaataattcaaaagcgtggcatacatggataagaacctgccagaagactcagtgtattaaattaaagtaaaataatagatgcaacaaagtaccacatttataataaagaagttataaggagaccagaagtttagaacaaagtgtaaaactccaagtctccgactgaacaaaaggagtgtggttcaattagatatccatgtgcatggcaactacataatacagacaaacaatagaaagataaataaacctgtattccaatgaagttaacaatatcatgatcatatgaaagattgtgggaggactttaacccctcaaatgttaatccttccatttcatattataagtcattttgacttttttcctagtcaaactttcttaagtttgactaaatttatacaaaaatttagcaacatctaaaacatcgaattagtttcattaagtctagcattgaatatatttagatcatatgtttgttttgtattgaaaatgctactatatttttctataaatttaagtttgactaggaagaaagtcaaagcgacttataatatgaaacggagggagtacaaactatgatagctcacattgtattttaggtgatatatgtagctcacattgtatttctgtttggcaccaacatttccaatagcattcgtattaaagaaaacaggaattgtactccttgattttcatacaaagacaaccataccttcaaactggttaaatttagagataagcttacggatatgctcttggtatttgtacagattgttcccaactactgaaatggcatcacaaaggaaagggatcacaatgtgtgacagtctattagatgcttcaactcctaagccctctctttcaaaacctttggccttgtaacacggcaagaaagccaaccatgcatcaatctctgcaatgttctgatcaaaagcgccagaactcgccacagcagctttaactaaaatatatgctttatcacggatgctcttaacttgcgaatgcaacataatgtcaatcagaggttgcaaatacttgtacatagattctggaactttttctgggcaccaatatccatcagattgacctgaatactcaactaaaagagataaaagggactgctgttcatccatggacagatccaaaggattaggcggcataaccttgaagaagtcaaatgatccatcaaaagagctaggcattaccctctgaaaagaaattgaagttaaaagttagaataccaaaagagtagattgtgaacgaaacttaatatatgcatttgaatatcaaaacattaaaatcataaattgtgaaggaacattatcgatttccttttgctagtcacagaaaacaaaaggagacagagcaggaatggaggaattaattaattcgagcaatgaaataagcaaatatagatgaagtggaaggaaatttaactgtacctaccagatagaacctgagaacatcaagcaactttgagtggaaaacatctccaaccacttttgcatctttgatcttcggatcttgcttatttagaccccatatctcacacagaatagtagtatgatcatttgccaagtccatctcttgctcttcaggctcatccctagacaactcaacatcaatcccgccaataataatatcagcatcctcatctgtggctccacgtctccttttctttcgaggaggctcaagctgtgcatgtttcttttgtttactctgagaataattttgatgcttctgactagcagaagagagtagcttgagaagaacctgcggatcaggtatagctccacgaactacatcttgaatatattctctcagagttatccacctatcgacgtgcattttgtctccatgtagaacctcatgtacaatggatgcatctgctgaagtagaacagcttaatcctggaaaaccgtctattttgactgtcacttttgttgaattatcgtgttctgactttaccctagcatttgatactatgtcattgattacttcaattacatcgcacagaaggttgactgattcaaaaacaagtctcagagcaccgtgctttacaagatcatcagaatgcagaagccccctgtttatcactgctcgagtgcacatattgggcacaatgcacttcaacagtacttgcacttgctcatcatcaacagataccagatcatgtgaagtggacaaaagattttgaaagatgccatcacagtttactgaagatatcatgtccgctgctagggatatggcagaaaacctgagaaacagtaattagataggaaagagtatactgcacgccaataaaaattacagagatgctcagctcaaagaactaaccatgaggaggatgggcgtggttcaatgctgtaagggaattcattcatgtatgctgaacaaagagacaaactcttactcacaatagccagcaacaaattcttgtggtgaacgacctcagtagctttcaacttcttcatgagatccagcagacgtttctggttacctctcaggtttgagcttggcatcagtccattttttggatcagtacacaccatgattaacacctcatgagcaatgtcagctgcctcccccgcatccaaattcccagatatcaagctcagttgttccagtgtggcactaccaaaaaggacactccggagccctggtgggacaagtgactcatctaccaagacattattccgcaacgttgagaggatatagacaatggtatcagtatcatcgtctccgatcccacgaagaacccctgaatagagctccctttgttgaaggatccatcttagcatcctcgggttcccaacctccaagaatgacatggcaaacccaacaaacgatcgccttgtggatccgaaatcagttcccttcttccgattccccccatctctgccacctctcttcttccgcacccccgagagctgcggcaaaacagccatcttgaaatcaaagctcttagcaatctccgacgccaaccctccaccacgcctaacaattgcagccagcaaatcaagcgcagcattctgcctccggaactcaccactgttcagctccagatacacgtcgcccatcttctccttatcctccagtatcatcctagcaactccatccaggctcttcttaaccaaaccatgccgccgcaacttaccgccagggtgtcctaagacagtagcaaagagcgaaagtatgtaagccatccctggcttctccctatgcaatcgccatgcctcagccagctccacgagccgtggcgactgctgcacatactcccgcagcacctcaccctcagggtcaccatccaatagctcaatgaactccctcgacgcgtcggagtagattttgatctcggcggtgtggaggtttttaaggatatggattagcctgaccttacaggttgctccgaatgactggttccaggcctccatccccaccttaaccaaattttgctcccgtttgggttccgcttcctccatctcattgtcttcattgagatcaacatcgaactgctcgtcgtcgtcatctaggattcattaaaaaaaacagtgagcatgttagtgttccatcgagaaatccgcaccaaatcgaaccgaatttacaccaaatttcaccaaaaaccgggaagtattttggtagctagaggtgctcaccgagatataaatcctcttggacgatttcatgctcgtcttcacctccaacgtcggcggtggagtccatcggagtttgtctcccggcgagcgattgcgagcacaatgcggaatcgagctggtagggtttaagcgaatcgaagggtagggtttaagggagggtatagagctgcaacgggatgagaccccccgcggcggaggaggagaggacccggcgagccgccgctgtcgtcggaggaggcgaggacggccggtgaagtgggtgctcgtggaagaaggggagtcgcgtccggtcgccggagcagcgggcagcggcgcgagtcgcgcgcgttcgccgccgtggagaagaagtcggcggccgggatgggaggggggaaagcagatgaaagacagaccagggtttcacttccgtttacatgggcttgggctctatccacgtgggcttctatttacatgggctcaatctacgtgggcttctattttaatgggctgaaaggctgagatatgtgaacaccagaccaggtttggcccaccatcatgcgtttcgtggcttagaataagttcacttatactctcttaacaagtggtatgcctaaaaaactaccggatattttgaacactcaactattaaagccgctgcaatttgactcacttgacgatttagaggtgtgacacctacatagtgttgacctagggttcatccaacgtcagatatgaatcagattagaaagctagctaaaggatttatagaggagttatttcctcttggctttgcgtcacgcgtagcggcatgcgcggtagttggatgacttggatcgatgcacggagctttcatttttgtttcgcatactactagcttggaatatgggcgggttaaacgacgtaaagaattctcgaattaatacgtagtgcgagaatgcgaatagtccataaatacccgcaccggaagcgttcgatatgatatgacccgcccgcctgttcctttcctttcgatgccacccatggctagcagttcgacatcgtcgagatgcctgacggcgagcgtcaccgggacgcacaacttggaggtgacgagctactcgctgctcgaaggcatgggggtcggcaagttcgtgagctcgaccaccttctccgtcgccggctacgactggaacctccgcttctaccccgacggcatcacggacaacgacagaaaggaaggctacggggctgtttggatgcttgcttcagtttaccaaatttctatagctaaggtgtggcatgccacaatttatgtggctaagaaattcttggccacaagttaggcaaatgttggcaaatgtatgtgcctatgataagtggggtcacaaaatcaaaaagtgtggcatgacaaagatgtggcaatcaagcaaacactaggctaaattggtcaaagtagcttgccaaagttgtggcaaagtatgatcaccatccaaacaacccctatgtatccgcctctctgcatctcgttggcaccacgacgggtgccatgccaattagggtgagattccgcttatccctactgaacggatacgggtttgacgcataacttcgagcgagccggcagcgactgcaggatcgccaggttcgtcaagaaatctgacctgcaggaacatgcaattcgccggattcggttcactggcaacgacagcttcaagatcgagtgttcgctgaccgtcataagcgagtctcgcgctgaagacgtgagcacgatcccagtcccgccgtcgaacctgcaccagcacctcgccggcatgttgcacggcgtcgagatcgcggatgtggagttcagcgtcggcggcgagccgttccgcgcccacgcgtgcgtgctggcggcgcggtcgccggtgttcagggcggagctcctcggaccagctgctgcacggagcatcaagatcgacgacgacgacgacatggagcccgcgacattcaaggcgcttcttcacttcatctacacggatcacctgccgaacgactccggattcggcaaagacgcggcaatgcagcggcgtctgctggtggctgccgatcgctacggggtggacaggctgagggcgatgtgcggggtcaagctgtacaagagcgttagcgttgggacggtcgtggattccctggaattcgcagagaagcaccactgcgcgcagctcaaggatgcttgccttggattcatggcttcacctaacgttcttggtgtcgtcaggaaaaccgatggattcaagcgtctcgtggagggctgcccttgggtcttgaaggagattttagacaaggtgcctagattctgaaaaggtgtggatttttctttggagaggattgggagtcctgggatgagtacttggccttgctgacatgcttgatttcagtaagatcaacgacactgtgcactgaagtttatctatgttcggttacaatccatatcctgcttattgatccagctaataagcttattgacatgtaggcccgatgatatgagatccacatgtcagtgagcagttactgcatatcccatgtagtgccgcattattagtactatatggagcatattttttagataatgactacatggagtatagtttttagataatgactatatggagtatatgctagtattgtgatagtattattctgaactctgaacttgtccaatgcttcccatcaaaacttaacgagagtgatctaagcgcctaactaagtttctatatatttgtccgatgagtataaggactcattctaagagtatactcctttgttttatattataaatcatttaactttattcttagtcaaagtttttattgtttgatcaagtttatagaaaaaattagtactccctccgtttcataatataagtcatttgatttttttctagttaaactttgttaaatttgattaagtttatataaaattttatacacatctaaaatatcaaattagcttcattaaatctagcattgaatatattttgataatgtatttttttgttttatttttatgtgtactagaaaaaatgcccgtgcgttgcaatgggtgaagtttattttaatcttattattgttatatggtttagttaaaatgaaattcgttgtgggagttcgcttggatatatattttttttagaaaatcatgagctgcagttaggagttcgatcatctcaagttagcatgggagttttttttttaaatagatctcttatatgattccttatgtattaccaaaaatgaacgatcttaaaaccaactcaaatacggatatgtattttcaaaagcaaacgaacttaaaaatcgactcatatacggatgacatagagatatagattaaaaccaaaacataaaattaaagctgactcaaacatggatgacgaaccacggaaacatctttaatttttataactgactcaaacacggatgacggaccgcggaaatgtctttaacttttttaatagataatagactagagtaaaacttgttctaaaaaaactagagtactgaacagcttccattgatccttctcatgctcatttgacctgcattattcattagcatcatctagtaaatgtttgctacaccaagagctcctccaaacacttggcaacatcacttgaaccgttcctatgaagagcttgaagagaactcatgggaataccaaatgtgtctcgtagtttgaaatatcacatgttaaatgcctgatgacatcgagagttcccccaaacacttcacaataggcattgaaatagtgccacgtgaagtgttcgaagggaactcacggtgataccaaactaggctccacctctttgtagtttaaaatgtcacgtaataagtgcttggtgacatcgagagttcccccaaacaattcacatagtaggccttgaaatagtaccatgtgaagtgattgaagggaacccgcgataataccaaacgtggctctcatctcattcttgtggtttaagcactacattaaatgtttggtgatatcgagagttcccccaaacacttcacacaataggccttgaaacagtgccacgtgaagtggttgaagggaactctcgataataccaaaagtggctcccatctcaatctcgtggtttaaacactatatgttgaatgtttggtgatatcgagagttcccccaaacacttcacatagtaggcattgagatagtgccacgtgaagtgcttgaagggaactcacgacaataccaaacgtggctctcagtcttgtggtttaaacactatctactaattgtttgatgacaccgagagttcctccaaacacttcacaacaaccctataaataatggtgtcgtatgaagtgcttaaagagaactcttgataataccaaacgtttctctcatttcttgtagtttaaacactatctacttaaatgcttggcgacactaagagttcccccaaacacttcacgacaactctcaatacagtgtgtcgtaaagtgcttgaaaggaactcctagggactccaaacctaatcattctctgtcacttacaaattcataaagtacaagcacttacatacctaacttgaaaatgctgagtgtcaactggagttcccccaagcacttcactatacatagctagcttttggccccatgatcacagttatgtaacagtgcaatgcaatgaggcctagccatagctatctactgaagtggattgaggagaactccagtggacaaccaaccaaattttgactccctagacctgattacttcatttttgatgtggaccacttcacttgtttaatctgccttgctgatgagcacagagccggtggctatttataagtgtatgtatgactaaagagtaagctagctagctatctgtctcctgtggactgtggtgtgtgtgtgtgcatatggtcgtccttgcaatgcggttggcatatattggatgaacttggcaacggatgcacctagccgtgatgcagactaggttagaagatggagtgtagtgaggagaatccaatgtgatctttgggctgcactgatctccgaatcgtagaaagcatgcatatgtggagcaaaaaagtgcccagccctgcaaattccttatcaccagcagagcactgtgtcgtcgcccggtttctgtccacgcacatttctttcacctcaacaaagatggagagaaatcgtcctgaccattgacttgctgcaaatgcgtgcaaattgcaagccccgggaggaaacatgtgtatgtaagattggatcacgagtaatttgcttagtttgtactaggcttcgtagcacgtcattgcgttcgtcgttgcgttgcgttgttcctggtcttttctgatgtgatcggtttgcaatatgcccatttaccggtagtgcttactactgcagtagtgaagtgctcctactgaattctactaccatcccaaaatataacaatttagaattagatgaaacatatcctaatctaataaatctggagaacaaattattatattttgggaccgagggagtaccattctcttaaactacttaatgagttgagaatctagtgatgatgaaattaccctacgaacgtcagatcatcatgtatgagagcacatattaaagtatatattcagttgtcttttgcatgtcggcgaccagtgggtgtcacaggttccccagtgatagaggacagcaatcatacagataaacaatggaaaaacaagccacctaatctggcaccttttcttactgctactccccgtttcataataaaagacaactttctagcattgtttatataaatatttatatagatgttaatatagacatatatttgtgagcaagtattaaactacttgcatgtcggcgaccagtatatataaatatgagtaatgtaagaaagttttatattataaaacggatgaagtattaaactactccatcatatatactccctctgtcccataaaatacgaatctagaattgaatatgacatattttaatactatgaatctggacatatgtatatcatccggtactaggttgattttttatgagaccgagggactaagaatctagaattagattaaatattttttagtactacgaatctagacatggtatctcatccggttctaaattcttatattttgagacggagaaatataagatattttagacggatgtgacacttctcagtgttacggatctgaaaaagaagtactaataagtgtctcatctatccaaaatctcttatatttgaaaatgaagtgagtatgaaaaaaagttgggacacacacaaacagtgggatggcagcattttctcagccacctgataatcgatgagtcatattcccaaaccccaaaaccatatgctcaaaaaggggaaagaaaaaaaaggtgaagaaggcgtccaggttcaatgtatgcgatccttggcattgcaaggacaatctttcagacccaccagctgaccactttcaaagcatgtccaaatagcaggctaggttccagctttaggaggaggggagagatatttgcagtataagtagctttggagaaggaacattcctaaagccaagatgcatcaagaactgttcttcttcaagctgtagcctgtaggagcggttgcgtcagatggagttcccccattcttcacttctggttcttgtttgcttcttcaggtagagctggtttggttttggtgattttcgtgttcatgattcatggagagatggatttgtttctcagtatccttatgtatgttgtagctggatcatttcaaagcaaataaatcgacgatgagtaaagagattatctgtgtttctcgatctttctagttacttgtctatttgtgtgttcggatgtgatgacctcaagaaatgcaaatgagtcagtttcatgctgccgtttagagatcgaaaggtcacagatccaacaggcaagcaacccatcagtgtcaagatgtttaggccgtgtacctacacctctgtactactgggcatctcgattctgcaacgcaaaatctcacgaggtttctgatgaactttaatagccgatatcatgccgtggtaaccaggtttacaaactgtaccgttatcgtggttatcacgtgtaataaccttctcaatttttaaaatcacgatatgtcttacggtaaccgtacgatgacaataaccacatcagtttggtaaaccctagtagtaacgtacacgagtctttgcagccaggcagccagctcgagttatgaaccatgatgcgtaaatcgtgaaccatctagctgactgcataagttggaaatgagtgatatgtgggtcaggatggttcaccatttggaaataagttatcatccaaatgggcatatatagtacagtgccaagatgaaacatcgaacttatagcaaaggaaaaattgaaaccatgccattataattttgcaaaatttgagatatgccatcctgacccacgtatcactcatgtgggtcctatatgtcattgagataccgatgacatatctcaaactttacaaaattataatggcatggttcaaaaggtttcattcgacctctgattcaccccatcctagatatgccatcggttggtcacaggacatcaaaggcaggtgatgggaattgagttaattttcacccaaatatatagcaaaagaaaggtttcagctgacttcagattcacccctcctagctatgccatcgtccaaccggacgagaagtcatgtggctacatcactacatgcccatagcagaatctccaagggacaacgaggatatatatacatggtgagttcgagagtagatgtggagttctagcagacttctatatcaaatctaaggcagatcccaatgttgaatagctcctgatatagcagctttgcgccgtatgggcgtatggcacataacacattgatccttactatatcttttttctgaagagcggcagaacccacgtgattaatacaattatgatgtaattatagtgtactttcaaaaatctctaggtgacatgctaattatgtgaaaacgaaggtaatgatatcgaatcccttacatgtgcgtgagttatcagtttatgtgcatcgaggggaagcaacgataaagtgcaacccccgaatgagtgaagattctatcatgtaccatcacctataccctcaatatcaaaaatgtactagacaatctattactaccttcgtcccaaaatatagcaatctattacaagatgagatatatattagaccaacgatctggacaggccgagatctttggattaagatatgtcctatctattcccaaattactatattttagaacggtgggagtactatatatatatggctctcattttatttctttttctcgttgctttgtttggctgtatacctctgtacatatatctactccatttttttttcttttcgaaggatataagcaagataagcaagaagtgtcgcacgtccagtgatcgtcgccggcgaatcgccatgctattgggcctgtcgagacaactccagcacggcccaatcgctgcccaaattgggccatctattctgtcgctcgcacggataccgcttttgtttttctctggattctgaactcatatactttggcgccggtcacgtatacacaacaactatatataatcaaagagatgcacacagatacgtatgtgtttggaaacaccctgatttgttgcgaacttcagcttggagcatcttgatcgacaagacaaactctgtatttacatgttgttgttttttgttgttgttcaagcttcgttgttctccttcgatcttcgccatgggcaacagcttgttctccatggcgagcagcaccgcttctccttcagatggtcgatccccacggctgccggaaacactgtcgaggtgcgtgacggcgagcgtcgccgctgcgcacaatttcgaggtgacacggtactcgctgctcgccggggtgggcgccggcgagttcgtcacctcgggcaccttctccatcgacggccacaactggaacatccaggtctaccccgacaggtggaagcaggagatgaacgccggctacgtgtcggtcttcctgtgcctctgcggcggagcaaccggcgtcagggcgaagtacacgctgagcctttcggagaacggcggcgagtccgtacaacggagcttgacgcatcggttcgacacggtgggcgccttctggggattccccaggttcatggagaggcccaggctgcggcaatggctgcttcgccgcggccccggcggcggcgacgactgcgtcacgttcaggtgctccctgaccgtcatcagggagcctcgcaccgagggcgtggccgccgtcgccgtgccgccgtcggacatgcgccggcacatggcgaacatgctgaggggcggcgacggcgcggacgtggtggtgctggtgcgcgaccagccgttccgcgcccaccgctgcgtgctcgccgcgcggtcgccggtgttcagggcggagctcttcggcggcggccacatgagggagaggcggacgagctgcgtcgtcgtcgacgacatggagccctccatcttctcggcattcctccacttcatctacacggattccttgccagaaaacccggacacacctggcgatgatcaagattgcatggcgatgcagcatttgatggtggcagccgatcggtatggcctggacaggctcgtgctgatctgcgaggagaagctgtgccgcggcattgacgtgcagacggtggcgacgacgctggctttggcagagcagcatcagcgtgtagcgctcaaggatgcttgccttggtttcatagtctctcggggtgttcttggcgctgtcgctaggactgatgggtttaagcatctgctcacgacctgcccgtcgattatggtggacattttagacaaggttgccagcgtcatgagcaagtaataatagattcatagtctagtctttctgatcttatgagtaacttttattagtgactagcaaagtagtactgtagtagtaataaagttcgagactgagtttgcgacgcgacatgatttgcagtatcacagtagttctattttttgttggtttcatgcttgcctggaaacatatcgaaaaagaactgaagattagagtcacattgttgtttcggtactcaaattgcattcctctgaactctgaagcagtcactctgttcttctctggtctcccctgtgtgttgctgttctatttccaggtgtgattattgttctgtttggcgccattattatctaagtttttgtttctgttacacattttggtcgagtttaactcgagatgagcaaattctttaactttgttcccggttgtaacttgtgagcctgtggcggagcaggttcagattcgtcagaaaccaaaaaaaaaaaaagttcagattcgttagtggcacaggctctctcagccctgaccaaaaatgggctaatctagttggtcaggcctgtggcgggcatgttcagattctgcagttttgggccggaatcaccaatttctctctcagccctgaccaaaaatgggctaatctagttgggccgcctagtcagacgcatgaacggccacgtggcacgtgcttcgtccgtgcgcacccgtggatcacaggcctcgtggcgggggtttcggtcgtgcgcactgtggagtacaggtcggcagggagccagggtcaatcgaatcgagtcgaggagaggagagagagagagagagagagagagagagagagagagagagagactcagggagggtttcgtttccgtttcttgcgcctcctccaaccgcggcggccgtcagtggggagcctcgtcggcgtccgcctccgccattcgcgagaggaattcaggtgatccctctccctaccagagccgcgctcccctccgatcctccccgaatctggatgatctcccccgattccgctcggcttcgctgatcccccctccgccgccgccgccgccgccgcggcgggtgggctatcccgcttgtcggaatcgatcgatttctgaggccttggattgtgatgaagtcatggatatcgggccgcatagcatccagctgatcgcgccgccgtccctctatcacgccgcctccgctgccgccatgggtgatcaccgcgacccggctttccccgcggcggcgggcggctgccggctgcccaagacgtcgtcggtgagcgtcacggagtccgtcaccgcggtgcacgatttcaaggtgacgggttactcgctgatcgaggggctgggcatcggcaggtacgtcagctcatccaccttcaccgtcggcggcgtcgactgggccgtcaggttctaccccgacggctccaccgtcacctgcctcgggaacgcgtcggcgttcctctactactgcggcagggagaaggaggtcaggaccaggttcaccctgaatctgctcggcaaggacggcaaattgtcgcaggtgaccaattcctacatgaagcacaccttctccccggcgagtgacaattggggattcatcaaattcgccgagaaatcgaagctgcagagctcgccgttcctccacaacgactgcctgaccatcaggtgcttgctgaccgtcgtcagggaatcccacaccaaggatgttgaggtcaattctgttgttgtcccaccgtccaacctgcataccgattttgagaacatgctccaggatggtgaaggttcagatgtgacattcaccgtgggtggccaagagttccgtgctcataaatgtgttcttgccttccggtccccggtgttcaaggccgagcttttcggtccgatgaaagaaaatggcacgcaatgtatcaagatcgacgacatggagcctgaggtttttgaggctcttcttcacttcatttacacagataggctgccagatagctgcagagatggcaaggctgcagcaatgcagcacttgctagttgccgcggatcggtacggagtggacaggctgaggctgatttgtgagaggcggctcagcgaaaccattgatgtggaaacagtggcaaccactcttgttttagcagaacaacatcactgctcgcagctgagacaggcttgcattgggtttgtggcatctccaaacatgcttgggccagtcatagaaagcgatggatttaagcatctggtagaaagctgcccgttgattatgaaggagatcttgagtaaggtttcacatatttggattgacaagtcttgctgagaagtttattaagctatcacttttgtagtagtacatcttagtagttatgaaagtcatgatcagttatctacatctctatatgcgactttgatctttttaagttgtgtgatccttccaacgcctaatatgtatgaacagtagaaatcttatgtatatggatgactccttagcaccatggtgtaagtttgggcattcttccccttttcatcttttttgaaatgttggatttactctatactcacatgctttcctgaatgtataatgactagttttttgagtggaatatatacggactaataatcattaattcaactctgtcttggtgatataaatcatcatttcaactctgaacatctcacattctttggtccaacccatacctcagagcatgcccaacaatcacccaatatttgattcccaaaaaatctgaattaggaataccaaaataaaaattgggcccaacaatgaacccctcctccaagagatgcccaaaaatcaattccctatcatttgttagtttgccacgtaagcaaggtggggcccagttcggtacttgtgcacgtcttctccctcccgcaccagcgccgatcgacttcttcctccccggacctgcgccgccgtgacctagcgccgtcatcaccagccagtcaaccagtgtcctgactgctgcgatttgttaaaaaacggaacaccaaggagatgccgtagcaattcgtgtcatcaaggaggtaatcgttagcaaatcccattgatctcttgtgtcgtagtcaatctctatgtctatattttgatatgtggatatatattattggaaaatattaagtttgatctgataattaattttgcagattgattattgttctattcctgccatcagttccctccattgcacttcatccctgtggtaaacgctccaaccccgtggcaaacaaaaagaggagatgagtcgtcgaagcaccctccttcaaatgctattggatgagttttcatcggatggtgacgaagaatttatttcttcggcggttgatatagtgcacgaagagttcgacgatgatgaagttccaaagcatggtgaatctgttataggtcatgcagtaattaatcagtgacagtgaaccttgttagtatgtatgtcagtggcacatacatactgaaattgaatctttcagacactattttcaatctttggcataagcatgtggttgttcatctgctaatctaaaaagtgaggcatactaaatgcagatgatcacttcaattaagcagttgttgtacttagagctaagaactgtacaagttattataatcctactgaacctatgctgttgtacttagaattctgcagctgcagctttcatgaaactaaaagtctaattggcaaaagcaggtggttcttttatcttgaaaaatagactatggattgcatcttgttgcattatctgtcaaattatctaacaacattatcttaatgcaaaaattcagagcatatttcaaagatgctgtgatgagagaaaaatatttcagactttcagagcatatttcagactttgggagtacatttgacatagcaaaaatatttgacacagcatatttcagactttcagagcataccacacatttagagcatatccttcattactaaatgttctgaaacctgatttcctctaagtgttcagactttcaaatttagagcatatcctacatatttcagactttcattcaatacagtacaaatttcagactttctgatattttcctctaagtgttctgaatcctgaattcctgaatttctagcaggggaagtcagtcacagaatagacatcagatcaggctacaacactctgaaaattaatctaaacatcgaacgaatcagggacagccttaccgaaattgctcctatggaggaattcttcatcactcacagaataagctgtggagaaatcgacgccaggagcttcgtgtgagaggggattcagtgtctcccatggagcatgtccctccatggactctgtcgcctgcacaccggagtagggaggttgaggatgaggcagaccgagacgacggcgaggcggcggtgtggggcgcagagggccgtcagccccaaatcgaggaggcagtggtcgacgtgcgggcgccccctggaacagcgccgccgccgacgcctgcgaggaagaggacggcggctgcatcgccgcttggagcaacgccggcgcctgcgcctgagaggaagggcatggccgctgcatcgctgcctggagcaacaccgacgccgacccctgtgaccaagaggaaggggacgaccgctgcatctccgcgtggaactcagtcaacgacgcctgcgaggaaggggttggccgttgcttcgccgcctggaaagccgctgccgacgcctgggaggaagaggaattttgttgctggcgactggcgaggagggcgagaaaaggagcgcgggaacaattttccccctacgcgcgcgaggcagcgacgaccgcgattgggaagaaaaaatggttccctgcaaatgagtaacgacatatacggatatgggaacatggattattgggatgttggttagggaatttgttggatgagaattttggttaaaatttctttaatttaaggatagggaatagaataagtaatctgttgggcatgctctcagccctgaaacttaacctgaacagatatttgcagtcagggccgttctagactgctcctagttggcttagctacttccttgtacttcgtgagcacacgctatcaaaatgttctttttttcaaatgttttctatatataactttcttaaataaataaataaataaatctatttttaaaatttgtaatagctactccctccgtccctaaatatttgacgcagatgacttttttaaacatgtttgaccgtccatcttattcaaaaaaatttaagtaattattaattcttttcctatcatttgattcatcattaaatataatgatgagatgtgagggaggaaggaactccctcttttttaatacctgggtagggtggctttactttgcctacgtaaatcccaaccatctgtcttcatttaagatctaatctccaattaaatttcctatcaattcccaccacctctaccaatcaacgtaaatctcaaccatctctttttatttaagatataatctcccattaaacttcctatcaattcccaccacctctaccaatcaagagattgagagtaaaaaatcaaattcttatgttaatctcataatcaattctctcatctaaacctccaatcctttctcttaaattgccaaacagaattctctcatctaaccctccaatcttttctcttaaattgccaaacagaccgtcaactcctccgaacggagactaaatattgttttttttcttccgaacaagatgtacaccttttatgtccccttttttctcgatggtgcatccagatggcaataaatagcgtcccatgctgttcaaaacttcagaggatgcaacctgaaccacaccccattttttctctgaacattcagactgcctctgttcgtacccctgtactactgagcaggctaggctgtatgaaaggcatcgacatggactcatggtcaccaccatagcgttcgcggagcagcagtgtagcaccggagctcgtgtctctgggcagcctgcgacacaagagtggcgccatgatcagttggattaagctcagattgtcaccttgtcacacgtatcgtctcgttcgcatgatcaggacttcttttgactcccgagttgtgatttggaggttgaaacggatcaggactatagtatccaataccataaattatctcttcttggatcaactcgtcgagagagattaaacggcaacgcgtggtatccaataccataaaagcatcttgcagtctatcgacgaggctctctcttcggcagggtaccggtggctgcatcgtctggtatgcggtatttcaaactctcgttgctcttaattgaatttgttataaatattagtcgatatagcggaacgataactaatcttcccgatcgcttcagtcattgaccacacaagacatgctaggtgacgacataggaacacacaatatttgttaacaaactttagctaaagtctacatctctagggttctgattatgggcaatcctccacaaccaatatagcacctagccgctacgagttcatggcctcgccgccatcctctccctgtgtgtctacactacattgcagtcctcataattacattatggtacccctctctatttaagagagttgccggttacagagccagagtccgactttaactctacccctaccatctattataactctaagtccaactataaccatatacacctattctaacataatcgatttgatttaaacatgcgcttgtttcatccaataaaagaagtgtctttgttgctagattagatttgacaaacaaaatagcacaattgcatcctctttttgtcaattcttgcagtggcagacatgttgacttcatcggctgcccgtacgtcctcacggagcgtgtgggagggcatcaccgggacgcacgacttcgaggtggtcggctactcgttgatggacggcttcggcgccggaaggcacgtctgctccggcgacttcagcgtcgccggccatgactggtatgtcgcgttctaccccgatggcctcgaccaggattccgccggctacgcgtcggcctgcctcgcctaccgcggcaaggagaggctcgtgagagccaagtacagcctgagcttggtggccagggacggcagggcgtcgccgctcgccggcgacacgctgcggtcgcactacttcacgccgacgagccgcagcgccgacgtcctcaagttcgtcgagaaatccaacctgtcgtcgtcgccgtcgtcgtcgtcgtactcgtgcctcgacgacgacaccctgaccatacggtgcgtggtcaccgtggtcaccggcccgcgcgtggtgagcgtcgcgccggccaaggagaggggcccccgcgtcacggtgccgccgccgagcctccacgagcacctggcgcggatgctgcgcgacgggcggggctcggacgtggcgttccgcgtgggcggcagggtgctccgcgcgcaccggtgcgtgctcgccgcgcggtcgccggtgttcgacgcggagctcctgggcccgatgatggagaccaccgctccgtgcatcgagatccacggcgtcgagcccgccgccttcgaggcgctcctccgcttcgtctacacggacagctggccgctcgccggcgtcgacgtcgcggcgacggtgcgcctgctctccgcggcggacaggtacgggctggagaggctgcggctgatgtgcgaggagaagctgcacgagggcatcgacgtggacaacgccgccgacgtcctcgccatggcggagctccaccattgctcgcagctcagagacgcctgcgtcgcgttcattgcctcgccgagcacgctgggtcccgtcctggcgtcgagcggcttcgaggatctcatcatggcgaccggcgcttcggtgaccaaggagattttgcacaaggtgtccgaatcgtggagcggtcctggtaacagaaataattcaagcaaaagaaagtgagaaaaatggcaattatattgaatacgactgaactactctattcgttagtatttttagtttccccagcaaagattatcgagggtacacttttcaaactacttcttcttaaaaaaaaccaatctaagtgattcattatcctagttagtgtcaaagccttttcaaggacggaggaagtacacggtagtttcgtgcataagttttctataacaagtttattttttcaaaaaaaaatcaattataagcttataacaattaatacttaataacttatctcattttgcgtgttgcaataagctaaacccaaacatctattcgaaagtaacctaaactacttagattcctcttgtaaacacttgattacttgaaaatgcatagattcctaagtacagggatcaatgtccttaaattgcttatactgcatataaattttaaaaatataattacttatatttgaaaacaaataaaatatacgacacacttatacttacactcaattttctggtgaaaacaaaacaaaaaaagccaatcaagcagaaaacaataaaaaaaagccaatcaagcagcaaaggagcatttttccccaagctgacaaaaaaaaaaggaattttcgggcaacgagcaaatcacgggctcttcccacggcccacgggaagtggtctctctcggtctcggccatatctgaaccctgcatccccccacgtctcctccccctctctcagtctctctctctctctctctcccgttcgtgcgtgctagctagggcatctcgtcgcattgatgcagcagccgccgtcgcagccgcagcccggcatgggcggcccgcctccgccgccacagggcgcggcggggcagccgccgcagtggggcgcgatcccgccgccgatgccgccgcaccagtacggcgcgccgccgccccagcagccgccggcgatgtggggccagcccccgccgcaggcgcactacgggcaggtgcccccgccccagccgtactacgccgcgccaccgccgcaggcgatgcccgcccccgcggccgcggacgaggtgaagacgctctggatcggcgacctgcagccctggatggacgagagctacatctacaactgcttcgcggccaccggggaggtacgggtcctgatctgctgtgagatttggttgcccgtaattttttgtttgtgtggcttgttgctgatggagttgtactgtggtgtattgcgactaatttagttcctgatgctgtatgttgtgacttgcgactgacttagttctgacttctcaaaagctctaggctatgagttgtgggtctacaataaaaacaaaatttcatgcttcggctgatttatcagtgattgttgaatgtatctttttggtttattgagattttatgaacatgctactttctttagtgaatcgatttcggaaggttttgtttggttttttacttactgttttcacatggatgctaagtttgcagactatataacatttgcgtacattctaaatgctatttatgtgattcggttttgctatcaatatacataagccattgctcagatgataatggatgaaatgcaacatctaatatacccagattgtgtccgcccattcatgatttacctaccgtatctaacgttttgcatttacttgcaggttcaatctgtgaagcttatccgggacaaacaaagtggacagcttcagggttatggctttgttgagtttacaagtcgtgcagctgctgatcgaattcttcagacttataatggacagatgatgccgaatgttgagatggtcttccgattgaattgggccagtgctggcgagaagcgtgatgatacccctgactacaccatttttgtcggggatttggctgcagatgttacagactacctactacaagagacattcagggtccattacccttcggttaagggtgcaaaagttgtaactgacaaaatgacaatgcgttcaaagggttatgggtttgtgaaatttggtgatcctacagagcaagctcgtgcaatgactgaaatgaatggaatgctttgctcttccagaccgatgcgtattggtccagcggcaaataagaaaacaacaggggttcaggagagaggtaaatgctgctgatcgtatttcccattgacaccttttacttattagctattattatgggcagttatctttatttctatctatatgtatggctggctactctgcttgatgataccttttccttttgatgttccgcttttaccttttccggttttacttacttttacggaataaaccaaagcttgtgtgaccctttttcttcaagaagtcattattccttagtacaacattccctgtgaatttggatcatttcatgcactagaactagaaaaatagtagacttatgaaactcgtgttatctggaagcaggaggtcaacaggctctctccgtattggagttttggaactgatttgagctgtgatgcatttcttgtgtaatgcatggcctcatttaggtcagtgtaaaacatttatgttctaaatttgaagtctgtttctttcgatttctgccctccgaatacttcagtcatttattcttcttgctatttcagattctacttcatttgtgcacgcatacgtttactatacattttctttgtttaaaaagttttatgactcatgcttgatgtgatatgcacatagttaaattagcatgttggctcgagcttgcttttatttgctaggcttgactattgagggtcatatccgtgcttcatgtattgaggcttgatatttttaacattttctatttccttctttttgaaaaatagatttttgaatgacaaaatgttagtaccttctgtgaataaattcttgtctttttcatgccttctagtttttgtttttgtgatattttacacttcgagttgccacactgtttatctgttcttttaaacatctggagaatattctgcttcttttctcaacatacattatgataggcttgcaatgtatctctcattttatctgcctctaacttgacatggaatcgattgttggggctgtatttcattctgtattgtgttgtgtattcagcttgtttgagattctatgtatacaatacttaaaaaacagtgttctgcttgcccttttccttgattgggtagtcttattagcatttttggccacttaactccattataagtctgttaagtgaaatcttgtctacatgtgtactattagcttggtggtttcgcctccataatcttatcaaactttagcatggttctgatgaacatgttcctgaattgctgagctatcctagttactctattctaaattgtcttcagtgatgcttgatattctgcttaatgcatatggcttgacatggctggatctatatgaatatcactgcttatgcttgtaataatctatttactactataagaacatcagtgaacgagacatttgcatgataagcattcatgtttaccagcatttgacaaatcttacattgtattttcttcacttttttgctttcatttacagtaccaaatgctcaaggagctcagtctgagaatgatcctaacaataccaccgtgcgttcttagttctatttttcctgtacaacagtaatttcttttcagttcatttagtgactatgtttgttgttgagctcagatattcgttggtggtcttgaccccaacgtcactgaagatgtcttgaaacaagttttcgctccttatggagaagttgtccatgttaagattcctgttgggaaaagatgtggttttgttcaatatgttaacaggttgactctttgttcgtttgttctatttccacagatgtcttactgccttgtattttttttttttgatgaggtacttgcaaattactcttgtcattgcatattcaggccttctgctgagcaagcactggcagtgctacaagggaccttgattggtgggcagaatgttagactttcgtggggtcgaagcctttcaaacaaacaggtccagatcaaactcaacatagtaattttcttatctataaagctgtataatggagctaaagttgataacattgtggtttttgaatgtcttcagcctcagcacgactcgaatcagtggggtgctggtgctggtgctggtggttactatggtggctatggacaaggttatgaggcttatggtgggtatgcacaacctcaggatcctaacatgtatggttatggagcctatgctggttatcccaattaccaacagcaacaagtagcacagcagcagccgccgcagcaggtgagactcccccttcttgtttccgatgtcatctaacattggaaatttacacactttacaaatattgtaactttcttgaaagttatcatgaattctgccatgtcaatcagcgtttgcatagctatatcctctagcgattaatttgaagcattattttttctttcttccagtgagccctgtttgatcgatcgcgtctttgggctgtgaggcacacaacccatttcaagctacagctttagctatgttattgctattctcaatagagagacggtttctgaagactccagatttcgattgaggttttaatgtatgaactgtattatgattatgaacaacggatgctgccatatcgtggttcctatattgagtcatgtattttgaaaacatatcctctgtttccatctcacccttatcatcgattattattattgctatgtaccgtttgtttcccgttggtttttgcgtgttggattctcctttttcgtgaaggacaagtgagttttctggttgcctgattggccacgtgggcggacattgcatcagggcatcagtgtatgctctgcacaatggaatctcgccaacttttgcttcgacactttaccccggttaaaatctttgctcgtgttttttttcaccgtgaaaatggctgttaaaatttctctacttgttttcaccgtgaatggctgttaaaatgtgtatatctatctgatcgtgtgccatggaagacgaaatgataatcgttttcactcgggctatttacgaggttagaaagtagaaactagaaagacttcaggaaagatctgttaaatgccatggtaaatttgacacagacaacgtaaaagctcccattaatctagtgctacactgacaccgacagcgtaaaagcacccgtaaatctagttgtattattcgcttattaacccagttaaagttaattaatctggttccaccatcttatcctagctaatgtgctttaagattagcgcgcgatcgaatcggccgcccttgaaatcgagagagctccgaacttaaccttcccgtttgcacggccgcatcggtggccttttccccttccgctttcgtctcgtctcgcctcgtcgcctcgcctcgcctcccctcccaccaccctctctctcttttccctcccttcctccctcccatggcccgccccaagaggacgaagccgccgccgccgtcgcgcaaggcggaggcggcggcggcggcggcgcagcggccgtcgtcttcgtcgtcgtcgccgtcgccgtccctccccgaggcgctgctgctcgcgacggtgtgcatggtcggcctccccgtggaggtgcaggtccgcgacggatccgcgtacgcgggcgtcctccacaccgcctccgtcgaaggcggatacggtgggtgctcctccctctctcctcctcctcctcctcctccccgtcgttgtttctgtggttgggtggctcgcttagggttcggagatcgcggggatgtggttgtgagcgtgatccagctgtgtgcgcgtgtgtgcgtagtgggtggcgatttttaatagggttggtgctccggctttttttttttttcgtttcgaagttaactggttcgtgatccgcttgttggttgggttgggtggcggtggacgctggacgcttgcgttgtttgttttttggatagtgccatggtgggatggatttgggggtggttgctggttagagatcgctggatgagtttcccccatttgtggcgtggctgtagatgtacttttgtgtttgcggttaagatcttggctgtttggtctttgatcgtcgtgattgcggtggggatttggatgagagtcccgtaaatcgttcctgggttcgtggtctagagaggatctcgcactgggttccaggatcataggcaatgatcctggtctctataatgtaatcgggtatcatggttatgctataaaccaactgcctggttgattgcaaatatatgttgtttttcttctctagaattgagatgccaatttgccatgaagaaatttatgattcatttagtgcattctagcattctggcagcagtcacatttttgggtttgattcgtactccttttggatttgtaatatcctagggatgcattttttttcttgccagatcatgtttataatgttgttctttctggtttcaacaatcaatttagttttctttttctgtgtggagaaaaaatgatactgatgtatttatgttgaacaggtgttgtgctaaagaaagcgcgaaagatcgctaacgggaatgataatgccaatattcctctgggagcttttgtagatagtcttgttattcacccagatgatctcgttcaagtcattgcaaaggtagctttgatgtgcttaaacatgctaacaaattttcccgccaaaagaaaaggtatactaacagattgccttctcgtggacgcttctacttttcaggatttttcactccatacaaaagatgtgtgcagaactcctgtttgtgataccgtcgcagccagtgcatatgtgaagcctcaaacttcacatgtgaatgtgtttccactaaagtatattcttgattcaccaataataggataaaactctttcaattgtttctttaatgatgctggttaataatgtagatttctagcaatctattctgtatatatatttcaatgtctattcattcttgaggttaattcatgctatttctttaacagagaggttaagaagtgcagcacgccaggtgaggagactaacatctccattgggagaagttctcctggtattatgtctaacctctttactattttactccgataattctttttccacttttcttccttgtacttaaacccgtccaactgttatgctagcctctccaactggatatgtagggccacgcctctcctgtaacgagataatgagttctgcggttgttggatcaaaagatggaaatactaagagtgcagttttgactacacccacaatgtcttcagatgtgaaaatctctcctccagccacagttgctaaaactgccacgccgagcaaaaccattgctaaggtgagctctctcggacccttgatacgtaagcatagggaaaactgtgtctagagaattagagatctagaaaaatgttttgctaatatattttaccttttaaggagcccagtactatttggaaagcattatcagttatttcgtccatgtacataacaatctgtgcaaggcttgccaactatgttatcaatgttatcagtgtgttattttcttattttgtattatcaagcacagttctctttccttcctatgtcatggatttctatgcatcctgagggaatgaagccgtgccaattctgtttttatgtttactgctgtcctagatgttctacctttgtaaccttcctgtgcttcatcattgtcatcagtccattcactattgcaggaatccaaactcaacccttgtgctagggtcttctctccttcgtttgcaagttccagaccagtacttgcagctgcaccctctgttaacccaatctacatctcaaactctgtagctggagttccaaccgggttacctgtatttgaaactaactcagtgccaggcggttcatccctgtccagcaaggctgttcattataataacctggctgctgcaaactatgctatttcacctcaatatactcagtcagtaagttctttgattaattcttttataatatcattgttgcttcaatagttcatcactttcttcagattgctgtcatatagtcatgaagtgataaacaaggaaaatattgcaatatggtgccaactcctattcagcaccgacattcctttaagctgataatttgctttatgtgaccactactactatctctacatattttaactattatctttactctggtgtaattttccatttatcttgagattaactattgaactactaatagctatcgtcaggggcggaatcaggcatggggcagctagggcttgagccccatgcctagctccataatccccattataatcttgaaaaatgctatgtaatttatgaaaatatttgagatcccattagctcagccttaggcgtggaaattttctggctccgccactggctatcgtttatcgttatgttatattctgtgcattgaattttcagattctacttcactttgatcttattgctgcataactctggcatgtacgttttgttcggatatgatcctgcctcctgaatccttatacatggttttttgaatgacagaccatggggcataatgtgagcaggctggatcctgctagaattggcacaccttatcatcccatgcaagttggacctgcttacattagccctagtcctcagcctgtaagttctaatcagttgtatatatataaatatatatatatatatatatatatatatatatatactgatattaatttcaaaatgctgttcatttgtacctattggttacatgatatactatcatttgctcctgtactgatctaatttatttttatgttatgacatcataggttactggtgggaaatttaatcatgttgtttatgtacacccattttctcaggtgagtaatgcaacagtgttatttctattaatagctcaagtggaactctgcgagagtaagatgatgaattaatgatgcaagtacaatttgtgttgtttcatacaatacttttaactgattaaatagtgctgattcattggagatatcatggttgtcttttgtatcgctcaaccagtagatagtgcaagtgaggcactgttatccaaattgaacttggatattcgtctgttttaaaaaataaaaactactcagctacatttcacacattagataatgtgaagcttcatttcgtggcatgcatctttgttggcaaccctatacattgcgtagtcatttaggcatatgaagctctcctgttaaccgtaatgattaatatttgacattatcatccctctaaaaaactcatcctagttatatttactgcaaatacaaattgccctaactgcttttagctgatctactatttgctttccgctgaaggatgtaatgcatggagcacctgttatgccccaaggatggtctcttcctgcaccattgaactcacatcaagctagcctccagaagttccaaggtaaaaatcgtactcattgtcgactgcttcctttattttaatggaaggtattaaaatgtttattttatttattcattacactaatcaaaacattttacttcgaaactctccaggcacagcccctgtatatgtagccccacctatcatggcaactgggaacctgccattggtggtaccaagccctgcaccgcttgtgcagccattccaggccgttcgtcccatcatggtacctgctgcaagcagcatggttccaggcaaatacatgtaaacttgtcatagcagtgtgatatcagtttttgttggaagaatcttggttttacccctttggccgttggggtttacatctaagaggactcgcagttttgcctaatctgttaattctcttgctagttgctggtctgtgtccgtctttttgttggaaggacttgcaacttttaccattcttaatgctttggcatcatcacgattttccttttttcttttttttttctttttggatcattggggtgggggtggtgggggtgttccatgagagcagttaaatgaaatagagaatattgaagcattttttttgtcatgtcaaataccttttccctttttgaagagtagcatgtactatgtacaatgagacactgtaaaagagttagatagtaaattgattgttttcacagggctaatgtacattgatcttgtgaactgttctcatataatgacggacaatcccgctatgaattagttttacctttttggagcatgtgctgacgattgatccagtgtttatttgcgccaagtagcgtttgttgtagcagctgctatatatagaggttacagatttctactgtccgctactgctataagatagtggatccaacatagtgtattggaaatggaacttggcgaccgatattacaataggctttgttggcctgctattacgcttaaacacgaatacacgatgttctctgtgtatgaataggatataagttaacgtcgtgtgctttctttctctcatttatttatgttgctttgtagtttttataccttgaaatgtatgagtaattaagtctatacttctaaattgcaagtgaaactagatgttagtgttactacataatctaaatttactgtttattttttgaatcccgttattggacagtagcacccgcgatcttcaatcggctacaaaaatttcaagcccgaaaccttcacaccaggtctttcacaagctacttgagaaatcactggatttgcctctcagactggccaggcacgccaatgtccatgagtaataagaagctagttcttgtagaaagagtgcctaaagtagctcttctagtttgcatattttatattgcatactccctccggttccatattaattgacgttttgaacaagattgaggtcaaacttttatgatttagactatcaataactttaaaaatatttagtttaaagaaactagaacaatatatatagatttgtcttttaaagtactataataaaagtaaacatgcatttatttattatatatattatgatataaaaataagatcaaagatatatcttgtagaccgtgtcattgtccaaaacgtcaattaaaatgaaaccggagggagtatgttattttcatactgtcgactggaatgccctacgataatcggattgtccggttctatagttgttttctaccgttgttgcattgaccagactgtcctatagctgtaagataatccaactccagtataggctgtgtttagtttctgaaattggggagaagtttagggaaagttggtagtttggaaaaaaagtttagagtttatgtgagtaggaaagttttggatgtgatgtggtgtgatggaaagttgggagtttggaggaagtttggtgtgaactaaacaagaccatagttggactgtccggttagttctaattctgctaaaagtttcttgaaatttcaggaaacatctattctaccctctaggcgacaacaacaatactcaaggcccttttcgtgaatagtctgtcctttttttttcttttttttgcaatggtaactgatactatagccgttgagctataaaagggcaagataatacgattggcaacaccacactccatatccccgcgaatgcgtccacataacacatgctctaaacaatagaaaccagcggcacctcctgatctcactaaattcctattgaaacctacgtgtgcgtaatatttgtggacaccaagatttaaatattggtggatggagtcatcacccatatataacttcaccatcataccgccgctggtgcttccctaatcagcttaccatctgattgtccggctaggccaactcccaaggcaaactttgaatcacaaaaacgaataaccctggttggctccacatgtatccactgagcactttagcgatttagatgttacaccatctaacgtgcatcacaccgagatgattagtaccttaatacctcaaactacaagtttcatcccgctagctatatatagtacggtctttgaatgtaaaaacaacctatttgtaagcacgttcaccccaagtccctaactccttgaacgtgtttttaccttgaagagggttgtagccaacttccgatctcttgatgaccgtaagctatctccaaatggacaaaacggtgtagcattgtttgtatcatcaaaatcctttttttttcaaacttagcaaaagtaaatagttccgatgatcatattgtcatcaaccaccaaaacaaccagaggggctagatgctttcacgtggcataccgcatttgctgaagattttgtggcaaagtgtgaataccatccaagtattctcagactgcaccatgatagacttcaattgactttttttttaaaaaaaaaaaactacttcatctgtcccaaaataagtccagccctgagtagaattcaattgatttaatattaacttctgccagattccgcaaggacaacaataccggatgcacatgtcagtaatgaaaaagcaaagtcgaaagatacatcttccggtttctgagatactgtaatagattttgacaataacagcttgccttctgttacttaattatcacaagggccatggtacaaatgctttcgattcagatatgccattttcctatatggggcctagtccttccaagttttttctcatttctttttgttccaagtatgaagtaacttttttgtatggctttacatcattattaaaaggttcaagtatccttaaatggaagacgaatgaaaatgaaagatagctcaagtatccttataaggaagacaaataaaagcgaaagacaagtatatatcctagagtacgagtctacgcctttggcatccagccatttatagtaagacttggcagaaacaatctggatttgaagctttcacctaacattaagaatcattttgtctttctcaagcgctgctttcatttgttgtcaaccttcatttcatgactgtcatctggaattttgattttcaatgtaacagcaagtttgttagttcttgcagtaaataatagataataataaaatgttcccaagaggtgtagaaggttaccttggggattatgtactgcggttgaagcctctaccggaggtgcagttcctgaaataaaagaggggtttatgtttagaacacaatccaaggaaaatggttattgttagcatcactgcttatgtaaggcacacaacaaagaactagcagaaaatcaatggttacacacgactaaggagaaggatttatgttagcaacacaatctagcttatgtatggggaacacaacatagtactagcagcaaatcaatggttacacacgaggaaaaggatttatgttagcaacacaatctagcttatgtatggcacacaacaaagtactaacagcaaatcaatggttacacacaaggaaaaaaaagcttgtgcaggcaaaggattatctttgagccaataaacaaacatatttgctcagaacatatgcccatagaatcaaagcttttaacgttactctaggtgccaataaaaacattaaaagtagagggtatcacatttttacctcctgaggcttctgactttgagtcatcagctcctttggaaatgtctctctctgtgtccagctgcacagcttgttctgtgctttctaaatattcatatcaacagcattaactagagggttaatactaagcatgtcaaataatggaattatgtattacccggtggttccataaaagtttgttgcttgctatttgtagcattaggctgctctttgggacctaaagatacaaatccatttagtgattgttcttgatagaaaataagtcatcgagggcagaaggggcatatatagtgttgtacagatgctatcttgacaacgagcgtgctgaatttgtcatgccccaaaataaaataactgaatctacttgtgtgtgacacacatgaatcgagcatacaacatctaaatcttacccaaagattcctttatagcatccattactggaacattaagcagatgcctttcccctataatgacacaaaaaatgtgatctattatttaagctttatttctatccagaggtaatatattattcaaagtagatcaaattgcattcctccaacgaacatacctgatgactcttcagtgtgctttgaagattcagagactgtttgaatctcattgacagttttccctccagcgacttccttgcatgatgccaatacaggttgacctgatttaataggtaccacagcagataacggttgtggattcacatgttcagtaccctgctcggagaaaatccttgattcagcattactgggtgaaactgagataggtactgctgcaacaaccccagaacccatgtgaggtcttggaacggaagggaccgtgtgcttagtgaaggatttctctacaggcctcctcatctgtagaggctttgcaaatgtaacatcctccaaggggactggaataggaccagaagcttgtctgtaaacagtagatggcctctttcgaacttgacttggtcgaagcatagggagatctggggcaagatcatcttttggtgttattgggcggaggttattttcatctggaatccaacctttgagaacctgattgtccttcactttcaccgtaatcagagaaaacccaggaaatttcttcgacatcttaccaacaaaatacttgccaacaatatcatctttgactgaattaccttgcaaaggagcactagtataaatggaggcttggctgagagaagtcttaaccagattgacagaatctctaggtccactggatctattagctgggccttgctttgtaggcaaagcctgaattgtgcctatattagggccaaagctaccacctgatgtatggttgatctgtatcccatcctgtcggatgtttgagctatcttgtgtgctgtgaagaggtgggacgctctgaatgtgctgcacactatatggtaattcatgcatgccgtactcatacttccgtggacgaccacgcttacgcttagcaccagagcttaatgtctgctccatgggtagtggttcattatgtgcaacagctttattctcttcagatgtcatctttggcaatttgctttaactttttgcagctgaacctaggaacgatgataatgccccgtaaaagtgtattcaccaccttcaattacttgatgagtttttctccccttgaacatgcaaagtgagcgcaatgagcaacctcaatagcgaaaggatggcaaaatatggcaagtaatcacaagaagattagaagatgatagagcaagtcgacaatcaggaagatagaagcctactttccatatccgctaagaatgaaattaattaagtctgctaagaacgtaactaaaaaggaagctctcatggaattattttcaaaagagacatagcacagtttgcaataaataaagtacccacagggtcatatctaggggagaaaatggtcggaaaacagcttcaaccatttctgtaaccgtacttttctcgaaaatataattgaaagcagtagagccggaaatggaaatggaaatgatattgaaaaatcaaaaagggaataatccgggcggaaatgtgttggaatcattaggaaaccaacaattcatgtcggaaacatcaaatagtaacaacatatgttttcacacacttgaccaacacacatatacacgtaatataactcaatttatttaatatgatggcatgtttacatatagccattgacaattgtactaaaaacatttatgaactaataaaatagttgtatacgaggtgcataatgaagtttaaatatttaatatggtggttggtgcatgtcttttctaacttataggtcagctgtttgaatcccctagctggaaccatttttgtgaaagaagtgggcagggtagcttggtcaagtcctgattgacgtagtggctctctacacggtgatgtggcctgaagtggtcctctacttggcgtggatcatgggcctctacgcgttgctatagtcagcctctagttggagctgtatatgctaattaccgatttccccaaaatgataatttctggaacaatatgataaaccaagaaaatggtcgattgaacagcaaaaccatttctgccaccgtttcgaatggctcttaccgtttccgtaaccgtttcaaggggcagacacaacaggggggcccgagcatcccctgctgcggtccaaccattcttccattcgtacaagtggcagggttgtagcgtgtgagtgcaagccgactctggtgtgcatgccgcttagttgagttcagctgctcaggtgttggtgcctctgctgtgggctgtggctgtgataaatgaaggcaatttgtgttcagtttccaaatttacatttataaaattatgaagtagcacttcaaaatcaccattaattatgatgatattagtacacaaatagatatttaagcacatttatcagttctcaggacttcgctgtgcattgccgaattactatcttcaattttcttttgcacgattggtttgtttacatgcggttcatgtataaatttggatccaaaaaaatgattcctttcacttcagtcgttactaatgtgttttttatttcactggcaacccctacattttaatcctgtgtgcgtcggttaccattcctagtgaccaaatccattggaaacagtaattgccaaaaacgagcattggaggaggaatttccacgaagccctagtcatatctaatgtttatataataaataacagtaaatatccatgaagcaatgaaaatgaaatttgtcagatgcatacgaggcaaaaggaacataaataccttcctggctataaatgttctatagcaactattactagcatcaacatgtaataaattaaactgggttatattcttggattacaaatgcagaaaccaacttattacggcgttgagctcttgtagatctgtaacacatgccctgagcacaaacactcaagctttgtaaaatatgtgtcaaacagatgaactagagggaccaactaatatcaccaaacttgttcgttggaacttgtaataatccctaaatgttgcaccaaaattgcaagcctgggctcaagcaacaaaaagaatcgtataaagatgagttggaggtgaagttcattaccactagcaatcttatccaattcctacccaacctaccacactaaaacctaaaaaaaatgcagcaatgcattttttaagtaaaattaaaggccgaggcacagctttgttgaaagcaataaccaaatgaaatgatttcccctcctcctgtaccattgattaccatattacatcaacacataacatcgattaactgagctcctaaattccgggaaaaaaactggatgagctaatcagagggcaaaaaaaaaaaaatccatctaatcccgaatgggtcacaaatccaatcaacgccgtctcatgaaatgacgcagatgcccaagagagaaaaaaatggatacctccaatccgatccgaccccgatacgatcgccgttcccgcgcgcgcgaggaggccgcgcaccaagggtgatagttgatacggccactaaggggggtgaggcaatccgcgccgtgtctccggcgcccgttcggcttctcccccgcggcgcgaggagaggagaggtggcgcgccgaggcggcggaggagagctcgccggggcaccaccggcggagacacggaggaggaggaggaggagagatggggaggaaaacgcgagagggagggggggaggcgatgcgaggcgtggatggaaatcgtttgccgtttcgatcgtgaaggcgaagccgtgccgtccgtcgatcccagccgatggatttagtttggacggtttggatttgttggtattggttttcttttcccttttttttttctgagaggttgtctgttttgatgatgatggatggctaccaactcgaggtttcgaagggggccgagccatcgggccagcgttggcattaacgtgtgggccgacccataagctacatatgggtccacgaggcccatcattggcgtgtttgagtaggggaaaggagaatgttgaaaagatgctcaaaacgagatgaaccattttcacataattaattaagtattaattattttaaattaaaaattaatatgattttttaaaataatttttatagattttttccaaaatacacaccattcaggaaatgtgcgcataaaaaactgagggactttttctctttatcctctccaaacgttttgagttttcatttttctctcttgtttgttgtgcataagtcaatctcaataaaaaaactgagagattttttctctttatcctctcttcctaagcagtttgtagtacatctaaagtaaggtttctagatgctaaacggttcattataataaatcttataatttgggtaaagttttcctctgataacacacgcaagagtagtacatctaaagtaagggtttctggatgctaaacggttcatccattttttctataaaactaatgtccactaaatatctaaaactcaacatgcaaacataatatttattaacactcctaaaatctacatgcaaacatgtcacatcaactcatttaacacacaaagttcaacatgcaaacatatattaattatatctataatttatttcattctaaaagtaagcatacacatgctaaatcatcattctcaaattattttcataatattttaatccaaattactccctccgtttcaaaatgtttgacaccgttgactttttagcacgtgtttgaccgttcgtcttattaaaaaaaattatgaaatatataaaactatatgtgtacatgaaagtatatttaacaatgaataaaatgatatgaaaataataaataattatttaaatttgaatggtcaaacacgtgcttaaaaagtcaacggtgtcaaacattttgaaacggagagagtatttcattatttctcccatatctatcatatattcgcagcaaagcgtggagcatcttataataagagaaactacaaactaaattttcttcaaccgcaacacaaatttttcttcaaccacaacatatcatgtgtagctaacactaaactaaattttcttcaaccgcaacatcatgtggagcgaacacaaattttcttcaatcacaacatatcatgtggagctaacactaaactaaaatttcttcaaccgcaacatcatgtggagcgaacacaaacatcaaactatgtggagcgaacacaaacatcaaactaaattttcttcaaccgcaacattatgtgagcgaacacaaattttcttcaaccgcaacatatcatgtggagcgaacactaaactaaattttcttcaatcgcaacatcatgtggagcgaacacaaacatcatgtgaaatttttttcaaccgcaacatcatgtggagcgaacacaaatcatgtggagcgaacactgaacatcatagttcacaaaatatggagtttactttaagtacagttctacaaagcttctacaaggtgccatacacacttgtaaatgcaactagtgcatccagcttcagatccggcaaccgattcgtcaaagcctcagacataaatgctgacacctcagtatttaagaaaagagattacagcaacagtgattacatcaatcaattccaaccgtccaatgccatatggagcagtacagagaaatcacaaccgcaggttctgttcccttaatctaaactagcctttgccttctttgaacttctccagacttcagaatttctacagaagttcaggttctctcacttagcgacagatttctcaacaggcttcctcatctgtagaggctttgcaaatgtaacatcctccaaggggactggaattggaccagcagcttgcttgtaaatagtagatggcctctttcgaacttgacttggccgaagcatgggaagatctggggcgaggtcatcctttggtgttattgggcggaggtcactttcatctggaatccaacctttgaggaccagattgtccttcactttcaccgtaatgagagaaaacccaggaactttgttggacatcttaccaacaaaatacttgccaacaataccatctttgactgaattactttgcaaggaagcactagtataagtggaggcttggctgagagaagtcttaaccagattggcagacggaccaacactaccacctgatttatgattgatctgtatcccatcctgttggatatttgagctatcttctgtgctgtgaagaggtgggacgctctgaatgggctgtacactatatggtttttcatgcatgccatactcagacttccgtggacgaccacgcttacgcttagaaccagagcttgatgcctctatgggttcattaggtgtaacagctttattctcttcagatgtcatctttggtactttgcttcaaccttttgtagctgaacctaggaacgatgagaataccagcaaaagtgtattcacaatttttctccccctgaacatgcaaagtgaaaataatgagtaacctcaacattaaaaggatgacaaaatgtggcaagtaatcagaagaaattagaagacgatagagcaagttgacacaatatgttattgaaaaggaagctctcatgaaactattttcaaaataaacatgacacagtttgcaatcagtaatgtaaataaagtacccacacggtcatatctaggggtgaaaacggtttgaaaacagcttcaaccattttctgaatcacacttttcctggaaatagaattttaaatggtagagccggaaacagaaacatgctttgcatcataaggaaatcggcaattcatgttggaaacatgcggtatcatttggaaactgtgacaccgtatgttttcacacactcgaccaacatacatatacacgtaatataactcaaacatgtttttacatatagtcatttactattgaactaaaaatatatgtcaaataataaaatagttgtatatatggtgcatatcaaagtttacatactttacagaattggctatccatcaacatcagcaacaaggatggtggttggagcatgtcttttctaacctacagttagctgtttgaatctccctaaccggcgcctatttttgtgaaagaagtgggctgggtggctgggccatgtcctggttgctatggtggccctctacttggagaggatcatgatgggcctctagttggcgtggtatatagtaattactgatttccccaaaacaatgatttccagaacaaaatggtaaaccgagaaaacggtcggtagaacagcaaaaccatttctgcctccgtttttgaatggctcttaccatttctaggggtggacacagcatgggttcctgagcattccctgctgcgaccatagttattaggatcgaatcggtggtctgaccggaaaaaatcggaaccagggccttagccggtccacctaaaagatcgagtgtgcaattgaaccggaataaacaggttgaactgctggtttttacattgaaactggttgaatacaggacaataaaccggctaaatgggccggtgcacgacgctgactcagcttgaatggcacaagatgggtatgtgggagtggaagtgggagggaggagaaattaagccaaaaaggcagggcctgtgcatggggaggtgcgcatccatgttgaggaggtgcgcatctaccactaggctatatatagactagtgatttgatacatatcttttttccatttgaaccaggttggactagtggttcaaccggctggaccaaacaaaccatgaactgaggccttgactggttcgatgtctagtccggtcctaataactatggctgcgaccaaacccactggtccaccattcatacaggtaggtggcagggttgcagcgtgtgtgtgcaagccggctctggtgtgcatgccgcttacttaagctcagttgcgcaggcgttggtgcctcttgtgtggttgtgaggatgaaggcaacttgtgcttagtttaaatatttcatctatcattgcttccaattttctaatttatttttatacaattacaaagtaattaaatagatatttaagcatatttatcagtttgtaggactatgctttccattgctgaattactttcttcagttgttcttttgcatgatttgatatgtttatatgcaattcatgtataaatctggatccataaaatggattactttcacttcgttagccttgtgttttttatttctctcgcgcccccctaaatttcaattgtgcattcaccagtgaccatttccgattcctagcgagcgaatccatcggaaatggtaattgccagaattgagcgtcagtgtgggaatttccgcgactgttttcacccatagtcatatatatagtgtttatgtaataaataatagcagtaaatatccttgaagcaatgaaaactaaatttatcatatgcatacgaggcaaaaggaacataaacaccttactagctataaatgttttatagcaactattaccagcaccaacaagtaataaattaaactgagttacattcttggattactaatgcagaaaaacaacttattagcacgctgagctcttgtaggtctgtaacacatgccctgagcagtactcatgctttgtaaaatatgtgtcaaataaatgaactaaagaattcattcatagtgccagagggaccaaataatttcaccaatcttcttggttagaacttgtaacaatccttaatgtcgcaccaaaattgcaaccccggggatactcagatactgtaactgtgataaaacaatcttgtaaaaacgtgttttgaccttttggaagtgaagttcatcacccctagcaatcttatccatcccccaacccaacctaccaaactaacacctcaaaaagaattgaagcaacatccaaacgaaatgatttccccccttctgtaccatcgattaccaccatatcacatcgattcacttaacccctaaattcgggacaaaactggatgaaacaaaaaaaaatcaatcggaggcaaataaatccatccaaagcccgaacaagctcaccaacctaatccacgacgcctcatcaagcgatccgcggaggatatgagattgaatacctgcaatccgattcgaaccgagatgatcgattgatcgccgtccttgcgccgcaccaagggggataagagcagggcagggttcaggtaagaggacgaggcagtccgcaccgtgcctcccgggccggttcgccggcggcgagagcgcgcgcggaggcgaggcgaggcggcgcggaggagaagggctcgccgtgtgccaccggcgaggtagagagagatgggggaggagtagacgagacgagtagtgcgatggatatcgtttgccgtttcgattgtgaaggctcaagccggtgacgtgcgcagatcacggacgttgatttactttcgacggtcaggatctctcggccgtatgccagatcaaggctttgtacatggggccggccctcgagatagatggggcccataaggcccatctccatgttggcttggcctgcagctaaacgccgaattttttttatttataattttttttattaaaagttttacaaaaataattttccattttgaaaattgacggaaatagtcgcctaccgccctctgggagggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaaatttgcaggaggcccccttgccaccctccgcgagggcgattttgcactgtgcgggggcccgcctgcaaatgggcggcgagggggcatggaattttgcaggcggcccccttgccgccctgggggagggcgattttgtactgtgctctatattttttttatataaatatcaatagttatcaaatctttttatattgaaaactatacaagattaaaatctccaagattggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgccccggggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtataggtatttaacagtattaataaaaagtaaagtaccgtgtgggcgagggatcgacgctccgtgagagaaagagctggcgaacgcgcctgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaataaaaatgaactaatatctgggctgaactgtaccgtgcgaaaccggtgttgtaggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatgtcttgtaagtatggccgcgcagatcacacttgctgcagcgtaaagtcctcccacctgcttctgactcatccatatcatttctgatgcgtctagtttggcgtcgaccctttttcaccctaaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgtaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtaggcttgcgtgccgtgaaggatgaattcaacaatagcaaccaatggaagtacccgaactcctcgcattacccagttgtacacctctgccaaattggttgtcattatgccataccgagatccatcggtgtcgaacaatagagcccacttctccttaggctcattctcaatccactgagagaaatttctgatggccgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctacaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttctatcttcaaccgatgtaaatgtatgtaggtcatagtaagtattattattcctctgggcaatggtggctaacaaacgaggcaaattatcataacaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaatgaaactgcccaatgcttcaccgcctccttcatctcatccttatgagcataccttgcaccctcaattacctcgtactccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctctttcgttttttttggatttttagtgaatataatgaaatttcataggggaggggctgggctttataggggggaggcaaaaatcgccctcccccagggcggcaagggggccgcctgcaaaattccatgccccctcgccgcccatttgcaggcggccccccgcacagtgcaaaatcgccctcgcggagggcggcaagggggccgcctgcaaatttcgttaccggccgtcgcccgagagcgaacggccgtctgccacgtcattttcgccgccctctgggagagcgatttttaaaaatcgccctcccagagggcggtaggcgactatttccgtcaattttcaaaatggaaaattatttttgtaaaacttttaataagaaaaattataaataaaaaaaattcgctaaacgcctatatcagcggctttctagggttccactcagatcacggccgttgatttactttcgacggtcgggatttctcggccgtatactaactcaagctttgtacatgggcccggccctcgagataggtggggcccaaggcccatcaccatgtgggcttggcctgcagctaaaacgcctatatcagcggctttctagggttccactcggcgccgccgtgtgggtagacacgcgggcgaggttggttggcttgttctttcgttgatgtgttcttggttttgagttctcttctcggttttctctttagcgttcttgctgggatttgatgcaggcattgagacattgatgaactcatgagtcttagcgtatgatgtttttgtcctgttggaacatggatttccaagcttggatgccgcgagactcgcacagaaaaaagtgttgccatcacctccctctctctgcttgagcacacgagaatggagtcgaataacagcacaacatgtcccataatgccctgaatctgtctcattgtgcgttctgcttaccagccacagtgttcttggtcactgtttaagagctgactcttcataagctaatctctatttagttagtacatactgatatgaactaaggtttccagatgctaaacagttcattttatattttatgatttttgctaaactcttcctctgataaggcgcatgaaaaaacataaatcactagagacatctgtgtgtgagaattttattcaactgcatcttcatgtggagggaacattgatcacaagttttacaatatggagtttacttgaagtacagttctacaagtttcttcagggtgtcaaacacacttgtgaatgggttgaatgcaacaggtgcactcagcttcaggtctgggaactgattcgtcaaagcctcagtcatcccaggcattgacatcatcagaccaagctggtccgtggacatcacctcgcaatcctgtggggtgtccttgatcttgctcggatcataaccgaagttggcagcgtaggacttgtacttctcgatgaattctggtccaggattaggtgttcttgagtatatctgatgcattgccgagagacgacacaatgttatgatatttcagtttacaaaatgcgtcagaataggcatatgaaggtaaggaatattggcttgatttctcagtgttcaagtccttgcttaaccctatgttgtctctatttgacactatatttggttcatggaacagcttacgtaactagattgatctttcaatatgcagaataagcatgcagagggctaagaaatagtggtcatttgcagttcagagatcagtttctgacctggataaagcttgtgtctttagcaccagacacaacggcgtaattgtcataatcggttgcaagcacatcataaggttccttttgngngtaatgaatggtagtgtggggaaacggagaaagcatttccccttgatcatctcctgcctttcaagatctgtctcagcactcgccatgtcctcttcggacaggcattgcacccttccccgaataccggtgatgtaaccatcaggtccaccatgaacacagaatgtgtccacctggattgagcgtgatttctcatccaatgcatacaccccctgcagtaccaacaaatttctgtaacaatcttcttacacattatatggtgcaaatggcatagaaaaaatagcatgcctgtgataacctattccaaatcagtttgatacaaagatgtcagatatcggtgttttcaggaatcaggattcagaggtaacattatttagtttgcccttgggggggggccaattccaatttaaccagctaagaaggaaatttttttttaaaaacctactagtattggggtgaggattctggcactacaatacctgagtacagtgacagtcctcttgtccctgacaagcaaagccacgtttcagcgatgctacttcgaaccatctaccagagtagcgaattgggtcaaagttcttggcagtcatacccttcatcatcaaacctgtgccgccatcatcagaagggctatcgaatttcagaggaaccgcagccttgtcgatggctgctaccacagcaacctggcacaattttggctgtacaaaggtctctgcagggatagcctggtcaactatgagagattaagagtacatcgataccatgttacaagcctgaactggtaatctcactccattttccctcttctcttaattgaaattaacaagttttatgtatccaatcaaaattgcagcagtaaaattctctcaatcctcaacagtaaaaatatcttttcttaaaaaaaactgttcttgcttagtgatcccgaggttatctctttgaattacgccgtgtttagttccaaagtttttcttcaaactaccaacttttccatcacatcaaaactttcctacacacacaaacttccaacttttccgtcacatcgttccaatttcaaccaaacttccaattttggtgtgaactaaacacagccttagtgtatatacatctgacaataagttaacatttataggtacctgacaaggtggagagatgaaaacaagcgaagcagcaaggcatgagagcaattttgtggataatactccatgagcattcagtggcaccttgtcatgcagagagcatctgaaattatttcgtccagcgggtctgcattttctcctaccaataagaagattacttatcagcattttcatccaggtactgtactaacctgactcctcctacgtgccatcactgaatgtggaatatgactttgacatcaagaatgttacccaaaatacatgcctgcttcgaacagtgaatacaatagaacagcacctgatctagccttatacaactttgatccaagaaaaatcaactgcgtgttgctgccactggcgcttgttacctggaagagcaagcagggtgtggcgccgcaagagaagaagaggaggagcccaacagcagagcgagaaccatggcttcctcccgccgccgccgtcgccgtcgtctcccactgtcttaggccgagtaaaccgttttctcgagattacgcggttgcagcttcttgagtggtttttggctttcgatgtctgcaggtgcgggagagagagagaggagccgaattgctggagaccgatgattctgggcagaggcagaagcgcatccagtgccgtccaatgggaggcgcccacgtgggcaatctccctgtatcacctgcgggccgttagctgggccagggccttgcacaaagggaaaaagtacaccgaaggtccctcaacttgtcattgagttacaaaatcgtcccccagctgcaaaaacagatatagaacatccttcaacttacaaaaccgttcactttaggtctttcggttgttttgaccccggttttgtctgacgtggcggctgagtcagcgtgggacgcatgtgggccccacatgtcagggtgtccgccttagcaccctttctctttccccaattctctacctttctcctctctctctcctctcctctctgcagggcaacggcgggtggggaggaggtcattagggtgaggtgggagaggctcgcggcggtggttgcgacactggagaagggaggcggctcgcggcggctgccgacgacatggcggtggcaggagaagggagagcatcatcgcgcgtgcgacctcagggttgcaccgtcgaaaaggctcgagaggcgggcgcggccgatgggggaggagcttggcgcaactagcaggggaggagttgcaattcctgggcgtggtagggatctacggggaggcggcgtccatcctccgcacccaccgcccgcatcgccgccgccttcgtcctcccgctcttcctcctcttcctcgtccacatcgccatctcccacgccctcttctcccacatcgactccgacgactccgccttcgactccgccgccccctgcacccacgcccaacgccatctcctccaccgcctcgccaacgactggttcgccctcctcctcttcaaggctgccaacctcttcgccatcctcttcaaggccgaccatgcaactcgcagaagggtaccgtcgggtttgcatttgaataggataccttttctcttttggatacacaacgagatcggccgcgctggcgaggagctcgccagagcgccactaccgccgccgccgccgatgccttgctcccctgctcccgtgtcgtcgccggccaccggacctcctctcccgcctcgccccatcggtctcctccctacctggtggtcggcctgcccagagcccaagagagaagagtgagagagagagagagaggaggaagggagagaagaggggaaagagagagagagagagagatgaggctaatgtggacgcgctgacatgtggtcaaagcgccacataggataaaaccgggatcaaaactaccgagggacctattgtaaccgattttgattagttaagggacgtcggatatctggttttgcggtttgaggacgatttttaactcgatgacaagttgagggaccttcggtgtactttttccttgcacaaagcatgagctactctgcgcccatagagcccgggctatttcaaaagggaacaaatttactctagattttattttcaaacaaaaataataattctattttcaacaaacttttttaaaaaaactccattttcaacaattttcatatcaaacttatttcttgggtttgtattcttttttttaagaatcactagaattgaaattggaagtgcttgctttaaagttgttttttttaaaaaaaaataaagtgtcaaaaattacctattcttacttaaaaccgacgagcactcgtgaatgcaatgttaattttagtgcatatgcatactagagttaacttctccatctcaaaataaatgtagtttcttttaaaaaaaaaaataatctccttctccaaatcgaaccaactcaaggaagggtgaattcaggggctgtcgttgacagaagtggctatctccgtggtgtcatagtgtgctatccatgatgtacctttgatccgttgcatgataatccttttacacagaactcttggataactattgtcgacttttccattgataaaaattgttgggcatcgtgaagcagggtttctagctgcttcaccggccaaaaaaatggattagatatcgcagctttttttctgctagaaaaataatttccggtagccaatatccaaccccttccattttaataccatcaatatattaaatggtatgatgttagtctattaaacctacatactcattaagcatattgtgcaggttataaaattgtaagcgtgccaatagtcacgctcttctagtaattatatattgcattgttgaagtgtggagttttttttttccaagtgtaccttaaaaaagttctatactgcattgttgttagtatctctgcacgggacctcttcttgagatctgccagcgaggagcgcgcggagagctcatttctgtgggtcaagagctcatttatgtgggtcgaatctgtttccaacctggtaacgtttataaaatctacgtacaaggacactttgtttggactaatgcgtccacgcaggtgaacactttttcggtttgatcgctgcaacctataaatatgaatatgactcctttccggatccatgctaggtttatttttttcataaactaggacggagagagtaaattgacgtgtggtatccacgtgaagacggtctcaatctcacatgttatctgtcctttttttttaacttgacatgttatctcacatgttatctgcaggtgaacacggaggtttattttttatttgatattttaaagcaacttcttaccagaaatttagcactttataaaaatgtggtaacagaaatcgaggtgaaatctgcatcttaattagaaaaaaaaaggacctagattttttttattaagattcagatttttacctcggttttcgttagcacatttttcaaactactaaacggtggtgttccgtgcgaaagtttcaaacaagctgggcaaacccgccgacgaaggaagcgagctcaatgttgtttttcatcctgttaatgtgatgtacctttgttccgcttgtcatctaaatagctactccttccgttccacaaaatgacattttagcttctttatctcttttctaaatttactaaaaactcatatataaatctaaacacatatatagagcatatacatatgtctatgtataaatttatttaaaagcaaaacatctagcattgtgaaaaccgaggaaatatatttttttagaaaaaaagaaaaacagacaaggttagtggagtaatttagcagcctccatccagcatcttccctccggactcccgtctccaaagcaagcgccacaactcgaccctctttgcacggttctctcaagcattcacccccaatacctgagcgctccaccttcgtgcccccgactgccgacgccgcagaagcacgtacgggcttgggtaagtcgtaacgtacgtatccactctcctctaacagcagccacgaatcaacaatagctgaataccactgtcatattactgttcattcgattgcatttgagtgagaattaatggttcgtcttctcgattttgcatgcagcatcttggactgaagcgcaaccgcgcgcatcggatcgatggattcccccgtgagcccggctcggtgggtggtgggcaaggccctcggccccgtctcggacggcttggtggaggcgtgggcggccagccgggagctcggacccaacgtggacgccctcaagatggagctgctctacgcgcagggggtgctcgacaacgcgcagggcaaagacatacgcagccctgcgctcaaggagctcctccagaagctgcgagacctggcgttcgacgctgacgacgtgctggacgagctcgactacttccgcatccaggacgagctcgacggcacctaccacgccgccgatgagcacgccggcggttgcgcccgcaacctcttcctcaatgtcacccacactgccaaagctgccagcaaacggctgggattctctaaatgctcctgtgctgctgctgctgataatggtagtcacacctatccaagatcagaacaaggtgcgcaaggacgtggcctctgctgtggttggtcatacaacgaccatgacagtgaggaggaggaggaggccaccggcggcggcatccgcaagcttgcttccggtgctcgcaacaccatccatgctgtcggtaaacgcctccattgctcatcttttccagctgttgttgatgatgattctagcgtttcaatctgttgtggtgcttgcatgcacaagccaccacaacagagaaaggatgtgatcaaagaaacgccaaagttgaagattgacagagtgggtctgtctataagaatgaaggatgttgtcgaccaactgcagctcgtgtgtgcaaaggtcaccactattcttaatctagagatacaccattctatccgtagcactgattccagtactgcgagcaatcgtcccatcaccacacctacaagtatagagcctaaactgtatgggagggatgatacagcgaagagcataatagattatataacccaaggtacagactgcggcaaggacttgactgtcttgccgattgttggcccaggaggcatagggaagacaactctcatacaatacatatataaaagccttgaagtgcaaaaccatttccaggtcaaggtctggatatgtgtttctcaaaatttcagtgttgataagctcatagaagagatcaaacaatatgtccctaaagtggatggtgaaaaagatggtagaccagaagagctaattgaacaaagattgaagtctaaaagatttttattgatattggatgatatttgcaagtgtcaaagtgatgattggaaaaagcttttacttccactaacaaaaggacagtcaaagggtaacataattctagtcacaactcggtttccggttgtagcagaaatggttaaaacaatggataactcagtagatttggaaggtttggaccctggagcgtttagggatttattcctagcatatgtatttggtgataagctaccaagagacgtccataaagacttacttgtgatcggagataagattgcaggaaaactaaaaggttcccctcttgcagcaaaaacagtaggtcgactattgaggaaccactttgatcaatatcattggaacagagtcctagaaagtagagaatgggaaatggaaaccagcaatcatgacattatgcctgcattgcagcttagttatgattatctaccttttcatctgcaa

SEQ ID NO: 70627 - DNA, 1057 bp, Oryza sativa
ctgattcaatcaagcaagccatacaccgctgatgacatacatgcattaaaaatcttggattacaagccaggtttatcgttttaaattctttcgcaaattagattaattcacagattactaattattgtttgatctgttattgtttatgcatgtatgtcggctgctgtcgtcgccgctggctggcttctttgcgtacatggctggtgtactctgccaccattgctggtggcgacattgtcttcaccaaccggctgcctccgtcgccgctgactggtgtcctcgcctatatggttggtcggtcacaccaccgttcatgggcgtcaacgtcttcatcgaccggctagccttcgccgccgccgactggtgtttccgcctgcacggctggcctattatgccgccgctgttgggcgtctacgacttcaccgccggcctgcctccgtcgccgccgagtggtgcctccgcctacacggttggcctattatgccgccgctgttgggcgtccacgtcttcaccgccggcctgcctccgtcgccgccgagtggtgcctccgcctatacggttggttggtcacaccaccgttcatgggcgtccacgtcttcaccgccggcctgcctccgtcgccgccgattggtgcctccgcctacacagctggcctattatgccgccgctgttgggcgtctatgactttaccgccggcctgcctccgtcgccgccgactggtgcctccgcctatacggttggttggtcacaccaccgttcatgggcgtccacgtcttcaccgccggcctgcctccgtcgccgccgattggtgcctccgcctacacggctggcctattatgccgccgctgttgggcgtctatgacttcaccgccggcctgcctccgtcgccgccgactggtgcctccgcctacacggctggcctattatgccgccgttgttgggcgtctacgacttcaccgccggcctgcctccgtcgccgccgagtggtgcctccgcctacacggttggcctattatgcccccgccgttgggcgtccacgttttcaccgccggcctgc

SEQ ID NO: 70628 - DNA, 3742 bp, Oryza sativa
cagcaagccagcaacagcaacgaacattctccgttttcagttagatggtttctgattacaaaacaagagttaaaaaatgtactatttttaatatatcgcatttggtctacagtatatacattattttatttatatttggtacttaatttaagcctcacttagacctttgtacatagccttcaaatttgacggcccagtcctgctaccaagtagctagtagctagctaggcggctactagctgctgcgtggctactggtgtccgcccggcgtggcgaatccggtggctggggtcctaccacgaggccgtcgttcaggcatgccgatgttgatacccccacagcgcgaggcagcgcagcgatgacacgacgagcgcggctcgcgggcgcagcagcgcgcgcggtgtttcggggcggggaagggtgcgtgcgcgacggggcagcgcacatgcgggcctcgtggccacgctgccccaccccacagccaagccccccacccccgggtcgcgtggcggtacacgccccccgtacggagatccggaaagctcgtacgggcggggaacgcccacccacccaccccgagaagacgaagaaaaaaaaataaaacagccgcgactgcgacgtctcgatcgtgtgcgcgtggggagaaaaagcaacgcaaaaaataaaaaaaaaggcggccccgcgacgcgacgtgtccggtgccctcccggcgtttgacgcggcaacctcccgcatcgggccccggcccggcacccaccgggagcctttcgccgagccaacgagccaacgcagcgtacgcacggcacgcgcacgcgcggcgcgttgcaggatttctcggttgatgacgggggaaaaggtgcggtggtgtggtgcctttgcttggtgaaagatgggttggttatctggagctacaagtgataagggggtactgtagcagatgatgttaaacaccggcgtatggtgttcggaagtagcggagttctgcatcagcaaaagctaaagccttgccagttttaatttgccaccacgatctgttttcttgagctgttggtgattgaaaggttgggagtccttattacaaacgtaaatgctcaaaacacacgtacatttatccttataaacatatttaaaaaacggatcattatattttgagattaacaaaatcatcacaaatatctcgatatcaatacgtatatcgcatattaccgaagaaataattagccgtaaatatgagcattcgtaccaattctaatatttaaactcgggccggtgtacgtattatatcacaataaacctagccatttgacgacaagtccttctggtatacgtcgtgcgataatcagcgtatgccattcgcgtggtgtcgtatatctgtactgattccatctttgctgatggttaaggctatatttgattcagcttattagttgagctatttcatcatgtttttcaatgtacattatgtaatgaatttatatttgtgagttccgtaaataaataaatgtatctctcaagtttgtactccgtaatagtgaagtacttaattaattatgttctaatgacccatattatttcacgagcttaaggcttcgttcgttgagcttttcgacaacacgtgaatcaagataagctattaacatatagttaatcgagtgttgattactaaaatatttatttaatttttaagaaacttatatatttgttcatacaaaatacaccgcttaacagtttggtagcatatgcacgtaaaaaacgataaggtaaagttggaaaattgtaatctatataaacacagccttacacactagaaaattgatttatcacaaaaaaatatatggcatcaatactaaaatcatgacaatagatacatattaccaccatttttaaatcgctgttatccgtgataataaatatagtgctaataggttgttgtaacgatttatatttagtggtaacaaatttggatattggcacaaaatgatgtggcaaaaaaaatcgtattgcaacacttcacatcgttgcaataaataattattgtcactaattcacctgtgtaccaattctgttagaaaatacatatatttccatttgtgcctacctaactgagattagaattatggatttgagtatctaaagatttcaaatgaaaaaattgtcacatataaaattgtagattttatcgatagctataatttttatataaaatttgtctcaatcagtgtccatatgaaaaaaagtaagttaaattatgagataacaaatttttttgttggaacaaatttattgatcgtgggggatctagagtcgactgcaggcaaaaaatagtaaaaaaagtaacttaccacaaccatgtgttatgcaaattaccacaaaaattaaaacggtggcgatagaacatgttttttttttgcaacactaatggttttttgacgataactcatttcctattgcaacaaaaatattgaataaaacaacgatcgtaaatcgttgcaacaaaatatggttatttgctaaagaaatatcattgtaatagtataatatatcttcacaaattagttttcgttatagtaatttaatagtaatacctcaattatcaagttttcaccgaacagttgagagaagagatggacttgtggaccagagtagaggagattctggccgggtggctggagccttccttctcctccgaactttctcaccgactaaacgtctgaacctcgttgtcaccgagtcgcgtcaaaacatttaccagcgctaggttccaacttccagtataccgcccacattgacaaaagaaatcacccccgtccagaaccttccacggtgaaaaaaaaaaagaagtcgtactccgcctcataaaaaatcaatctatattaaatgtggcatattttaatactattacgaatataaaattatatttctaatcgtagtattataatatatcacatatatattaggttggtttttagggatcgatggagtactctatatcaaataagcagcaaaagaaaaaatcgccaaaagatggtaacagtgacgcacaattttcgttgtgtgttgacaacggactctggaactgaagttattttaacaagggactagggactgaagaatgcaaggcaaacttttgagagtaatccttacacggcatgatatattattgatgtagtggcttcatatgcgtttcccgtttttttagctggaaaaaacgcaatgaacaggaactgaagcatgccacatgaggacataaggataaggaacaacatggcaacttggctcacaagtgatcaggaaaaatattataaactgcattttttttaatttgagttattctctctgcccctctcatagtctcatgcatgcgcaagggataaaattttctgcccaaaaggaaaggcaaacaagatttgtttagctccatttcatgttaactaaagtctgaacctttgtaaggtctggacctcccattttattttttaatttaaacataactagcaagtctttactactccaaaaaacttacagaatttaccaagtggaaaacattacaattagtttatcgaggttcataatagatttctgatcatatacatggaggtgatatttttcactctgttcagtcagtaggtacctctgggaaggcggaaaaaaatgtgaaatgttaattgtgatcgcaactagatactctatccgtcccaaataagttaatctagtacgtgatgtggcatatcgtagtccgggt

SEQ ID NO: 70629 - DNA, 3051 bp, Oryza sativa
  unsure (1)..(3051): unsure at all n locations
ctttactactccaaaaaacttacagaatttaccaagtggaaaacattacaattagtttatcgaggttcataatagatttctgatcatatacatggaggtgatatttttcactctgttagtcagtaggtacctttgggaaggcggaaaaaaatgtgaaatgttaattgtgatcgcaactagatactctatccgtcccaaataagttaatctaatacgtgatgtggcatatcgtagtccgatccagattcgcaatattagaatatgtcacatttcgtattatattaatttattttggaacgaaaaggagtatgtttggattgttttttttcctctcaaaagaaaaaggattttgcatttgaattgtttagcttgtataggagtgtcggtgacatggggccgggggtatcgtgactagaggcttgggtagccgcggtcacccacgtggcctgcccccctcgggggggggggggggtcgggcccaagggtnacgtggccacccttcctcctgtctccccgaggggtcgggccgctcctgtttcggccccgagggctggggcaccccgaccccctgtggttttggcgccacgtgtgtgggttaggtgagcacaccgggctcacctacccgcatttatagcaggttggacgagcgcgccacgccgcatttaatgcagcgcagcgcacgcttatccggtccgtgaccggtcgcggtgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagatccattccaggcttcagcgcaagtatggcaaggaagtcgctggccattaaatgaaggttgaaatgggcgtccaccggaaaagcgggcgagcggggcaggaggcgtgtgctctgcttgtcagaggtcacttccggctgtagactagccctgattgtaaaaagcatgtttcccttcttaggcagcaggaggcccatgtggtgaccccggaccagataaaaaggaggcccaggcctagaaaaagaaaggagaggaggagaaaggaggggagtggggactctggcgaatgggttctagagcctgaactctctctcgctctccggctctctgtattccttcacgcacagatccaccagaacacaggagtagggtgttacgcttctcagcggcccgaacctgtctacgtcgcccgtgtcttgtgcatttcctctctcgctgacgttcctcagatcgagggcgaagaacctcacttagcgcccccggccgaaccggcaaaggggggcctgcgcggtctcccggtgaggagccccacgctccgtcaaggaggtataaaccaaaaatgaggcaagcacaaatcaaaattgttgaacatgggccataactacctttacagatgcatatacattgcatcgatttgtatggttatgaatggaccaccatgtaccctcatgtcccaagtgtgcttgctgggggaagcatagcatttagaacggtttcgaaatcaagaggcagacaaatgaagtgagctctccaactcagcacaaggcaggttttttctttgttggtacgtacaggacaagagggacaacaagaaaggacccacaataatttatactctatgggttttcatgaccgatttcgcaactagattttctttgttattaataggtgtcctttcatacaaaagaagataaaaatgcaacattgatgacatagttgcttccatctttaaaactattattacttttaagggtgcacttgtctttatcttctggttaaacaaaaattgccataaattgcacatcctgcttaaaaaactatatcataatttttgctggctacttttttccaagtgtttttgaccaattatataaaaacatgtacacacaaaataatacgaatgcatgaaaaatatccttttaacatcagcttaatggctcctttggaacgcatcagcttaatggctcctttaaattcaagtgtcttgttatcttaaatcctacagatagaaaaaaacacaaagaaacagtagaaatgatcatttggattgagtagaaaaaaaaacataggaatcaaacgagactgacagacacagaaattttttttcccaagaggtggcacctcatgttgataatccttcataattcctatgacttgacacaatctaaaagaatttaaaggaatttgagcaattattcctttgttccaaatggttacataggatccaatctatcaaattttttctcaaattcctttgttctaaaggggacagagttgaaggaaaaaaaacaaatccatataatcgagtaaaaattgtaatgcatatacgtgtggtcgcataggtgaaagttattagcattctaagggctcgtttggaatatatgattttcaaaatacgtaaatgaaaaatacaagattggaaggtcctaacacttcaaaccatatgaattgaaaaagttcaaaaaaaaactacaagaatgactgtttagatggagcacgggaaaagcgttggaatcaaaaagagagaagaataagcacaaatgattttttttttcaagaggttagaccttatgttaaaattccttcaaaatttctatgttttgggccaatccaaagaaattttgtaggatttttggatggctattcctttgatccaaagtaccacattggggattttttttaataggattgaagtcttccaaaaatccttaaaaccactttattccaaggagccttgctataacagtaaattgtttattgcaacacaaaccatacatatcttgcgttcgtacaaaaatatatgcacttgttttgctacgccgacaatcccagcctgaaaataatttgattgtcattgctaccacatgagggtgatcagccagcccagccctcccctccaattgaataatcaccaactaaccaacgaccatatcaagaatcccaagctcctgtcagcgttata

SEQ ID NO: 70630 - DNA, 617 bp, Oryza sativa
atagccgagccctcggttatgggcaagccgagcaatgtacccaagttagtgttttaattcttaaaacttgctcaacaactaaaatgtggaatggttggcctgggttggcttgggacgagctgggacccagggtcgggttgccagttcggtctgaatcatcataggccttgggttaaggcaggttcgtgtgggttcacggccttgattaataacattgtgtaactctaggatcgtccttataaaatggctttgggcaactaagtgacttttaaatgctgtttactgcaaaacttaacccctatattattaccccttgtacccccttgcattaatcatgcatctgccggtgtggcttgctgagtactgtggttgtactcattcttgctcaatctttcccctcttcagtaagagaagcgttggagaagatgtcttaagtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgttgtatggtgtaccccggcttttcctgg

SEQ ID NO: 70631 - DNA, 598 bp, Oryza sativa
cacggtgacgattgaccctagcatcctcctatcaaataaagacacccctcactcacatagcgatcacaaggagggaacaatagtgaggagaaagtatgtgcggtcaaccgtcaccgccgatgtattgccgtaattattgtgtacacgatgtaaactattttggatgtattgattatccatataaatcaattgatgtatggcatatgttaattacgcacgattattagaggttttaacaagtttaaatcatgtgtatgctagttatatgcgatacttacaatttttaaaagttttaaatcacgcaggtggcaatttcatatgttaattagagtttttaacatttaatttactatcattctgtagcgcccgttccgttgtggcgcctagcgggaaaactatctcctaaaaaccctatttgcgaaatctgtttctttgcttgctgtctagtgtccgtgccatctcagatctcaaatccacaatctatcgtcgagttcaatcctgaatccaaatccttcccaaatcaatccctccgcaaaagtctattttgcctccctcgggttcgatgggccgaatccctctcggcccatcttccccctcc

SEQ ID NO: 70632 - DNA, 5840 bp, Oryza sativa
atgcagtgccgccaaatctttaaagcatgtatttttgtggtcaattccagaacgtgcgtggggtggttgccttcatggggacgcaactgccgtgaagcataagaaaccactttgccatcctgcatcaacacacattctagcccctggggagatgcatcacaatagacctggaaatctttcgtctgatcaggcaggattaagactggtgcagacaccaaccgccgtttgagttcttcaaaactcctattgcattcagcagaccagataaacttttcttccttcttcaatagctgtgtcattggcttagcaattttagagaagttctcaatgaaccggcggtaataacccgcaagtcctaagaaactccgaacctgagtgactgtccttggtggggtccatttggtaactgactccacatttgctggatccacagctactccttgagcattcacgatgtgaccgagaaactgaactttcttaagccagaagtcgcacttgctgaacttggcatatagctggtgctcttttaacttttcaagtaccagccgaagatgctgctcatgttcttcctcggacttggagtagataagtatgtcatcgatgaaaaccacaacaaacttgtctagaaattccataaacaccttgttcatcaaattcatgaagaaggcaggtgcattagtgagtccgaaagacataactgtgcattcgaacaacccgtaccgagtgatgaatgctgtctttggaatatcctcttcgcggatcctcaactggtgataacctgatcgcaggtctatcttagagaacacagtagctcctttcagctgatcgaacagatcatcaatccttggcaaagggtacttgttcttaatagtgacctcattgagtgcgcggtagtcaacgcacatcctcttggttttgtctttcttctccacaaagataaccggagcaccccaaggcgacgtgctcggacggatgtatcccttctataactgttcatcgacttgcttcttgacttccgccaactcgctggctcccattctgtaaggcctcttgtggatcggtgcagttccagttaccaagtctatccggaactcgatatccctttttggtggcattgttgtcagatcgtccggaaaaacctctggatactctctgactataggaatatcctctagtttcttagtggttttctccactgctacctcttgttcttcaccagcagcctggtttaaactaatcctggcttctgcggcactggagactggaagattaccacctctccttttgcattggtcaacttgatggtgcggctggcgcaatcaatcactcctctgtgccttgccaaccaatccattccaagtatgacatttaggtccttggattcgataagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaatgaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccagcacgtcttggcttcgggcactttccaaccgtgtgtccgggtttgttacaattgaagcagagttcgggtttttctcccaacctcttgggctgttctggcagagctggctgaactgattgagctggaatctttagtgaactcggagtagggttgaggctgtgctgctcactgttgttgtgactatcactatggtgggtcttattgaagctacccgggtggtagggacggtgctgtcggataatcatggtggaaggtccaccgtgacgtcccatcgtgtaacgaggcttctgacacttccctggggagtcctgaactgggctgccttcctcttacggttcattttgttacactgctcctcttgacgaatagccttgtccacaagcttctcaaagtcctcatagtctctagagatcaactggttggtcaattcatcatcaagaccagacataaacttctcctgcttctcggcatcggttcgcacgtcctcaggggcgtagcgcgcgaggcggttaaactcatgcaaatactctataactgttctggtttcttgttgcagggaacggaactctctcttcttttgtcccacaattccctcgggaacctgtgctttattgaaactatgacgaaactctgtccaagtaacctctgccccagccggacgggtcaccatgtagttgtcccaccaaatagaagcgggaccttgtagctggtgtgtagcaaaagcaaccttctcctgctcgttgcattgcaaaagattcagcttcttctcaatggcatgaagccagtcgtgggcctcgattgggttggtggtgcttgagaaagtgggcggcttgacacgaagaaattctaacagtttggactgaggaggtggaggaccaaactgcaggttctgctgctgcagctgtgcttgctgctgcacctgctgcatcacctgatggtactgttgctgcatctgttgcatcatcattgtcattatctgagtctgattgtccaacacctgagcaattgttgggttctcgggcggtggggacggactgttgtcagatgcaccgttggcacgtgctccattgatcggctcttcgctgccactggcgttgttcgagtcgcgtgaaccattccttatctccatctgaaggggataggtagaaatatgagaaaaggaagaaaaacagggggctcagaaactaatcttgcttatgaatttaagtgcaattatcttaatcttgattaaaacactgaaaaagaggcacgcaactcctaattgaggcagtcataccactgacacatgatatcgaccgccgactaacccacaagcaacaaacctaaacacgaaaactagcaagcaaacagactaagaaggcgataaagctaagggcggcgactctgaagctcggggcggcgcttgcaaacgagggataggactgacatctaaagtagacaagggataggaaccaattcatgctcaaatccgaattaaacaaagcaaaagaagactcaaataaataaccgagcacgatgatttttatgcatagaacatttttcatgaactcaaataaagacactaatgcaactaaacaataaattaatgcatagactagttgcatggaaaatgatgcgcataacattgcccccatcgaatatagacaccacctaatgcataacccccaataaattcccgactgactgtcgaataaactgcaactaaaatttttctaaagccctagattgagctaattttttttttttaaaaaaaaaaaatccgatccgaaagaacgaccaagatttttcccgcaaaccaaagaggccaaactccaaattttcccgaaacaattccaggtgcaaaaaggcatatgcagatgaaaaaggggttcagagggctcttagggtttccagttggcttgtcctacggtcaaggtcggctctgataccaacttgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataaccaaaggaggctagaggttcttttgcataaagctagcatttaaaagcagtagttgaaggcagtaaaacagttgtagtaattaatcaatattaaccaaacactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccgatccttaactgccatgggtgcgaccagcataaccatgcacccacagcccaccattcagtgtattttaattaactaacaccattgcggtggcaccaatctaaagctataccaatagacaaagtctatgtaataaggtgatccccatttgtgtgctagttgaactaagcatggctaagcatttcctaaaccaacatctagtcattttgatacccaagttatcaatggcataaggtaaacaataaatggctgagtattaggacccatcccacatgacattgtaaaaggatgcaacatttaatagaaatgcgggatatttgtaaattgggtacaatatgatcaaacgtattgcatgacttgccttgctctcgcactgatgagatcacagcaacgtcttcgagaaactgcggatcgacgaaacggccgaaatctacgcgacaaacaaagcacacaagcaaaacaggctataagactactgaagcaggaaacaaaactatttttaatggattctttgcatttttcttgatttactgagacttgaatggacttaaacggagctcggatgaattacttatgaattttagaagataaactgtgtttttactaataaagaaaagtccttaattaattattgcgcaatattgccccagggctgacgtcatccaaggggggggggcggcgccgacatgcgggccccactggcagcggcacaaggggagagggagggggcggctggcaagtgggccccaccaggcggtggctcaaaggggaggcgagggaggcgccggccgggctcggctcggcctcaaagccgaccggcggccatggcgaccggcggcgacacgcgcggtcaccggcggtgaccggcggcgcgggagacggcggcggccagtgcgaaggcgggcggcggcggccgaagatgacggcacacgcgcggagggcggcggcgctcatgggagggagggaaggaaggaggaggagaggggattcctcaccggcgaacacggcggccggcgcgaaggaagaaacggcggcgacgaccggtgatgccgaggcgcgaacgggcggcggcggcaccctaggagagagcatagaggggttagggaagggaaggcgaccatggcggcttgaattgccggccggagacggaggggagagagggtctcaccggcgcgcgaggagaaaagggctccggcggtgattcgcggcaatgaaacggcggccgaagtgcgggcgggctcggtgagc

SEQ ID NO: 70633 - DNA, 9750 bp, Oryza sativa
gatcgagtgccgccgcatcctcccgtccgcccctctgccaactccctcctcgccgcatcctcttcgatggagagccagacgaggccaacgggcgcgaggcgggagaggagatccggccgacgacgcggtgacggccgcgccccgctgctcccccgccggccgccgctcgtgcagctgctgcccctccacctgcgcccacccgcacgccgctccgccgtccgccgcccatggagaagagagagggagaggtgaagaggagaggagaagaagaggctgacacgtggggcccacggggtcccacgctgactcagccaccaacgaccgtggtcaaagcgcaacgtaggataaaaccgggacgaaaaccgctgagggatctcgggtgactggttttatatagttaagggacctcgtatatctggttttatggttcgaggacgttttcgtatctcgctgacaagttgagggacctttagtgtactttttccacctaattcatgtcctcgaattcgtctcaagaataaatatggcccatcaaggaattcagcccaccatataacttgacacagtttactcattaatacttcatccgttttaggttataaaatgtttcgactttattcaaagtcaaattgttttaagttttattaagtttgtagaaaaaagtagtaacattttcaacccaagacaaatttattataaaaatgtattcgattattgatttgatgaaactaatttattattataaatattactatatttatcaataaacttagtcaaacttgaatcagattgactttgtctaaagccaaaatgtcttataacctaaaatggagggagtaatttggaccgccagcaaacttggcccacttattcccatcaacaatttcagcccacctatgaattaggcccgcttgctgcttccgtccctacagcgctcgtcgctctgctgctgcagccggcctccgccccccgccgtgctcgtcgctttactactgcatccggccgctgcccctaccgcgttgctgctgtggccggactctgcccttgcctcgccggcctccgtccccgctcccggcgtggcacggttcagggatggaggctcgggactgactaagggagacctattcctaggtctaggggtcaaagcgacccctttcccatgtctcacgacggtagaggcatcgatggcaaggttggtggcggtgggcagaagtaggcggcgatggtgctcgtggtggcagcgctccagcgagtttaggcaggggcatgatggcttgggagttcgaggagatcacggaggagctcgatgtaatagtggttgggcacaaagatgcactgggggcaacgtgtcgtgcggtccacagtggctaagtagaacagcgacggtggtatagggatggaaactgaggggttttggtgtacttgggacatggattttattcttaccattaattttgaacaaggacggtttggtggggggtgaattttgaggtttggacactgacgagtcgagttaggattcggcttcctagctccaatgacggtgattggcgctgctgagagcagagcagcttcagggagcaaggagagcatgctgtggcgtttctgtttgttggtggtggcgaccgatgaggcagtcgggagagggagaacaacggtgaggacaagagagcggcaaaggagagctcacgtatgcgggcacgtttgtgaaaaaaaaaagatgggagaacaagaatgagttgattggtaggtcgtatattttttttttcacttacatggggtcttgtgtaaacacgttagcgagtcaactatggttaacctatcatattagtaaaaaccgctttctaaaccaccaaaaaagttaaaatgcactggttttcaaagttggaggatatgatttacacggtttgttttgctgttaaaagatgcgattcgaacaggggcaagagggaggcattatagattttagtccatttccctttagtatatttgatccacaactgaaattggccttgttaattcccgtcaactatttgggtctctaatgaatttggcctacctactgtccaatcaacgaaattgggcaactacggccacgaaagaatttaggaaaaagtacaccaaagatccctcaacttgttagccagatataaaatcgtcccccaaccataaaaccggacatctaacgtcccctaacttacaaaaccggtcacaatagatctcttggcgttttttgacctcggttttgtcccacatggcggctgactcaacgttgatctatgtgggccccacatgtcagatagaccacgtcaccaccaaggttgttaggatcgggatactaggcagtatcgttttgctcaaagtaatatcgtatcgtagaatcgtatcttagtatcgggatactatgagattttctttttttaagtttaattaatatttatattaattatatatagccattatctactactacttaaaaaataagaggtgcttctatcgtccgtcaaaaaaaccgagcgaaaaaaccaggtttgtccgataaaaaaactgggcaaaaaaaagtgcgaaaaaaagaaaagaaaaaccaaaactgtccaatccagaaaaaaaaagggcgaaaaagaaccgggccaaaaaaccaaagttgtccgatccaaaaggaatcgggcgaacaaaaacaaaccggacgaaaaaatgtgcgaaaaaaagaaaaatcaaaaaaaattccgattcctatggcaaggcggaaaaaaaatgtccgattcttatgaaaaaaagtggcgaaaaaaacacagtagatccgattcccttaaaagttggaaaaaaatcatattcctatattatcctatttcccgtacgggtgtttttttttcttcttttttttccgtttcttttccctttttttctttctttttctttcttttttttatttcttaatactatgtatgtatataaaatttatatacacgtatacaaactttatatattgtatattttttcttttttatacgtatgtatatgagctatgtatacttctctatctctactattaaaaaatttaaaacatttccttcgtccgtccctacttaaaaaattcatattaaaaaaggtctgtccgatttataagaaagtgggaaaaaaaggttcgtaaaaaataaaaaaacaaaggagaaaaaaagtacaaagggcgaaaaaaagcacggcaaaaaaaaagtccgatttctattcgtttttagtccctatatatctcttctctatctctaatctaatctaatctaactatttaaaaagaaaagttttcatagaacaactaaaaagaaaaaatgcgcgagaaaataaaaacggttaaaaaaagcatgagaaaaaaaaagcaaaaaaacgcgtgagaataaaagtcagaacagaaaagctaaaaaaggtttctgccgtctgtaaaaaataaaaaaacatgcgaggaaaaaactgttagaaaaagcacgccatttctaaaaaaatggtttgaaaaaacctcacataaaaaacaccgtttacaaaaaaaacaagcagctctgaaaaaactattagagaaaaaacgttaaattgatagacgcatgagtcggatagtatcaatcatttttttcatctcttaaacggcttttgtttcgtcatctatagaaattatattaaaaaacaaacatatttttaattattatttagagaagagtgcacatgtagcaaagtgattctattttgtgtagacttgattatacgaggcaatgtaggatttgattgatcctattattggttgcaagaatgagatcgaaaaagtattttagattatatgtatgttgtcgcgtgaataatccaattattttaggtaaagcaagcatcggtaaggttgtgatcgtttatgttgggccattacattaaagatgttccaattttcacccgttgcaacgcacgggtattttgctagtatattaaaaaatgtagtaatgatatatgtcatacaaatagagacatttatcaaaagaaaccacgttggtttgatatatttaactgatttttatataaatttgagcatatttattcacattattttcaaaccatgttttcttaaataatattttgtagtatcgtagggatcgtcgaatcgggataccacctaagatttcgtaggatcgtgtaggatcatgtagtaatgaatagtagaatcgagatactatgaaaattaggatactaggtgggatcggtatcgtttcggcttggtagcatcgtagtattgtaagatactaggatacgaatcgggatactgataagcttggtcaccaccctttctatttttcccctcttctctcccttcctctctcctttttcctctgggcgtggatggcggcagcgtcttcgacgcggcgtggaggagggccggcgtggccggcggctgacggggaaggagcagcgcggacaggagggccgatgggacgggcggcgccgccaatggctgccgtcgcgcgaggaggagcgcggcggtcgtcgtcggggtgaggcggcagaggaaggggagattgaagacgacggcgccgccgatgtggctgccgtttggtggggcggagcggcgggagaccggggcggcggagctagagccacacgtgcgacggctccctggtcaacttgcgcagccgcgaacaagtagagcctcgccttcaccgccgcctcgcgatgacgatggcgatgagttcgatctccggccgccgccccgccgcatgcatgagctagaggaggtgcccggcgagtttcggcagtgagtttcgtctgtgcttggaggggtggtggcgtgagtttcggcacttgcttgcgacggcgcgagcttctccttggcttggagctggcagcggaggtcgtgccacacatccatgctccactcgatccactaccagctgcatgcacaaagctaaccaaccgatagacttgctccactagctcatgcaacacatgcacgtactagcatagcacaaagccttagctaactaactaattaatcatgcatgcagcgttggcgatgccgtcgtgcgagcgcagcggccggcgaagcggaggcggcgtgcgagcgcggcggccggcgaagcggagtggagcggtggcggcaagcgggcgagcgcgcggcggccggcgaagcagagtggagcgaaggcggcctcgggtcacgctcccggcctccgccagcgttgtcgccacacgagccacgttctcgacgcacagtgcgaatccgcccgagccacttgaccagcgtcgtcgccacatcaccacggttcagaagccttagcacgcgaagctgaggagtctccagccgcgagatcgacgccatcttcctcctctccggctgctagtcctcgccgttgatttctctttccttggtgagctagaactcgattcctcgcgaatacaccttcctggggacattgctaagcccctggacatcttcttttagcagcgcatcgatcggagtgggccgccgccgtgaagctgacgccatccgccgtcgccaagccgatcccgaggtcgccgtcgtcgtccaagcttcaccaagtcacgagctatctcgactctcgagtaagcacctaagaacgccgaccctcttccccaccgcgtcagtgacgccgtcgccgccgcatcggccctcctctccgcatcggtgatgatggctgtagccgcgcgccgccaatgccgaccgcacgagggggacggggaggccggcgagctcgcgctgccctaagcccgcgcgccgccacccgggagctgccgtcgccagccacaccaccctctggccgcgcgcgccgccgcctgtgcgagagcagagagcgaaaggaaggagagaaacagagaaagagagagggtgctgacatggtctccatgacatgtggggcctacgtgggtcccacgctgagtcagccgccatgtgggataaaaccatggtcaaaatcgctgaaggaactattgtgatcggttttataagttgggggacgccggatatccggttttgtggttgggggacgattttgtatgtgggtaacaaattgagggaccttgcgtgtactttttccaagaatttttagcccagctctttcgtctacgaattcggcccatctatgtcctagtgtcccgtttcggtttcgggcctctacagatggacaatgggccatgcgaggtgtatggtccacaatggtccggaccacaggagccatgccaagcgaaatctctgcgtctaagacatacttcgtacttccttttgtcacgaaggaagaaattaattcatccgcatgtagcaaacactagggaactatacgaatgcatctaaccaatgagtattaacatgttggctcaggttttgatcaataatttaatttagcatcatacaacgataatccctttacataacatttaaaatatgcgtagtttattataaaatactaataaataaaatatgtatttttggattaagaagcatcaaaaccagataatagaaaatacaggcgcgaccacgatgccatgactcggaggttgcgaccgggtggtgccagaactcgccgagttcgcaccggacagatcgatgcacttcattgtcaataaggtccctacacgtgctttttgctttgaacatagcattatatgcctaatcaactaactatgttataaacttataattcttttttgcttttgcttttatctctaataatttctgttgcaacacacgagcctttagctagtccttaaataaaaggcaataaagaagtcacactaccaaaactttctaacgattttgttatatacatctcaacaaatttctcttaaaaatttatcaaatataaatataatattattatagtgtactttaatataattttgaactgttaaatttgttttaaaattcatattagcaaggaagaaaaaatcacaacatgcttacatgtgaggagattctattccgagaggtccgcttcgagaggtccgcttcgtggaaatagcatgttactgcgagatttaggaacattacatataagttgtatcgtagttacatgcaagttataatataattacactataattgtattatatttgcttctgtcaaatttttgtaattaaatttttttcaataaaatatatagaaagactcattttctaactgaaaagcacaacaaacacatgttataactagctagatttttaataatgtagtcattttaaaaaataatatacaaatagacccataaaacacatcttacatatggaccctacctcagcagtgatatgttggtgccgagatgggatatctcagggctaaatactccggcgctgagggtctgatggcgccagtgaattcagcgtcgatgaattcggtgccaacctctcccatctagacctgcaagtccaattaatttgctgtcaaatttttggaagaattgataataatatatcttaattcattatctctaatatatttttgtctataaaatcttgatatggaggagaatgtgcatcctttcctccttataactaaatcctattgatttgctgtgaaatcttggacaaaaacaaattacaatcatgtgccacaattcaatttccctatattttttcttcaaaatttgacacaatacaatacgggctaaaatgaattaggatacattgattttattggttagttttcttttcaaaatttgatagcaaatcagtagagtttgaagcaaaaggagttgttcttaggtgagcgtcaaaatgactggtgttgaggtatggtgtcggcgctagttgtttggtgccgagagatagatccatatctgaaataagttttttagtggtctgtttgtaaaatatgttttaaaaagtctaaaatgtcaaaaatccagttataactggatgtgaatctgtttcatagaaaaaaaaggatgtgaaattgtgaatcttgacagtaactaggaggcaggcaccaaactggcagatcagacttcagagagttaggctgtgctaaaccaagactggggtaggagttaactgtggaaaagaagaacaggaaaagattaaaagatacactaggggatcaggttaacactaacgtgacgtgtcttacttgaggaggagacagttggacacaacattttccctgcagtttcatctcaacaagcaagcactgccaagagctcaagaccaatggtgtcacgtccaaatcagccaatttttagcaagaaaaaggccggaatgactgtggaagcttacaagaaagtgctattgcacacgtcgcaggataagataaccatcactggaaaataggcaccaaaactgatcaaagttcagaggattattcatctgttccatgctgtctggttcctcataggaaaacaagatatgtctgatttgtttgtgtggtgggtaaagataccctggaatttaacctcaaccaagatctgaatggcctgagaattcagttgaaaaattgaccaaagcatgtgaagaatgaacattgtttggcaatcaatttagagtagaaacaatgtgcatgatttcatttgtcccttattttaaaatgtcacagaaatgtttaagcaaacaagtaaatagagattaatagggttgtttcagtaggctgatgcagaaattcacggtttggtattcacacttataaataaccgtttcatacaaaataaaattgttaaggataatacacatctagttgcaatactgacataaattcagtagaaataattcatattatagaaatctaaagaatttgagtacactacaaaatctatatccctattaaaaaaagtagtggtggtgacagttaatctgctaccccgcctactctcattgtaaattttataagttatccctaaacttcttaaaaaaaactagattgatatgtaaaaggatgggtaatgcattaatatattttttattagtagcaaatcacggacatttagctactaattaaagaagcctaatgttgagaaacaactggaatttttttttattcctgaaaatacccagagctccatggattccgcccctgggttgtttattgtgtgattcttttttctgtttgtcaaaacaaactccaattacacatggcaaaagagtgttaattctaaatcggtcactaaaacatcttacactgcattctttacttacatttaatcaacttctacggcatattttgcaatacgagttacattcaaaaatcatatcaatttatatattttaagttttttaactaatacaatcatacaataattcgtcgctccattatttgtgccatgaaaggggtttccaatcccccaaacaaacaccttagattgtaaattctcaacctcgccatttacttagcacagagtatatatcacgtagtaaacttaccgtaagattgtgtgactaggcacaggaaaaaaaagcaataaacgataatccatatcagttacatatcaccatcactaacaataaacttaaaaatcaaaactaatataaatcagaaagccattacacaatctctcctctctctcgcctctcgctctctccaaatctgtgcgcggttgtgtgcggtgatccggggtgtcccgaccgcgatcagggccgtcggcttcgggtcggacggacggatgccggtggacgtcggccgcgccgcggcccgcgaggcggcgatgccggcggcgtgcagctcgtcctcgattgggaaggacagcgacgagtgctcgccgccggggaaggaggaggaggaggggg

SEQ ID NO: 70634 - DNA, 23987 bp, Oryza sativa
  unsure (1)..(23987): unsure at all n locations
gtatgccaaaaaggactacacctggcgaagcacccgcagatcgatgcgccgaacgtgcaggtgatcaagctcatgcagagcttcaagtccaaggagtacgtcaggaagcccttctcctggcagtactactactggtacctcaccaacgatggcattgagcacctgcgcaactaccttaacctgccatctgagattgtgcctgccacactcaagaagtctgccaggccacctggccgcccatttggttctggcccacctggcgaccgcccaaggtatacatattctcgtgatgctcccttcaagtgcatgcaatttggcatatactataatgtgcttagtgaacatggggcctgtgtcaccatttcaccatgatcatataacacttatatttctacaaatgattcaaatgggaaggagaaaattatggctataaatgtctgatattattcctgtattagatttatcgttaagaatctagcttgtagcttttgagatgggagtagtgagattctgtgggcagagcagtggagctttttagcatgtcagcacgtttgttgcataaaattgtccttcaagaaatatgttgctctcattttggtagaggtgttgatcgttttcatctgaccacagggcttctgctttagggtgaagcttgtaattttctgtgcattgttcataatgttcttgctttaggctgcagcttttgcttgtacagtgctttctaagcttgtgtataaataagataggattagaatgataaatgtattcaagatgtgttgatgtggtttggtttaagttaatctgttcatagtctttcctgatttaatggaggctgattctatactgttgattctctttgcgatgtatgtaggggcccgcctcgctttgaaggggacaggccaaggtttggtgacagagatgggtaccgtggtggtcctcgtggtgctcctggtgactttggtggtgagaagggtggagctcctgctgagttccagccatcctttagggtaatcaactactttccctacaagtgtttcattattgttctgttgtgtcatgtagcttatttgacttgttacgctgaatacaagacaagcaaaatccatttttgtactgcctatgatgaatttatatttggatttaccatcaacttaaaagttctagcagaattacttgtcttttttactcgtagttgtatgctacatccgagatgcctatatatttgatgttgttcgttcatgtcttcttggcctgaaaaaacgaactattgcagttccacataatgtttgggtgggatttagcgaggttcatatttttttttgtgtaaaagttttgaacaaccttgtgattttgcttgtcgaaggccctgtgcactatgcataccctgtttgttttaaacaagattttgtatttcctgttctgatatttagctaatatattgatagttcagttgatttgatgacatcaatgattttggcttatatttaccaccataaaattttgcagagctctggtggcagacctggctttggccgtggtggtggcggaggctttggcgctggcccgacctcttcctcgatggagtgaacttcccgtagtttggatatgatgttttccttcgcatgaggcgtttaattttgaaggacagttaaattatgtagcagtgatgtttgcaggatcgaccgctgttgacatatgctaaaaatatgctatcttgataccttccagtataatagtttttgcgaacgcttaagttcaatgttaatgcttttgacatattggcggaaattatcttttgcttctgaaaaaaagaattatgtgcatgtttgattgctggctgcgtgaaatagtgatatgatatctgtatgcaagtttttgatggaagtacgtgtttttgatgtgctcattcatcggagcttgcatgtcttgcgtacaatgagtacaaacaaattcttgatcgattacaatgtagacccaaccaatcaggtatccaaaactcttgcgaatgtttgatgtacaatgtaaagcgggatctaatctgtttctgggaggcagatgcaatctatgtacagcaaaatttgnggggaaaggatgcggtggtgatgcttggtgtttctgccatgttctctcaaaggctcaagagtagagcagccagcgtagatggcaccagtatgatgagctgctgccattgcaacgtcgccgtcggcggccgcagcaacgccgtggcgcccgatgtcgcgttaaagatgcctttgggcgtgccgccgtgccgagcggtcgtgcatgtaccattgccctgcacaagcaaacacgtttcaatcttttttttcaagtcagatttgaattatgatcattagtttagcaatgtgcagtgctggaattcaatcttgcattgcaacagaaatcttaacgaggtttctgcagcgaggcattacactgcaagcagagacgctcccacacccacagaccagtccgccgttggccctgtccgtggcttcagccgcaccacctcgatcacttctctgcattgttttcgcaaacaagtccagaattcaaagcctcttttaaaactagcacaagcagtttctaatccatattcatgatgcagtatcagaccttgtagaaatcgacggcgatgaaattggcccatctgtccgcggacaggtcatggcaggtggtgagcatgtcgagcagctccgccgagttgtccttgcaggccaccgggaaattcggtaggtccctgaagtagttcaccagcaccagcgacctcgagaggtcgttcatggcggccgactccgcgcggttcgggcacctccccttgatcatccccttcgtcccatctgcacccacacgcacacgcacacgcacaccatcgtcaaaggaaaacccaaaccgcaaaatcctccacgatcaaagtcacgtgactttatcagtgacacgtgggtcaatgagatcctgactccacgtgtcaatgacaaaatcattgtgacttcaaagtcaaaaaaaacatgatctcattggtgttacttaggatcagtttgacacagttacagctccacatctcctgaagctggagctcggtcaaatggtttcagcttcatctaaaataggagtggggctaagtagagtactctcataaaatagagaggtggagttgggtttacgaagcttcacaactctagtccatacctaacttctgaagctaaatttagaagtggaagatgtacgcccttacactggttttcgacgacgtagtgccactcgtaggggatgccctctgcggcctccttggcggacttggaggtgaagaggaggaggcggtggttgtcgcggaccatgtcgctgagccgcggccagtcgccgccgctcttgggcatccgccacgccgggaacacgtactttgtcaggccggaggcgttgaggacgcgggtgagccccatgggcgactccacgtagtcctccacgaacaccgtcaccacctccgacgggttccgtgccaagaaccgctcgatctcgcccagcacctccaccgccggcacctgctcgaattaaaacacattgatcagatcaaaagctctcgtgttcgtcagattcatcgggaattcagaggcgattgtacacgtaatcatgtgtgccttacgaatgcggtgaagttctggcaggcgccgccgaaggagtggcagagccagatgtcgttgcggaagtcgtacatgtccagcatcagtcctcgcacgccgttctgcacgcgtgacgtgttgatgaatagcgagaaaggcagaaagctttggcatgttaatctcatcgatttgatcgttgtttgacatgtgtaaattcagtgtaatcttgaatactctccctgatgtttgtgacggatcacggaatcaatgatgggttgattaaaatccgggtttaagtggctgtcagtgacagagggcgattgaaattgaaagtgggagagagacgggacgggcacgggacgggacggaacggcaagaatggaatggacgtgccacccgaccgtatccccctgcgccacaagggtacaaatcacgggggcacacgacgcgacgatgggaaattcggcaaggtggacagccatggaagaactgaccagcaatctgcgttggcgccacacacgcgggcgaacggcgaacctcccgtgtcgtcttccgtgcccccacgtacacgccccggtgcctttcacgcaagcggagacggcgccgcagcgtgcgcgcgcgcgcgaggccgtgcacgcgaacgcgccagggtgcgacatgggggttgtggcgcgccggactgacacctgttgcgtccgggggacacctgcccctgctgttgtggttgtggggtctaattattgggtttgtgtggggcccgcgcatccgacgtggcgcgcggcgtgtcaggaacgaacggccggaaacgaggacgacggcgaggaggattgggaagtgcgaacgaaaggaaaggacttacgttgagctggtcggtgatggtgtcctgctggttccaggccgtggcgatggccgtccccgtccgcgaccgcgtgccgagccgcgcgaacgagttgtgcgtcgtcaccacgcgtaccggttgaacggcaggtcccgcgcctgcacagcacacaaaccgccggaatttggatgcggtcagtcagcgccgccgcgcactcggagaggaagaaaccaaaccgcgacgtcaattacctaccttggtctgcgggtcgacgggggtgactgcgggtgcagncgcgggcggacgttgccgtcggccacgcacgtctcgcagtgcagcccggcgtcgcagttccggtccgccgcgcacgtctcccccacctgcaacgtacgcacacgtacaccctccattttaacccaccaattcccccctccaactaattaaacagcgcgcgtaccgcgtacgtaccttccgtgccgacacgaccagcagcagcgcggcggccgcgacggcgaacaggaggaccctcacacccggcgccggcgcctcctgccacttcgcagccatctcctcctcacccctctccctctgcgcgctctctgctcttgatgcgtatgatgcgcggttggtgctctcccagtgctgtagacgtcaagcaacggggcagcagccgcagcaagcagaatcaaggcaagtggcggaatatttgcccccctgtctctcaaggtattggatggccttgtcgttgtgttgtgtgtggctttgtatcgtaaatcgtaattcgtgggcggcgtcgccgtcacctgcttacgtacgcggcaatgcgggcgttcactcacgcacgcacacgcgccccccatccgcttcgtctttccgcctcgcgcaccttgtgacatggtgcgcgtttgaggaggaagagtgaggggggaccggtggtggtggtacggacgtcgaggcagagcagtgaccgtttcggtggtccggccggcctctgtcgtaggagctaacacggtttgaatttggcaaaaactgctggagaccacggcttgatttttttttgccattttctcgcgtgatgacacgttctttaaacaaaaataatttggctataattatgagccgtattaatataatgtggagagtttcatcggctaactaacgacgagttcagacagatcattcttggtggaataggtgatggagagagagaaatggtgccaatatacatgcacgcatctcgccgatgacaaaagacgacttctgtatgtactactggtagtatatgtatagtctttatctcgcagctgccaaaggcttgatctggtatatccgttatctgttgcaattcaaacgacatgtttccgacttaatttcagtagaccacttctgaatcccaacttttctgtgtccggaattgtccattcagaactgaacctgaacatgaagaaagacgtttgcgatacctgtctggttctagccttgtccacaaccgaaagaaaaagcctcgatcgtcagattctctctttcatgttcctgcaaaatatgcacaacaggtaccacactgaaattatgatgtgcctacacagggacaaaacacactcatactggcagagtcttgaaatatgtacacgaattgtctagtatttgaaacatgtggccatctcagccactcgagtggattatatttgtaggacgcagtgtacttaatctcccattcatcattcaaggagtcaattacggaattccttcagagacatagtcaattatcatacatatcaggaagttagttgctggctgatagctagaataatcattaatcatcaatctaatgaccaagtacatgcatcatgcatccacatcacaaacttctctttaaaaaaaaaagaagcatacatacaaacatgaaacatgcttgcggtggttagtccacttgggcgtagactaaaaacggtgttcatttttgcgtcagttatatgactatcttccaaatatacattgaccgtctgaatgtgcacacatgggtattagtgggtttggtactagttgttactcaagacaagctttaatactcaacacgttttagcaaaacacgcattttgtcaagtgaagactgaagatgatgaaggatgaagcaagcagaggttgaagaagccttaaaggcctaacaaaagcccagctttacatgatgaaagcccacataaaagagcatacaaaaatgtcaacttgtgggcttaccagctttacatagagacagcactggaggacctctggtgcaagttgcgtttggcaaaatgagagaaagctccagcctccagctagtagagaaatatactttggagtttggacaataccttgtggtgtggcgagagaaaagctggggagctcttcagagaggaaacagacatgtctctgcttgtgtggcacaacttttgaagttctctttctcggcatggcctttttgggggtatggtagcttatggcgaagctgcgtttgcccgtgagaaacttcccaggtagaaaacaacaatggcgccaggacaagtatagatgctagcaagtgatactgtctgcatgctgtttgctatacattattgtactaggattagacaagaagatgttagagtagagtggtcaaacaccaggcatactagtatcactgcgtgcattgacatgcatgtatgaatggatgtacctgtgctgccggtcctgtgaaacagaacaactgcagtcatctgtttgtgctacatgagccatgagtgttcacctaggattccccttaaactttgcagcagtaatgatgcaggagagctgatcagtgaccagttttcctgacatgtttttagtccgattaggttacgattgatgagtacttcctccccaagtccccatctcattttaaatctagccacgagtttctgtgtccaacaatagaacggagggagcacatggtaaatgtgtggtgttctttccctgtgtcagttcaacacccccctcctcccctccccccccccaaaaaaaaaccaaacaaaatttttcaaaaaaattatttttcttttgaactcgtctgaagattggtgcacaccctccgttccatttcatattacaagtcattttaattttttcttagtttattaaaaaatggtatatatctacaacaccaaattagttccattaaagttaacctataatatatttcaataatatgtttgttttatatgcttttctataaatttaatcaagcttaaaaaataactagaaaaatatgtctaaacgacttctaatatataatcagggtgtaacggttaccatgccatacgccgagcaggagccaggaggagcatatctgaccgaagcggagcagccaaagaaaaaccaacgcagagcaagagagctgcactgccgcgtacagtacgctgcagccagccagccaagccagccgcggcctgggcctcggagacggcgccgtgcgcgcgcgtcggcgtcgctccccgtattttgttcacttgttgtttggtcgcgcttgtccggtccacgccatctggcacattggcatgtgccaccctcaccctcacggcctcacccaccctatccgtggggcgtcgcgtcgcgcctccccttcgccctcgccctcgcggttctcgcgtacgcccgcgccacggccacgggagggaaaaccacccgtgagccggtgtgacgcagccgcgcgcgaggcgcgacgcgagtgtgcgtgaccccgacccggccgcgcgacgcgaggcgagggaaaagacaggagagaaaaggcgccgcgccgcgagagcccccgcgacccgcaaagcggaaaagcgcagcgcgcgcgcgcgcggcgagacatatcggcgtatcgcgttggcgtcgcggtgcagcgcagcggaggcgttggctttggcagtttggctaggctggcacccttcccgttcgtccaaattcctctcgccctccccgacaaaccaccctttttccaccaagcactccaagcatcccactccactctccgctccgccacctccttgcgctgctctcgctggtacggaggaggatgcggcgcaggctcctcgcgctgctgctggtggtggcggcgctcccgctgctcccggcggcgatcgcggcaggtgagctcttttgtactactttttaatggcggggctcctcctcttcttcccttcaccgtgtcacaggttcccttctctgggtcgccgccgccgccggaatcccgctgctggctcctctctctcatcgagcgatgatctccgcgactggagcggccttggctggtcgccgcggcggagctgttgcgacttgcgcaagtagcgccagcagccgcgcacgtcgctcgagaagcgatttttttttatatcttattttaattattattcaggcgtcgattccgcttctagtttcaaccattccccgcgatttttcgtcaccattctactccgattactgcattgtagaaccacatttttgtcatgcgagagttgattaattagagctttttttttttttggggggggggggaggggctgatttcaccggtggttattatccctcgccggagagcaatccctaaccacaaaatggcacgaacagcatgcatcgtcttcctgcttcctgcagcgttcgtcagccgatgccggtaaaggggactgtactactcgcaatgggggttgacgggttgtcacgccattgaattcccctcacctaatggggctcactcactcactgatgaacactgtacaatcagagtgtgggtggtggtggtggcttggctttgcatttcgttcgtgttccagggctcctccccacgctcgccgtaccatttggatttagctggccggtgaggaaggtcccgggtcctggcaatttggtagtgttattggatcacttattagatcggcttgatcgtgcagtcttacctgatgttcccttccgcatcacatgggttgttcttgacttcttgtgttgtgtgtgccgtgctaggctactggtgtacggtacggtgtagcagaatcggttgggttaatgaagtttttgatacactctccccccttgtatggaagtacaagtacgccacattctgctggtagttcttattaaatgtggggggtaaatggagatttgggaattgatggcaagtgatcaaatggaaggataatgtgctagtactggtcatgtgatctggtcctggcggtactgatttcatttcctgttaataagtaatgatcatgattgatggcgtagatagctagcattggctacctgcagagcattacatgttttgcacttcctgtgtaatattactggttttagtagatatgcagcagagtgatgaggctgaccttcagatgctattcaatttacgccaatagatgggtaatgtgctagtgctagtactggtcacgtggtccgttcgtggtggtaccgatttcattttttgctatacatatgatcgtgattgatggcattggtatagatttcgagcattggctatctgcattgcattacacattttgctgtttctgttaatgttcccgattttagtaaatatatatacagaatggtggggctgcatgttaactttgtggtatgtgttgtatactattgcatgatctttataatttctttgttgacatgcagagtgtccgttggatttgagttggccaaactatgaactgatggcttctgtatgctcggatgaaaatggacactcaaaatgttgccgttacatcaatgctattattgcggtctcgtctgccatgtatgcaaatacgacaggcattcttggggtcccagccgaaatttctgatgcttgcattggcaacatctctgacacattggtatcaaagggaattctgcctaccgccgcttcattttgtggccttgggatcaaaattcaagtttcctatcaatgtattgggatgactaccgtcctccagatgttacagtctccgaatttcagtgatgtcactaggagctgtgcaactctactttcagatgatgtcagttgcaagaggtgcttaaactctggtctgtcatacctccgccatcttgtgggagaacaagataatgtcacattgaatacctgccgtgatgctgcctttgttgcatttgcgagtcaagggaatatatctaccgttgatacggcgagttgcttttttagcgtccaggggcttagtgctcttcaaggtttgaattctgtacacaaattattttttatttgatgaccttgttaatacaaacaatatctttttctttaatagagagcttcacttcccatgttgactattcgtatctgttatagccttataggatataacctttttgacaatttgtagaggcaaaagcatttttcttctattatgtttctagtgcattccattgttccacgtgatctccagctcatgtgttctgttgacattgcttcggatcctgaggagcaatagtaataatgatatgccatttgacaacttgtagaagcatgggattttttttgtttcattagggctaatgaattacataagctccacatgatctccacaattgttctttgaaaagcttcatacatgcagcattgctgtgcatgtccatgctctcctaatatatgcaataataggtatattaatcagcacatgctactaaaattttcatttattagaatcaaccatcagcagaagctataatttcatatccttattgatgataatatgtgtggcgaaaatcttgtcatattaatgttaaatcttgtatttgttggtaagatgatacattccacctaaaatatgatatgttatcttctgttatcagttttttcatttacaatacaacataatatgtttgtgtagaaataagttaggtcattaggtctagtagaagtgaagtggaccatttgcttgttattcttcgattcatctttctcaaggtttgagtccacaatgttttaataagtgatgtatctatgatgcagtgaatatctccgtgccatccccagctggactaattgcaccgaatattgctcccagtccacttgcaatgcaaattcctggggagcatgttactggagtgctatccaagcatcatcgtagttacaagcttgcactattccctgcaattggggctttggttacaggattagcagttatactaatgatagtattgattttactcatccgtaaaaagagtagagaattagagaagattgaaggaactaaccctcttgatgcgtggagttcctgtttgaagaagggccaagaaggtaatcatttcatgagctatagctgtactgacattcatacatgaatatttattcatttattatatggctggatggtttctgtgtgttcatgatgctatattgcacaccaggtctgttattttagggctaacttcacatgaaatttcttaaagcgtaatggctttgcattcctattctcctgtggctgtggatatgtgcaatagcagtaaaactgatttattagtgtggggtttacaacttaggaattcatatggttaatttgaatttgatgaactaacatttgacaacttgcattacaactagaatcagttctaagacccatccaatttatctgcttaacatgatattttttcaggttcttccaccattttcgacagatttacttacagacaaatgaagaaggcaacaagaaactttggcactgtgttgggaggaggtgaaaagggcacaatattcaaagggaaactgagtgatggttctgtggttgctataagacgcatagaaagctcgccaaaacaaggtcagctggaattttgcaaagaaatggaacttcttgggcggctgcaccatcgtcatcttgttggacttaaaggcttttgtctaacaagatttgagaggtagagtatgttatacatatttttgggtatctagaaatccatggttctttacagtttcttattatccaggttccaggtgtatgaatacatggaaaatggaagccttaaggatcaccttcattgtaatattttattttcactcccaatcgttagtctcacactgcataatctggtgaattgtgtgcataaaagcaattttctctttgcagcgtcaggtaaacgtcttctaccatggaaaaacaggatccaaattgccattgatgttgcaaatgctttggtaagtcctggaatctggattctgtattagctcaagtagtacatatttcgtagactttttttttgtaccaaagcaacaattgaatacttggtgttaggcctattaacctgctaaaaacttgtttcgcaaaagaaaacctgcttaaaacacttacgttacttaagtacgttatttaaatgctgacgaataactgctacaaccaaatattttgctcgcaggagtaccttcatttttattgtgatcctccattgtgccatggggacataaagcctagcaatgtcctattggacagaaactatcttgccaaggtacttgacgtgaaactttcctacagtgagaacaattaatccctactctgctggcagcagatacttgtttttgaattaacagggctgatcaagatactaatggctggttcattttccatagcttgccgtttctggtcttgtacaatgctcaaatggtgatagtaccaccatcagttccaccctagtgaacgtgaagatcccggcaactcctggtaagtccaacatctgcctttttggtgtattcttcacctttgtcagcatcatttccaacaaatcaaacacacaatacatgtttgacatgacaatggttcaatttgaaaacacactttcatcaaaagtagtggagcatgaacttaaagttggataaaattttggatactcgtggcacgcttttcaaactgctaaacggtatgttttgtatgctctaaagtatcaaattaatatatttttcaagtttgttataattaaaacccaatcaataatatattaatatcatttcgtattacgtaaaacacttaatcttcgtcttcgaaaaaaaagaagaccaccttagaagcgatttgaaatttgatagcaatagttttgtgtggtgcaggctacgtggacccttgctacgtggtgaaccaggtggtgacgccgaagagcgacgtgtacagctacggcgtgctgctgctggagctggtgacggggaagcccgtggcgcagggcgacgacgatggcaacggcgacagcagcagcaggagcagcagcaagaacctcgtggaatggtcgcgcgagctgatcggcacggactaccggctgcacgagctggtcgacccggcggtggccgacgcgttcgacctggacgagctgcaggtgatggccgatgtgatccactggtgcacccaccgggacggcgccgcgcggccgtcgatgaagcaggtgctccgcatcctgtacgagcgcctggacccgctctccggcggcctcgcccgcgccgtcgccggcgaggaagggtactactacggcggctggcagagcgggcggaaggggaaggagggcgcggagatgctggccggcggcggcggcgacggtggtcggtgcctgccgtcgtcgtcgagcacgtccaggtcgtactgcagccgcagcgtgctgcttgagtgcaactcgccggaggaggcgccgccccagtcgtcgccgcgcggcttgccgtgacaccgtgacacgccatctttttgtcggttgcatcgacagattttgcaggacacaacgtacagtgaacagtcgaaacactgactgaactgaaagagagattttttttttcgtttttttttttttggtgagagtgagtgatgcagctgtggctgtccagcgagggaatgcacacagcacacacagggatccaccgatccagacattcagtgagatgatgaaactgatgaggcaggggggggcccaggtggcggagtgaaagaaggccgggcacgcgtgatgaagagggcgatgtttgttcagttccctagatggagttggtggttgttccaccttcattgttcagtcagcattgaagagcgtactacgtcgggaacatgggccattcaattcgtgcatggaggatggatcccttcacttgccttccctagctgcagcctgcagcagctagcagctcgagtggtacgcccatctcgcgcgcgggtggtccatccaccggtggcgcgcggcgccgacgccgacgccgacgccgtgggcgcgcgcgctgcgctgcgctcggagtggcattggcacagcacgcaggaggcagggcaggccagatcgatcccaccacggccgcgtgcgacagtagcagcagccgtgccatgggcagggtaacgtgacgcccagtgacaatcaccgtcaaaaacagggcagggggcagcaagccgacggccggcataggcagtttgctgaccgtgactgcagaggcgtacctggaggctggaggagccaactgatgatggtactaaggtggtgtttggttggagggactaaagtggggttaaactttagtccctctcaggacttatgtttttatgagagggactaaatttagtccctagtttccaaacaccccctaaagagactgggtttttatttttatttgttcgatcgcgtttgtgtgaatgtgtgatcagatcgaactttaaaaggaaaaaaaaaaggagctcccgtttgccggtgatgtgtcaatgtcgcgtgactcgattacaggagttgaaaaatagaagctttacgggaagcgaaaaatgtgtgtgtgtgtggggggggggggggggggttgaatcagtcatgaacttgtgtctttcatactagtcgtattttttggccaaagcggccctgccatttgtttagctgatgcggcctcgataaggaggagggtttgaacacggtcatttgttttagggatcggggcggtgttctcgcatcggtagccaccagccagggcttccaagtcaatgctgctgtcacggctcacgatggattcattccatgggtttcgatcaatttcttttcatgcgatttgcacgcatcaggcatcaacccaatcacctgctcctcctttaaaaaaaattatataatcaacttctactatgggcccgtttagctccctaaattttttttccaaaaacatcacatcgaatctttagatatatgcatgaagcattaaatatagataaaaagaaaaactaattacacagttatgggggaaatcgcgagacgaatcttttaaacataattagagcacccgcaatggtaaagtaagttgctctctataacacacgtacatctcaacaatagactagattaatagtaaacctccttaatagtatgtctacatgggtatctatagctctctaatccattgcctcgtttttctctatagactatctccaggttagtagatagttttgctctctctcttcatttaatatcttccaagtaggaaaatatgctgacatggatctcttgtagagagcatatagataaccattgcaggtgcccttagtccatgattagccataagtgctacagtaacccacatgtactaatgacggcttaattagtctcaaaagattcgtctcacggtttccaggcaagttctgaaattagttttttcattcgtgtccgaaaaccccttccgacatccggtcaaacgtctgatatgacaactaaaaattttcttttccccaattaaacacaccctatgtttcatgcaacctcatcagcccaagtatgttttgtctgtcaatttaaagagaatcatatttaaattcatagcaagaaattgtttttcctaaaaacgtagggtgtaaactacctgtatcgtttcgtttgtcttgagttgtaaaaggtgcaacagcagcaagcagcaggagggacactagtactacggctgctgctttgtagtaacaatagtacactattaaaccattacccgcagtatactgagtactgacacggttatttgcatcaatcaactgtgacctcggttctcattaagcaacgagcaagttggcgcaaggagacaagcagaggaatgggcacatcagataggataatcgagtagatagatcattaataaagaatcaatcaggagcgtttaagggttccaaatccgggagcattcttaattagagcaagttcagtagtatagcaaaatactagctccaatttatctataactaatctaatagctcattaatacaatagttatatactacactattaatacctggtctcatctgttatacacacattgtatcttgaagtccgtgctacagttggctacaaatctgcagtccgttgttcttctctctcctaagagcgagtttaatagtatagccaactactagatccaattcatctatagccaatctaacagctcatctatataatagttacatagtacactattgatacctggtcccacctgtcatacacacactgtgtcttgaagtccgtgctacagctggctacaaatatgtagcccgctgctcttctctctccttatttttctctttaaaatatgtttgcagctggcttatagcctgctattgtatatgctcttatttatctttttaaaatatgtttgcaactggtttatagcctgctattgtacctgctattgtggcaacagctgaaggcatggaccgtaaacaattgcagtaagcaacctgcacatgggcagggattaggcgttgcccattctccggtttcacgtctcacacgccactgttgccattttcacttgctagcagcctagcactactatacttgagtctgaactatcttcatttgcttcactgctagtactacggttctaccggagatgcatcaaataacattgatgtatcatgaccattgatatatgatcctactcttgagcaggacaacaaaactgagatccacagtttccctttgaactattctcttgtgaaattcttgcgctccaaaccgggcaacaaatttaattcttcttcgaaagtaatattaatgctaattatcatctacgatatcttactactccccctgtccaaaaatataaatatttttaatacagtgctaagtcaaactttttaaattttgactattaatagcaaaaaattaaaaaagattaatcgtgtaaatttggtgttactatatttatcattaaacgaactatcataatatacaactttttgtatttaatacattttccttttgtaaatattgttggtcaaaatagtatctcggagaccatgtccaagtccaaaaatgcttatattttgcgacggagggagtataatgatatttggatggaaagaaagcgcttcgtaggtagcaaattactctccccgattagaaatatttgatgtgtagtgcaagattcgttcgtacttgtaaaagtttaaaacttttaaaaggttcagacaatattcggttaaaaatattcaaaccctgcaaagtttaaaacatttaaaagattcggacaagacttaagattttaaaaaggtttaatcaaatcttgtcctaagcgtctcaagtaccaaattacgcgaacacatgcagagcttaagtaccaaattacgcgaacacatgcagagttggtttcggtacaacattgaccgaaaatcattggtttaaccagtctttgataaattggtgggagcggttttttttataagaaaatggaaaaaagctactttccttcctccgttccagaatgtaagagtttctagcattacctgaattcacaaaaatataaataaatctagactcatatagaaaatctatacattgattaatgcataaatctagtagaaaaggaacggagggagtattgcacgtaccggcaatttttctttcagaaaacctacaccacggcatcccgtggagacgggatcccctcctcctacctcactcctctcccccaaatcatctggatcccctcctcctacctcactctcctcccccaaatcagacggcactgtagcctgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagtcacttgaagcatgtgtggtggagagaagaggggaaacacgcgcgcgctcgctcgcctcgcctggctgggcaggcggcgcgcgtgcacgacgtacgcgtcgaatggtccgaaaaattggctcctcacccttgtgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtacagatcgtgcgggcgccctgatcaagcgacccttctctatataaaccgacctgccgtcttcacgcaacacacgtgaaatcaatctagggtttgcctcctactctgtactgcgccgtcgctcgtagactactccatcccgctcgccggcgtgcaccggcgatcgggagagcaggtctccggaacctctgccttcgacgtcctgcaccgggagaaggcggcaataaggtttttgggaagcgcttcgcgcgactgctccctgttcgttcgtgacggctcgccttcctcttcgctcgcgtgtttcgtgccttcgtagacacctgcgaaaagtttcgaccaagtagccggtctttccgtcacctcggtacgtgttcaatatgttgcgcatatttgatctgttcatgttatactgtgtagtttacatgtgtagatttaatgatgcgttcatgctagttttcatctgtaatgtcatgatttatttatggaatagattaaatcattatatgtctataatctcaacatagccctccctgtcgtcgtcacccaccgctcgccggagccagcgaccaccgccgcggggaggcggcgatggcaaggagctcggcggcgggcgcggtgagtgagaaggagagcggaaacggggagcggtggagccgaaacggggtgcggctgcggcgacatccctccatggccaacagcaagtggatctgctacaacgtcgatgatgaaggcttccatggccggcggcaggggtgcgccgagcacgtcgtcgtccacagctggctgaggaggcatggtacaaggtaggcaccagatctgttgcctcctcatcctccaccgctgtccccaggcgacgagctcgccccgctgctcgacctccctgactccgcgactgctcctccttcctcctctctcctagggtatcacgctggtacccaggtttgatatctaggtacaagctcgatacccagataccaggtaccaggtattagccggtactagggtaccagggtaacaggtattagcctggtaaccaaggtgccaggtattagccgatactagagtatcaggtaccaggtaccagccggtacctaaggtaccaggtaccaagtattagccgatactagggtatcaggtaccaggtaccagctggtatctaaggtaccaggtaacagccggtaaccaaggtactagcagggtttcctttacaggcttaccacggggtacggtaatataaataccgcggtaacctccttaaattcaaataaatttaaaaaataatttaaatttttgataaattttgtacggttttgtacggtttttcacggttcccgcggttaccgcgcggtaaccgtgcttaccaccgcggtaaccgtgcttaccgccggggcgcggtaaccccggccccggtggtttgagaaaccgtgggtactagttattaaaattcttccgttgcaacggaatcccgttgtgtaggagttccctttttctttttccaaacggaaccgtttgccctgaaaattttccgcgtttcggcaagggaggacactgcccccagctgcaggggctccgcgtcgcgtcggtagtcagccacagacagccaagcctaccaaacccccacacgcaggtcgtcgtcgtctccacgcccgcacgcctcccctccaaaaacccacaggatccgagctaaagctaagcttagctaccacacagtggtggccgcgcactcctcctcctcctcgcactgcacacgccaacgggttacaagaacgagttggcacgcgagagccctgcagggaggaggaaggatgcacctgcacgcgaagacggactcggaggtgacgtcgagcatggcggcgtcgtcgccgccgcgggcggcctactacgtgcagtcgccgagccacgacgacggggagaacaagacggcggcgtcgtccttccactcctcccccgcggcgtcgccgccgcgctccctcggcaaccactcccgcgagtcctcctcctcccgcttctccgccgccaagtccggctcctcccgccgcaccgccgccgccgggggagacggcggcaaaggcggtgtcgcggctggccgcggcggcggaggtggtggtggtggtgggcggcgtagcccgtggatgaaggaggcggccatcgaggaggaaggcctgctgatggaggacgacgacgccgacggcggcggcggcggcggcggcgggttctcctccctcccgaggcggtggcgctatgcgctgggcttcgtcggcgccttcttcgcgctcttcttcttcttcgcgctcatcctctggggcgccagccacaaccagaagcccgtcgtctccatcaacgtaatgatatgcaaagctcgatcgatcgccattgaaatgcttgcaagaatcaaaccgatttttctctaacttgagagggtgatttgtttcgcatgcagagcatcacgttccacaacttcgtgatccaggcggggacggacgcgtcgctggtgccgacggagctgtcgacggtgaacgcgacggtgaggatgacgttccggaacacggggagcttcttcggcgtgcacgtcacggcggagcccctcacgctctactactaccagctcctcatggcctccggcaacgtaagccgcctctcaaaaccccatcttttagcttgcacccatcgattttgatctcttctgttcaatacagtagactagtttcttcttcacactgcatccgtagtcctagtaaaaagacactttttttaaacaatataaatcttaattagctgatgttttaagctgcaaagcagagctgtggcaaatattatggttatggccgagtttagttccaaactttttctaaaactttcaacttttccatcacatcaaaattttcctatacataaacttccaattttttcgtcacatcgttttaatttcaaccaaacttctaatttttgcatgaactaaacacaccctacgaatcttagctgctaagtttcagaagatgtgtgaaaatattcatgctaagtagatgccgggaggggataaaacctcagcattttgcagtaaaccatcctggtaggctgatactcttgttaaaagcgctatataatttatcacatgaaaaagaaaaatctcgatctcttgttcgtatttgtgaacaatggactacagctgcacattgaccaaaccaaactgtagcagttgtgataatgcctacacggcagcaccatggatgtagactagtactacttcacactgttgaaactagttcaacacattcagagaatctctgaaactctcaacatcatcttcaaacactagctgtcatccattcagtcaagttgcagcatcacacactccaaatttttcactaccttcattaattccaattaagaaaagagagagacaaaaaaaattgtcattgtggtccatccatccaaaactgatctgaaagtctgaaactttcttggcaaaaaacaccgagtgactgacaaaactgaaacattctcactcaggtgaagtacttctaccagtcgaggaagagctcgcggcacgtggcggtggcggtggtcggcgacaaggtgccgctgtacggcggcgggtcggggctgagcagcacgccggtgaagggcgcgccgccggcgccggtgccgctgcagctggcggtgcggttcaggtcgcgggcgttcgtgctgggcaagctggtgaagcccaagttcctgaccaacgtgcagtgcagcgtcaggctcgacgtcgccaagctcggcaagcccgtctccctcaacaaggcttgcagcctcgtctaatctaagctgcaatgccggcgagctagctgctcatcactgcgtcatcttcgaaatatcgtcttcttttttttcttcttcttgtttctttcttgtctgatatttacagtatattgtcactgcatactttgcgagttggttagtttggaaggagggtgaggagatcgatcaggttgtgtgtacagggaaattttgtcgcgaacattttgagatatcgaattttgggtggataataataattaatcacgccgttgccgttctttctttgttgctgagtttctccgaaatgttgtagcgtcaggtttttgtgaattgtgtgatgtgatgtgatgttcagacattcagttgtcacctgaaaatcttcttggaagtggtgggtgccgtgtagcccggcgttgcttccatttctgacgctctttgcctgttctgatcttctgttccagcacgacagcggccagatccagtacttaggccctgtttagatgggactaaaacttttgagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatgtaaacaccaccttacttcctcccaaaataagtgcctcccaaaataagtgcagctatagttttccgtaccaaactttaatcattcgtcttatttgaaaattttttgaaaaaaaataaaaacataagtcacaaataaagtactattcatgttttatcatctcgtaacaataaaaatgctaattataaaaaaatttcaaataagtcgaacgattaaaattgagcgcggaaactaatggccgcacttattttgggacggaggtagtagaaaacttcccggatgatgaacgtttccatgttcagatttctgacgagatgaacgtttttgcaggctgctgctgatctgtgagctggcaatgctcgattgttgattcagattagatcatcagcttcaggtgctttgcaactgattactgctactgctactgtactttttactgccagatcttaataatcttatcgcggtgatcaacaagacagaatcttgttgacatcgagtagagccgttccactgtttccgtgcagatcgacgatcgagaatgggggta

SEQ ID NO: 70635 - DNA, 3255 bp, Oryza sativa
cagaaggaatgtgcctgatacaactcttgtgtgaacctggacagcaatagctatctaaaagagaaatatgcttctacttttatggagcactcttgtatgtatctatccctggagggataagaaaagagctgttaatttcacccggcactgctttgtttcaatgtaaacaatccttttgacctctggatatcggtagttcatctaatctcatgatgttgaagtatccatatctacgtagtactacttaaaatgttagcagtgatcgtattcgttctacgatatcaccctatctcaatatttggatcccacaatttatactactacatatttacatcatcctccaacaagttcttttccgtttcagtgttggttatcacctaaatttcaaaatcacctacttgttcaatataaaaataataattacatgtgattgacttaatatgttagaaactcaattagctttccgctgcaacatatgggctctcggctagtgtagcagtagtgtttatttgatgccagaccgccagtgtttatttgtggttgaggtataggattcaaccaaggacaagagccgagggaggcaaaatagacttatccttctttctataaagtgaagaccaaaagctcaaacctcgtgcttccactcatcatcaaattgtgaaccgtttgatgaatgcattagatcgtttctcagacgttggatggaatgcagcatagagcccaactcattagttaccgagtgagtctcttcgcctcctcagtgccaaatatagcccacatgaacacattggcccatctccatacacatctacatgtatttagcctgtcaatccgtataaaagagctttatggctaaacgccccttcagttaacatgtgctacctaaattatctacaaattttagatagggctgctaaaaagaatttctccaagaaatctatttgttttttcttgagattgtacctcctatctaacaaatcgatgttaaccaaatccagcagcaacacgcggggcatcctctagttactagaacaattttgctatatatttgttgataaattttctcccaaaaatttgatagatgtaattacagtacaatcgtagtgtaattacactgtaactataatgtaactttcaaaaatttctccgtaacatattatttcggtaaaatggaggtcatggaaataaattctttgacatatgtgtgtgttgtgtttttttcttcctcaccagaacaaatcttgtaatagatctcacgattcagaattacgtgaaacttacatactccctccatactcacaaaggaagtcgtttaggacatcgacacggtctccaaaatacaactttgacttcttgtttctataaaaatattcattgaaaagtgatatatgtatacttttatgaaagtatttttcaagacaaatctattcatataatttttacattttcaaactcaacaactttagagttattcatgatttatattctcaagatttgacttaaacattgtcctaaacgacttcttttacgagtatggagagaatacaagttacactgtagttatatgcaagttacaatataattacattacgattgtactataattacatctgtcaaatttttaggacaaaatttatcgataaatatataggtggtacagtaccgttacggcccaactaattacatgggcttcactaactacagtagattattatttaattcaatttagtccagtataagttgtcactgtcgctgctaatccgatcgcccgaatgccactccgcgcgatgcttcctctccctctcctcctcgccgcgctcgccgtcgccgctgccgccgcgggcgcaccccgcccccacccgctcgaccccctttccgccgccgagcttaccgccgtccgcgccgcggtgctcgcctccccgctcgtcccggcccgcccgctcaccttccactacgtcggcctcgacgagcccgacaaacccgatgtgctctcctacgcctacggcggtggcggcggcgcctcgcgccacgccctcccgcgccgggcgttcgtcatcgcccgcgccggcggcgagtcccacgagctccgcgtcgacgtcgccaacgcctcctccccgtccgtcctctcgcacgccgtccaccgcggcgccggcttcccgacgctgacgctggaggagcagttcgcggcggtggcgctgccgccgaagcacccgccgttcgtggagtcggtgcggcggcgcggggtggacatggacgacgtgctctgcgcggtgttccccgtcggttggttcggcggcgacggcgagccccgccgcagcagggtggcgaaggtgctctgcttcgtcgccggcgcgacggccaacttctacgcgcggccgctggagggcgtgacgctggtggtggacctcgaccggatggccatcgtcgggtacagggacagggtggcgtacccggtgcccaaggcggaggggacggactaccgcgccggcaaggccgggccgccgtacgccgggccggcgccggcgcccggcgtggtggtgcagccggagggcaggggcttccacatcgacggccacgtcgtcaggtaatcgctttgaccattactagcagcttgttcaagcttgtacttgtgccgtgtgatgcatccacgtatcgttgtgatattttcaatttgaactattagaagctcgtgcaccacgcgtgagaaatcccaaggatagtcgccgtcaggggacggcgatggcctctattatttttcctctttttgaacttgacgacaagccatataagagtcgatccgttcatgataattccatatgatgattgatagcgagagcattgttatggagatggattttcaatcactccaggaaatatctccttattttttatatcatttaaatagtcactaaaaatttgaataactttgacaacatgagatatatcattccacaaacatacaaaatcaaattcaacttctacaagttgtaacaaaataacaaagtaaaatgaaaatgattaatgtatatttgcagctatatttgttacagcttgtagaagtcgagaatttgaaattacatgtttatgtagtgatatatttcatattaatctatcttatatttttttcaacttttttatggttgtttagatgatatgtaagaaacgaggaatattcatttgagggatgaaaatacttttccattgacatgtacaatgcattaggatagatattgatatgtacagcgcaccagcata

SEQ ID NO: 70636 - DNA, 1892 bp, Oryza sativa
aaattcttatcgcggtttacaggtggaatctataatttgttttgttattagtctatatttaatactttaaatatgcacttaaaaataattttggccaaagaactaagcacggcctatgtcgtaaaataaatcaacgtaggtactattctgattcgctgtattgccagctagcattgttaccaccgttatggacttattatggtaaatttggttaggggcatttgcaaatttgccaccggttttttgaatattgcaaggataccactcgaatgacagttctagtggcatttttgcaattttctagtggcagttttgcaataataattcaaagtagtggtaaatttgcaattgcccctgttcggaagcatcacagccgcatgtcctaagattgattaggcatgcatggaagtactgatttttttttcagcaagctggcaatgacctgctaaaggctgagtttagttccaaacttttttttcaaacttctaacttttctatcacatcaaaactttcttacacatataaacttccaacttttccgcgtcacatcattttaatttcaaccaaaccttcaattttaacgtgaactaaacacacccgaagtttttctttccctaggagtaactcgctggagttgcattggtattccgtacatcagtctaccaacaatcgttaaaatagaagggtgggaaagctgctgaagaaaggaagtaatccagtcttattagaggcaagttgtttatttgcctaaccctagctggtaagaggtaacgcaatcgctagacagatggctgcaagtagacgctctcggctctcactaatttagaaacgaatttcaaagctgactggtccgtccttacgtataatacgtagttgtacacctgaaccgtgttatttgtaatattttaaatagcgggctaaagtatttagcggttagcttctcaaacaactatagcggaagatagtggcagctacatacaatgggagatttaaaaccctaattatttggtggttcataacgcgcaacagtagtcacgaatagtgatagtcagatggtgtcacattctagcaaagcatatttcaacattgttcagcaaataatacaatatactaacaggtcacccgcgctgcttaataatagtaccagctaaatcgtgatggttgatagtacagcctacaacactctgcatatccatagtcaattactaataagtgtcacgacactaatggcatgacaaccatattatgcacttctctatctaattttaaaatttattgcagatgtatacacatgacacggtagttacccacagacaactcatgcacatatgtacgtattccatatgatatgaacacttgggactttacataattcttattcaaaaaatttacgtaattataatttattttgttatgagttgttttattactcatagtactttaagtgtgatttatatcttatacatttgcataaaatttttaaataagacgaatggtcaaacatgtgagaaaaagtcaacggcgtcatctattaaaaaacggagggagtagcaaaataaccatgctttactatggtaaaatcccgcgcttatttgatatatgttattcacttgatcgaaaataaatattagaccattataatatcagaaaatatcatgaattaatttgtatagtgtacaaaaagtagtttttacaatagtataggaaattactccatccgttattccatagagaatgttactgtaagattcaaaattattactctggatactaatataattcctgtcaattacctctctttttttttcttccaacacccaaccactctgccactcttgagttaggagtcataaccttacatcatttaacaagcgaaaatatagtacgtagta

SEQ ID NO: 70637 - DNA, 7716 bp, Oryza sativa
gatgatatgtaccgtggactacctgtattgtttgaggactattttcgggcactgattgtgttgttaattcacagagacgaaatcgaatttgaggtgatgttagtttactggatatattatgccattagatttagaattgagtagcttttaattagtctgtccacgatatcatacagattatgctgttataggttgtgtgttggtcaaaatgccaacttttgctggtgctggagtgctggtgaggtgtttgtgttatatgcttcatctccggacctaacagagcattagcttgactctacagtatagggtgaacagaaatgttttttctggataagtaaagacaagtcgatgtcgaatggaaaatcagttcgttttgtgttaaattcatgtggttgttgagtgctcttccttttcatgcatgattcaagaagagacgattgtgattgtgatatatattttttttgtaggagttggtagctgttgaaagttctagtgaaacttaaactttttacttaaaccttgtcaaaagtctcaaagtttaccgttaattaagatcactttatccaccaaaattttcaatttaaaatgcataccatcgaaattaattaagctagtatatcttctttaagatatgtaaagctagaggaatttctagcatggagaaatgcatgctgtcaaacaatcatggcatatttggttgaattattcattaactgaaaaggacctgcttcatgtggtagtgaccagtgttatgaagcaactttcaaatgagaaggactgcagtggattaacaggtacaaaacatcaattattgtctaattgaggacccattggtgccagtatcatcactacagtgaagtatataagtgcaattttttaacaagcatggacaaaggttgtacaagcaactcctttgctcccctgggtacagaagttgtgatgtttatcgtagtgttttaattctttatatgcagtgatgttttgttatcatgctgttttcctgatacaatcatacaagtagaatgtccttaagcatcttttggttgtttcattctatccatttttaattgtttggttataactaatattagctttatgtgggctatagtgatggcacttattggttcaatcatcattttattagcttttgcagtgtggatgttcacactgcagacatgatatgacatttttctatatttcacctctctaagatccacatgttttcatgaacagacgtagcatctccaaattctacaatggaaaatcaaaatctttcgcgtgtctcaaggaagctgtttcatcttgtggctctgcaaaggacatcgcgaaggcagagagcgcatattcgagaaaacggaagaatctccttgcatacagcatcatgtatgaaacttcacaggagacagcagcagaagtttatgaaactggaccccctaagaggcttgccagtctgagcagaaactctttggtgaccttggctagtagcagttccaggagcagcagtagtatcagcatcgaagaaaccgagctcactgagcagcttcattctcctccgtcgcttgctaatgatgaaaattctgcggtttataatgctccagcactacaattaggatcctgtgatcctaaaacatcatctgtgcctgtgaggtcattttcaatgatggatttgcgccgtctgcataggccaagatcctcatgtcgtctcaaagatcagaaaacgacagagtagcgtagtattcttgatgttttactggggctgctagtgtctttctgtattgtgaataaataaggggggagtttgatggtgttgtctgtgcctgcaagatgattggggctactgtgttgtatgtaaattagcatactacatactgatatcgatggcctaagccctaaggtgtatgtctgtatcatgcaaattaacatttgtaaattaactaaatcctctagtaccttatattatacattcttctggacccgctgactgtatctttatggtgttgctcttttggttaggaacatggaccctctgggccgctacgaaaccagtaagttcagtgcagcctgtagaatctacacaacatgagtaatttggataatgtacattgatttttgcggttaacaaacttacagtgcagatgatcacattgatttatactagactaacttaatatctaatttgatgcttgagtcttgaatggttttcaatgaactcattgatatgaattgaaggaagaatttgcacttttcagtgcttagtaataagaaaatagatgcaacgtttgtttttatgggaccaaactaactctaatttgaaaatgtaggaactattggactcttcaatagcattatatatactaaggctctcctaaaaatcctcacattaatctagtgaaggaaaaaaaaatctagaaattcccatattgatcgaaaaagaaagaaatactcagattaaatcaggaaaaagaaaaaaaaaatcttggccatctattcatggactacctctctgtcccaaaacaattattgtaacatttaaatcttgtctcaaaaaagcaatcctagaatactatttttcccttcaatcacctcatttaaatttcttcccaaccaccctttaatctatgtcagttattttgaaacgaggagtatgtaagcaacatacggttggatggcttcatttggtatgtctgagatcagacgcttgaatttatgtcctattcagttttcatactttgaggtagctaggaccgatgtagtgcatgcgcacggaacaaaaattaaacaacagtacatgtttgcatgctgcacaatcgcacagctagctcaaatataagcatttttaggattcagaatttatacacattataagcattactaaaatagtactacttatcgcatcaaccaccctcccactcacaagggatactacagtctttcatctcaaatcttaatatatatccactaaacatgattatatttcatattataattttacaaggttgcatgctgccgaatcgaattgcttcatctgctatgtatatcatatttagtctacggttggtacatgcatgtttaacagaaattttgcgttcttatacatttagatgataaatgaggcaaaagagagtaagagactataaaattgatatattatcttacttcaaaaataataattggtatattattctcttcacaaaatagctaaagtgatttgaatgatatgtactatttattgttaaaatacaaaggttataccgtgatccaaaaaagataaatacattcatcctaaaataggaagtgctaagcatatgctcgggttgtctcaaattttaactgataagagaaactagaccaaggataaccctggagatggcatgctttagacatgagtttaaggtttagggtttagtccacaacatagatcaaggcaacataaacattagttcaattattcaacataacgtatactcctcccaatataaattaacctagtatgagatgacatatcgtagtgttgtacagattcgtagtattagaatatgtgtcaccccgtacgtaataggttaaattaatattaatttgggatgaagggaatacatcctcgtctagagtagcatgcaacaccacgttctttttatcttactagctaaatacctatgctttgccagaatgaaatgtatttttcgtgaaatgttttacccgttgtttaattctatatgccgctatacatttagattgattggtttttaatataacgaagtttaggagttactcaaaatttacgatgaaagtagttgtgatgacgtattcactaaaacaaccactaaagcctcactagagccttttaaagtaatatagtacataagttcagggggtgatttgtaaaatttacaataaaagtagttggggttggcagattcactgtcaccactactagatccttttaaactagtatagatttgtgggattactgccgtagattatttatctccgtgcttctaaaatacaatttcttaaaaataaaactttattctggtccatttctaaaaagaattatgatttctagacaacttgttctatggtatttgttttatttttaaaatatttacatatgtaataaaacagaaaattcatgtcaacaggaactaatttatatgagagagttcacctctcatctatatctctagtctaacctattttattagccatgctaggtcatcgacttacttaccagccagccgttgctaaaatttaaaatttagttttaaagctgattttgaattctttttcatcgtagtttatttttcaacgttaacttttaaatgtgtaagaataaaaaaaacttttccttataaattatatttcaagctgtcaagagaaccccatccgtttcaaacaaaaccattaaaaatatatgtacacatatattttgtccagttttgaaagtcaaaggcgtaagaaaaacctgctttgtagttcaaggtaaaaggtagactttgagcaaagtttaagggctaaagattttaattttataattatatatttggatagcatgcattcatagatgagttcttaagggaggggcgagatttaaatagccgtgcatatatacttagcttaggacaaccggtgcataattacaaagtaaaatattgcaataaattatttgttgataaatatcaagtttttttttgaaaaacattctttttgaggggatttaaaaagtattttggcacaaagcgaagagatatttaactgtttgaatctcagtcaaacggttgaaccaaggaagaggatggtttctaagaaagaaaaagtgagaccggttgtttaaataattgatcagattttatttagataataggtcgaaatggtttacatctccgtcctctgccaatgagcacatagctaaaaggttttaggagtaaaaaaataagaagaactgaataaggtgatggagcaaaaccccaacttctgttaataaaaaataaactaaaataacatttgtaaaatcacgcaaattctagcacaaaattttgtaggtaccacgcaatccaaaatagaataaaagattcatggttaccagttccatgtgtgtaacaccattgtgtgcagtatcatgttattcctgtgatagcatcatagatcaagagttgaattagttggaacacatgaccataaactgttagatattttttattgtcaaaaaactacatcattatggcaacaccaaattgatcaacataaagcactagttccatatatatatatatttttaaaatctaggcacttctcttcgcaagttaccaaaaataaattttacattacatggagggaaaatattaaagaaaaaatgacacatatccaagcaaagcgtgcaacatgacagtccagtcaaagaaaggatgctcttgtgaattagaaaacaagattgtttgttaccctcaattttctccttgtcaggttatctttagttagaattttctctttaaggaaccacgtaaagactttgatttttattggtacctttaactcctataaaatcttcttacaatcttcttacagattcttacattgaagttcacgattgcattgtacaaggatttgaagaaaaatggttcgttttatgttgcgaccaaataaaggacatctcatttagttattgcaaacaaaaacatgtggaatcatcatagaaaggacatcaaacatcatgttaaaagaataggtatgcagtgttcgacccacatagacaatgacaattgttgaaaaatcagaaagtgtacttgacatttttgcatctcaaataagggctcaacacatttagaagaaaaatcatatcagacgccgagagctgcaaacataataatcaagagcacaaatatatgcacaaacggcaaaactttgtttcccaaaacattgtcaaatcaagaagaaaaatgagaaaaaccaatcctacacataacacatataacctcacaacatgtttgcatattgtacacacataatctacagacatatagtgcacaaaaactaaacttgctgaatcaaaagacacatagaaaaaaagctagcaaagcaaatatacctaggtagtgtagggtggacaacgtcgcggttgcggttctcatggccttcttgccatcatcaacaagaattacatggaggccatcagggaagaatgacaacatctccttttccattgccacaaccaatagagatttacacaatcacacactgctagctatgtactactctcttttcaccgatgagtgattagaccgctctcttctcacggtcttcatgtcatcatcgacaagcatgacacggaggccactagggaagaacatcatcatctcttccttcattgccatagccaatagagatgtacacaatcacacactgctagctatatactactctcttttcactaatgagtgattataaccgatgtgttctcatggcattcgtgtcatcatcaacaagcattacacggaggccaccagggaagaatgacatcatctcttcctccattgcctcaaccaatagagatgtacacaatcacacactgctagctatgtactactctcttttcactgatgagtgattagaaccactctcttctcatggcatttatgtctcatcaacaagcatgacatggaggccaccagggaatagaaggagagcatctcttcttccaccgccacaaccaatagagatgtacacaatcacacattgctagctatgcactactctcttttcattgatgagtggttcgaaccgttctcttctcacggcctttgtgtcattgtcaacaagcatgacatggaggcatcaatgaatagaaggagaacatctgttcctccattctcacacaagtctacacacggtgttactactcacttgttcactgatgaagtgattagaagaggggaccgaagtcactgaccaaggagaaggtagtgaggaaggtccagtatgggtgatgtgttgtgccaatattttttttcttttttttttggagtaaactggcgttgccacatttgaggatcaaaggttggctaacctatgttacggtgtgagcacgtgatatgtgttcttccaattgttcattttagccaagaaattacgagtggcatttctgcacaaagttgataaacttgcttagttctatagctatactttatgcatgcatgctgcttttaaaagtgtatgttacatatacatgatgcacacttggaaccatgtaaaaaagccattatgtgcccatggaaaaatgtactgtacacaattcaaaaaaagtagtacactcatggtactagcaactttctccctctttctctcttcaatatggatattttcaactatctcttgtgatgactagtggctaccctttcgttcatatttgctcgaaatatgtctgatcattcccaatcaagtagactcatccgtgactaaaagtgcatctagtcccttgtgtcggttttggctaattctgatcaaacaattaatggaatattaatgtggttaaagaaacattgtgccttgcaagtgcccatcagcaatacaatgatgtccttcaacgatgttgctgctagtgactgtgcaggctctggtgatggggcaacaactctcttgtggtgtctagttggatgcttccaggtggtatctttggcccttctcctaccaaggctctctgccacctactatgcgtaaccacat

SEQ ID NO: 70638 - DNA, 1968 bp, Oryza sativa
cctagaaaattagggtttagcttgtaggcttttaaaataatttctaagaaatgatttaaaatatgcatttttaatttagtcgatttttagggcgtgacaaacctaccccccttaaacggaatctcgtcctcgagattcagaagaactggcgaacagatgaggatgagctgacttcaattcatcttctcgttcccaagtggcttcttcttctgaatgattactccactgaaccttgcagaaccgtataacgcgattccgagtattcctctcgcttacttccaatattctgactggcttctcaacataagttaaatcttcctgaagctctatacgatcaggatctgcttcctccgtaggtacacgtaaacatttattcaactgagacacgtggaacacgtcgtgtattcccgccattgacgaaggcaactctaactgataagctacctctcctcttcgactcacaatcttaaaaggtcccacaaaacgcggtgccaatttccctttggtttggaaacgatgaacacctcgtaacggcgtaacccgaagatatacataatctccttcttcaaaagccaaatctctgcgacgattgtcaacatagctcttctgacgtgactaagcaacgcgcaacctttcttggataatcttcactttttcttccgcctctcgcaatatgtctgtcccaaaaacttgacgttcaccggtttgatcccaaagaagcggcgtacggcactttcgaccatataatgcttcatacggagccatttgcaaactagcttgataactgttgttatatgagaattccgcgtacggcaaattcttatcccaacttccaccaaaatctagaacacaagctctcaacatatcttctaaaatttggtttactctttccgtctgaccatttgtttgagggtgataagcagtactgaaattcaaacgggtacccatctctacttgtaatttctgccaaaacttcgaagtaaactggctacctctatctgacactatcttcttaggaacaccatgcaaacataccactctggccatatataactctgcaagcttatgccctgtataggttgttttgaccggtatgaagtgagcgacttttgtcaacctatcaaccactacccaaatagaatcatgtcctgccgacgttctgggtagaccggttataaaatccattcctatttcttcccacttccactctggaatcttcaacggttgtaacagaccggctggcttctgatgttctgccttgacccgctgacatacatcacatagagccacatattctgctatctcacgtcgcatactggcccaccagaattgttgcttcaagtcttggtacatcttagtgcttccagggtgaatggaatacaaagtttcatgagcttctttcatgatagtatccttcaactccttattatctgggacgcaaattctttctcctaaccacacagttccttgctcatcttctacaaaaccgatggctttacctctcctcatgttctttttaatttcttgtatgtcaggatcattcacttgagcttctctaatgtcacaccctgattttcgtcttaggatttataaattatttaataaattattaatagaatttatattaaatgttcattaatttacaagtgaagttaaatgtgggaaataaaatttcctaaatataaagcatggatggatttaatttttattaaattctccgtggttaattatactctctggaattttctcggatttttcggagctcaattcctaattttaatcatacaaagagcatttcagtaattacccacatattaaattaatcattaaatggtctaattataattttgttaagtacttttagtgtccaagtattttcaggatttttcttgaaattatttgagcattggaagtatttttaacaattgaaagatcatttaagtgattattttaattggaaaaagtttt

SEQ ID NO: 70639 - DNA, 956 bp, Oryza sativa
atcgattcctctcgtttggagttcgatctcttcaatccaatgctataaatagcatcccctagtcgtcctcttgcgtttgccccaagtcccgagctccctggtcgctcgtagcgctgccgcgccgttgccctagccgctagccgtcgccggcgatctccagttgcgccgcgccgtcgcctccgccgtcgccgccgtttgccgtcgccgccgttaggtgcgccgtggtgagaggaatctcggccgcccgttccccttcgccgccgaccaccggagctccgccgtcgccgtcaagccgagccgccgctgccgttctcttcgtcgccggttgtcgtcgtgcgtcgtttgacgttgtggtgagtaccgttgggttcgcctcgtcgtcctctacacgtaggtgtcttccaaatccccggccaaggcccctatctccggcgagcttgctaaccctaatcggccggccgtgggtgacgtcatgctgacgtcatcatcctttctttttccctttttcttttaatagattagatcttctaaaaatcatatctaaataaccgtagatccgtttcaggtggttcaagttgctaaatttttctaaaataaagatctacatattaaaattgtccataaattgaattaaatttatttaattctttttaaatgggctttaattagatttgatcttgtaaaattcataattaattcatatgaagtcagaatgaggccgttcaagtcttataattcatctaaaattatgatctacatgtttgtttactttttatgtactgtttattttgtttttattagtctttttcttcgttttgcgtgttagcttgtcgtttccgtcgttgcgaaggttcgtgagtgcgtcgggggatcaagaagattaattgaagaccgattattgcaaggcaagtcacacagatcgtaaacacaatcctttgagcatgttgatcctatat

SEQ ID NO: 70640 - DNA, 1805 bp, Oryza sativa
tcatctgttgtggtacgtctttgttcgttgagcgcatcacgccggtgtctttttcctgaatccactaatatgttttcatctgtcgtgtacgtctttctccatcgagcgtgtcatgccatcctccttgaatcccagttgttctttgcatactcagaatcggagaaaagaaaaccaactcagaataggagaaaaggaaaccaagttgtatccgttaatacaacaaaatcctcgtaaagtttcatagcttcaatatgaccaaatcggataacaccataagccaaaaacaagaaccgaagcttaagaaaacaaacccaaaaatttcataagaaaacaatatttgctctacctctagccgcctgagggacttcaccctcttcttcagtggctacagggtgggctgctggattaggcacctccgaactcactgtcgctagatctgatagccacaaggtgatgctggccgagagaaagcaggaggaatcgaagaggacatctcggatctggatactttgagcggcggcggcagcgtcgctggcctcatctgcctcctctcctcaccgtctttctcgtgcccttctgtccctgatgaggctaccgaagctacggggtgggtggggatagagacatcggcggtggaggaaagtagcgagcggcgtggctagggacggagccagtgttaggagcgaaaaactaaaatggagttcagagttcagaactctgaatggcggagtggatggcgccgcgtcaggctacttacgccgggtcggtggggaccgatggagagagagagagggggggagggggactgagagagagataaagagagagagccaagagagagagagagaggagagggtgcagtggaggaaaaaggaggagagaataatgacagaagagagagatgagaagaggagaaggacgggaggccaccggtgttcggctcgactcgattttaggagtgccttttttttaaaaaaaaattccaacacctataatatattagggttgtcagtttttaattaatggtcacctataatatattaaaggttctattttttaaaaaccattatctcagatgccagtttttctttagaaccaatacatataattatttaaatgtgtcagtttttgtattttcaatccacagaggtgagaaaaaaaatatagatgccgatttttagcactttcggtacctatagtgccgatctctatgtgcttttttttaagtagtggcaatccgccgcgtcctttccgatataagcctgttcggttgagtacgagtgatgatgcacacaaccatcagaataatttatccgtgttgacgtgctaaaggcaacatcaatgcatatagctaaagtagtacatatagatgggacactttaactattgcaatattcacaatgtatacaggcagtaagtagtaggaagaggagagaggaaatagagacaaatgacatattttattctatatgggcagctcatatgcttatggatgactttggctatttttctcctatgaactacttccacaatgtggttaggtagctgaatgtattattttatagaaaaagtatgaattaccccccaaactatcgcggcgtctgaattacccccctcaactttcaattccggacaaattacccccctcgacccaattcagagcggttttgtcctacgtggcgtacgcgtggcaatccagtcagcattttcttattaaaaaaatgggggggtccacctgtcatcttccctctttctattgttctctctctctcatccacaagctgacaagcggggaccacagggat

SEQ ID NO: 70641 - DNA, 19591 bp, Oryza sativa
ctgcaaaaaaacattttttagacgccgcttaagtggtccgtctgcgaaaatagattttcgtaggtggataacgaacttcacccgatttatatttttgtaggcggtcatttggctccaagggtcatgtccgcctgcgaaaaaaagaccccacgtcggaaaaaaatgctttttttaagtagtgagctacatgcggtcctttttgttaatgcagaaatcgatgttagtcttctactgctatgtgctatgtaagtatgtatgggaggcatcggaagccacgaatctatctgctgggtcatgctatgcttaacgagcatcgagcaggtaatctcagaggcagcacagcaggtctgattgccattgtgtatttcctatacaagatgataccccacgtgttaaggtgggcattggagaaatacctaaaaatatcgtttcaagctacaatctctcttaccagtgtttgtcagcggttaagatgcatttttaaagaactaaaaagaacatatctataattggacctagtaaccagtacaactgatagcatgaaaataagtctttgtattatatgattaattcaacccatactaagaaagcgtgatttgctctttgatgaaagaaactgcatgaaaatatagcgagcaatatataacagaacattaaaaaaataataaggagaatgtctaaggatataaaaaagatttaaaagaacaactaatggtattaatgacatatatggtgacattgaaagagaaaaaggatgggccatcaaggccaccaatcctatcgtttcttctgctaattaagatctaatactgcagttgatattatgggtcaacttctaaggaaaaactgataacatggttgcacataatctaagctaatggtgactcatatagaaatcgtagatgtagccggtggttccccttggtaccggctgcccttcgtggcctggcttggcggtctctctcacatgatcatagcccgattggatatctactttctatactggtatgaacattatctatccgaatccattttgttttcatccctagagtggatgcagctgccgtctcgagcttagttggattgctgagcttaaggagtttttcttgccactgctaagtttaaggcttcaataaatttttcagtgtaattagtagaactgtgtttgctggcaggaaagagactacagttaatatgacaataaacatagaccgtcgtggaaatatgttttacatagtttttgatacaaagccattgaacctaataactgctttctatgcggtgctactatatcaagtgagtaaatttgaggccatctcaaaaatggaatagatcagaaaattaaacagagaggtaaaaggcaattaaatttgacaaaccccacatcacagtaaagatttcatttcataccaaatcgcctgctttcatagtaatctccatgttctgtccatttgcatttactgtttttaaaataaaccaaatgttcatcaattgtggctcattttcttttaaatagctctacggtcccacattttgtactgccattcacaacactacaagtctcgaagagtccatataaatgaccataagagaaagaaagagagaagaaaacacaggaacaagaacgagagcagctcagacatagcagaaggcaaggaataacatgccaagcagatgacaacaatttgctcctcaaaaaacttacatgcatattaggtctaagaggcatcaggagctccattacaatctacctgttgcatgtaccatgatagaaaaatcaagggagtgccgggagaggcacaaatacaacctggcccttctagttcgatgagagctaggcagccaagttttgctccttcggccaactaaaaagccttcctttctgctcctcgatcaacaaggtcacaaattcaagcatatcaggtcgcatatgggttatgtcccaacttccaattgccacatggtatgacaggcgagatgatacctctggcaaaggatcgaggaatggcagcagagtactttaggcttcaatatcttaatctctgtcccctgttactggataagtttttacaaatttgcttttagcggtcaatctcttcctcaatttcacttgtggactaacggtcaagaggaggcaaaggcttagagcattgtaacaaatacgtaggtaagcaaaagatcagagcaccctgtagtcaagcatcgaccatacttccttgttcttttcaccatattcatcgaattgttgtaatggattaattgctccatgcttcgcaaaatatgcctttgaaagaaaacatttttcaattgcattgttagacaacttattttaagttatttattcaatttattttataacatatttaagccatccctataatcaagtaaatagcatgtgacaataatcttcacaacaatctaattcaaacagtgcatttcgcgcaaacattttctatatataattttcctgaaatacttttttaaagtaacttttcataccaaaccaacattgaatgtcactcattcgccattatatgttaatttgatgacttaatgcactaaccatctggctcatgccattacacgtgcatagatgcattgagtttacatagcatatactccctccgtttcaggttataagccgttttgattttggtcaaagtcaaaatattttaagtttgaccaagtttatagaaaaaagtagtaacattttcaacccatgaaaaatttattataaaaatataattaattattgatttgatgaaactaattttaaatattactatatttgtctgtaaacttagtcaaacttaaaacaatttgactttaaccaaagtaaaaaacgtcttataacctggaacggagagagggagtatgtttaaaaagtgcctagatgttgacacaaaacaacaagaaaaatacaacgcactgtgcctcaccaagctgtttgactgatgcaccattaatctcgctagagttttggttgcacacattttccataggctgatttcctccgtgatttccccatatctctcatgcaatcaacataaacaagcaaaggagcaagtgaatgagtagatctactgccaccccattcacatgctgtagtagcaagcacaaagaagtcagaaagcaagcaacttttatcatacacgcaagcatgcagcttcggtaatagccgttgatagccgtggtgcagggatggcacacttagatgatatgtgaccagaaagtggaaaatcttgtggtgtttgtggtgagccttagtgaaggtggaggaagtggggcaaagtcggcgagacaaatctagtgggggaaggaggtgaataagccaaaaaattgcgttggtgctagctatttcggaaatactcaaccactcctaaacttaaagatttcaactactcggatccaactttttaatatgtgaatatgtttacacatgcagtagtctttagaatctgcttgcgagaacggtttacacatgtggatgtctttgaaaatatgcctgggtaaaggtgtgggcccacttgtcccgtggatagttagatatacttacatatacggacaacctaactaactgcttgtgaaaaggcggctatctaaagatgccgtcagagataacaattgttattttttttgaaaattaatagaaatcctataggaacttctcaaattttttgaaaattctttgtgaggaactttttctattaagattgaaagcctccaattctcctgctggtcaaaagtgcctaataatgttctgtttccattctgggaatgtactaatagtaaaattattactaatgtattctaattgctgtgcttctctgttctttttcttgaacgcaatatagactcacctactaccaatttattatagggtatcccatccttgcactcttgatctacgtagaaccatacgtgtaactttcatcacaacaaccaacattagtgttctacactttggtataactgactagcaacaaccactgtatgcgtctgaactctctaaatatttcttgggaaaaagttacatgcaatagaaatgggatgcaacatgaaatgtactgccaccatatctcaccagataactgcactgggtcgaggtctttgggagaaacttctgatgtggtcttcacgtgatagcggtgtcgaattctttcacaagagaggatagctttccgtcagactctagcacagaaacataagtgcgaatcaagtagaaagctcttggttgaaaagaaaaattagtcacaacaaatggatcataagttaaggaaggaacaaagtttcagagattgtgtctgatacaatgaattcactaattcttgaataagaccaatgaagcagaataaaatcgagggctgacaaagtttcgtaaactcagtatatatacttcctgtacatttctgtctcagctatatgcatcaacttccatgcataacgactttaggcaagaccaagggaaatgtgaacaaaggacgaactagttttgcttctttacatactacaagaaacatgacttcagtttggcttttgctttggttagttagtacttgatccttttacaatgttcaaaaaccttttagctacaaaactcagaatgaccaatcaggcaaccgtacgagagaataattcattgacccatcctatcctagcatgttttcactaactgtcttctatattggtgctagaacttccaagttccaaacattgatgacatgtctgaattccgttcacttctcaacaccataagccacaattcaggatcaaagcaaaaatggaatatctattgcctcaatgactgtatcctagaaaatagttgtgctctcaacattgaattgtgagtcctgttatccatacctacatttcaagggttgttgtagttggctacttaatatcatacacaaatccctatacatccaacattaacgtccacttccatgtcaaatacataattgacttttttaataattattaaacagtctactgacaaaacaggtataaatgatattaaaatcaaaatatatgggcatagaagagagtgagaaaaactcagacacaatagatcaactgaaaaattcccactagtggggaaccggtcatttgtgccaggcgataaccctcaactgtgttgacagagggcctggtaattgatgagtggtcattgaggagcaaatatttgccccactagccctcccacccgaagtagcacccgaagtaggaacagtacgctgggttgtgataactatttcaccaagtatcggggtatatatatagtcacttatatcattgatagtctgttaacaggaccccgtaaaaatgactatagtcctctttgttgggcactatcctctttcatatcatccggtgtgcttgtggcccatcacagatgacccgtgttgggccgcatatttagcctgccacaggtaacgggtacggcggtgaggaccaatcttcaacgtggatttttttcggtctgtcaccagtgagcacatctgtgatggccgttcacgatgcaaagttagtatctaatgaactcatatgtatgcaaagttaaataaattatccagattaactacacatctattggtgtcactatcactagggaagtgctgacacatgttgatatctgttagatcatcattaagtgcttgcagttaaactcatcagaaaatgaaaatgttaacagagataatagagtctgggccaactgttgacagacaccaaccctgggccaacataaacagagagcctcgccttttctattcctgtaaactgcaagtgagcatgtagtagtaataacagagaatcaaagcagtggttgtatcaaaacttacggtaaacaacctcatcttttcgcttatgcttttgtttatcagccaaaatttaaatttttaaccttaaatttagagttgattttggagttttttcatcgaagtttattttccagccttcgctttaagaccctaagaacacgcatataaaagttttatttacaaattatttttcgttggtaaatatgcccgaataagtgaaacgatgggacgtttttctccaccatatcgaatcgtaatgatgaccactcagggctgaggtacatactagctagtaatagttattcactcgagacgtaatgctatctataaataaagacactcgatcgaattttcatggcgtgccactttgagagctgttagtctcctactggtgcagtactccttttaggaggtaaaaatcgatgtagtctcctcctagctcgctctgctaactaggtatgggaggcactggaaactattcagccgcctcggatccctttgctgggtgattctatgcttaactacgatcgaactagcaatttcagcggcagtgcagcgagttcgattgccactgtttttcctatacgaagccggtggatcaccgtcttgctcaagcatcgtgcaccagaggccctccgctgcaacacgatgcagccttcaagtgatccggtcgttagctatgacgagcacacaccgcaagcacgctacgtcgctacgacgatgcccaggatatgtaagccctagcattggctcggcgacgagttttctcaaatgtacactgccctggcatgtcgagcttagttggggattgctcaacttaacgattattgtttttggccactgctgagatgaaagcttcaacaatattttaatatacttagtagaagtgtgcttgttaattagcatcaaaagagaccaccgtctggatgcaacataaacatgaatcctcatggaaatatattttagatagttttgatacaaagctattgaatctaataactgccttatgttatgttgggttggtgctactatatcaagtcagtaaattggaggccatctaaaaaatggagtagaaaattaaaacagagcagcaaaaggaaaataaattactctaaatctaacccaccccacttcgtagctagcaaaggtttcatttcataccaaaccctctggttttgtagtaatctctatattatgtctaattgcattgacagtttttgaaacgaaccaaacgttcatcggttctggcccattttcttttaaccaggtctacagtcccacattttgtcctaccgttcacaacactatacaagcatatatatacatatatatatatgtatgtatgtatgtatgtatgtatgtatgtatgtatgtatgcttgtatagtgttgtatatgagagagagagagagagagagagagagagagcaacacaaggacaataatgagagcagctcatgcatagcagaaggcaaggaataacctggcaagcagatgccaacaatttgcttctcaaactaacaatgcgtattaggtttgagagccagcaggatctcccttacaccctatctgttccatataccgtgatagaagaaccaagtgagttccaagaaaggcacaaatacaaccagtgccttccaacttgtagagatctagacaaccaagtttttctccttcggccaaccaagtggccttctgttatatatgctcctcgatcaacaacgtcacaagttcaagcttatctcagaccacatacgggttatgttccaacttcaccaatcgccaaatggtatagcaggtgagatgattcctcacatctaaggccctgtttgtttcagcttaagattattgtaatctagattataaaactagattactataagctggattataataagccgatatagaataagctgctagctgtttgtttctctggattattatctgtttgttagttgttagccacccaataatctaaaataagcacctttagagtggcttaccagattatagtaatctggcttatagattataataatttatcataataagctatctgtttgtttcagcttactcctaataatccagattataataatcctaagctgaatcaaacagggcctaaggacataattgttttcaatagctcttaaagcggtcaatcgacatgatttgtatggaagagataaaaaaaaatcagaatttaggggcatacaagggtgtgagaaaaaaaatcataaacacataaggtattggttcaaaattcaggctgctgcaagggattttctctcaataaaggcctgatatgcctaccatgcgtgttaaacaagttccagaataagattacaaatcttgcggtgtcatcaaatggtaaggtgctgacatatgttgatatatgttagatcatcattaagtacttgtagttaatcaggttttgagtagttgtagttaatctggttttgatctgtgtgatgttccaactttgttgttcatgtgcaggtgttgcttgagaccatgagagtatagtcggtgatggatagagattgggcttaggagaagttgaggtctacgcgaggcgctcaggcttgaaaacaatgcatgtggaggtgaagttttttttatggcatacacatggtgttgtgtgcatatggaaagataagtgaagtttggattagagtccaaatttgaaaagtttggagtgcggagttgtatgggatgctgtttccctgatttggtaggttttctatgtgattaggtgtcctagttttgcttggattcgtggctaggagcaaccatgttatgggtaatagaagagggattgaggctaaaagtacatttaccttttgggagaaaaattttagggtttgttttaaggtttcaatcttagtttgtgagttgagagagtagtgctttagatgcactttttaacaatctcgacaagttcagaattatgggttgatttatgaagatctcatcttgtttctcgtgatctagatgcccggccgggcaattgcagttattgttacctccatgtaggaaggaacttgtagccttgtattttaaatcctcaattgcctcttgaactaaaacatttttaattatgttaatctggaaagttcaatacagaatacttaattaatttggttatatattcagttaatctgaagataaactggattgcattgcttatttcctgcaatttccgatgataagttgatcaagtgtgctctgtggagagattacagtctctgcatatgtttcccttcattattattgctggctggggttgggcattatcttgctacgaatcacctagtaactgtgggagaaaacatgaaggaatgcttggtgtactgtagggcttcgggaagaagaatcaaatgcatggtattgtgtttcatggcgaggtattgtgtttaatggccatgtgtgcaaagggatagaaagatctacaaccagggcttttcatcgagacaatttaattgcttagtgatctccagaaaaacaggcaattcaatacctttttttttggatggaaagacaattcaattccttagatctccactctccaggagtttatccaccacaaatccacataatgcgtctctgcaattagatcaaagcagaaattgtgaatcatccaggcaaatcaatccctagtgatacaccttataacaataaagacattgcttgtgatatacattagccattgggaatatatgttgttggagacattggccgtaccgaacctatctgtacagtcgtcacaattagtttggtccaaattaagtcagatgtacatgttaatcaggtgaagctttttttgcatttctgatcagatagctttcaagacgctggattatattcccttttgtttcatattataagttgtctggtttttttttctaattaaactttattaagtttgactaagtttataaaaaaattagtaacattgaatatattttgataatatattttttggtggaaaatactactatatttttctataaatttggttaaacttaaagaaataggactaagacttataataaaagagatagagtattaaattagcaacgacagttcatgcgaattggaacatatctgattctttgagacggaacgagagcgatcgaagatatattccatgtattatgctatctagttgtacactctttaaatctagtactagcataattgtatttgtcaaagaaaaatagctattctaatttttgagaagataaatatctcattacttttcagaccttcgaaagcattgcacaatactaacttgcaatattcagtaaaaaaaaaggagaattggttggcagttttgattcaaatttttttgtatgattcacctggttttactttttctgccttgagagggtaagttattttttgtttcttttcataccattgcagtataaatataattttggtttggatctgttctcaagattagactcgcatgggattgcttgggggttaagccgaaatatcttatgccattcgagttttctgtcgtacacggaaactatgtatgtatctgtactatttaaaaaatataaatgtaataattgttagtgaatcatgatgtaggctataactttatagtaagagtcattggagggagaggcaagtcataatagctgttgcacaagtagttctaacaatgtacatatgtagggccaaggccataaaaaagggagaatgccccaaatctatctaccgatccatcgggctgctgattggtactagtgtactattgctctctcttttcctctaacaatacataatatagcaagctttaaaataacttttctcataaactatttatccaatctacgatcctattacaccattgtatttgttataattaaatctttataacaagatattgtatggttatattatgacgaaagaaaaatatatgtttcaatccattaacactctttgttttaaacgtgatagtgatatgtttcaatatgtgtcttcactatgtttaacaaaattccaaaactaactgccattactctctctccattctctccacctcatccatgcatgcatgcattttagcgcgcttcaaaacgatttttctcctaaaatagttatccaatcaatgacccgatcacaccgttgtattcgttttaattaaatctttacaacaagatatcacatggttatattttgataaaataaaatcatatatatcaatccgttaatattagttgtttcatatgtgatagcgacatgttttaacgtgtcatcatgtttcataaaatttttaaatgttacagttgttggttttttttgtttcaccatatataactttgatgcttcactcgttggtcaactgaaacatttgactgtcccatctttttagtggcatcgggtgcccgatgagaagattcttcccataaaaaggcaagcaaagatagagcatcgaaaggtagacaaaaatcttgactaaactcgaaaccctaactaaactcacaactcaatgatctcaaaagcgataccgggaagcctcacgctccctctctagttatacatgaggtagccagcctaaagccatgaatcaaactcatactagaagtcctaatccacctaggaaaccttctcgtacaagaaacaaactttacaaactccaatcataacaaatttggactcctttcaaattcgactccacatcccatacgcacataatacctccatcgtatgccatatggaatctgcaccaaccatgtgcattgaactctagcctaagtatcccgcatgatatctgactgtcacggacatctccttatccccaagttgactcccgatccatcaccggcaatactctcccgaggcatcaagtcacctacacatgaatcaaacaaagaaactatattccgagactaagctatctccaacttgactcattagtagcaaacaacagtattacatacgcatagtatccatctagaagccataaatataaaacaatcacagatatccaaacaaacaaccgaaaattgaaaccgacacagtgtcggccggtcagaccgcgggctgagccggtctgactgcttgatcaccgtcggtctgaccagcaaccacagcccagtctgaccggaccaaaactcagcagcagctcttgttcacttgcaaatccaattatctccaaaaaccacttcgccaataatctccaaatatcaaaaccaataatgtcagatgccaattgttcatcacagaataataatcaaaaacatctttgattttacatgggaggcatcggaagccacggatccctctgctgggtgatgctatgcttaacgagcatcccgcattgtgtatagcaggtaatctcagaggcagcatagcagatctgattgccattgtgtatttcccactgcccgcttgcatctctactccctagagttgatgcagctgccatctccagcttagttggattgctgaggttaagtaggtttttttttggccacagctaagcttaaggcttcattaaatatttcactataaatataattaggagaacttgtttgttggcagcaaagagattacatgcagtctggataagtttgtttggagttctagtcacaggatcttaatttagcctatacataatcacctttctaatttggaaaatttaatttactgatctgcttgagaagcaatcggtgtcaacttctttgattctcttttcttattttcttcttctggttgcgcaagctctctcttcttatagtcgccggcaccttgctaggtcaccacggtctctgggtctccactagcactgccctaaggcagcctcacgaaccacttccagtgtttagctgatcagcagcgtttagggttttaggttttagcgcaaagagattgagcatcctctgtcctttgctttatttctttatatatggtactggtggggcacgggagccatatctccaattaggattcaaaattgattttaccgatcacaaaaccaatctatctcttatttgttttcttgttagaatcaaactgtgggatcacccttttctaacttactggacttagccgataaatcaaccaacaatgacataaacatagaccatggtggaaatatgttttagatagttttctatgtggtgctactatatcaagcaagtaaattggaggccatctcaaaaaaggaatatatatcagaaaattaaaacagagaaataaaaggcaaataaatattacaaaccccacttcacattaaatatttcattccataccaaatcgcctgctttcatagtaatctccatgttgtgtccatttgcattgatagtttttaaaatgaaccaaatgttcagcaattctggctcattttctttcaacaagctctacggtcccatattttgtactgctattgacaacactagaagtctcgaacagtctatataaacgagcataagagaaagagagagaaaccaacgcaaggatgagaacgggagcagctcagacatagcagaagccaaggaataacctgccaagcatacgacaaaaatttgctcctaaaaaaacttacatgcatattaggtctaagaggcatcaggagctccattacaccctacctgttccatgtaccgtgaaataaaaaccaagggagtgccaggagaagcacaaatacaacctggcccttctagttcgatgagagctaagctgccacgtttttctccttcagccaactaaatggacttccttgatcaacaacatcgcaaattcaagcatatcaggtcgcatatgagttatgtcccaacttccaattgcgaaatggtatagtaggtgagatgatacctctagcaaaggatcgaggaatggcagcagattactttaggcttcaatatcttaatctctgtcccctgtaactggataagttttttcaaatttgcttttagcgatcaatctcttcctaaattttactcgtgtactaatggtcaagaggaggcaaaggcttagagcattgtaacaaatacgtaggtaagcaaaatatcagagcaccttgtagtcaagcatcggccatacgtccttcctcttttcaacttatttattgaaataatgtaatggattaattgctccacgcttcgcaaaatacatttttgaaaaaaaaaaacctttgtcaattgcattgcttagacaacttattttaagttattaatttattaaaatttgataacatatttaatccatccctataatcaagtaaataaccagtgaaaataatcttgacaacaatctaattcaagcagggctggtcatgtttacacgcttaccaagctcttaaataatgcatttgatgcaaatattttctatatataattttcctgatatactttttaaagtaacttttcataccaaacaaacatgtgatgtcgctcattcacctttatttgttaatttgatgacttaatgcactaaccatctggctcatgccattacatgtgcatagatgcattgtgtttgcatatagaatatatttaaaaagtgcctagatgttgacacaaaacaacaacaaaatacaaggcactgtgcctcagctgtttgactaatgcactattctcgctagagttttggttgcacacattttctgtaggttgatttccttcgtgatttccccatatctcttatgcaaataacataaacaagcataggagcaagtgaataagtagatctactgtcaccccattcgcatgttgtagtggcaagcacaaggaagttagaaagcaggcaacttttatcatacacacaagcatgcaacttcagtaatagccatcgctagccgtggtgggatggcacacttagatgatctgtggcgagaaagtggaaaatcctatggtggatgcggtgagccttagtgaaggtggaggaagtagggtgaagtcggcgagccacaaatctagtggggaaaggaggcgagtaagacgaaaaactacattggtgctagccatttcggcttccaactggcgaacacaagacaatactcgaccactactagacttaaagatttcaactacttggatccaactttttaatatgtgaatatgtttacataggcagatgtctttagaaaccgcatgtgagaacggtttacacatgtgcttgcctttgaaaatatgtgtaggtaaaggtgaggacctacttgtcccgtggatagttcaatataattacatagacgtacaacctaactaactgcatgtaaaaatgtttttcacaagcggctgtctgaagatgccatcagtgataacaattgttattctttttttgaaaattaatagaaaacctataggaacttgattgaaaggctccaattctcatgccggtcaaaagcgcctaataaagttatgttccattatgggaaatactaatagtaaaattattactaatgtgttctaattcctgtgcttctctattttttttcttgaacataatatagactcatctactaccaatttattatggggtaccccaacacttgttcatatcctttcactcttgatctacgtagaaccatacttatgactttcatcacaacaaccaatattagtgttctttttttttaaaacacatcaactttgttaagcaagagcagaattaggggataaaccccattacataaccaaggataaaagctgaaagcaaaagagccacccctgagaagggagggttaactgaactacgaaatcaatcttcctgaaataacctaatagcagaaaaaggagcaagtcgatagggatctccggcgaagccgcgacgactgctaccctgggcctcaaaaaatgtgcactccgcttgacaaaccgttaatccccatcagctgcctccacggaaccggcacaagaccgaggtttgttgctgagccgtagattttggtgtgtgcatcactggactcagcgaaggatccccacgaggctcatcattgaatctgaggagctctaacatcaaccctgtcaactgaaattgcgcagatggttcgagctcaacccgaatgacaaacccagcatggtttcttctgttagggaacaacaggaagggtgaatccgaagagcagccaaccttcaacgatggagcacttgaatggctgcaaatcaacttgtcttgctgagatgatggagatggttgaggaagagatggcctgcaccatgaaactggaagcaacgagaaagggtgagctgcaactggaagcaacgacgcaggagacggccctcgcgccgccaccgtcgtcgggggccgcgtccgcgccgcagccgccgctgaggactggatccgtgctgccgccgtcgccacgggccgcgtccgcgccgtcgccgtcacgtcgggccgcaaccacatcgtcgccgccgccgcggacctgatccgcgccgccgctgccaccgcggactggatccgcaccgccgccgtcacatcgggccgcaaccacgtcgtcgccgccgccgcggaactgatccgcgccgccgctgccgccacggactggatctgcgcggccgccgtcgcctcgggtcgtatccgcgtcgccatcgcagttgcgagcagtaacctcgtcgcctccaccgtcgctggtcacaatcgcgtcgccgccgccatctccaacttccatcgcctcactaacgagaagaaaacgggaagaacccgacctaacgagactagcccgactacgtaactactatgggggagggggcacgacccctctccctcccgccgccggcgacgaggtcgccggaatcgaggaggaagaggggtcgagggtggggaatttactgtagcaagaaagggttcgagaggttcggtctcgtgtagatctgagcttatattagtgttctacactttggtataactgatcgactagcaacaaccacactgtactgtatgcgtctgaactctctaatttcttggaagaaagttacaagcagtagaaatgggaggcaacaggatatgtactaccaccatctcaccagcacactgcactgggtcgagcactttgggagaaacatctgatgtggtcttcacgtgatagcagtgatgtcgaatgctttaacaagttatagcggatagcattccatcagactcaagcacaggaacataagtgcaaatcaagtagaaagctctttgttgaaaaaaaaactagtcacaacaaatcgatcataagttaaggaaggaactaagtttcagagattgtgtctgatacaatgaattcaatatttcttgatatgaccaataatatagaataaaatcaaggactgacgaagttttgtaaactcagtatatggactttttattaatttctgtctctgctatatgtatcaacttgatttgataaaaaaaaaagcaatgtttggaacttggaagttctaattgcctcaatgactatatcctagaaaatagttttgtgctctcaacattgaattgtgagtccttttatccatacctatatttcgaggtttgttgtagttaactgtttaatgtcatacacaaatccctatatatccaacattaacgtcgacttccatgtcaaacacataattgatcttttttaagaactattaagcagtcaactgcaaaacgtaactggtataaatgagatcaaaatcaaaatatatgggcatagaagtaagtgagaaaaactcagacacacaatggatcaactgaaaaattaccactagtggggaactggtcatttatgtcaggcgataaccctcaactgtgtcgacggagggcatggtcactggtgagtggtcattgatgagcagatatttgctcctctaaccctcccacccaaagtaggaacaatacgctgggttgtgataactatttcagttgacagtcagttaacaggactccgtaaaaatgactatagtcctctttgatgggcactatcctctttgatatcatccggtgtgcttgtggcccgtcacagatgacctgtgtcgggccacatatgtagcctgccacaggcgatgtgtacggcattgaggaccaatcttcaacgtggatttttttgttctctccggtgagcgcatctgtgatggcccgttcacggtgcaaagttcatatctaatgaactcatatgtatgcaaagttaaacaaattatccagattaactacaaatctattccattatcactagggaagtgctgacatatgttgatatatgttagatcatcattaagtctttgcagttaaactcatcagaaaatgaaaacgttaacggagataatagagtctgggccaaccctgggccaacataaacagaaagcctcgccttttatattcctgtaaactgcaagtgagcatgtagtagtaataacagagaatcaaagcagtggttgtatcaaaacttacggtttgccaccagaaacgacatcatcttttctcttatgcttatgcttatcagccaaaatttgaattttcagctttaaatttggagttgattttagggtttttttcatcgaagtttatttttcagcctttgcttttagatcactaagaatacgtatataaaagttttatttacaaattatttttcatttgtaaatatgttgttttgcttattccacgaataagcgaaacgatgggaccgtttttctccaccatatcgaatcgtaatgatgaccactcagggctgaggtactccctccgtcccataatagaaaagattttgggtggatgtgacacatcctagtataatgaatctggacacctgtcacatccacataaaattccttatattatggaacggagggagtacgtatgtccggatctattatactaggatgtgtcacatccacataaaatcccttatattatgggacggagggaatacatactagtaatagttattcactcgagatgaagtgatatctataaataaaaacactcgaatttgcattgcatgacacttttagagctgttagtgcacataaacctggtgctgtccttttgggaggcaaaaatcgatgtagtctcctactagatcgcttgtaggtatgggaggcactggaaaccattcagccgcctcggattcctctgttgggtgattctatgcttaacgaccatcgaactagcaatctccgaggcagtgcagcgagtccgattgccactgtttttcccatacgaagccggtgcatcaccctcgtgctcaagcatcgtgcaccagaggccctccgctgcaacacgcgatgcagcgttcaagcgatcaagcacacgctgcaatgccccaggagatgccctagcattggctcggcgcggcgttttctctcatgtgcccactgccctggattgtcgatcagcttagttggacttctcagcttaaggattgttttagccgccactgctgagctgaaggcttcaacaaaattttaatatgcttagtacaagtgtggttgttagcatcaaaagaaaccactgtttgggaacgacataaacttttagatagttttgatacaaagctattgaacctaacaaactgctttatacgtggttctactatatcaagtgagtaaattggaggccatctcaagaaacggaatagaaaattaaaattaaacagtgcagcagaaggcaaataaattactctaaatttgactaaccccacttcgtagctagcaaaggtttcatttcataccaaaccctctggttttatagtaatctctatgttatgtctaattgcattgacagtttttgaaatgaaccaaacgttcatcggttcaggcccattttcttttaaccaggtctacagtc

SEQ ID NO: 70642 - DNA, 2180 bp, Oryza sativa
aaagagcttcgtcgagatctttttaaaaaggagtacattaaatttgagatgaaacctgaagaagctttggatgactatctttctaggtttaataaaattttaagtgatcttagatctgttgattcttcttatgatgctaattatccacaatttgagatttctcgtcactttttgaatggtctcgacatgtctatttgggagatgaaagttacatctattcaggagtctgttaacatgtctactttgactttggattcactttatactaaattgaaaacacatgagatgaatgttctttctcgcaaagttgattctaaatcaagtgctttggtttcttcttcttcttctttggatgttgatgcttcttcatctaagtcgtcttttcttgctgtttttaatgccacatccgatgatcaactcgaacaaatcgaggaggaggatttggctttggttgctaaccgtattgctcgagctatgaataatgccaggaacaggaaaagaggtggttcaaatcgttgctttgaatatggttcaattgatcatcttcgttcgcattgtcctaagcttgggagaggcaaaagagaagacaaagatggtgagaagaccaacaaacaacaagcccaacaacaacaagtcgaagggttctatccaagggaggaagacggagaatcttaggaaggcttttcaacaagtttgcgccgccttcgagccactaagtgatgtagatggtgaaagtggagatgatgacaagggaaagaacgtctccgatatttgcttcatggcgcgtggtgaatctgacacagagtatgaagataatgaggtgagtgcttttgaggaagctattaatattctgagtgcaaaaaataaaaagtgtgagaagatgtataaaaaacaagaatttatcattgaatctcttaaatctgaaattgataggttaaaatcttttattcctaatgatgatgattgtgaaaattgtgaggttttaatgaatgagatttcaaaaattagagatgttaatgttgcacatgatttgaaaaataaatcttctcttgcttgtagttttgctttgcacacacgcactttggatgagttgtttttaaccaaaaagttgttgcaaaaatatcaaattgcttttcatgctagtttgatgtttagcatgatttctgctaaaaagttaaaacaacctcatgatgttttggattgctcaacgtgtaatttgaataagatgaaactaaaagatgctttaggtcgtgttgagtacatggaagatgttgtgaaaaacaatgaagtgctttcttgccctaaatgtcgtaaaagcaaaggtgtcatggtagattgtgaaaattgtgctaatttggaaaaaaatggtttcttatttgaaaaattctttgctaagattttctgatggtaaaaagaacctcaacatgattttggatcaatcaaaggttagcacacataaccatggtttaggttttaatccttatgctcataattctagacatcctcctgttgtgttatgtgttggtgctagaagtggtgagattttaattaaacatgataataataaaattgtgtttaaatctgctggtatcatgtctactatgaatgcatcttcttcaaaatataatgttgtgcatgcaaaacctcatgtttctaattgtgttgctaaatcttctaattctaacaatgtgtctaaacaacgtgaaaaatatatttgttctttttgtggaaaagatggacatattggtttttgtttcagattagctcatgaacagaaaaaggagagagagattgcttttgcaaaatcaaagtggcaaaaatcgggatttccctcgaggaaaccggtcagaccgcagtgggtcccgcagtcagaccggcgaccggtcagaccggctgaacagcctcggtcagaccggcagtacaggagcggtcagaccggcccccagtcagaccggccactgtacctcggtcagaccggcctcggaggaatttttctaaaaattcaaaattgattttgcacgtggatatatgcctattggatcttctggtcgtgtgtctcagtactggattcctaaatttttattatcatctaacctcagtactgaggcttcgacttctgcttgtgtgtaggctttggtggcaaggaaggagaacgtgtggatcgtggattccggttgttc

SEQ ID NO: 70643 - DNA, 4615 bp, Oryza sativa
attcacttgatcgaaaataaatattagaccattataatatcagaaaatatcatgaattaatttgtatagtgtacaaaaagtagtttttacaatagtataggaaattactccatccgttattccatagagaatgttactgtaagattcaaaattattactctggatactaatataattcctgtcaattacctctctttttttttcttccaacacccaaccactctgccactcctgagttaggagtcataaccttacatcatttaacaagcgaaaatatagtacgtagtatttcttttctcaaaccttaatctctactaaaaaatactccctccggcccaaaataagtgtagttttgcactattcacgtttaacatttgaccgttcgtcttatttgaaaaatttttatgattagtatttttattgctaatagatgataaaacatgaatagtactttatgtgtgactaaatattttttaaattttcacaaatttttcaaataagacggacggtcaaacgttgagcacggatatccacggctgcacttattttgggacggaggtagtatataataacttttctaaaacatatgaagtattttacatgtgcttaaaaaaagtcataaatttatccttagtaaaagcaattctatatcagagtatcggtttcacattctctaccacaatgaataatgatactatcattatagacactgacatgtggggtaataggaaggtaaaactcacattaggggcagagctaaaacgagatgcacggagaaggtgccacttgtttaatttgctctgcttaatttatatcaagtttaaactaatgcgagtgtttaaatttgtattgaagggggtgcacatatggttgaaatagatcaggtatagctacaaatttatcttgattgagttcttgggcaccccctcaatgctctagctccgcccctactcatatactagtgattgtaatggtataagtgatattatgtagaggatcctcaaccccattcaccacgtttttaaacaaaaaaactagtccaagctttctcatccttatccacccatattctcatccacccgatcgctccgccttcgtcgccattcttcttttcgcgggcgccgggtaagcgccttacgcttcgaccatgccggcgtgacgccagcctgtctctttgacgtcgtcgtcgtccccaccatcggcgcttccttctccaccaccgacgcccacgccgtcagcagtggtgatgacgacgcgcgcaggcgctcgtgccgcttcactcacctttgtctccctctcccctccactcactctctctctctccctccctctctctttctctctcgggagaaggctgagaaggtggagatgaagccggccgagaggaaggggtcgtcatcgtcgtcgtctccggcggccgaggaggatgacgacggcgcggcctgattggcaagatcaccctcaagctccccaagccaggggtgatcggcgtctctctggcttgccgtcttcgtcggtattctcatcggctgggcatggcgcccacgctgggctatcgccgttgtcggggacaacgaacagccgccgccggtcacccctgctctgcctccatcgcacgtcgccgaggacttttggccggacatcaccaccttctgcgtccgcgccacaaccttctccatcaggtatcagtcgtgatacctcagtatctggcctagtatccacaagtattaggcatggtacccaggtaccaaagtttgtgatacctaggtaccagtcggttctaaggtactaggtaccaggtacccaggtaccaaagtctatgatacctaggtaccagccggtaccaagataccaggtaccatctaccagtcaatacccagtaccaaaggtaccaggtaccagctggtactcaaagtactaggtgctagtggaacgcacctggaagctcacggaaagaaagtaaaatatcccgttctaacgggatcccgttctgtagtctccctctttttaaactatgtgctttacctaaaattaaagttatcttttttttaaggcgaagtgagtattccacaaacaaatattttttttccattctctcactgtaggttattatgggcttatggcagtttgtacccctactatagacagccaacaatccagccagccacgtcgccacgtccgtgttcgtgcctgtgcgtggtagcgcagcggatggattggtggatgatggggccgtggggtgatggaccagcggtcaataagtgcggtcggtggggtacgcttcggatgcgatgaagaaaaccacacatggcgatccacgacgacgacgacggtcggcacggaccaaacccgcccgactgattggtgatttggtggaccggggctccagcctccatcaccttggagtagctgtagctagcagcggctacagcagccaaacggccggcgtacgtttccagcgcaagaaaaaccgagagagcagcgtgggacgggacgggacgggagctgggggagaaacggaggacaccgagaggcggaggagaacgaaaacgagaggcgcgggcgcccccccgttttgtttttgtctagctcgctcgctcgcgcacgcagcacgtacgcagccaagccaacgactggtgccacacgggcgcgcgacacgcgctcacccccacccacttggcctgttggccatcgccattcgccgcactcgcgacacgacgaggggatccgtcctgaccgggagtgaaaaggagggctgaaagttttttttcgcttgcaatgtagcgagcccggcagtacataggacggtaggagtatatacacgtccgttttttttttgttttataatggaacgaatctcggctctttgctttaaaagaagttacattcatttattacattctctcaatgagtaaacattcagttaacttcataatgactgattgaaaaacatcaacactaaaaatggaaaaaaaattattgaaatcttttgtaaatcttcatccgaaattaatgaaaatctacttgtaacttgtaagcttcaacatgcagcatatattagctccatattctcttcatatttttgaagttgtgtctaaagtcggaacagtgcattgctcggaaatgagatgaaattcgatgatatgtatgaatcctcctcgcgcactgaaatgttggatggtaatacacaacttgaactagagaaatcgtgtacaacttgcttattttgtatgttaataattattcttttggagcatagccgatgtttttccggtgcttgaaaggtactagaggtccgagtgtcaatagttggaaaatacccctatggcaatgtttggctaatgggaaatggaaatgatttcccacccataaaaagacatctttaaatcttaactattcattctccctctttcatttaattctaacccttcattcatttcctaattccaatctcatcctccatttttcgttatccaaacacaccctatgtattgatacttttcgatgatgcacaattcctatctttttttttcgtttgcatagacatataatctcgtatgtattatgaattaatttattcggtgtattacgttattattattttttgaacatgctaaatgtttagacacgggcagataaacctgcaaaatggcataaatcttatggtgtacatcatgctatataccgcaatcatggaacaaagacaaaatgtctatattgtactccctccgtttcacaatgtaagtcattctagcacatttctcatatttatattgatgttgatgtatctagacatatatatctatttagattcatcaacatcaatatgaatgtggaaaatgataaaatgatttacattgtgaaacggatgaagtactggttgtcacactataccatcacaccaatcaagcgaagcttgcatcaacgatgatttaaattttacaaaaaaagagagagaataatttgtattcattagccatttcatctaaaagtttaagctgaccgagaaagtctggtaaatatccactcgtatttcaacaaattatttaaacaaagtctctatttgaaaaacatcaacattcaaaaaggggaaaaataattattgaagtctctacgcgctaggtcgctgtcttgttaatcgatcgaattgaataacgtatcaacaaatttcttcgactcaggcaagcaccaagcagatatcaacccaaatcgatcgcatgtcgtcacacacaatctcctttcaccatcttcacgtcattcaggacaggataccacaccgtgcgtatcacgcatttgatatgcgagtgcgctaatatacactcccagtccgatcgatttggcagaggaaatttcatactttcacatacgtgagtctgcctaattgctctccgaatgatctaattgaccaaacgacgagacgagtagtccccggagcgccgctcacgctacaggacgggaaggcggcagccggaagccgcaacgaagccggaaaccgttgagggccctttgaatcaaagatttatatagaaatttaataggatttaaatcctatagaaaattttcctatttgaccctttgattcaaaggattgaagctttctaaatcctacgaaatt

SEQ ID NO: 70644 - DNA, 1797 bp, Oryza sativa
catgtggtggggaatgagtgagcaggaaaaatggaatggccactgccaaattatggccattggattcatcacagttgactgctagaatggcaaatactgcctactactcctacatcaaggcatggatgaacatacattgaattttacaagtgtttgattgatgccaatcttgcaaccgtatcagcactgcatcctcttttttattccgaattatcaacaacgggtcgttgctttacattttacaactggtgcaccgcccttcttttttaaaaaataaatgcatgtagaatttgagacactgtcagtgcaaaagtaagacacccaaggagaaccacaccaggtaaaaaggtagaaaatccacttgtgagaacaaaaaaaaaaacaattttaactccaaaatactcctacctttgaatgcgatgcacttgaagcagcatcaggattaagctaagcacagaggaggagtactggagtacagtaccattttgcaggccgggtctccctgacatcaactttggagtacgccaaggaggatgaacaaaagaaaagaagcacagccttttgccgaagcatttgatcctgccctcacctcgaaatccgtgccgccccccgcttctcttttgcaattcgctgacacccaagtcagcaatggcggccaaatcgcgctccggcacggccgccgacgagtccgcatctcgaggcgccgagtatcccggcgatctagctttgctttggcttcgattcgagccggcggaaaagccaatcctccgtgccggccatcgccggcggccggtctctcgcctgaagcaggagggccgaagtgatggcgcacctcacctcgccgtggagcaacggcatcaccaccgcgcgcggcctcacggatcgatcgatcgatcgatctcatggcgccgcgcacccggagacctcttccctcgccatcgccggcggcggcggctgacgcactactcccaccaccgtcaccgacaccacctagccgacgatctcaccgggaggccgcgcgccatggcggtagaggggggaggcgagagcgaaaaaaaatgtcacaaactctgaggcggaggaggaggagtggccacgtgatgcccgcgtggctttttataacgggctcacacttgtcgcgtgtcgctttgcaccccttgctttctatgctcatctttttttttttgttatttaaagcgaaagcggcgttgttgattgttgaacggccacatcgagcggtttcctgcgcggctttcttttcttttatttttctttctttctccggtgatgatctttgaacggtcccagaggtgcttgtacctttggaattggttgttttcagtatgtgattaaataagtaatcatgtcatcactatgacagtgtgtttggaaggttttagtgtgcatttcttagtggaaaatcttgccaatttgtgaatggcagcagtgaaagaaagcaagccactcgattttctggatgtatattactagtaagaaagaaggtagatcaaatatttataaaaaatatttataaaaatatttatatcatgactaaaaagttaatttaaagcatgtataagcttttcaagaacaatttcaagattttcgtgcaagataactcaatccttatggccttgaaattgttttatccattagtcctaaaatatagcaattttgtctagatgactagattcatagctcaaatgattaattttaaaacatgggaaatataatatataatagtacaactactccctccgtactcataaaggaagtcgttttggacagcgacacggt

SEQ ID NO: 70645 - DNA, 2636 bp, Oryza sativa
cccggatccggtccatcctcagatctgagacatgcgccccccgatcttcctccaaaatcccctcctctcctccccggattcctcccccaaacctcaccaccaaacaccacaagatccaaccaaaatcaaaatcactccgctaagattagagagaccctcttcctctcgctacaaatcccctctctctctctctaggctactcctactactctggctctcctctcctctcctctcctcctcagctatggtggtggcctcctcttcttctcgccgctgctctctcgtcttgtggcctcctcctccccctctctgccttggccttccgtctggctcgctttctaggcaacccgctcgcctcatcctcgttttgtcgcttgccacccccccccccccccttcatccccgcatcggacggcccggatacgcgcgcccggcgatcccgcatccgacggccacgggctcgcgttgcgccaccgtggcgggcaccgccgccctcggatcggggcagggagggggggcccacacgcggggggtccgagagcgacgctaccaccgaacccccgcgcaataaaatctctttttcttaccgtaaagcatgggccagaaaccgacacgtggcgggtgcccgcgggcgggaaaaatctaagcgtcgacccgcagtaggaggtgggtggtggatggggaaaaaggatccccatttagccccctaaaaaaaaatactaaaataattctggtatattttaataaaatcagcactaaaataatattatgccttattttatatgaatttaatattggctcgttgtccgcttttggtgggacccacttgtggggccatgtagatggtcctgatctggacagtggggagggcgggggggtttaccggggctgacgtggcacggcgtcgcaccggttgctgcgcttgtgttaaaagggcggaaagtctccaggcaagcattaacggtggggcccacgaaccggacgtagcctccctcacccctcttcgctttttctactcgtgggcgccgacgtggcagtgcgatgacgtcacgtgggcgcccactagccaccaaccttcacagcactactctcactcgcactatttctgaaatactaatgctatttattaatttattatgccgaatataaaattcgataaaaatactgttttaatttcgaaaattggtcaattttaggagtattctagtcagctccgccatcattcatcaatccagcaaggggatcgagaagaagccatcacttgcaactaaaatattcgatctactcactaaattaagcaaagaaacctgaatacggagtaccaatagagttaatctttgctgcggtattcggaatccgaatgggtacttctaccattttctactagtgacgtacttggttcgtgcaagctcttatttaaatgaaaagaatcacgtgcgtcgtcaccagtagttttggcttaacaccgagggttaattcttcatgcgtctacgtggacagatttaaccacaaatataataattagacatacttcctatatctcataaaatataaatttagaactagatgtaacaaattatagtacaataaatctaaatatatatatgtcaggattcataataataggatatgtcacattcagtactacattgatttttcatgcgatggaggaagtacgtactatattggttttgatggacggagtgagtacttcagaaattccccggtcttttggagaattgtgttttattatgtggatagtagaaaaaaaatctactagcaatagcattagcagttactccactaatgacgctagttaaccagccagattaggtgttaatcccgctcattaaccattttaacccccggctggtggtggacgcttcacgcggggcaacacgtggtctcggtccaccataggctgtcgtgcaccaccggagggggaaaaaggcggaggaggatgtggtggggcccacgcggcaggataagccatgatatttttttcaattttctttttctcttttttccccgcgcgggaggagagagacgtgaaggagagaaaaaaaaaggaaaagaaaaggcgagtggcgcacagacccgcgtgtacttttccctgttcgccagccagtgacacgtgggcccaacgtacggcggggcccggtcggcgatttattttcatttatttattatattaattatatgtttttccacgggggagacggggggtgggggtgtctggttcgttcgggagtgggaaaagcgtgtggtggagtggtaggggggggaccacatgcaactcacgtgagccccggatgttgacaaggaggcacgtggttgtaggcctcgcgacccctctcacatgggattgtctgcgctcagccgggggtaaaaaactgcacccatctttgattatttaccgtttatggtttttttaacaagcgtgtaaattatggcattttaagatttttattaaaatgttttaaattagtactatatggtagtacagtgaacactccgcatgtggtggggaatgagtgagcaggaaaaatggaatggccactgccaaattatggccattggattcatcacagttgactgctagaatggcaaatactgcctactactcctacatcaag

SEQ ID NO: 70646 - DNA, 8875 bp, Oryza sativa
caagttaccgaatgttactagttactacttactatttcctccgtttcacaatgtaagtcattctagcatttctcacattcgtattgatgttaatgaatctagacacgaatgtgaaaaatactagaatgacttacattgtgaaacggagggagtactcgtgtattactttcgtccacaaatatttttttagctacatacattcacaaagtaacgagagctacattaggtttcatgtggtgaaacctattcatctaagttaaagttctaaatttaatatagacaagaaaaaactacccatacgttacaataagtgaaggctattttaatatattattgttagaatttttgtctaaaaaatatatgggatttttattttgatagtattgatatctaatttggaacccttattaagatgatggtcatatcatgtacgcctgacgagaattctaaagcaattaagaatcagactcccatcctaggtttgcatgtgagtttttttaaaaaagatttcttatatgactccttatatattttcaaaagcgaacaaacttagaaaccaagtcaaatacgaataacatgctaaagtatcagcgaaaatatttttaatttttataataatggagaagagatagagataccaataccgaaagagaaaatgaggggaaaagagaagagattgaaagaagagggagagaattaggattatcgggaaaaagaaaaagagaaaagagtaaaaaaaaagacagtcaagggaagagcacatgacttcgagtggatgcacgcgggatggtacgggtcgattgggttgtgttgggctaggagagggatgggtgggattaggctggggaggaggtgtacagtactccatccatctacttttgataggtatatttccaaatctgaaaaatttacttttgaaatgcatattttaatccaaccacctatcatcttaatgactttctcggatttaatgcgtgactttccattctttcacataagactggttacatgggcatcaagaaatataaatattaatgaatcgattgtttacgatgaataactagtaacatgtttaaatggatgataagtagaattacttatccttggtcattgtgtgaaatatgactataaaaagtagatggatggagtagttattttaggctcgagctgaactggatgcggacgacgtacaacctagacaccgataacgaaataaaattccgacaaaaacatcttcaaattttataatagtagatatatgatatgctctcatttacacataaacttttaagtaattttaagtttagataacatatctgttaatatctgttaacagtgaggtgtttatggtaatttcgtcaaatttaaaatatatccatttagtttcttacaagtgctaataatgtgtccctgtattcacaggggattagtatgcacacatgtatatgaatttgaatatctattgtattgtgcttgtatgagaaaaagacgcatggtcgtgtcgcttgtatgagtatacgtcttttaccctttccacgcgcggagcttcgctagctgtattccggctgtacaacgttggacgcacggccaggggaagaagagtgtagaacacgcggtgcatgcgatgcgatgcgatgagctcactcgaaccgcgaccgatcgaaacgaccgcgcgcatgacgatgacgtgcacgcacgtagcaatcagtcaaacacagccaccaaaaaaaatcacagcataatccaaaattcgtcttgcttaatttatgcctctactttgcattactttacagcctgtgaaagtgagaacgaatgtttttgtcacctgcatgccgctgatatttgacgcggccaaaacacacccgtctgccaaaataaaaccacacgtttttccctctacgaaatactacaaccgtccaaaaatactcaacttaaaagaggatgtaacctcttctgatacaatgtatttagacaaaaagctatccagattcattatactaagagcaagtttaatagtatagccaactaatagctccaatttatctatagctaatctagtagctcatttatacaatagttacgtactacactattaatacctggtctcacctgtcatacacatattgcgtctcgaagtccgtgctatagctggctacaaatgtatagcccgctgctcttctctctccttatttatcttattaaaatatgtttgcagctggtttataatctgctattgtacctgcttaaaagacgtggttgagtttttttaagaacgaaaagagtactaatcaggaaatttgaatttggttgtgacaagaaaaggatcttgttatcaagggtagacgtcatgagattgagaaggatcacgacatgtaaactccatgtcagtgactcggtcgcaatttcgcagtgcttaggtggtctttgaatttagggatttaactttagttttttatttagacactaatttagagtattaaatatagactatttagagaactaattacataaatgaaagctaatttgggagacaaattttttaagtctaattaattcataattagagaatgttttactgtagcattatattctaatcatggattaattaggcttaatagattcgtctcgcgaattagtccaaaattatggatgggttttattaatagtctatgttaatatttataattagtgtccaaacatttgatgtgataggaacttaaaagtttatagtcccatctaaacagggttagactatagattttgcagggggccagtgctggatacaacggaggaaacaaacaaagggaagagatggcaggaggtagtagtagcaaggatcctctgtaacaaccatatctacaacgatcgttgcagattcgactataatttgactggccccagcaggcaatggatgctccgagtggaggagcagggagttgcaatcatgactaagagaaagctaataggatttgtcaagtttgaagattttcgaaagagatgtcaagtatatatgaaaggcaatactgcaaaaatctaaaaatgtgccaaattaaggtggtacattctctcatacaatttatgcaatatctgatcaaataaagctcgaactctaagtagccgatgtattagaagattggaacccttgatggatttccctttcgatataatttggttaacagaatttaggtcgaatgtccataatctcctaaccttagagcatctgtagtgtgaacaaaaaatcgattttacgacaggagaaccaaatcatgcacattgtagctgtcgaaccgtaggtgtcaaacaacaaatcgaactccacattggagtcgaactgaaagagtaaattaatatactgtgcatgcatgcaggtacggttccagtgattggctcattccctttttacagatcccacaaaacaattttaacattatagctatcaaactgaaattttgtttggctcttctattagattgatcaaaccaaacactacagatgcccccagtgcctttgccaactgttagataagtgtagaattttgctttcacttttgaaatggaagtacactaatatatttgggaaatacaaagcataacttttaaaaaggccaaatgcgttttacactaaacttagctggtgctctgctccgctcacagaaggtgggtacgcagaagatcattgcggcagggaagtagtagtaggtcatggtcaaccttaaccataccctaccatgacagcagcagcccaggcccatcaatcgcccacagcccctgcaggcccgggcccactcgagcagaggggcactgtgaaaaaggcccagtcggccccaccacgtcatggggcgccatgcacgcaccggtcagacgacgcggttgtcggcctggccggggtgcccagccacgtgggcagcccgcgcgctaccgacagcggccgtgacccgcggggcccggcggcgcgcgctctcgcgcgcgcgcgacgtcgtcgagaccgcgacgccgaccgatggcgagcgcgcccgcgcccccgccccgcgcgcgcgccgcgccagccaccatgcgacgacgtcgtacacgcacagcgcgccgcgggcgcgagcgcgcgcgctctgcagcgtcgccgccgccgaacgccatgccgatcgatgccgccgggcgcgcacgcgcgcgcgcgtcaccattgtgatcatggcgcgcgcgacgtgacggcgacacaagccaatccatcgctagcgactcgcttagtactattaattactccactaactagcggcatgtacaagaagcggtaggagaaatatcgtgtttctgtctaatcttttctgtggttgtacgcttgtttaatcctccttttcgtaggagttaatgacgatagggctcgatcagagaataaaaattgggttggtgcgctgatcactttcgcggcgagtgttgctgacttgcagcaacgcgcgccacttgccgccgttcggttggcctccgcggcgggggatgataataatggataatgctttatgcgagatacggctctgttggttttgcatttctttttcgttagggtggtgagtgcaccggagccaataaacaggtttaggtggaggactcgtgtttttttttaaagctcagccatacgcccatacgataattatttcatttgttcttttagatgtgcctactagttcgtgctagtaatctatagagcacttcaggactagatagcgagaaatctgttttaagagatcaacacgacacccctttgcatgcgaccttgggcgagtggctagctaagcttggactggttcctaagattgccactaaaaacatgtgtcaaatggttgactgaatatatatgtaaggtgtcagacttgtctcaagatataatggtgatgagatccttttgggacgcacctgatcgattctatgaatggactacaactcttttgaagtagcagatcatactagtgagcaaacgcttaataatgtcactcattccctccgtctcagaaaatacaatctaagataggaactgttatatatcctcggacaaccaatcaagacaagcacttaatccagattcgttgttcttgaatgcgtcacattctattctaagttaggttttttttatggagaaagtactttagattataaacaaaacgtatataatgattgagacagctatgtaatatcatttatgtacacagccacatcaactaagaacaaataaaaatggcatgtacaagagacaatatgatatctaatgtcactcctctcaactgtttccttgtaccctatattatctgagatgcctctttgcaaagatacatctcctttctcttctttctttatccatcgacacttcattaattaattgcaatgagtcatatggggtggggggtgggggggggatggaggaactaagaccaattaaggactaaaaatatctagcagtagctggtctagagctgattactggttaccaaacgatgaattcagattttaaaaattcgactattatggataacctattcgatttttatattactgcaatgttttccctccaactcgtaattcataaatagtagggctggccagccagttggcaattgggagtccaactcagaagacaatattgtgcataattcagttggcaattgtccggttaattttattagtaggacaaattcgttatgccagtggcacctagttcggtaacaaattttggtgttattgtagaggttggatatagcgttttcatatcaaacactcaaaagtagtttagaggttttcccctgtgtggatattatgggtaccccatacccatacggcatggttatccgaccagtcataggggataacttatatctatagaatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcagatctataatacacccggcggattcaaatccccaaacaggagtagggtattacctctcattgagagggcccgaacctgtctaaatcctttgtctccacatccatccacttttaggtctcgtgcgctaccccgttttattattgccgaaatcatgtttcgacagttggcgcgccaggtaggggttgcgtcgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcctccgtcgccgccgactggtgtcatcgcctatacggttggtcggtcacaccaccgttgatgggcatcgtcatctacaccgccggcttgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgctgctgttgggcgtctacgacttcaccgccggcccgcctccgtcgccgccgagtggtgcctccgcctacacggctggcctattatgccgccgctgttgggcgtctacgacttcaccgccggcccgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgtccccgcctatacggtcggttggtcacaccaccgttgatgggcatcgtcatcttcaccgccggcctgcctccgtcgccgccgattggtgcctccgcctacacggctggcctattatgccgccgttgttggatgtctacatcctcaccgttggctcaccttcgttgccgtcgactggtgtttccgcttacacggctgacctattataccgccattagtgggcatcttcgctttcaccgtcgaccgccttcgtcgccgccgactggtgtcttcattattattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctaacacccgggggctcgttggatggaccgagtaacgcaaggtgctaagtattactcggaagaaatcaaaagcatagagataatataatttattttctgctcttaataattgcaaaagtacctgagtagtaaattctgatccgtgaaactttgttccattaatgacgaactcatgtcactcatatgcatgtttgggaaatgcctaggccgactcccgatgcttgggggctatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacaccaccaccggctcgcctcgaccgccgccgactggtgtttccgcctgcacggctggcttattatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggtgtctacgtcttcaccgaccggcttgcctttgccgccgccgactggtgtttctgcctgcacggctggcctttatgccgccgttgttgggcgtctacgtcttcaccgaccggccgcctcgtccgccgccgactggtgtttccgcctgcacggctggcctattatgctgccgttgttgggcgtctacgtcttcaccgaccggcttgccttcgccgccgccgactggtgcttccgcctgcacggctggcctttatgccgccgttgttgggtgtctacgtcttcaccgaccggcttgcctttgccgccgccgactggtgtttctgcctgcacggctggcctttatgccgccgttgttgggcgtctacgtctttaccgaccg

SEQ ID NO: 70647 - DNA, 9045 bp, Oryza sativa
accctcatgttctttttgagctctgctatttcaggatcacttgcttgagctatgcgaacctgctccaccagtgtgggctgtgcctctagggcagccacgaatccgtgctcaactataccaaggttcaaatgttccaaatcacgttgaacctcacagcatagttcctctacccatgcgacgttgcagtaactcttcctgctcaaggcatctgctaccacattagccttgcgggatgatagtgtatccccatatcataatctttaattagctccaaccatcttcgctgtcggagattcagatcaggttgggtgaagatgtactttagacttttgtgatctgtatatacctcacaacggttactgatgagatagtgccgccaaatctttaaagcatgaacgactgcggccaattccagatcgtgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaacttctattgcattcagcagaccagataaacttttcttccttcttcaatagctgtgtcattggcttagcaattttagagaagttctcaatgaaccggcggtaatagcccgcaagtcctaagaaactccgaacctgagtgactgtccttggtggggtccacttggtaattgactccacatttgctggatccacagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgataaaaaccacgacaaacttgtctagaaattccataaacaccttgttcatcaaattcatgaagaaggcaggtgcattagtgagtccgaaagacataaggtcgcattcgaacaacccgtaccgagtgatgaatgctgtctttggaatatcctcttcgcggatcctcaactggtgatagcctgatcgcaggtctatcttagagaacacagtagctcctttcaactgatcaaacagatcatcaatccttggcaaaggatacttgttcttgatggtgacctcattgagtgcgcggtagtcaacgcacattctcttggttttgtctttcttctccacaaagataaccggagcaccccaaggcgacgtgctcgggcggatgtatcccttctgtaactgttcatcaacttgcttcttgacttccgccaactcgttggctcccattctgtaaggcctcttgtggatcggtgcagttccaggtaccaagtcaatccggaactcgatatccctttttggtggcattgttgtcagatcatccggaaaaacctctggatactctctgactatgggaatatcctccaacttcttagtggttttctccactgctacctcttgttcttcaccagcagcctggtttaaactaatccctggcttccgcggcactggagactggaaagttaccacctctccttttgcattggtcaacttgatggtgcggctggcgcaatcaatcactcctctgtgccttgtcaaccaatccattccaagtatgacgtctaggtccttggattcgagaagaatgaggttggctggaaaaatcgacccttgaatttcaactgtcacagatgggcagtagtgagttgtggtcatgccacctccaggagtatgcactcgcattggtatcttaagcttcactaaagataacccatgtgcaccagcaaaacgcttggaaatgaaggaatgggttgcaccagaatcaaacaatactactgccggtgtcgagttgacggggaatgtgcccaatataacctctggtgctgactgcgcctcctctgcagatgcatgattgacacgggcctgaacggacttgggtccagcacgtcttggcttcgagcactttccaaccgtgtgtccgggtttgttacaattgaagcagagttcgggtttttctcccaacctcttgggctgttctggcagagctggctgaactgattgagctggaatctttagtgaactcggagtagggttgagactgtgctgctcactgttgttgtgactgccactatggtggttcttgttgaagctacccgggtggtagggacggtgctgtcggataatcatggtggaaggtccaccgttatgtcccatcgtgaaaccaggcttctgactcttcccctggggagtcctaaactaagctgccttcctcttacggtttattttgttaccgtactcctcctgacggatagccttatccaccagcttctcaaagtcctcataatctctagagatcaactggttagtcaattcatcatcaagaccagacaaaaacttctcctgcctctcggcatcagtacgcacgtcctcaggggcgtagcgcgcgaggcggttgaactcatgcaaatactctataactgttctggttccttgttgcagggaacggaactctctcttcttttgtgccacaattccctcgggaacctgtgctttattgaaactatgacgaaactctgtccaagtaacctctgccccagctggacgggtcaccatgtagttgtcccaccaaatagaagcgggaccttgtagctggtgtgtagcaaaagcaaccttctcctgctcgttgcattgcaaaagattcagcttcttctcaatggcatgaagccagtcgtgggcctcgattgggttggtggtgcttgagaaagtgggcggcttgacacgaagaaattctaacagtttggactgaggaggtggaggaccaaactgcaggttctgctgctgctgctgtgcttgccgctgcacctgttgcaacacctgatggtactggtgttgcatctgttgcatcattattgccatcatctgagtctgattgtccaacacctgagcgatcgttgggttctcgggcgggggggacggactgctattaggtgcattgctggcacgtggtccattgatctgctcttcgctgccactggcgttgttcgagtcgcgtgaaccattccttatctccatctgaaggggataggtagaaatatgagaaaaggaagaaaaacagggggctcaaaaactaatcttgcttatgaatttaagtgcaattatcttaatcttgattaaaacactgaaaaagaggcacgcaactcctaattgaggcagtcataccactgacacatgatatcgaccgccgactaacccacaagcaacaaacctaacacgaaacctagcaagcaaacagactaagaagccgataaagctaagggcggcgactttgaagctcggggcggcgcttgcaaacgagggataggactgacatctaaagtagacaagggataggaaccaattcatgctcaaatccaagttaaacaaagcaaaagaagactcaaataaatacccgagcatgatgatttttatgcatagaacatttttcatgaactcaaataaagacactaatgcaactaaacaataaattaatgcatagactagttgcatggaaaatgatgcgcataacattgcccccatcgaatatagacacgacctaatgcataccccaataaattcccgactgactgtcgaataaactccaactaaaatttttctaaagccctagactgagctaattttttttaaaaaaaaatccgatccgaataaatgaccaagatttttcccgcaaaccaaagaggcaaaactccaaattttcccaaaacaaatccaagtgaaaaagggcatatgcatatgaaaaggggttcagaaggctgttaggtgttccagttggcttgtcctacggtcaaggtcggctctgataccaacttgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcaccgggaaagataaaagcgagctaaaccgggaagcttgacttcagcagcgagcgactccactccacaggcaaaccttgacggcagcgacgaaacaaactttggcaaaacagctccaacaaggaagatcttcagctctggtgtgggggaaaaagagagcaagactgagtactacccactgtactcagcaagtcataccggaagaggaggtatgatgcaggatataaccaaaggaggctagaggttcttttgcataaagctagcatttaaaagcagtagttgaaggcagtaaaacagttgtagtaattaatcaatattaaccaatcactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacagcccaccattcagtgtattttaattaactgacacccatgcggtggcaccaatctaaagctatgctcatagtcaaagtctatgtaataatgtgatccccatttgtgtgctagttgaactaagcatggctaagcatttcctaggccaacatctagtcattttgatacccaagttatcaatggcatatggtaaacaataaatggctgagtaataggacccatcccacattacattgtaaaaggatgcaacatttaatagaaatgcgggatatttgtaaattgggtacaatatgatcaaacgtattgaatgacttgccttgctctcgcactgatgagacctcagcaacgtcttcgagaaaccgcggaacgacgaaacggccgaaacctacgcgacaaacagagcacacaagcaaacatgctataagactacagaaacaggaaacaaaaccatttttaatggattctttgcatttttcttgatttactgagacttgaatggacttaaacggagctcggatgaattacttatgaattttagaagataaactgtgtttttactaataaagaaaagtccttaatcactttattgcgcaataaagcccagggctgacgtcatccaaggggggggcggcgccgacaggtggggcccgcatgtcagcggttcaagagagaggaagggggcgccggcacgtgggccccattggcagcggcacaagggagggaggtggcggcggcatgctcggcatggctcaagccggccggccagccatggggcggcggccgaagacgacggcgcacgcgcggagggcggcggcgctcatgggagagagaggaaaggaaggaggagaggggattcctcaccttcgagcacggcggccggcgcgaaggaagaaagcggcggcgacgaccggtgatgcggaggcacggacgggcggcggcgacaccctaggagaagatggagaggcgttagggatggagaaagcgaccgcgacgaccaaaatggccggccggagatggaaacaatggcgagcacaccggcgacgcggggaaatcggagctccggcggtgattcgcggcaacgaagcggcggccgaggtagctctcgcggcggcgaagctaacggcggtggtgggttggcgcggcggcgaccctagcggcagtgacgcgcggccgaaggcgacggcaagcggcggcgctagcaacaagcggcgcgagcgcgataggaggcacgggagagcgcggcgaatgagggaaaacgaaagagggggctcgggagagtgcttttatgggcaagggaggggaggacgtggccgggaaccctcccgatttggccggcgacgtggggaggagagagagagagaggggtgggattcgaaatcgaatcccgccctctcgagcgcgcgcgcgggccgggagatgcgggggaagaggcggcgacgtggggaggacgcgggagcggcgcggcgtgggcgcgggaagagcggagaaggcggcggcgtggcgtattcggcggcggttgccgtcggaggcgggtggctggaggaaggggacgacctgacaggtgggccccacctgtcagcgtcccggagagagggggaaggagaacgggccggcccacaaggggaaggccgagcgggagagggatgggccgacggcccaacaaaggaaaaggagggaaaagaaaaaaaagaaaaaggattttcctgggattaaaattgcaccttggtgatttttaattggtaaaaattatttccaaggctctgaaaattccactaaaaatcctgttaatatattgtgacatgtggaacccaagaaaaaaatcccacaatgccaattccaattattaattgcatttattaattatggaattagctctaggttaattaagataatttcttcggacaaattatttaaccaatttttttaaagcaagaaaaaggggaaacttccgagcgtgacaaacctaccccccttaaacggaatctcgaccccgagattcggaagagctggcgaagaggtgcgggtgggtggccttcaactcatcttctctttcccaagtggcctctttctctgagtggtggctccactgaaccttgcagaatcttattactttgtttctggtccttctctcgctggtttcgaggatacgagtcggcttctccacatacgtcagatcttcctgaatttcgatgtgatcccggacttgcctgttcctcaggaactctcaaacatttcttcaactgagagacgtggaacacgttgtggatgccaagcatgttggagggaagctcgagctggtaagcaacttcacctctacgttccaagatcctgtatggtcccacaaagcgtggtgccaactttcctttggtttggaagcgatgtactcccctgagcggagtgacacggagatacacataatcccctgtttcgaaagcgagctcccttcggcggttgtctgcatagcttttctgccgagactgcgcgattctcaatctttccctaacagctctgactttctcttctgcctcatttaaaacttctgtaccaaacaattggcgttcccctgtctgatcccagaagagcggagtacgacattttcgtccatacagtgcttcaaatggtgccatctgcagactagcttggtaactgttgttgtacgagaactcagcatacggtaagcttttgtcccatgctccaccaaagtcaagcgcacatgctctcaacatatcctctagtatttgattgactcgctcagtctggccatctgtttgtggatggtaagcagtgctgaaattcaaccgggttcccaattcttcttgtaatttctgccagaactttgaagtgaattggcttcctcgatcagacacgatcttcttaggtacaccatgtaaacacataattcttgccagatagagttctgctaatttcttccctgagtaggtagtgtgcaccggaatgaagtgagccactttggtgagtcggtcaacgactatccaaatagaatcatgccccgatgacgtcctgggcaaaccggtgatgaaatccattccgatttcttcccactttcattctggaatctgaagtggctgtagcaaacctgctggcctttggtgttctgcctttactcgttaacagacgtcacagagtgctacgaactcagctatttcccttctcatgctgacccaccagaacttttctttgaggtcttggtacattttggtactgccgggatgaatggaatattgagtttgatgagcctcggttagtatcaggtcttttaattccttgttttcgggtacacacaatctttctcccatccagattgttccttgttcgtcctcaacaaaacctcgggcttttccaaccctcatgttctttttgagctctgctatttcaggatcacttgcttgagctatgcgaacctgctccaccagtgtgggctgtgcctctagggcagccacgaatccgtgctcaactataccaaggttcaaatgttccaaatcacgttgaacctcacagcatagttcctctacccatgcgacgttgcagtaactcttcctgctcaaggcatctgctaccacattagccttgccgggatgatagtgtatccccatatcataatctttaattagctccaaccatcttcgctgtcggagattcagatcaggttgggtgaagatgtactttagacttttgtgatctgtatatacctcacaacggttactgatgagatagtgccgccaaatctttaaagcatgaacgactgcggccaattccagatcgtgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaacttctattgcattcagcagaccagataaacttttcttccttcttcaatagctgtgtcattggcttagcaattttagagaagt

SEQ ID NO: 70648 - DNA, 8870 bp, Oryza sativa
gccgccctccccctccatcctcgccggcatcctcgccgacctcgccgagatcggcggctccttcaccggtggcttcgcccgccgcgccgccctccccgaacctgccttctcctccgcctccgcctccgcttccgccaccaccgcggagtccccgcgcgccgcttcctccacggcctcctctccttccccttcccctgctgccgctgccgctgctgatgtcgctgatgacgtcgtcggggcggcgcaggcccttacggcgcggcccgaggcgtggattgacttccccgtgctcgcgctcgatgagagtaatgctcgattatctatatacttatggttgttgctaattatgcatccatcacgcactgattgcacccctggtttcgtggtagatgtgttggaagtcgagatgagtgtaaaaagttgctgattcgggatatatattggatttcatgcttgtgattctagtgaaattatgaggcaaaagtacttctcttaggaattcatctaggattatctgaggttagtataaagttatggtgtggggaattattgggccaaattgaaagaaatcaattgctctactcatcgaagagcattcattgccattattagaaagtacagagtgtggcaaggcaaaagaaattatttgagttgctcaaattcatagctaggcaaagaataaactagatgcttcattatggatttgatgaatggtttaatgataatagctataacagggacaatccaaatataggcagcaggtattacttaataaatgtttgtgtggaaatactgagaggtaaacatatcttgtttgtgccgtgctttttgctggttcagtttctagccattgttgcattcacttcttaggatcactgaagttttacagaaccatactgtaacttttgaagatttcaattatgcttttggaatcaggatgtctttgagttgttttactgagctcatcttaggagaatcatttgtggctgttatttagctctgcgatataagtctgtctaaatgccatacttatttactgattttgcaattcacagattctataatctccgatatccaaagggatcatatggaagccattgaaaaacttgtacctgacttagcatctctgagagctaggctctgcccttcttacatggatattgatgtattctggaagatctactttacgctgcttgagtcgaaccttactgaacatacttcagaggtaagtctagtaatttatgcttttttagaagtatacgctacctcttatattgttttatgtacctgtggtgtgacttattttttgttgtatgcattccgagtttccgatattatataatcttgtgtgaatcacaatggttgcaccattgcaccacatcgtgaattagaaagtgaacattttctagcaggatagtcttgtctgaatcgcaatggttacacacaccattgcaccaatggtcttgtctcaatcatactaggagtctaggacttaaacttgggaaccatggtattattgagaaaccatacaatgctagcaggatagttgatgcatgctgagagcctgagacaatttcttccgtaaacaggcaacagctcagagatgtggaccagacattagtgtcatttcaatttagttctggatttctaatcttggtagtcaattcagatacaatgggaacagatagaaacttggatataatcagggaatgcatttttttcttcgtgttactgctttcttcacatggtcttaacataaatgagcatcatctccaattgacaagcagcacataattgagctggattctataaaattcttgggtgttattgttgaaacatgatcattgaaattaggtggaatactagagtatgaattcgctttagaatctacatatctcagacttgcgaatatgttagtgttaagctgcacaaatcaataaatcatgcacactttcaccggttggttgtaggcatcaggacacatctgtatctcactatcttgtatgaaatatagcttgtgtaattgtgttagttttaagcatcccctggaggctttctactcatcttacagtgaggtgctccatttggatatagtaactatgatttgggtgttaagcgcaaaagcaatatgctgagctttgttttgcagatatggtactattttgcttatttatcgtgaccacctgtacttgcaggtagatgagaatgtaccaggttctgttcatcacgtcaatgagatagagtctgattctgcgcctaatgtttgtgaaattgaaagtgtgaaaagcactcaagagggttatcaatcgccagatgatcgtgtgttgataaaaacaagatccaatcaaagcattgaccaatgggtgtttgcaaagtcaaaatctgagcaaagcatggatcagtggtccgaaataccttcggatgtggaatcttctagagatggtagaagatacattagcggtgaggagcttagcgacgctgacagtgcccatattgttgtcatggacaaatacatggattcacttctgtcagatcggaggagcctccactatgctagctcctcagtccggcgggattcagtaagaagaaaacctgcatcttctactgactatagccaccggcctccacaaccaactccacctgcttcactatccaagaaggaatcatgggatgtcattgaggattcagagtttgagatacttgacagttaataacagagatctctgggatctctctggctatttatcctttttattatttttctctctattcccttacccttcacctgcttgtaaatgacgaccttcaggtggtgtcagtgttcgtgggaaaatttctctaccattatattattacagtgtgcatatcactatgtaagttgggtatatcccctcattccatatggtgtaacataaagaaaactgtgatggatcacctgccaagggtgagactatgggtaagtctcccactgtacaaaattctgtgtcacatgtggcttctatgctgggtttccggaagttctgtgcagaatgcagggaatgctaggccttcttctgactgcatgaattttgtataacttttttttcatcaggatcgattcgatttaatttctacaaaccttgaaaaaggaattcatgtccactgaaggaggccttaaaactttgcacctaatgccagaatccactgaaaaggttactgtgcatggtagcctcataataaccgttcggttttgtaaaccctaggctagattggacgcggttagaatgccctgcggcagctgcctcgccgttgctggcttcttgttcttcgtcgtccggcagctgcatttgggcgtgaaacgctgtgttcttcgctgtctggattcagtggtggagctagaaaaatttttgagcccgaactaagcttcactataactattatttactatggaaatttcatcatcaatttatttatgtaaaatttgctacaggacacttaaaaaacgtataattagttatatgacatcacaaagatgtgaattgtctataggacattgcaaaagagtgataattagctattaaacaccgaagatattattttattatttccgaacaacatgaagagagaaacaatcaaaaaagactaaattgccctatgtgggccaaggatatcagtctctcatctattttcatgacctcttcctcccaacgagacgcatcgcgcacagtgcggcgccgacgccatccttctccgccgctccggcgggctcgtacgtgaacgaggcctgggcgtcgatggccctgacgacgccgaccgcgcacagcagcacaagcagcgcaatgtcgtagcaggcgcacgccttgccatcacgcagcgccgctccagctcctgccgcgccgcgctctccgcccgcgtcgtcgccgctctcgccgccatcaccgcggacacccgcatcgtgcccgctctgccgcgccgcgccctcgccgccgttgcggcagcccgatgtcgactgtcgaggactagaatgtggagccgcaggaggaggcggcggtgtccaataaggccgcgaccagcggcttggctggttcaagagcacgcagcgcagcggcgccgcagcaaccggcgaggatgacgacgccaacgcgaggtggcagctgctgcatcaacgtgcggtggtgctacttcatgggctcgtatcagtacgtgctcgccgacgacaacctgcagtggagcctgggcgatggcattcactggtctccgtcccctctctgcctctctgcctggcccaggagaagatttgaggaagcaagcgagcagtgcgtgcatgcgtgaggagagagcggccaggctcagcagggcttctcgccgtggccgccggagccgacacccgaggcggcaactgctgctgcgaggcctgctgctccgggcggaatctaatgcgcttgcgccgccgccgcaccagacggcggcttcttgatggcgtgcgactccagcacaagaaaaacgacgcgggggcattcggtactttcaacgctttttctctcttcatttccatcgaaaataataaaataatatctccggtatctagtagctaattaccactcttttgtggtgtcctatagccaattcacatttttgaggtgttccacagctaattacacattttttaagtgtcatatagcaaattttgccatttatttaagaatattaaaatttaatggagttttcacatgcgagcccaaacggttgcctgcagagatggcaacgggtatggacccgacgggtttccagtccccgtaccctcacccattgaaactaaatctgcccactacaaaacccacacccgctcgcgggtgagaaatttccccatacccgcacccgcacgggtgataggtacccacactcgttgcaacaattttaattgtgcacaacaataactcaataaggttagctgcagtgatatgtacacactagaattgaaaatctaaggctcaaacaaaccatacaggatacatacagcctgccaggctgccacattgcaaaatcaacagcaagccatgcaaccacattgcaaaatcaacaattataataagatgataattcaaataatgcataacctattaaccaagctccaggcatgcaacatcattccaagctcaaagcatgcagcaatatcatcattccagcaagtttaatgacaacaaatcaacacatcaacctactggtccacatcagtctaaagctctagagttcaactcttcaagtgttcacatacagtgacacatacaaaatcattacaacgaaaatggcataagtagttcaattcttgcagcctcctaggatttcctccaacaacattcaagtgttcacacacagtgaacatacgaaatcattacaaccaaaatgacataagtagttcaattcttgcagcctctctaggatttcctccatcaacatcaattcaattcttgaaagcaaaatacatccatcctcttctagtctcaattctcaaatagtaagttcctacataagtagttcagtacacaaaatataagtcaaattagggagcaatttatttttggctgttacataagagtgacacaagtgaaatgacagagaaagttttagagaggagtaagcaataacctgaagaccctcttgtatgtcttgaagacaagaccaaaaggaagcttgctctttgtccttctcatcaactgcaaaacacagaattataaaagtaaataatttgtttgtagttagaaggaaattaactaattgcataacagcaagtgcaaattaacctttgtacttgtttcgaagccaatcctgttggcacattagagcttctaacaacttagaagtgagccgactacgatgctcactaagaactctcccattagtgctaaaagctgattctgaagcaactgtgctaacatgaattgtaaatatatcccttgctatcctcctcaaaacagggaaccgagttccagccaccttccaccaatctaaaacattgaaattctttgtgcgactgtccaccaaatcctcatccaagtaacggtctagctcacttcctataggtcttttggttgcagcacgggcactaaggctggagaaatacccgcctttgccttgggaaccttgtggactggatcggggacgactacaccggaaaggggttccgttacttcggtgataggaggcagcggcggaagtgtcgcaggagacgccggcttaactcctttaccagtgttgtcttgtgtacccaccggatctgacggtggatggtcagtggaggtggcgtcccttcggacatcgtgggggttagttgatgcgaggcaagggaattagatatatagctgcaatgcaacagttaagaacaaaggggaagaggatcaccagccgtcgtcgttgccggagcctgctgccatgctatgctggtgtggggatgggaacaggaacgaccgattggaatttggaggggacgaatggaacagacgatgcgggaaaaaaatgtggcgcctcacggtcacggccccagccggatccagcgacctactacctcactgcacctgcggcggcgctcctgccgagagctgaccgagcgttcgtgccccaggcggcgaccgacgcggtggctgtcccgcccccaggaggcggcgtccctccccaggcggctactgcccgcacagcggcgcccctactagtccgccctcagcgccccccctcccacgctggcggctgcccgcacggtggcgcccctgctccaccggcgcgaccgagaccggctggtgggcggcggcaggtgctgcggtcgtgcgcgcctatggggtgtcgacgtgtcgtgccgtcgtgtgcgtgctcccgtgcgcggtggcgcgccgtgtgcatccgtgcggtgcggcagtggcttcgccgcttgggtgatgggggccggcggctaaacggcagcaggagggagaggagaggaggagaaggggaatagggtttagaggagtgaggaaaagagtatttatacctagggttttgatggttgtgggccttgggccatttgcttattgggctaggcctacgggtattttcaacccacgggttaatgggttcaggtgacaggagaacgtacccacacccgtatccgatgggtgaaggttttgcccgttgatgtacccacgggtatgatgtttggaacgtatatacaccctaatagagtagaaacccaacgggtttcgggtcgtggggccccgttgccatctctagttgcctgggctagccgggtggtggctccacccctggaagttgcgccgccagtctcgaagctccagtcacgagtctcgagacgcaacgaacgttgagagagagactgagttgggccgggccaggagcgggagaggggaccacaacttaattacacattcccacgtcatcggtttttactgaaaacacctcacggcccgtttggttggagggagtttttaggagggattgggagtttagagggatgaagctattaagtgttttgtttgattgggagacatgtgaattttggtgggatggggcaggtaattgggagggaattccttctttactttgactaagcaaatctcagccatctgtttttattaatgacctaatctccaactaaactccctgtcaattaccatcacctctaccaaacaagatactgggattaaaaatcaaattcccatcttaatctcatcatcaatttcttcgtgtaaactcctaatccctttccctcaagttaccaaacaagccgtcaaaactacctatgcgttaaaaacatattactttatcaaaagttaattggaaaaaaacatatttttgttgaaattcgatgtaaatggatgatgctaatccatatgcctcacagcttgacgatggattcacttatttgaatttcaagtgtaatagtggacaatatggaccacataaataggtaggtggtggtgacacctttgagatatttgaaagaagtgtttgtaaataaattggtaaaaacacacacaaacactaaaaacggcgtgtactaggtaattaaatgtgaagatgtgaatgttatattacattcaaaatcgatatgtgctccatccatcccataatataagggattttgttgggatgtgatccaggtaattaaatgtgaagatgtgaatgttagattatattcaaaatcgatatgtactctctctatctcataatataagagattttgttggaatgtgatcctagtactacgaatcacaacaaaatccttatattatgggacggaggaaatatatataaaaatatactccctccatttaaaaaaagccaacttagaaagaaatatgacccctcctaatacaatgaatctaaacattatgtctagattcattttattagaagaggcgggataagccatcttaggttgttttttttggatggagtgaatattttataaaatttaatcataaagggagagatgagctgaagcattgaccgaaacaactcttccaatatttgatcaaagcctgaatcgtgctcggatgaacgggtagagtgaccaagtatatgcaagagctataatagatttacacttaaaagagaagaaaaaaacagtaattttgtcacatattttgttccaatcttgtgaagtctcagtcatgagcatagacgaaactgttgggcatcagaggtcgcaaactccatcgcgtcccgagccaaaatatgcaactccgacctgccaggcaaaggccggtacagggccacctcgtcggcggcgagcttgaacgcctccgagcctccgagggctcggggcctaaaaaaaaaaattcatgcaactgaaggaggccctaaaactttttgcaaataatgccagaattaatcaagggctt

SEQ ID NO: 70649 - DNA, 20937 bp, Oryza sativa
cgcgcagcacaactacacaaggacgagaacgagagcagctcatgcatagcagaagccaaggaataacctggcaagcagacgccaacaatttggttctgaaactaacaatgcgtgttaggtttgagagccatcaggatctcccttacaccctgcctgttccatataccgtgatagaagaaccaagtgagttccaggagaggcacaaatacaaccagtgccttccaacttgcagagatctagacaaccaagtttttctccttcggccaaccaagtggccttctgttatatatgctcctcgatcaacaacatcacaaattcaagcttatcagatcgcatacgggttatgttccaacttcaccaatcgccaaatggtatagcaggtgagatgattcgtcacgtcttaggacataattgttctcagtaaatcttaaagtggtcaatcgacatgatttgtatggaagagataaaaatcataattcagggccatacaagggtgtgagaaaaaaacataaatacaaaaggtattggttcaaaattcaggagcatgaaaggaattttctctcaatgtaggcctgatatgcctaccatgttaaacaaattctagaataagattacaaatctagcggtgtcattatcaaatgggaaggtgctgacatatgttgatatctgttagatcatcattaagtacttgcagttaatctggttttgattcgtgcgatgtttccaacatacatatagagccttaccttttatattcctctaaactagaagtctacaagcagtagtaataaaattggtgtgggttctcaacacaagaattcttactcaatataatcatatagtcatagtactgcagttaaaaccaaattagtggtagtatcaacacactgtagaatcatgtgatgattaattctcaaagatgagtgtttattgaaaatactgtgaatagtgttttcggattatgaatggttttgtcagctttgtgaggccagtcatacctggcaggtgccgtcggtcagaccagtggtgctagagcggtttgaccgggtagccggacggtcagactgacataccccggtttggagtgatcggttttggcttgtttctgtggaatttctagattgcttcatgtttatgatttctagatgctttctattcgtatgtaatactattttgtgctgatgtgagtcaagttggtgcaaacttgtactcggatatacagtttcttggttgttcatatgcgggtgttgcttgagaccataggcatgtgtgcaaagggatagaaatatctacaaccagggcttttcttcgagacaattcaattgcttagagatctccagaacaacaggcaattcactaccttttttttggatgaaaagacaattcaattccttagatctctaggagtttatccaccacaattaatccacataatgcgtctctgcaattagatcgaagaagaaattgtgaatcatccaggcaaaatcaatccctagagatagaccttataacaataaagacattgcttgtgatatacattagtccccattgggaatatatgttgttggagacattggctgtcgcgaacctatctgtacagttcgtcacaattagtttggtcgcaaattaagtcagatgcacatgttaatcaggtgaagcttcatttgcattatttctgatcagattgctttcaagatgctggattataccccctttgtttcatattataagttgtttaactttttttctagtcaaacttaataaagtttggtcaaacttaataaagtttgactatgtttataaaaaaaattagtaacatctaaaatatcaattagtttcactaaatctaatagtgagtatattttgataatatattttttgttaaaaatattactatatttttctataaatttggtcaaacttaaagaagtatgattaagaaaaaaattgaaccacataatataaaacagagagagtattaaagtagcagcacagttcatacaaattggagaaggggacaattacacctatgcccccactttgaactctaattaatgttttactctcacattttaggctttgcatttttgctctctctttatgaaaacgaaccaattgtttgccctcacttttgacgtctagtttaacggtgttagttttaaaacaaaaggacattgatatccttagttgttgttgcttttttgctcaacttttagactagccgcaccggaagcccctgcagctcctgccttcgctgcgccggaagcctcctcatcgcctgcctcgctgcgttggaagccccatggccgccacctgccatcgccgtgcaagggagtgggaagcctgcgactacccacctgactcaccgtgcaagggagatcggggatccggttttaccagaacaacacaaagtcacaccgtgcaagggagatcggggatccggttttaccagaacaacacaaagtcacagagcatattgcatactgatcagaatatcatatcactcatctccgataccaaatgcgcccacataaatcttacaatgctatctacacaaatgaaggaacatagcatagacaactacggggagaaactatcctgcaagacacgcgacgggttaagcgaggatgagcagagcaactgctcgatcagggagggatcggaggggacgctatgtggacaccccgagtattataccatccagtgtccaacacgaccaccacatactgttggaggagtgggatccaaacacgcataaaaaagccactcgtcctcaatgtgtccatgatcacggttgacaccttctgctataataaccggaatgccgagtagtgatcgcaagagataaccataagataacttgccaggctactccgtcatatgcccgtcaaccacacgaaggcggcgaccagaaaacaaggcataccccagtgcctcgatccaaagcgctatctccaattatctcaagcgatcaaaacccgttactcgtgctcagctagtccccaggaatacgactaacctcacacattcattgcaagcaattggaacatcatcacaagtgcataaaaaggggttaagtatagcaagtatttggtacagaatagggtccgaggtcccatctaacagcaaacaagtagcagcggaagattcaaacaaaagccaaaagcacaaaacaaaagccggtggtgccacaacccacaagggcaaatcaaccgggcaagagccaagctgaaggtagcagaagatcaatccctgccctcgccgccccaacatcccggcctagggcttaataggattaatagaatattcatatcaacaagttgcaacttcttttccggaagccgatctccaaaaaaactccagggttaagcgtgcttggcctggagcaatttgggatgggtgaccgaccgggaaattcttcccgtcctcacgcatgtgtcttgccacgcaagtgaggacaaagtgtgcagaaaacacatgtgtcttgcccttgagcatgtcgaagaccttgcgacaggtgatgtcgaagaggtctttgatgtcgaggaagtgggtagtgaggacttgagcatgtcgaagaccttgcgacaggtgatgtcgaagaggtctttgatgtcgaggaagtgggcagtgaggaggtggtcatggacgggcttcacctagatgttgatgaacccttgccataagggagcgggaatcccgcggctgccacctgcctcaccgcgcaagggagggaagcacggccgtcgcgcacacaggagacctgtcgtcgactcgcgctcgactaccatcgccgcgcacacatcgccgcacttctcgatggaaccgtcgtgcacgccggatgtgccaccatcactgtgcttcctgccggaactgtcgccgtcgccgcgcatgtcagaaccgccgtcgtcgccgcacacgctgaaaccgtcgcccgtcgccgcctcaacatgactgagctcgtgttaatgaccaaatttggtaagatatgaaccagattcggcattggaatcagagtggattcggcaaagagttagattcgaagaacagagtatgcatcggctggagtctgcatcggctgagatggatcggatagaggacagccgatacagccgattctgatgagacagttgttaaattgtttctagaatcgatcaacgtgctacacgaggattgctgtgatggagataagctctcagataggcaatttgtacctattaattaggatattttaaatagtttccttagagatatgtttgggcaaaagtctgccgttaagacttatgtgtatcttagagtttgttagagataagagtcgtgtcctgcaaagacctatcatctatctcggctataaatataacacgaacccatgtaatttacaacaacagtttaataacgctttcggtgcatcgccacccttttctactttcgttctatttcgacgagttcttgccttcgggttgagctgcatcggtctcgatcttcaactagaggtaaacttgtcatggcggactgtgttctcaggattagtgcttccatcattatgatactctaatcttgcttatgtaattcgtcgagttatcatataagctctatagtcttcattagttgcgctatctgattaagcaattagctggtttctactattagggagtagccaacaaggttagatcttgttattagtctagattatatagcatatctaccatctcttagaggttttcatcatcttgcctagatcttatatttatctttatgcctaatgctgcatcggttgagttcaatctattaagtaatatccataactataatatttagcttgttagcttgttttatgattgtcgagagagatagcatcgtggtttcagccgatattatctggtttagctatcttattccttatatgcttgactgttatactaaatcgaccctttatattaagatcttattgcattagaatatactagtcttcttgtttgatatattttgcttgttttaatatcttagtataaagtggtatcggcgtattagccgatacatgctagatctatctgatcggctatgctataaacgcctatataatcattgctttaatgtatctttctacttaagtgatttatactgtctcggcacggcgaccgatctatcccaatcacttagtttaaacatacatcgaaggaaagattatatatcgttaatatctatagccgatcgagtagatttagtcgtatcttattcattcattactgccgatcgattccaacatgacatcggctcgaggacaaatgatatgtcatcggcaactagccgatcggctattatttatggatttaactttggtttagttgtattttattcttgttaattgccggatcaaatcaacttgcacgctctcgaacctaaaagcaagattttggacctacacaagagttaagcagatcttctaggccagtgtgtgtttttcgcttcaacagctcggtgaaggaatgggcttgggtccttatccattcactcaagggtacaacagtaaattgatatttcataaatcctttttctaattacttttcagaccttcgaaagcattgcacaatactaacttacaatattcagttaaaaaaaaggagaattggttggcagttttgattcaaatttttgtatgattcacctggttttaatttttctaccgataaattattttttgtttcttttcataccattgcagtataaaaagaatttcggtttggatctattctcaaggttagacacgcatgggatttcttggggtttaagccgaaatatcttatgccattcgagttttctgtggtacagggaaactatatgtaatataaagctaaacagaatttctggtagaaaaatattagtaaaattgtattgtccattttgtgaaaaatactgaatagtaaaattattgatcactttggcaacactatatatctgaaatgcatctagggtgactacaacaattttggtgtgatatcctaactcaattaggatgtggtctatgtaattcatgagagctgtgtacgtatatttagtaccacattgctagtttagcaacggtgtaaccaacttacaagggtttgtccttccaaccataacacctctaggttaacgattttacacgaaacatagacgaaagtgtaagtggggttggaatgtgtaagtaggcccgcccattcgctgtgctaggctgcatggttatggagggcgggccattactcatggtatgagagcggtccctcacagttgtgcgtacgggtcagtgtgtgggcatatgtcgcatggtgcgtgtgggctctgtgagagacacatggcatgatgacatatggcgtcagcactggatgtattgtcggcacccggggatggaattcctgaatacctggagcatacaccgtactagtcccatgatcagtggctagcacacgcatcctcaacattgctatcacatccatacatcatacttgacatataaatagataaagtggttatcataacttagcgattgttgatggtccttaaatcataatatctgaccgtcaatacctgcatataatgaaataaaacatggtatccaacttagtggtaggtattattactaatcacttccactagtgttggtgaaatatgtgtatgcaggtaatttgaggagaaaacacatccgtcatgcgacaaaatgcacctctgcacattcaggacacgtttacacggattggaggccccataagtcaatgaaaaccatttagaattgggccaaaacatagtgcaggttattgggggcccattaagcaacttaccggccaaaggagagaccgggaggcgagtttttgggttcggccgaaccattcctggcgcctcccgccatctacttccacgtggacggcttggattcctcccctatggcggttgtagggtgttttggtcatttccgatacccctaaccgtcatttggagcctatataaggaggtcttcatctcacttcaagaacacacaattttgagctgaattagaatagactctattgtatcttttgtacgttagaataaggtatagagagtgaggggaagctctggaggagttcccggaagtttcgcgttcatccgacttctacctcgacgagtgtagcttcctaggaggaattctagaggagtactggagctgtcggtacactttgctccaggttcggagaaccttcttctataaactaagcatcagtgttcttttcttatgttatttaattacttagtctgagtaagatagatttccatctctacgggttcattgtttagtatttatactaagcgctctagtactaggactctggatagagaaggaagttcctgtaagtataagagtagtaattaataacttagacgtggtgtctaggttagagattacctttgtttattgtgtatcccatagatttgtcagaggtaggtggcaggtggtgacagccttgaattccgttctagtaatcctccacgttcggatacatcataaagctatagccggaaccgtattggcagaccagcaggggtcggtgcccgaagcaacagataggaaattatcttttaacttagcttacataattaaaatacatagaaagtcctctctagcctagcctatctacctatagttgttgtccttggatagtcttagccttaggtagattacacacgttccatgagttcgatatccttttgggggtcacccgaaggtgaagtgctacagcggtattccgtgcgcttgcggatttatctgtagtcgtaagaaataccaatagcgatgcaaagttcttacataatagttaggtcgactggccaaataaaagagtttaaacgcagcggaaaagataaatatacataagttcttcggtatgcccatctaccaaaccacacaggcaaccgactaggaatcaccctagaaagaaccatctcggaaactctggtacccgatgcaaagtaatcgtcactaggcacctcatatcctgcatcctagtctaaaaacaacaacaaaaggtgggtcaatacactaggtattggaagtcctacccaaaccttaggaaacctaggtctattgcaagttgagatcgatcaaggatggctcgatttataggcgagggaggagcgagaggcagatgcggaggttgttgtgatgcattcggcgtctcttgcgcgcgcaggctgtggtccgcagggaacatggcgggcagcaggcgtcggctttgcgcagggattgcagagggggtgcacgggtagtcagagggagccaggggtggtcggcctcgccttgtcgcttcgggcgtcggctttggcagggggcggcggcttcgggttggcgaggcgcactgcgaggccgactttgcaggcgggagacatggaggcaggggcgtcggctttgcagacaacagacgtaggtcggaggccttgcagacgaaggaagcaacggttgagttcgtagcgtctcgtcgctccgggcagagggcggcgccggttgggcgcggtggctacgagggcagcgctgggcgcggcagggcatcaggcagaggcggggcagaggcgagcgtcagctttgcacagccttgcagcgagattcgcgggcagaggaagaatgggcggcttggaggcgacgactttcggctcgcatcctatgtgttcgatggaatgcctgcaaggaaagagaggggaaagaggaagagagagagatggggtgctgggccactggcaggtggggtccagggtgcttgggcccactgatcagagaggtacagggatagggggaggtgaggaaaatttcttcccagggattttaagagagggctgagggtttgacgaattttttttggaatggctacattgctcaaaagcatgcgccatttttactggaagttactgtagtggtgaactccatttggtgaacttttgagatttttctcatgtgcagttattttttgaaaattcaaacaagtttccttctcttattccaatttaaattaattttggttgccttcatctttttaattgagatgcaaaagctgagttataactaattaaatttgttgtttattattctcatcattaatcttattacctttttttctctaatttaatttatatatgcaaaatgaaatgatgcatagaagatccaaaaacatccaaaacaaattttcaccacaataataaatgaattttttttcattatattgaatttccaagtttctacaatttgggttagttacatgtatggacgtgcactaagagggccatgttcctagacatttgcctatatgcatgtgaggctatatgcgtaagttcgactgacagggttgttgggtcctttaaggtgaggggggtgtacgtaacatcatgggccaatttggatatcgtctagaagacattgcttatggagaggttctgatataaattctagtaacaaatccttggttctttgggatagagtttgtcagctgaagtcttaaggaggtttaggagtaattgatctcagatttcagaataatgctttgtggatgaaaaatctccatcagatttataataggcatactgttcgtttggtaagtttgatatggtctacttactataatggcaaagtcccacatgctttgtctttaaaagatccttttggtggagagatgttttacaatttgtggacaattttagaggtttatcaaagtgcgcagcgggtgatggtgggacctgactgttttggaatgataaacttagatcaacactctatcccagggcacattcttttgcaagaaatcataaggactcagttcatcagacttccacaaaggatctgtctcaaatctttttgctcccaatgacagagtaggcttatcaacaatttcttgcaatgcaagctgcagatcctttggatcagctctcagatgactgccatatggtcttatgctagggttaatgatagattctcctctcagaaagattaagccataatctttatgcatatacaatctctaattatttaaattggatctcgaagagcaaatgtactatgaaagtcaaggtttttggttggcttcttttgattgatcgattaaatactcgagataagcttgatagaaagcattgtgcccctgatggaagtgatcttacttgtgtgatttgttcatccggagctagggaaactctgcaacatttgttcttccattgcactttcagttcgcaatgctaggcgcaatttggtttagtttgggacttatatttattctttgaagatatgttacaacatgcaagaggttcttattgatcatctcattttgtggagaagattttatatgcggcttggaatatttggaagcagcgaagtaattggctatatttttgataatgtgccatcctcagtctcctcttggatgacattctttaagaatgatctgtcgcttcttgttttttttttaaatgcagatgagagatcaacatttatttcctggttaaaccagttgtaaaactttttattttattttcttaatatataattttactttgggggaggggggttccctcacagtgctttccctcaaaaattaggatatggtctgtgtggctcataagagctggtctgtgtggttcatgagagctgtgtatgcatgtttagtaccacattgctagtttagtaagagtgaaacaacttataaggtcttgtatctccaaccatatcactcgcgggctaacccttctacacgaagcgaggacgaaagtgcaatggggtggtatgtgtaagtgggcctactcatcggttgagttgggctgtgagtttgtagagggcgggccattacatttggcatgccttgacgaggcagtttcgtcaagaatcagtgaaatttcgtcacaaggacataatcgcagaagatctgttcctctgtgttttttttcactagatccacttgtttcactcttaggccgaggttagttccaaaatttttctttaaatttctaacttttccatcacattaaaactttcctacacacacaaacttccaactattccatcacattatttcaatttcaaccaaacttccaattttggcgtaaactaaacacacccttaaaaaaatgaggatccagtagtgctttgtttgactcttactccaccagataaggattccaaagtggagtcctggcaaacagattctttgctcaaaatgtacacttacctacaaccatttatacctagacacttgttgggggttaggagtacacccctggcgcataataccctccaccttcagaggggagtgcagcgccaggaaggctagggcagaggccatgtggtcaaccatggggcctactacaagggatgcccaaaaagggtttcctatgccagcctttggcttcgaaagataatgcacaaggatagactacaacaggaaaactaagaccatgtttagatgggactaaaacttttaagtccctatcatatcgaatgtttggatactaattgtaaatattaaatgtagactattataaaacccatccataatcttggaataattcgtgagacgaatccattgagcttaattaatccatgattagcctatgtgatgctacagtaaacattctctaattatggattaattaggcttaaaaaatttatctcgtaaattagctttcatttatgtaattagttttgtaagtagtctatatttaatactctaaattagtgtctaaatatagggactaaagttaagtccctggatccaaacaccacctaactatcagtgtagttcgggatggggacgagcggacgacacaactcctaccactaaaaagggaggggccatgggtgtgtgccatcctttcaggggtgggctcatcgactggggctgcccccctttagttaggttgaaaatatacgattctgctcctggagggacccacaagtccgtggcttaaatataaggatgttgtgtaactccattaggtcataattgtaattttatttttgtaatttggggcctatcgttaacgacaaaatttggtaagattctttagtggattgggttaaggaaagagcacaatcaaccgatggaaacttatccatgagaccaagtttatgaaagaatcgtgaagactatggcatggcagcataattctatatattggttaggcttaatttagtagtttccttttatctttaggaaagtgtgtttagtgtcagataaggactttatgtttttcttttgtctttaggaaagtttttaggaaagtttcgttcttgtccaataagcacttatatctacccataggtataaatatgtacacccggggtcattataaactatctcacagatcgtcattataaactatctcacagatcaatacaactactcttgacgcatcgttaccagctttattgaggtttttacttatcatctgacggaacttggcacctgacatggggctgcatcggcttttgatctccggtgaagggtaagtcctacgttccgtcggcctaggcaattgtatctgctacgttggtgttgttcaaggctgcatcgctttgatctcttgcatcgctctggtttggttgatatattttcctacctatttattatatatcttagttaatctagtttggtagatcgatttacttgtatcggctgggatctgctttagggtttttgccggtatcggctaaatcgctttactagattagatttgctaatgtatccaccaccgtgaaaattagtcaaatacttgattttttagacttcatgcttcttaaaatagtttgtaatgcatcatccttagtcgtgctattagaatcataatggctagcctgtctttgattataataagggtttcatcgggatttcagccgatgagttatctggacattgcatcggcttactaggattgtatacaagttagttttagccgattgaaacaaaggtttcactaatcatctaattgtgtggattttatgacatcgaacctccagccgatgtatacttttaaccttcggatcaatatttattctatcatactaattttagccgattagtttctactggattatattattgttctattacattatcatcagccgattgtctttatattgttatctacattggtcatataaccgacatctcaaaaccttacggcatcggctggaactactctatcggcttgtcagccgatcagttatttgatctgttgtttacatatcttgtcaattgcaggatcaaactgactggcacatccgcatctcatcaatttttggacctacactggagctaagcatatctctcatgccgttgtgttcattgatttagtttgcgccaacacagttccggcaccatcggccgaacgcgaatttttcgtcaacacctatataaataggacgcatcctctgtttgattggggattggtatttttatgtctagtaaactacacttcacaactcagttgtgtctccaatcaagatcttcacgtatagtttgttggtacataatttgttcccagaacactcgttccttgggcacttctacatatcaccatccttacttcgaccataaaaccaacacccattgtgttgtaggtttctaggactctacacagtgcatgtgaacacttcaatttcttggaataaaaaatatgcagtagaaatgagaggcaacaggagaagtagtactacttccttggtggtgggtgttcttcaggagccgcttgtgttgcggttctggagaagtatcaatatcgatttcaagtaattttacctttctaccaaatctttctggccaaggaactaagacggtgtttgattgtgaaggttgggaaccttccccacccgtcacggaaaacagagaagcttattagcgcatgattaattaagtattagctaaaaaacctttaaaatgaattagtatgattttttaaaataaatttcccatagtcttttttgttgcaaaaaatacaatttagcagtttgggaaacatatgcgtgtgaaacaagggagtggaggttgggaatataaagaaacaaactcagcctaagagtacatgtgtacaaaaaagtaggaggaaaaaaaagaaccatgaacgaagcaacttacaggagctgataagattgtattgagtaaggtcttatccgtgtgaacaagataacatatataacagaataataacctttgacgttatctcgtgcccgcatcgctgctgaattagtacctcactctgataagctacaaggtgttgtataattattttctttccaagctgatgtttgtaagtctaaataatgctaagtatattcatcttgacaggtggttgtatgatgcccctttccatgctgactaacaactttaatcaacattataagtacaaggtcctacgtcgctacacacctttttaccttgcatctggctgccaagtaagctgcatcctataattttccagttgaaaagtttctgattttgggtgaaaatgtttgcatattgaattgactgttgttaatttttagtttttttagtctctctttgaatttgtttgaaattccacctgtagaaagtttctatatgtgcaaagtttatatatccaaaagttcatatgtgcaaagtttgtacatgcaaagtttctatcagcaaaaagtttatacatgcaaagtttctccataaatattggattaaaaaagctttattagttctacaaatttgtgcttagtaaaacttacagagcgaaaaattatggtttaggctagttttcaaggttagtcgaaagttgagagaggagcactattcttacactttgttaacacaattagagttaatgaagtttatcaattttcagagagttctttgatttgtgtttttgccgatctcggcggttaaaccgggaagaacccatgacattgaggcgatcgcctgattcagggggttgcggtggtgagctgggcggtcagactgatgactagggagcagtcagaccagatagcacttggcggtcatgttacagaataacttttaattccgttaaaagttttgctttttgtatttgtttcttgtgtctcatatcttataagtggtattagagtcacgtttagtcttttcgagctgaaaaaatattctttcaacccttttgttttctcccttgatttttctatcaaacgttttctatcacacgtttgatatcaaatccataattcaaattcaaatcatttagactatgtgatagaaacgttccaccggtttggttgtgaggaaacattcaaattattttgtatatattatcaaactatttcatgggtatagtaaacagttagtcattcatgagtatgaaatagaaagcttttcagaggataggactcaaactttttgataggcctaaatctggctgaagaagaatgctcatgacaggcctaaatgacctgcgcaagccactcatctatccttccagctccattatctcaaccagccgagcagcagtccccttgttcccctattcccttgcatccccaagcagctgccagtatggctggtcgtgatggtgatgggaaggacggatgaatgcagcgacagctgaaaggagaggggggaggggggagtgactaacggtgtaggtcgtggccgccgctgttgctgctgacaatgatgaaggcgtgatcgtatatgggaattagcaccgggcgatcacgttgttgcgcacgagggcatcgaaggaagaccaatccatccactggatttccaatgttttagccaatttatcttgaagagtctcgtgttacatcggaatgtagcactggatattttcgacttcaattcttcacggttgtgttgatctttcaacaattaaattttgatatttcttgtgtgaggccgaaatgtttcaaccgtgaattctccaatgtttcctgatggcgaaatattttctcccagtggtgaaaaaatgctcaaatttgggggaaaatatcgggcactcgatttgtagttgtgccctaggctgaaagtaaggttctgttcaagatccctctagagcagattgtttgatagacaagtcatgctgccatggtcgcaaatagtattacgcgtgcagagaacagcacaacacacttgcacatcatgttgtggagaaaatttcttctatggccctaaaatttttagctgatcctttacatgcccctcaattttctttgctctcttgtgtataccagaattttgattttaatcccttccatattcttatcatcaattgcctgttaataggtgcaaaagaagttggttttacccttaaatgtgcaaggaatatatagaaatttgttgaatctattgttggaaacgtactaatttgtttcatgacactataatgttcatatgtctttcaaatgagaagtatgatgcatagaaattataatatatattaaaaagtatatgtaacattttttaaatggtaaacattgttttgtacagcattccttatataagatataaaacaaggggactgatccgttgaagtaccatcataaaactatgctacatataaataaataaaatgtatattaactacttttgtcattatgtaaaagtaaactatgccgtgaataataccttgtacagtgaagtcatgaatataatagtcttataaaattaacgtacaaatccaacaatatactctacaaaattccatgtttcttttatgctaagggcgaaatgaacctatttataggaattaactggtcaactaatggtcaactaacagaatgggtatgaaattgatcaaaaccaattttttcaagggcatataagagagtaaacaaaactcggggagcatataagggattgcctaaactttcatgggcattgaaagcatttcctccattttgtatggacatgagggtgagttttgttctccttcatatatatttgcagcaccaaactagttataagttctagtacagcaaaatattttggtaggttagagttgcctcaactttattgattttgtaaaataaagctggattcaaatcagaatcctgacaaacaatattcaaaatagggtagagttgccttaactttattgattttgtaaaagttaggattcaaatcagaatcctgaccagcagtattgaagctggtataaatagttcgccttttatgtagctatgtggttgtcaaaatggcgaattggaggcgaagacatcctggtcgaaccttagaggattacgaccggtgccacatccagcgccgcgatgacattgccacactttggttagacttcgaaatgactaatcgtcaagttgttatcgcttgacgtcagtgtgtatttcgcttccttcccccttagagtcgtgtacagtattgatgacgaatcgtgttcgcgggacttagtaggggcggggcaaaaatgttctgaaacggatgatgtaattttttgctcctttgtataacacgtatgtgcttttgcccgatggagcttgtgcgtgtttttatgtttcttttcgctatcattgcattttgtaacttgtacgttcggaagggcgaggcgtgtcggcccccttgcatgttagcgaaaggaattcacattgacttttcagccctcatcattcgctctcgacttttggcatgtgcgtccagaaacgcttcagtatttgcataagtcgagtgtagcgacgatcgatatgttttccgaaaacgagctgtcgcggtttcaacgttcggcgagctgtgcttcggccgattcgtatcgcccccctggcgttttcgtcgatcaaacgtttgccttggggtttttccacgaaatatcatacacaaaaaaggcgaagacacccatgaattttaaatgactgagcgtcagtttgccattgcccagcgtcgacgcagcataatccccgtttttccttctttaccgctaattttttttttgtattgatctaacaacaagcgatgaagaagatgctcaagggggtagtccttcgccatttgaggactgcttttgttaatgaatcggatgtaaagtccgaatgccttttggcgggcaatggaatttatcagtaacttgtgctttttggcaaataaatggagtgtggtgcgtgttacggctgttcggctcgtactttgccctttttgcctttggcactggtatttttaggtactttgatcgttttgaccgttgccggctttcggtctttttagcacttcgacctttttaactgttaccggctttcggtcatttctttagtgctactagggttttgtcgtttgtccctttcggctgccccgtttgtctgcgggtgtgcaaccgatgcgaacttgatttcaagatttagcccctcgcacattttcttggacttctcggagtcaaaccgcttgttattgccggtaatgaactctttcggcacaccgaatcggcagaaaatgtttttccgaacagatttttatactagtgccgaaggtactgccttagcccatcgaaggcggcttgacactcaggtgtccaattgagtttgccggcccctcggagcatcttgaaaaatgataaatctctttcggttgctcttgggagcaactccttaacacattttcgcccctagtccttatcgccgtaccttgctggtactgtggcgaaaggcatgggtgtggcgaaacctgtttgcccgcagcccttggcgccataccttattggtactatggcgaagggcatggcgtgtggcaaaagctgttcacccgcagcccttgacgctataccttattggtattgtggtgaagggcatgggtatggcgaaaggctccagaggctagggtggcctcatagcccccgagcttggaagcaacatattttcgtccccagctcttgtcgccgtaccttgcgggtactgtggcgaagggtgtgggtgtggcgaaaggctccagaggctagggtggcctcgtagccccccagcttggaaacaacttattttcgcccccagcccttgacgccataccttattggtactatggcgaagggcgtcgatgggcgaaaccagttcgcccgcagcccttgacgccgtacctcattggcactatggcaaagggtatggcgtgtggcgaaacctcttcgccgcagcccttgacgccgtgccatattggcactatggcgaagggcgtgggttggcgaaacctgttcgcccgtagcccttgacgccgtgccttattggttcgatggcgaagggtatggcgtgtggcaaaacctcttcgcccgcagcccttgacgctgtgccatattggcactatggcgacgggcgtcggttggcgaaacctgttcgcccgcagccctagacgccgtgccttattggcactatggcgaagggcgtgggtggacgaaacctcttcgcccgaaacccttgacgccgtacctcattggttcgatggcaaagggcgtgggtggacgaaacctcttcgcccgcaacccttgacgccgtacctcattggttcgatggcgaagggtatggcgggttggcgaaacctgttcgcccgcagcccttaacgccgtgccatattggcactatggctaaggtcgtgggttggcgaaacctgttcgcccgtagcccttgaggccgtaccatattggtactatggcgaagggcgtgggtgggcgaaaccttttcgcccgcaacccttgacgccgtacctcattcgtactatggcgtagggtatggcgtgtggcgaaacctctttgcctgcagcccttgacgccgtgccatattggcactatggtgaagggcgagggttggcgaaaccgtatcgcccgcaacccttgacgccgtgccttattggtactatggcgaacagcgtggcgtgtggcgaaaggtgtatagaggcttgggcggcttcatagccccccagcttggacttaactcattttcgccccagcccatgtcgccgtgtcgcgcgggtactgtggcgaagggtgagggtgggacgaaaggctctagaggctagggtggcctcgtaggcctcccgcttggaagcaacttattttcgcccccaacccttgaggccataccttattggtactatggcgaagggtgtggcgtgtggcgaaacctcttcgcccgcaagcccttgacgccgtaccttattggtactatggcgaaggacgtgggtgtggcgaaacctgttcgcccgcagcatttgacgccataccatattggtactatggtgaagggcgtgggtgggcgaaacctattcgcccgcaacccttgacgccgtacctcattggtactatggcatagggtattgcgtgtggcgaaacctcttcgcccacagcccttgacgccgtgccatattggcactatggcgaagggcgtgggttggcgaaacatgttcgcccgcagcccttgacgctgtgccttattggtactatggcgaagggcgtggcgtgtggcgaaaggtgtccagcggcttgggcggcttcatagccccccagcttggaagcaacatattttcgcccccaacccttgacgccataccttattggtactatggcgaagggtgtgggtgggcgaaacctgttcgcccgcaacccttgacgccgtacctcattggtactatggcgaagggtatggcgtgtggcgaagcctcttcgcccgcagcccttgacgccgtgccatattggcactatggcgaagggcgtgggttggcgaaacatgttcgcccgcagcccttgacgttgtgccttattggtactatggcgaagggcgttgcgtgtggcgaaaggtgtccagcggcttgggcggcttcatagccccccagcttggaagcaacatattttcgcccccaacccttgacgccataccttattggtactatggcgaagggtgtgggtgggcgaaacctattcgcccgcaaccctttacgccgtacctcattggtactatggcgaagggtatggcgtgtggcgaag

SEQ ID NO: 70650 - DNA, 1041 bp, Oryza sativa
gcccgcaacccttacgccgtacctcattggtattatggcgaagggtatggcgtgtgaaaagccttttcgcccgcagcccttgacgccgtgccatattggcactatggcgaagggcgtgggttggcgaaacatgttcgcccgcagcccttgacgttgtgccttattggtactatggcgaagggcgttgcgtgtggcgaaaggtgtccagcggcttgggcggcttcatagccccccagcttggaagcaacatattttcgcccccaacccttgacgccataccttattggtactatggcgaagggtgtaggtgggcgaaacatattcgcccgcaaccctttacgccgtacctcattggtactatggcgaagggtatggcgtgtggcgaaacctcttcgcccgcagcccttaacgccgtgccatattggcattatggcgaagggcgtgggttggggaaacctgttcgcccgcaacccttgatatcgtgcctcattggcgctatggcgaagggcgtgggtagacgaaacttattcgcccgcaacccttgatgccgtacctcattggtactatggcgaagggcgtgggtgggcgaaacctgttcacccgcaacccttgatgccgtacctcattggtactatggcgaagggtatggcgtgtggcgaaacctcttcgcccgcagcccttgacgccgtgccatattggcactatggcgaagggcgtgggttggcgaaacctgttggtccgcagcctttgatgccgtgccttattggtactatggcgaagggcgtggcgtgtggcgaaatgtgtcctgaggcttgggcggcttcgtagccccccagcttggacttaactcactttcgcccccagcccttgtcgccgtatcgcgcgggtactgtggcgaaggttgtgggtggggcgaaagtttatagaggctatggtggcctcgtatccccccagcttggaagcaacttatgttcgcccccaacccttgaggccataccttattggtactatggtgaagggtgtgacgtgtggcgaaacctc

SEQ ID NO: 70651 - DNA, 23826 bp, Oryza sativa
atgttcgcccccaacccttgaggccataccttattggtactatggcgaagggtgtgacgtgtggcgaaacctcttcgcccgcaagcccttgacgccgtaccttattggtactatggagaagggcgtgggtgtggcgaaacctgttcgcccgcagcccttgacgccgtaccatattggtactatggcgaagggcgtgggtgggcgaaacctgttcgcccgcacaccttgacgccgtacctcattggtactatggcgtagggtttggcgtgtggcgaaacctctttgcccgcagcccttgacgccgtgccatattggcactatggcgaagggcgtgggttggcgaaacctgttcgtccgcagcccttgacgccgtgccttattggtactatggggaagggcgtggcgtgtggcgaaaggtgtgcagaggcttgggtggcttcgtagccccctagcttagacttaaaccactttcatccccagcccttgtcgccgtaccacgcgggtactgtggcgaaggatgtgggtgtggcgaaaggctctagaggctagggtggtctcgtagcccccctgcttggaagcaacatattttcgcccccaacccttgacgccataccttattggtactatggcgaagggtgtgggtgggcgaaacctgttcgcccgcaaccctttacgccgtacctcattggtactatggcgaagggtatggcgtgtggcgaagcctcttcgcccgcagcccttaacgccgtgccatattggcattatggcgaagggcgtgggttggggaaacctgttcgcccgcagcccttgatgtcatgcctcattggcgctattgcgaagggcgtgggtagacgaaacttcttcgcccgcaacccttgatgccgtacctcattggtactatggcgaagggtatggcgtgtggcgaaacctctttgcccgcagcccttgacgccgtgccatattggcactatggcgaaggacgtgggttggcgaaatctgtgcgcccgcagcccttgatgccgtgccttattggcgctatggcgaagggcgagggtggacgaaacctcttcgcccgcatcccttgatgccgtacctcattggtcctatggcgaaaggcgtgggtgggcgaaacctgttcgcccgcaacccttgatgccgtacctcattggtattatggcgaagggtatggcgtatggcgaaacctcttcgcccgcagcacttgacgccgtgccatattggcactatggcgaagggcgtgggttggcgaaacctgttcgcccgtagcccttgacgccgtgccttattggtactatggcgaagggcgtggcgtgtggcgaaaggtgtacagaggcttgggtggctttgtagccccccagcttggacttaactcactttcgcccctagcccttgtcgccgtaccgcgcgggtactgtggcgaagggtgtgggtgtggcgaaaggctccagaggctagggtggcctcgtagccccccagcttggaagcaacttatttttgcccccaacccttgacgccataccttattggtactatggcgaagggtgtgggtgggcgaaacctgatcgcccgcaacccttgacgccgtacctcattggtactatggcgaagggtatggcgtgtggggaaacctctttgcccacagcccttgacgccatgccatattggcactatggcgaaggtcgtgggttggcgaaacctattcgctcgcagcccttgacgccgtgccttattggcactaaggcgaagggcgtgggtggacgaaacctcttagcccgcaacccttgacgccgtacctgattggtactatggcgaagggtatgggtgggcgaaacctgttcgcccgcaacccttgatgccgtgccatattggcactatggcgaagggtatggcgtgtggcgaaacctcttcgttcgcagcccttgacgccgtgccatattggcactatggcgaagggcgtgggttggcgaaacctgttggtccgcagcctttgatgccgtgccttattggtactatggcgaagggcgtggcgtgtggcgaaatgtgtcctgaggcttgggcggcttcgtagccccccagcttggacttaactcactttcgcccccagcccttgtcgccgtatcgcgcgggtactgtggcgaaggttgtgggtggggcgaaagtttatagaggctatggtggcctcgtatccccccagcttggaagcaacttatgttcgcccccaacccttgaggccataccttattggtactatggcgaagggtgtgacgtgtggcgaaacctcttcgcccgcaagcccttgacgccgtaccttattggtactatggagaagggcgtgggtgtggcgaaacctgttcccccgcagcccttgacgccgtaccatattggtactatggcgaagggtgtgggtgggcgaaacctgtttgcccgcaccccttgacgccgtacctcattggtactatggcgtagggtatggcgtgtggcgaaacctcttcgcccgcagcccttgacgccgtgccatattggcactatggcaaaggcgtgggttggcaaaacctgttcacccgcagcccttgacgccgtgccttattggtactatggcgaagggcgtggcgtgtggcgaaaggtgtccaaaggcttgggcggcttcgtagccccccagcttggacttaactcactttcgcccccagcccttgtcgccataccacgcgggtactgtggcgaagggtgtggtgaaaggggtcccatttcgccttttcggtctgggtcccccatggacggcgccagctgttgtcgaatggacaactatgccatgtcgaaaggcgtggttctctcaacagtagttggaatgtaaaagcaattgtattgattcgtgaaatattttttggggatcccccattacatggccctagaggtttatttatagccttagcacaagcttgcaccttctagggtttagggttacaggggattttagatggctgcccttatgaaagggacatttacatgggtatgcagtgtcatttgcacatatgggcctttaatgggctgataggctgggcctggtctatggcaaacgggcctaaaaggccgggggcggcctgttgggcctccttgatgccgaactcgtcatggcgaagtctttgtagttcacccgagataccttcgcccgagatgcctttactttcggaataccgacgcggctttccagccttcgccatcttcgcttatggctttcgccatagggcttcgcctgaatggccttgacgtctttggcttgaatccttgctggtactatagtttcggcaggtccgaccgaagggcttcatgacatgcctccaacaatatatattcttgtcagtaacattcgcatgtgcagtgtgttgtgttcatggatgtcatcgttacttccattcatttgggttgttaaggacatgcaatataatggtattagacgcatagtagattgtacgtactgatggtattacaagaaagcatgatagtggatgcgtgtgacaagcttgaaatggaaggcatcagggattcaggaagcacggtcatgttttgtgtgtcttcatcttactaaagctgcatgcatcctcagatagttagagcaacaagttactgttgtcagattgagtcggctgaattattgtggcatagcctatttgccttggagaaccaactggagcggatcttgtaatgaagggttcagttgtttgcttacttgagcacaactactgcaaaccaactattgtggtcattaatttttgctttacagtgaaaaccaataatttgcgttatgcacataacgtataaatggcatgcttgttttgtttctcatttcttttgtttaccttaaataaaacatgctgacataatgggttttgctagaatttgctctctagctacatcaattgtttctttcatctggagagataggcagaaactagaaacagagaaaatgaccaacaaacaacatactcccttcgtttctaaatatttgatgccggtgatttttttaaacaagtttgaccgttcatcttattcaaaaaaatttaaataactattaattcttttcctatcatttgattaattgttaaatatacttttatatatacatatagttttacatattttacaaaagtttttgaacaagacgaatggttaaatatgtgctaaaaagtcaatggtgccaaatatttagaaacggagggagtagtttttttccagctgcaacactatggatttttgtaattttcttcattgccatatagaggacaacaaaattgatttgtggccggtgagatctcatccgtgagcaacagaaatatacaagcaggtacttcaggaactataaaaaatttatctaagaatattcggagttatagaaagcgccaccacaaatcagatgagaaatcatggatacaaggaaaagtgcaaaacacgatggcactgatatgccatgcatctgtatgaacagcctcaattcgatccattggtcttgacgattggctaatgaaggctgatcgtaccaaactattctcaaattgaacccacataggtggggataatttacagtgcatcagaattcagaaatatcaggtcaataagtagcagtcaccttagctatccagtagccacactccaggcgcggaagttatagaggcagtggacatggtgctattagatcgagagagaataatgcacgcgagcacacatgcacaaacttggaatggaagacctcggggatttaactcacgcatcattagatcatgtattcacgccttgtaacgctcgagcagtgctcatccacaaaccattggattgagtcgccagctgtggagggctgttgagtgtgttcatcattgtcacgcccagaaattcactagtaatttccgaacttatttgtgcataaaatcctcgtccaggaatcagccgaggtacacaaactgacaatttaatatacaaatccatcataataataacgttacatacttacaaaagaaaagaaaacagcagcggaattacagtctagcgaagctccggctccactcccacaggcaccgattgggtaacttgctggatgttaacttcattgctttccttagtctctgatttgatctcaccaccgatgttcaactgttgcgactgtccttgacttgcagaagaagatccaccaatttggagtggcttgatacgctgcctctggctactactttgtgcctcctggaaaacagtcattcttctcttacggttgtccatcctgttcttcttgtcttcaagtcgaattgctttgtcaaccagctgctgaaaatcaacatagtcatgtgagatcaacgtaactgacagttcatccttcaggccttccaagaacttctcctgcctttcctcgtcagtacgcacatcttctggagcataacgggccagacgattgaactcatgaagatactctgccacggtatgatccttttgcttcaatggcctgaactcacgcttcttcaaagcaacaactcctgcaggtatatgtgtcttattgaatccttttgtaaactcttcccaagtgattggttgtcctcctgctctgttcatccggaaatgatcccaccattctgaagcagatccttgcaactgatgtgaagcgaacacgactttctcctgatctgtgcactggagcaattccaacctcttctcaatagtgtgcaaccaatcacctgcttccactgggttggtagtgctagaaaaggtaggcggcctcacacgaagaaaatcagctagcttgttctgaggcggtggagcattgttgttcccttggttgagctggttctgcatctgttgcatcatcatgttcattaactaagtctattgagctagaacttgagccagagttgggttcccttcattgttattgtttccacttccactggcgcgagtgttcaccatctgttgcatattggagaagatggaagcagagaggttacactaaagacaagaccttaaccaggttaacactgatctgatgtgtgtagaccattatattgttcaagttgattaagcaagcaacccagtatagttacacgctcatcactgaacaacaccaatgatgggaatgcaaccatacctacacacaagcaagcaacaaacgttctaccctactaactgtccttcaaggatagtttggcggcataggttctaaggtaggatccaaacttcattccatcttgaccacttggcacttcggttcatcctcgatccacttgactgacctccataggttgaccacatcaacgtcttctagtttaaacaactagtttcagaactactcaagttgaaagcaggaggggagaggatgataaaatgatttatagagaattctagagaaggaagaaaggaaaattttcacaaatcatgttttcggaaaattagtccttaaggtttgaccatttggctcatcctacagtcaagatggctctgataccaacttgtcacgcccagaaattcactagtaatttccgaacttatttgtgcataaaatcttcgtccaggaatcagccgaggtacacaaactgacaatttaatatacaaatccatcataataataacgttacatacttacaaaagaaaagaaaacagcagcggaattacggtctagcgaagctccggctccactcccacaggcagctcaactggggtataagccaaacgtcttctcctttgcaacttgtcttcaattgaggtttgattgattattgcaaggtgagcatatgacatactcagcaagccacacaacaaatatgcaagtacacatggataccaaaggatagcataatatagggctcatttgcaaaagcagcatttagcaaacatttgagaattataaaacaatagagtaattaatcatcaatattaatcaacactgaacagcacacccatgctgcacaggcccaaccatcctgaacaaccatacccggctgcacagatctatctccaaaccaggagctaaacaaattattaccaattatatcatcatttattatggtgagaagtgtgagactaatcacgaaagacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccatctgcacaacacaactcaccacagtgcaccattcccggatcatagtcacccccttataaacaaggcatggactccccagcgaccctcgtgggcttatctccgccacttctcagtctggtgctccgcaatgaaccatgctatacaaaacgtaaagccgttgcccacgctggcttgtggttggcacggttaatgtttcacaaccgaaaatcgtgaaccggtccttaattgtcatgagcacgactctcaaaaccatgtgctcacaacccaccattatcaagttttagttggcaatttaattaattaaccaatcacgattgaccatcgtgaactatcattaagccatcattaaataatagtgaatcataagttatcccgattgtgtgctaatgtttctaagcatggctaagcaactatgtctaacatctagatgaaccaatatatataaagctcaactagtcaaattataatatcccaaggtatcaaggaatagaataatcaatgcaaacaggccataacaaaggaatagattcacaccacccagtaacattcgaaaataaatgcacagttgaaataaatagagaatttaaatataggatcaacatgctcaaaggaactgtgcttgggatctgtgtgacttgccttgcaataatcggtcttcaattaatcttcttgaacacttccggcgctctcacgaaccttcgaaacgacggaaacgacaagctaacacgcaaaacaaggaaaacagtaagaaactccaaataaacaatacatataaattcaacaaacatgtaaatcataattttagatgaattatgagacttgaacgacctcattctgacttcatatgaattaaatatgaattttacaagatttaatctaattaaagcccatttaaaaaggattaaataaatttaattctatttatggataattttaatatgtagatctttattttatacaactttagagacttgaaccaactaaatccgagctaagatgaattagttatgaattttcaaagattaaatcggattaaatcatttatatggatttttattgaattatgacgcaataatgaattatttttgaaaagaaaaagaggattattgcgtcagcggctcgggttcacggtggaccgggtgcacaggaacggtctacggaacggacggtctagatcaaccctatccacaacgaacggccgagatcgatccagaccacggcggtccacgagacacggcgacgatgacgtcggcgatgacgtcatcactggcgacggctcgggtggcacatgctcgccggcgaacgacggcgcggcggcgcgaacggagggcaccaacgggtagagggcgacgcggcgatccttaccgaggcatgaacggcggcggacggcgaccggacggtgatggctacgaggaagaagcggcgatgacggtcgggttgacgacgacggtggtctgccggcgatgacggaggggcggacgagattggtgacggcttggcgaccacggcggtaacctccccgagcggtgacgacgagcggagcgacggcggcgcacggctggacgaacggcggcgacggcggcgcacgggctcacgaggctagggtgctacaggcggcagcgggcaaaggcgagggtggcggcgagtagaggagacaccgggggtccttttataggggctagggggcggcggcgaaggcccacggcggtcggcggcgcgaaggaaagtctagggttcggggaagaaaatcgaatccggttcgatctcaaatccggcgatttccaaacgaaattagccgacgattccaaaagggaaaagatagagtggatcgcggggatcatttcccctctatcgattcggccggagatggaaaggagcgacggaatttggaagggcggcggcggcttgcgggtggctagggcacggctgcggcggcgtgaggttgacgacgaccctgacaggtggggccctcctgtcagcgggagagagagaggagagcggtggctcggttgcgggccggcttgggccggggaggaaagagagagggttttgggccgactttcagcccaaagccaaaagaggattttaaaacctttttcaattataattattcatgaaatgcaatttcatttattaaaaatacttccttggctcaaataaatcctagaaaaatctaggaactatagaaacaagagaagtatttaacaaaattttatctagcccacttttatattgagatttaacaaattaaaattagatcttctcttctaggcttttaagatcatttctaataattcccttttagacaacaatttataaattaaggattttaaacaagaaaagtacttaacataattataattagatcattaattgattactaattactgaactgttctttgtatcatttaggaattgagctctgagaaaaaatcagagaaaatttcagagagtataattaatcatggagaatttaataaaattaaatccaaccatgctttaaatttagaaaattttatttcccacatttaactttacttgaaaattaaagaacatttaatataaattctattattaatttattagataatttataaatcctgaaacgaaattcaggctgtgacatcatgcacatcctgccagcatggtactgcgaagaaggggttctagggcacacccctagttagtcatacgccctttgctatgtcttctaggtgcaccagctgtgaagcctacctacttattcgcttcctcggtgaatgaaacgttgtgtttgtagaaatgaattaatggtagccagctttcatcctctatgttatcaaaatattcatatgcaacaattagtgttataagcaacagtgttgttagtaatcacataaacccatgaatttcgagcagaggtattgccaaagaaaacatgctcccataacgctgtagttgaaatttgctcaccatttcatggattgattaggtttcaagtttcacctccacatacttgcgtgaattggcagcacaaaagatgaactaaaaaaccaccgatctttgtgttgaagcatttccggtttttcctattgccatttgaaaacaaaatcgatatggggccagtatgtcctaaattaatacacgccatagacaacaacgacatctatcgcacgtcgtgatcatggtgcacgacttgagttgtgacgcgcttggtcttgcttcttcacaaagtgctcagccagccagcaaaacggagggatgaacagaggaatctagatacccaaaggaactcatcacatgattacaacgaaatctaacaacagtttcgcaatacaatttcatttaacacaacattattagtttaacataagaactagacaactagttccttaaccagtcataagtaaatcagctagcaggtgaagaacacatggagaaatgccaacgcagacacgaatagactacagagcaacatgtgaaatccaaccatatgggcctcaactcctttcgcagatcaaccaagaatgtctcgcatttgaacctgacaatcagaaagagagcatacgctgcaccaaatctagactaaagacttaataatcaactagatataatgtatactttgttgattatgtgggcatgcatatgtttcacaaactcaacatgtaaggcatcgagatcagtcagcactggtgtttcccttaccactaggcctgcttttgctatatggtacctctcctccgacgagtcaggagaacgaatgggtggacccacaaatcgacttataggtcaattacctaattggcctataagtggagttgcgggtcaactcacctacagctatatgaaccattgtaaccataaattaatgatgtttagaaaatatgtggtaaagtctatacagaaaacttgaaattaagctaacatttttaattttaaattatttatttattgcttacaaaaactgcaaaaacatgatcacacaatgacacagatagcgtaaaaaccaagcttctattgcggttattataattggatacatgccattaaaaatttaccagttttgaaatatgccactagtattgatgtatttgaaaatataccattataatttcacacatattcaaaagataccactacttaccccttggatgcatttcccaaaaaattggaccaaaccgccccttttcccctcttcttccttcttccctttctccttcctcctctcctccttctcagcggcgacgtggcacgtcggtggtagcagtagcgtcagcgcggcgcgtcggcggcggcggtggccgcatcagcgacggcgcgacacggctcggtggcggcagctgtagcagcggcggcggcggctgtggtagcagcagcagcagcgcagcggcggcggcagcggcaacagcaacagcgcagcggcagcaagtggcggctgcagcaggagcggcgcggcggcagcgcgagcagcatcaggagtggtggggacagcggcggagtgagcggcacggtggcggagcaagctgcagcgcgcggcggcatggatagcagtggagcgagcggcgtagtggagaagagagagagggtagaagatcgggaagagagagatagaagatgagggcatttttgtccaatacatgcaaaatatgtgtctcagtggcaccactaagattaggaacaagtagcagtggcatcgttacaaatatacatattgtaatggtatattttaaaccggcaaaattttagtggcatggatctaatgaaccctatatttttagttgaatgaccagggtgtgctataaattaggagaaataattgttgcaggttaccaagaagagtgtgttttttttttgggcatttgcaaatttgccaccggttttttcaatattgcaaggatgccactcgaaggacagttctagtggtatttttgcaattttctagtggcagttttacaataacgattcaaagtagtggtaaatttgcaattgctcctttatttttctgtttattatggtggacaagagaaaagaaccttgtgaacgacaaggaattacatgttaaaatatagccattcgatcaataagtggttgctagggctattttagttgctagactgggcagtaaaccagagcaagcggcatacttacgagactttgagtataggagttaactagtagaactacacaaaacccaggatggaaatcacttcaatttcataaacgatggtattatgtatatacccaggcagctaacctatacctactctttgaaccgaagctgtcattaggcattaattcgatgcggctgttagtagctcacttttgccgattaacatctgtggggctgaacggaaccaccagtgaatatgctagccacacgctggagatggagggttcagtcactaattgcatactcaagatatggatattccgggccagacatgagttgatatggattagaggcaactggtaaacaataggaatgagagatggatcatttctttctgtctagttaattagttactacctactgtgatatattaactgctaaaaatatggatgacacatgagaccatactataccctaatcataccttaatcaatcttatgttagtcatctgatcatttgcatgagccataccctgcctccctcttaatggatatctattcttattatgcccatcgtagggtctgctagtccaagtaggtggttccaaaatgtaccctgattagccttacatttgtcgatgaccgtctattaaactaatagatgtgttagtattaattatctctttaacgagatctacatggttcttcattgatagatataaaacctccataatcataataatggattataagccccacatacctccatggcaggtgatctagacaagattaattcctaatgtacgtagaaattcttctctgcacgatacctcatgagtcatcacagctctgacagaacagtagcttgaggtatgtcacaacaggacccgacgtagcgcaccaagagatttttccaagctagttgaacccctaatgcattccattccgagttcatgagactctctactttttgtgttaggcattctatgtcctaagcttgtgttgggtgttccatccatggatgctaagccagttgcgtgcgtagcttggcacattggcatttatccaccaattatttatctaaaaccgacacatataaagtatttttcatcttttgttagtataaaattaaaatctggcacctataaccagtcataggtatgggcatcatatgagtccacaggtgccagtacagaactaagaaccggcacctgtaaccagtcattggtatgggctcctgtaaccagtcattggtaccggcacctataataacgtcgttcatatatgtgtttattgcgtacatcagttgtgaattgctcggcttccatcattgtgcaagcagggaagaaaggcagccctctttgatctatggctccaatgtgttgacgatgtggcttaatctattggcttctttaaaggagttaatatttataatgggtataccatctatatagaaagaaatgattgattaatttactggctttttaataatatctgttttatattagtgttaaggtaccagtaccgcaaaataaggacgaacctcctaattgctcatgaaaaacacactattttagcagtgtagaattgcctagattctattgacttatgttattggcttcaatgcatacacccaacaagtactattggcgcttctaaatagttggtaggaccagatttggcatcaacgagcataatttggcatcaacatattcatcctgcacgcaatacaagcataattaggagtttgctagctaaactatggccgagtttagatacaaagtttttcttcaaacttctaacttttccatcacatcaaaactttcctacacatgaaactttcaacttttccatcacatcatttcaatttcaacgaaacttccaattttatcgtaaactaaacacactctatgaaacaaccaccgtaaggtagttgaatagttgattctcatggcatagaacttcttctcttcacgattcctcatgagtcatcacaactgcgacagattctgccatgtatggctagccacagtagcttgagctatgtaacagctggaccggaggtagcaccgagagatttttccaacctcgttgaacccctaatgccttccattccgagttcatgagactctgtaccgtttcactatttgtgctaggcatgctatgtcctaagcttgtgttgggtgttccatctatggctgccaagccagttgcgtgcgtggcttggaacattgatatttatccaccaatggttccacttttgcgttgccgtggagttaagaggaggggcccggcagaaacattttaaaagtagtgtacccttgtgctaaatttctcgtggttcatctgaaattttgatcttctactactcgtggactcctgccaagatatcttcccgtaaaagcaaattatgtgaatttagaaaaaaaatgtttaaattccaaaatgtttttatttcaaaatttcattatgtcatagccaaaaatgtttttttatatctccatgcaataactagaatttggcaaaaagttatacaaattatattctttgtcaaccataagtatttttttaggaaaaatttgctataggacactcaaaaatcgtttaattggctgagggagaccacaagaacatgtatttgctgtaggacatcgcataagtgaaatcaaagtgtgttttgactatattcatatcacgaaacaaggtagtatatgtgaaatcaccgtgtgttttgattatattttgatgatgaacaattggctggtatatattttttttattaaagcacagtgagggaggcccccacggtatatgttaggcttgtatattattgattttgatattttgagattattggctgctgctgctgctgactaggttagcccggtcaaaccagacagtggtggccggtcagaacatcatggtttgtgcagttagactggccagcccgactgtctgactggccggctctaagttggttttcgttttgggttgtgttatgctcatggttagtttatgtttatggtttctacacgatttctacatatgtaatagtgttatgtgctaatgttgagtcaagtcggagagaatttgtgcttggatatgatttcttgttgtttgaatcatgtgtaggtgtcttgatggctcgggagagctttatcggtgatggatcaagagtcaacttggaagaaaatgatgtccacatgatcacgatatcatatgggatgcttagtctaaagaaccatgcacgtggttgatgtagattttatgtggcatatgatgggagattgtgtgcgtatggaataaggagtcaaatttggaaggagtccagacttaggaagaatgaaattcaaatcgtaaagttaggtttgtgacagcaggctgcctacctcggatataaatagaggggctgggttgagtcctcccagtatcgattatgtgtgagtggagtttagggaaaagttagcgtttcgagtttggtcaaattttctaagaggactattgttgttgcactttgtaaactttcatctacatagagaaatcattgatttatgttgactcgggtatcggtgactactgtctggtcagactgacgggctcagggcggtttaaccgaaggcagcgaagggggcgacaggtatcagcagggcagtcagaccggaacatcatcaccggttagaccggagatctaacaccggtccgaccaacttccggcagatttcgagggtaactcttagttctgcaaaaagttctcagttttagtgttggtaccatttaccccgtgtaggcttagttcttgttatttgatcctacagtttaatcgtattatatttatcaatttagaagataggcagcgtgaatgcatttctttgacttcactgtcttacaaacaaatttctccttgctgatactcaatgaacgaacaaaacaaaatcattctaaaaaaacatatttctcttttttttactacgtataattattgaacatcccttgaacatatataatatcaagaaaaaaacgcactaagcatctttggatcataccttggcagattcttgcagtaactagcttgaagagctaatatttcattattggtgaactgcatatacaatgttgaatggaagagaaattaatcatctctgattcattttgttcatataattccagatgcaatgaattcttcttgcatccaacttagctacagaggctgcaaaaaatatctcaccagcagataaatatggaagcaaatagaacgaaaccttgatcatctggagattggtgtataccaaattaagattacttaggaaattagatgatcaaatggattgcaccacttcgatgatttcctcatgtagagaccggtacacaatcaacacttttcttcacactagaacccaggctataaaaggtaaacaattgtgtggagttgtggacatgtgtacgccagcgttgccgtagtagctgcagaggcacaaaaacgttgcagccacgctgccgtgatgaatcgatgttctgcacttctgatgaaggctatgaaagcagcccaggatcttttatccatgccagacaattcggatgctaagcttatttggtgattctggagcaaatatataaggcgataaggcttggaaattgctttttgcgtatttatcttcctttatgcatatttattgcgtacatcagttgagaattgctcggcttccattagttgtgaaggcagggaagaaaggcagctctaatgaagggtgatcgaagggtcattctgttatgaaaatagatgcacaaccggcaatgatcactatagaggagatgactacaaacataggaaaatcacaatgggaacatcaccccttcccgtacggcttacaagagtatatataggggataaaagaaagacacctaataggtctcctaagaggaaactaatccgaatatattgtgggcccaaaattcggatcacatatttaacaatctccaccttgagacgaatttcctcttgtagcataaaaaacatcaatcaccaaaaaatacctcatgtaggtaaaatcaccgcgcgccaaatagtctctaggactatactttaacaccaaccaagcttgagcaaagctcaaacttagtagcaggaactgcctttatcatcatatcagctgggttatcatgagtacttatcttgcataccttgacatcaccttcggcaatcacacctcgaataaagtgatatctcacatcaatgtgctttgttctctcatggaacatctgatcctctgtaaggtatattgcactttgactatcacaaaatatattaatgcaagacgtaactccacaaagctcagtgtacaaacctctaagccaaagagcttctttacaagcttcagaaatagccatatactctgcttcagtagtagataaggcaacagttgcttgtaaacttgccttccaactaacagcacatcctccaatagtgaaaacataacctgtgagcgatcttctcctatccaaatctccaggaaaatctgaatccacataaccaataagtccatctctagatctcccaaactgcaaacaagcactagatgtaccacgtaggtatctgaaaatccattgaacaactttccaatgctctttgccaggattagccatgtatttactgacaacactcaatgcatgtgataagtcaggacgagaacataccatggcatacataagtgaaccaactgcacttgaataaggaactctagacatgtactcaatatcataatctgactgtggacataaatctgaagataatctgaaatgtgcagctaaaggagtactcactggttttgcatcatgcatattgaaacgacgaagaactttttcaatataacctttctgactaagatataacttgccagaatgtctttctctagtaatttccatactgagaattttcttcgctgcacccaaatccttcatctcaaattcactactcaattgtgccttcaacttttctatctctgatttatcttttgcagcaatcaacatatcatcgacataaagaagcaaatatatagctgaaccatcaacaactttaagataaacacagctattataattggatcttctaaacttctgagaaagcatgaaagagtcaaatctcttataccactgtctaggtgactacttcaacccataaagagcgaattgaactatgcttcacaacaggggaaaagacatcattgaaatcaatacctggaatctggctataacctttagcaactaaccttgctttgtatcttgcctcatcactgggaaacataccttcctttcttttaaagatccacttgcaacggataggtttcttctcctttggcaacttcaccaattcccaagtatgattcttttcaagtgactccatctcatcatgcatagtagttatccatctattgcaatcatcagaaacaatagcctcagaatatgtagaaggttcggcattaccttcaatttcttctgttacactcaaagcataagcaactatgttcgcttcttcaatatatctttgaggaggtttagtatttcttttgggcttatcttttgcaatagaacgttttggaaactgctaaacaatagaagaatctgaatcttcaataacaggtgcatcttggttaatagcaacatcttctttttctggtgcatgccctgaactgatcaagtgctccacctgcacacttgctttttcctgactctcaacaggaacattagtagaaggtttgtcatgtaacataaccgattcatgaaagacaacatttctactaatcacaacctttttggtttcaggacaccataacttatagcctttcacaccagacgaataaccaagaaaaatgcacttaatagctctaggctccaatttaccattatcaacatgagcataagcagtacaaccaaatactcttaagtctgaataatttgctggaaaaccagaccataccttaattggagtcttcttatcaatggcataactgggtgatcgattgataagataacaagtagtggaaacagctgccgcccaaaactgtttaggtaaacctgcattagacaacatacaacgggcctttgatataattgtcctgttcatacgctcagctacgccgttttgttgaggtgtgtagtgacgcacaatgccttcagacttgcaatatgatttaaatatcttagaacagaactccatcccattgtcagtacgaaggattttcaccttcctttcagtttgtctttccaccatagttttccactctttaaacacatcaaaagcttgatatttgtgcttcaagaaataaggccaaacttttcgcgaataatcatcaacgatagtcataatgtaacgagcacctccaaaagatgtcttacgagcaggcccccataaatcagaatgcacataatcaagaataccttcagtagtatgtgtagatgtgttgaacttcaccctcttatgcttgccaaagatgcaatgctcacaaaatttgagcttcccgatgctttgtccatctagcaatcctcgcttgctcaattctgccaaaccaatttcactcatatgcccaagacgcatatgccaaagattagtagcatcggaattagataatgaatcagaaactgctgcaacattacctaatatagttgtacctcgcagatggtacaggttggcagatttaatatcagctttcatcacaacaagagagcctttagttaccttcaaaattccgtctccaccggaatatttgtaccctttgcgatcaagagtacataaagagatgagacttctcttcaaatttggaatatgccgcacatctgacaatgtgctgatacaaccatcaaacatcttgatctgaacaattccaatacctgcaacctcgcatggtgtatcatcacccatcaaaacagtaccaccttgcacagcttcataggtggcaaaccaatccctattcgggcacatgtgataggtgcatgcagtatcaagaatccactggtcactagtttgtgcacaaccagcataagcaacaagcaattctgcatcagacttctcatcagtaacaactgcggctttaccttcctcttctttcttaccttttggtacatattttccggttctcttgtctttatcctatagcttccaacactcagagatatcatgtccatctctcttgcagtatttgcatgacttatacctgcctctggactttgatctcccacggtagctacttgaacttttatctcttgatttgttgtttgtgttcttctcctgttgcctgccccaaacaaccaagtcttatgcttgtgaatttgaaccttcagagggtaccatcttcttcatcttttctttggcatgcaaagcatcataaacttctttcaaagttagagtatcacgactataaagaatagtattcctgaagtttgcatatgagctaggcaatgaacacaataaaataaggcctaaatcctcttcatcatactttacctccatagactcaaggtcagcaacaatttccttgaaagcggagagatggtccatgacagacccatcatcttgcaacttgtgcaaaaataacttttgcttcaggtgcatcttactggtcagatccttagacatgcatatttgttccagcttcaaccacagcccagcggctgtctcctccttaagcacctcctgcaaaatattatttgatagatgaagatgaatttatgacatagccttacgatcccttttcttctcatcgttggaccaatcctgtgtcctcttgtcaaatccagaaagcgcatcatcgaggtcttgctatgcaagaacggctcgcatcttcacttgccaaagtgagaatcttgtgtctcggtccaagagcggtagatcatacttcaaactcgccatgggaattaatcctgaatttgctagaaagaaattagggtaaacctagcaaaacgcgaaacctggtacacttctcctgtgcacgtagcggtagatctgaaacttcctggtacacaagcttgtgtgcgcgtagcaattccacgtgaatagaaaatcacgtgaacaggaacctgatcgcttccctcgttgacttccttttcagactcgggaaccgtgcgatttagtggatgtattcacgccggctgctactcctggacgtgcgcgtagacggcttgctgctgctgcttgccaatctcctgacgcgtgtgccgtttccaggacgtgggctactgctgccctaatttcgcgcaggcggtagggatgacgccgatcagatcgatccggcgactcgatgatccggcgcctcgacgaatcggcggcggctgcgtgacgtgtagatcgatctccaaagctctgataccacttgttatgaaaatagatgcacaacggagacacgaattttacgtagaaaacccttgcgggaaaaaaccacgggcgccgaccggcaatgatcactatagaggagatgattacaaacgtaggggaatcacaatgggaacgtcaccccttcccgtacggcttataagagtatatatataggggataaaagaaagacacctaataagactcctactaggaaactaatccgaatatattgtgggcccaaaattcggatcacatatttaacacattcgaacaaagatgatcttttgatccaatggctctaatgtgttgatgatgtggcttaacctgttagcattttttaggagttaatataccgaaagaaataattgattactagaggtactggtattccgacttctgagtaccaaacatgtatcaacccagacccgcctcactccacgtcctgtcattctgctcccaaccggtctcgcccccacttcattctttccttttttttccaaatatgaatcaatccaccatcgcagcctagaaatcggtgacgcgccatggaggaggacgacggcaccgtggcggttgacgccgatggctagcggttgaatcgaaggcgctgcttcggaccttgcggcaagacatcgggcaacaccttaaccagcaaggaggtgttcacttgggccaagagcaacaaccgtcggctgctccatgtcggtggcattgacagaagaagcaagtaagcaaatgatactcctatttgcatatatatactctccgtcaccttcatgcatgcaaccccaatttctttttgcaaatcaaattaatgtgcaatctcgaatattacctgatcagaattgatgggctacaaaagttctacatttgtagatcgtactccatgtggctagctgtaaaggatagggtagagtccgccgatcatggaggttgtttgctatttttcttttgctcgtcgtctctatgacatgaacaagaatgtttttgcatatttttgtgcttgctagatgatggatggttgctactgtgtaacgccgagctcatctctataccacaacattacatccttccttgattccatcgtcaactaacgctcgccacccggttgtcctctccactacgagtcacaagacacagactagcctctccatccatatagcaagatctaacaatcctaccaggatctcagcttcacgatggatttttggctgaatcattttttcttttctagtttgattcacctatgagtaattttatcactcgtgtgtaattgagcctgtaaattttttcatttgtactgctattttgtgatacaaattaataattctcttatattgtgtattgaacacatcggttaacataatactacatggtggcacgagatcatgggctatatcgagagtaatgtggtaattgttttactcgcagaccacaaactctagaaaatatttataacttgtaaaagaattactagcattgtaagctggtagtaattcttttacgaccatctatgaatagtgccatacgatgtgggggcattcatgcaagtacatttgttacatttgaaggatacattcgtgcgagtaaatttgttacttttgaatgagtagatctgggaggctgggagtaaacggaaaacatcacagagtaaattcattacttttaaaacatgggaatacactaaaaaataagaaaacgtcgaaagaaaagaactacatgataaatactttactaaaacaaaaaaatagaaaaactcgagagtagaaatgaaaaacggaaaaatctagctggttcattttttaccaggccgtttgataaagcgtggatgagatggaaaagagaaaaaaaagaaacacaaaaggtgaggtggtaaaaaaaaagaccaagaaaatttgggatacgaaggaaaggtggagtggtaaaaaagggaaaactggaaggagggatctttgtgtgaaggtcgaactaatattcagtgcgcagtgccatatttgcgccaccgttaattgatctactggctttttaataataccgtgttgagctaccattaccacaaattaggatgagcatcgttaggctaattactcatgaaaaacacattatttcagcagggtagaattaccttgattctattg

SEQ ID NO: 70652 - DNA, 3098 bp, Oryza sativa
gggggcgacgggtgcctcggagccggaggccggggcgggcgccatggaaggggcagcagaggagtgaccggaggcggcgacgcggatgtccaccttctggccgatgccgcagtggcccgggaagccgcagaggaagtagtggtggcccgtggcgttgaggaccaccgagtcgttgcccgtcgaccaggtggcgatcggcttgctcgtgtcgcagttcttgtagtccgacttgctcaccgccatcacgttgtggaactgcttgttgtacgtgaagactgcacggctttttttttttcagacaagagaaggcaaaaaatagtcagtcaattcagcaaaacacgagagagatcaaagttcttttgagttcaatacaaaaaccatgaaaactctgttgttccgcatcttggactaaccatcccttagagggtattgttaaaagatcctcgattcctaatgaaatcgatttagtagtggcttgatggaagcctaacgtttttatttgatccagtatatgggatgtatatcccattccgaaatgatatattaatctgctaataagtcgttcatagcagttccatctatctctttattatgaaagaccagattggcccgttccgccataaataagtacctctttttcggctgagtataattcgacaattcctgagtaggattcgacaatgggcctgagtcagtgattcgaaaacttagttaacttcctttcctaaatctcaatctggattcgtgcggcaaaaatgatgatactagcgaaatcggaatgcccctcgaaaggggcgaatctaacttccttgtttagatagtgtatgaataggcctgactaaatccttgtatggcttcctctatttctctgtaaaaagaaatatgaccaagagtaagactggggtacgtcatgaagctttgtaaaaacagagctagatcatactagtatcatgcatcagcatgatgaaacagatggtcatttgtgcaaaaaagtgatgtttttattttttgtactacttttggttgttgtggaacaagatgaacctagtgcagttcatatctggaaggatcctaccagctaactcgatcgcaatcaccagatatgacatgcttgagagtcactactaaaagctctatcatgttcagttagttatatttcttaatctattccactcctaaaaatccactctctagtgtctagtatccttactaatgactctgactggtgacgactatacttggttagatgtgattgggaatatatgctgttatacataacgataaaaacaataacagcattggtttgacaaaagaaacccacggcaccacgcgtaactatctcaaagatactataaatctagaaccaccaaaatagagctaaacatgtgaaaatcctagagctagctactttgactgatcggatggcatctctccagggcaacaaatgatatgatcgcaatgccaactttccagctcatgggccaaacccaatcaggtgtccacattgcaaaatggcagtttggcaaccctatcataatagaacagcgataatcatagaccctctttctggacgagctatatgcatttgtggttctttgattactctatgcttccaagttccaaaagatggcatccgtgccgtcatcttttcggcccaccaaggaagcctaccaaccaaccatgagattgctcaacagaaaacaatgattcaatgagagcgcatgcatcggtgtgttggccatagggtccaacataattttgacaagctgtggaacagatagcaactgagagcatgaaatatactcctataaagttgtggttgattaggatttgatcatttaattcaatgcaaagaacaaacattaactttcttcagcagaggcaactgaaaaaaagtgcctttggtgccctctttttttaatctcagctaaagaacaagtgccttcaaaatagtcggcacacatgtctaattgtgcaaaagaataaaacgcctttccttaaagcaagaaaagctaatccttacaggaataattgagcaacaaagtactcacaactcacaaggagcgctagagcttaaaaagaaaaacaagtgttatggctgacaaagtgacaaatgactaaggctgtgtttagttgagggggaagtttggattttggttgaaattgaagatgatgtgactgaaaagttgtgtgtgtatgacaggttgatgtgatggaaaaggactgaagtttggatccaaattttggatctaaacacagcctaaggccctgtttagatcctccaaaatggcaaaagttttaccattttatagcactttttgccattttgaatttaaacactagtagcaaaagttggcaatttggcatttggcatttgctagtccatagtagcaaattgtgccaaaaagtgctttgggaccactccctctctctttctctctctcactttagtgctagaatggaaaaactttaacatgcatctaaacaccaactagtacttttgcaatgctaaaacttttgccatcaaaacttttgccatttgtcatttgccattccaaatggatctaaacatgccctaatttggccgtgccttcacgctccaactcacacgcaggcatacagatccttggtgagaagggaaagtactcatctggtagtgcgcgctctttccgaaaccagcatgttctttggtggagaagaaacacaaagaaggccagcgctatctgacgtcaggtatccagatagacctgtttggattcatgccaaaacacggagtactctcgcttaccacaccaaccgcgtgcctgcgtgtcggcgcgccgctacgccagaacgacagatgcgcgtggaacacgcacacgcaccgggtgtggtgcggccgtgcaggccaggcaaacaccgatccggctcgcccggcgaaaaggccggtaaaggccaacggatcccgcggcgccatccacaagccggcgctccgcgccccacgcgcgcaccgagggagagaaggcgactagcgctgcggccagcggcgcgcggcgcgtgcaggcggtgagggccaccagctggtgccgtgtgccgtgtgcgtgctgcaccgaagtccc

SEQ ID NO: 70653 - DNA, 29055 bp, Oryza sativa
ctaatagtatagattagttgcagagtttatggggattctttgattaattgttcaaaagttcagtgcaaatctgagtaattagcttagctagcttggatttgttggttggttatgactggttcttgaattggcgggagtagctttcagtatggttcgcagctgttgctgcagcagttaacatttactacttctactccagtactcaccgtatttaagctagctgaactggcaacctaatcagtggctgaccaacttggcagacattgccagcaagctgcgactactgtcaaaactacttcctctgtcccaaaataaatcaaaacaaatcaatctagaacgggtaatatatcataatactatgaatctttggtttattttggggccgagagagtataactactagcactagtgtaaccgttgatttgagaaaccatcacaagattcatggcacctactagaaggattagcggacacttgctgtccggatcaggtagctagtgtgagggtggttaggcaattatcctgcagtgaaacacctcagttcagtacgcacagggctgggcatggaggtttttcacgcggtggccgtgtattgtgccgtgagccggtgggactgttcttgaattcttagcggtacaggttcacacaaagctagtgatgcggttttgagggttaaccgtttctcctttttttcttttgcctttggaaatggccaggtgtttattcagatatcctgggaaatgaccatgttttttattgataactgaagagttgagatgatcaaatcaatcttatgaaatgagtaacagtagagatgatgataccgaccggtgctagaacatgtagaaatcaattggggcttgtaaaagtaacaaaagtaacaattttactccactgcagagaggctatacagtctggtaaaatcattcattgctccaccttcaccagatctctgaatctagagtgatggtatgaaaaaagtgctctctgaatctgccaacatgtctctacagactacagtatttgtgtaccatggcttctctgctagattaattgaccattgacagacccagccctttttctggagtaacacaaccccaccaacatttacaaagattcagcacagtagtagtactgtactgtagtagtacttgtagtatcatacagtatcaaatgaaagaaagaaaaagatacagcagacaactgaattgattctataccagttttaatgtagacaatttttcgtgtgatggctggtaataggatgccatgtcctcgtcctaggtgaaacaaccacgtcatctcgcgggtaaatccattcatcggtagtgtgattttgtaaaatacacaaccaaaatatatgtacttaagtgttaaatgtcaaaatgtgtgtgattttctgcaacttagaccacaaaatgtgtagttttatgaaatttactctttattaatactatgtctttttgacttttcgcctatattttcttgtcagttaaaagactgaaaatgttttacagtatgagccatcactcccacgagagttcaatgaaattattgaaatggacattatgtaagtggcacttcagtcttaaggagcgaagaatgataattgaagagttgatctaaaagaatactatgatttactactaaagaggtgtttacaaacagaattaggtttaagagcaagtataataatgagctataagcctactataaacttatgtggaggagagaaataacaaaaaatcaagaattttggctctcatgcaagagctagcttaacacaaactcctaggcaaatacattaaatgcataggtgagagatagagagagaagatagttgtagccaaccttatagctaatccattatatatattggctttaagataggctaatagtaggctataagtgagctatatacttatgtggaagagagagataaggaaaagtgggtagtgttggctctcatgcaagagctagctccacacaacctccaagaaatatgcattaaattcatggagtgagaaagagagagaatggaaaaaataaagttaaccttatagctaacttattatacaagttaactctaacattgacttatagtaagcagtgagctttactattaaacttgctctaatatatagatcaccgtagaggccgttgcttcattattatgatgttgaggtctcgtggtccactgtcgatttgcagcacagctcacaagtcacagttctgacctgatcgtctaattttgatcccaaatagctgcaccccaattcttcaatttctgaacaaagacaaactttttttatgaaaagaaaacaaacttaagtgttcttgctgtaatcttgtattgatgcaaaagtggtaacaattaatgattttcttgggtttggaccggctcgcgccatgcattgcaggtcacgagcttcaaatgcggtggcatggcgctcggcttcagctgggcgcacctcatcggcgacgtggcgtcggcgaccgcctgcttcaacacgtgggcgcagatactgagcggcaagaagcccgcgggcaccgtcctcgagccggcgaacaagccgctggaccgcgcgcccgccgcagccgccgccgcgccgccgcgctccgtcaagccggtcggccccatcgaggaccactggctcgtccccgccggccgcgccatggcgtggtactccttccgcgtcaccgagccggcgctcaagaagctgcaatccgcggcgggacgccatgcggcgggcacgttcgagctcgtctcggcgctcctatggcaggccgtggcgaagatcagggcggcggcgtccaaggaggtgaccacggtgaccgtggtgaggacggacatggccgccaggagcggcaagtcgctggcgaacgagcagagggtcgggtacgtggaggcggcctcgtcgccggcgaagaccgacgtcgccgagctggcggcgatgctggccggggacaaggtcgtcgacgagaccggcgcggtcgccgcgttcccgggcgacgtcgtcgtctacggcggcgccaacctgacgttcgtcgacatggagcaggtggcgccctacgagctggagctgaaggggcagcggcccgtccacgtggagtacggcctcgacggcgtcggcgaggagggcgccgtgctggtgcagccggacgccggcggccgcggccgcgtcgtcacggtggtgatccccagggacgaggtcgacagcctccgcgccgcgctcgggagcacgctcctgctgctgcaagacgcctgagcccggagcgccgccgtgccgcgcgtcgtcttaacacgcggcgccggcgaccggcgatccggctggtatgaaatttcgacgagcgtaggacaatcttggcgcctcttttttctctggaatttacgaagtctgtactgtatcatgatgtaccgtaataagttgttcgagtgccagaatggaaatgcagtgttatataccacagtatacttgtcagaaattcagaatacattattgtaagtacttttgggcgtacggtaattcagatcaagcattattattttttagactgggtaattcactgggatcaagcattgttactacggttgaattcagatgagatttataccggtagaattcagatcaagcatttgctactgctagtagtattgcatacggtaatttaatactctggtgaattgcacacagtattttatctggcagaaacagtttttgcacatgcatgtcctccgtctgatgacgttattcctgagtactcattcaattatggctgtgggtcgataaatcgaaatcaatgtagactaccagtacgtgattaatattgcctgcagaaaacacgtactcctaataactgacctgccatggaggcaatgcaaagttgcaaaccatgtactaacgcctgccaactggtcggacatggacgcctgtgacagtgtgccgtcgtgaccaagtgccctagcttttgggctccacaaatatgcttgaattttacacatttttcggaaaattattagacaccttttattatttgcaaaaggccccgtttagatgggtcacaatcttggcccatccaggtagatgggccgagatttaggcccatcaaaacaaggctcaaagagtagtcttcctattgggctggcccaatttggaaccagcaatactaaagcccggcccaagttagcaacgcggcggccgctacaaaaccaatttgcgagggtggctaggtctcctcctctttcgcttcgctgaccccccaaaaccctagctcgagcgctcccttcttccccccacctctgcggcggcggcgggcggcgagatggcgaagtcgctgcggtcgaagcgggagaagcggctgcgcacgctgcggcgggagatcgcgcagcccttctacgacaagaaggaggcggccaaactcgccgcgcaggccgccgcgctcgaggcgcccgcgctgccggtccgcgcgcctccgccgccgtccaaggattccggcggctcccgcgccgcctccagctcggcatcggccatgggtgagccttctctcgtctcagtggttcgtggttgtgggggtaactgtggccctagttttcatgtaggaggcggacagaatcgctctgcgccttatctgttatgtttgggatgcttgtttgagtatcaatccttcaggtagagaatactgcagatttcatctcacgatggtcctggtgcacacaaggttatagctgtagctgcgatcggtggattgagctgaccttccactttattgctttgctcagttagtacatgactatcatgatagttcttgaagtgtatcagcggtggaatttgctccgattgacaatgcgttggtgctatgttgatgtctcgtctggaaacctggaaaaaagcatgttgttggatgccaatttgagtaaatttagctgcaaggagcatgagccgataactgttctgttgtgcgtctttgaaaactattggtgaaacaaatgaaagcttcctttctgaatcgcttgcctatatgtgtgttatgtttggactgaagatgctgttaagttcttttattattaggttgctgtacatctgtttggagtcacttcctcttggtttgcaatttgagtacttgtatcagggaagtgaccaatagtaacatttgtgtgatgtcctgttatgaaattattaataggtaatggaagggtataagtttcaatcaaatttaggtaatggaacatacaaatcagacactgttttgcttcacatgaaatttgcacctgttagtaaacacaaaacctaaccggtagatgcaattttggactcattctcatatatctaacagaaacgactttttcatcaatttgtttctattgctgccttgttgatcaagtatgttgtacttactaaataagcttggtttgttagtatggatccttctgattttccaccatcaaaacacctgattcagagacagatatattagagtcggtttttacattttcacttcaccttgtttcttgactgatggcatgctctctttgtatcaacaaaacagacgttgagatggcggatgaaggaaataacaagtccaagtccttcttgaagccaattggtagcattagcaagaagaaggtacaacttcacttgaagatcaagaaagataaaagaaaagctaggaagaaggggaggtttagtaaaaagtaggtgtcaaagcttactctgttatgagaaccatcaattttggttagtttgaacaatgcatgtaatggtaatctcttgtgttgttgtgcacctaagtgttaaccatccattctgggtggataccgtattgaaatcagcgaaagcagtgagccagtgacaccctattcaggagcttcatccgtattactgatatgatctttttttaagcatctgtgatgagctatatatattcatttcctggtgagtctttgcatctgctctttccgaactattcttagtgataacaaaagggcatgatgttaatttcaccttgcatcttgttgatttcttaatgattcatcatttcataatttggatcattttgccccaatgttggtgggcgcttggagatgggggatgttcttggtttactacatctcatgtacagaacttgtacctatctgttgtattgaagtgcaaatttctttgatccagtactccggtgccagccttattccccgttcctacgatatcttcattaaagaatgccaagtctccaagaacgcatgttccgttctttgacagtttgatagcagtggcatgttgagccgttaggtagcatatgaactgtcagatgctgttgtgcatatgaggttttgtaacatgatcaagtcaacacataattcctggcaatttccatgcactcatgtgcactaaataacagtagttgacttaacatgaaatccgatcagaattcagaaaataacctccaaactgaagaacatgaactgaattttttttggtatcgtatttcagtagctaatttttcatgatactgtatcgattcttaaattcgttgaacccggcacgaacaagctgccttggctgctaaaaatgtcatttgataattatgaatttggtacctgttaaattattgcacgactcgtatcatggtacacgaagaactctggcgttgaatcgatccttgcacgtcttagtccccaacccacacgctcagttgccatcattatccccacccgctgactgacccagggctgcatgtttgttacacctccccaacatttgcacaactcgcacatcaccgaagaaatgttcagacataaaaaaagaagaagaagaaaagaagttgcatcagcaagccagacatactactctctctcggtcccttttcaagtgcagttatagttttttttaatccaactttaaccgttcgttttatttaaaattattaaaaaaaaattaaaaaataaatacacataaatcactattcatgttttatcatttaataacaagaaaaatactaatcataaaaaaaatttaattaagacggactgttaaacgttggacatagaaaaccacaactgcacttaatataggatagaggaagtagtgctttttttttgcaggggcataattatcatatcatggtgtgcaaaggaagcgatgggacaatctcgttatgtttaaattattagggcatttgcaaatttgccaccggttttttcaatattgcaaggatgccactcgaatgatagttctagtggcatttttgtaattttctaatggcagttttgcaataatgattcaaagtagtggtaaatttacaattgcctctaaattaattaggatggacattttccaaaaagacttggagatcggtcagggcttaggacaaaccagtgcacaatgtaacagcgacatatcgcgtagaagaacaattcaaacttgagttatttatttatcttttacgatgtttatgacctcgatttcaagtctacgcccccattttgtcaaaaatattactccttcccccctctgaatgggatggttaaaatgcaaatttaatatttaggtcttttttttctccaataagagttggatgaagtttaagatttttgtgacacgattttcaaactgctaaacgtgcgttttgtgcgaaaactttttatatgaaagttgctctaaaatattatattaatttatttttcaagtttgtaataataaaaactcaatcaattatacgttaataccacattgttttgcgtaaaaaaacttaatcctaatcttcatcttcatcttcagataaaagaacgccacctcaataccactgttcatcgtaagataaattcgttttcgttttcgtggacttgaatttcaagtctcctctccgatggcctctctaccatccatgtcttctccactacgtctcccgcgctaacaacctacaaagatcagagatcgcgagcgcgagagctcgaggtcgcagaggaggagagagagagaaggagatcaagaagcacggcaatggcgaggaggttcgccgccgcgctgtgtctcgcggtggccgcggtgagcgtggccgtggcgacggcgaggttcgtggtggagaagaacagcgtgaaggtgctgtcgccgcggtcgctgcgggggcggcacgaggcggcgatcgccaactacggcgtgccggactacggcggcacgctcaccggcgtggtggtgtacccggcggacgcgaggctggccgacgggtgcaggccgttcggcgaggcggcggcgaaggcgctcaggtcgcggtcgcgccgccccgtcgtgctcctcgtcgaccgcggcggctgctacttcgcgctcaagacgtggcacgcgcagctcgccggcgcggcggccgtgctggtggcggacggcgtcgacgagccgctgctcacgatggacagccccgaggaggagacccccgacatggcgttcctcgccaacatcaccgtcccgtcggcgctcgtcaccaagcagttcggcgacgccctccgcgccgccgcctccgccgccgacgacgaggtggtggtgcggctggactggcgcgagtcgatgccgcacccgacgagcgcgtcgagtacgagctctggacgaacagcaacgacgagtgcgggccgcggtgcgacgagcaggcggcgttcgtcggcgcgttccgcggccacgcgcagctgctggagaagcgcggctacgcgctgttcacgccgcactacatcacctggttctgccccgacgcgttcctggagacgacgcagtgcaaggcgcagtgcgtcaaccgcggccgctactgcgcccccgaccccgacggcgacctcgccgccggctactccggccgcgacgtcgtgctcgagaacctcaggcagctctgcgtccaccgcgtcgccaacgcgcgcaacgcctcctggctctggtgggactacgtcgccgactaccacctccgctgctccatgaagggcgaccactacacccgccgctgcgccgacgacgtcgccaagtcgctcggtgagttagccgccgccgcctcgccggcttacccttcttctcgccgccgccgccgccgctgacacagtggagttcatggcgatggacaggtttgccgatggatttgatcgacgagtgcatgggggatcccgacgccgacgtcgagaacgacgtgctcaagacggagcagattgttcaggttcggtgaccaactgaccagcttgatgctgaaaaatgtagtaggattttgaaattttcggtgtactgacgaacaccttcgccattgctgttcttgatgcaggttggacatggcaccagaggggatgtgacgatcttgccgacgctggtgatcaacaatgtgcagtaccggggtaagaacgatcaagatcacactgaattgtggctaagatcattgttcgatcgaagatttggtgtttgtttctctctgaaacagattgtttgctgttgattttacaggcaaattggagagcacttcggttctcaaggcgatttgtgctggattcaaggagtccactgagcctgatgtctgcctgacaccaggtttgcaatcctcaccagctgaaatcacacttgatcaatcacttgatccaagtactaatcattgatcatgaattcatgatatccactaatcatggcagaaatggagactgacgagtgcctgaacaacaatggcggctgctggcgagacgagaagaccaacatcactgcctgcaaggtaccccattcccaaaattctttgaagatcacaagaaattactgtgatacaaatcaattcaagtagataaaacttttattgactcacttgattatttggcaggacactttcaggggaagaatttgccagtgccctgtagttgatggtgttcagtaccaaggagacggctacacccactgcaaaggttgtactagactactgctaatgtttcaccttcaattcagtgttcttcagaggatcatttcatttcagctcatcttgcacctgaacatggctgaatttcctactgatgtttctgctccactgcaatcttttcagcggtcggaccagggcggtgcgcgatgaacaacggtggctgctggaaggggacgagagacggcaagacgttctctgcttgctcggtactatgataaaaacatgccacctctgtgatgatcttctaaaccacattaggtgtgaccaaaaaatgcttgttggcctatccgccgcaaccgaattttgaattctgaaacttaattttatagttggttttggggtttttatcatcgtagtatgcttttaagcatttggcttttaaatcgtgaacaacacaaatatataagttttactcaggaactatttttggttggttcattcatttctaagccgtagctcaaccgatcagacacgggccatggtgtctgtcactgtcacctgctagcttcagactcatctgatgttttgagctgtttgcaaatgcaggattcagacttgagtgggtgcaagtgcccacctgggttcaagggcgacgggctccattgcgaaggtgatgaaatcacttgtcactctcctgcaaatttcttggtcagaattgcatcaggttgtcgtcgtcagatcttgttcttgatccgttcttcgccattgcagacgtcgacgagtgcagcgagaagctggcgtgctcctgccctcactgctctgcaagaacacatggggttcgttcgactgcagctgccatggcaacaacctgatgtacatcaaagctgaagatacctgcattggtaattcttcgtcaatggagatcaatccagcctcgacatcgtcatcttcctcatctcgtcgctcgagattttgagaatgggtttgtgtttttttggttgcattgcagcgaagaacatgtcggcgtttgggtggctggtgacgacgctggtgctgtcctgcctcgccggcgccggcgtcgccggatacgtgttctacaagtacaggctcagggtacgctggatatgatcagacagcgtcatctgaacatttttgtcagaaaatgttcttcttccaaagatcatatccattgctggcgttgttactgattttgctcttgttcttgttcgtgtgcagaggtacatggattcagaggtgatggcgatcatgtcgcagtacatgcctctcgagggccagaacggcgagaggctgccgctgagagaggaggcccaggttgagcatgcttagctaggcaggtactaacaacttcctgtctgaactctgaacagaaattgtggccaagtagttactgaactcatatgtttcagcattatttgtctgtgattatagttccttctctgattctttccatacttgcagttgcagaggttgaacattttggcaatgtccattcgttttgagacgccaagacacatgacagcgacgaatgccgcgatgtacatggcgaagttcagacatcatacttgatgacaggggttcttgcagtttctgcttggtgcttttgtagagaactgaaccagataggttcagagtttctggtagaagaacgggataagtctatgtcaagccggtgcaccgcaaagtgcagactagacaagtatagctgctgtaatgcagatttgttagaatatattgtgaataatagatcaacaatcttcctaataactttgaatcttgaacgcctgatttgtggcatcacttcattaacaactgaatcagttgaacttctaagtggtatctaggacgcacttgcattgcattaccttatacgaatgattatcattctacaataatactactacaacacgatcaaaattttgttacctcgcgatccacacacaacactattctactatccttgaaaacttaacagagccttcgtccacaaggctggtttgctttctcttcttggatagcctctggaaaccactctgttcatcaacaaactgagcagcggtcctcgctcgtagttcttcaagagtctctccttccttagctcgctcgatcacctgaatgcaaccgcaggaaggtcaaaatacaaatttcatcgcattgcactgcagtatatggtaggttagttcgaagaggaaatgtttgatccgttaccaaatgtcgcccgtagagatgagtgctcgcaagtgcttggagagcgttctgcgcctcttgctttgtgacgaattcaacaaatgcgaaacccctgtgactcccaaacttcataggcagtctgaggcttttgatctgaaattatgttccatcgatacacgtaagcacaaacaagagaaaattccttgtgttctcaacctgaaaacataagcattgatcaacctgaaagcagctaactcctttttgtctatcgaagagaacagaaagcatgaacatgataggtgttttactattttcatgatatattgttgcgtgatattaaattttattccacagactactatcctggacacaaaaggacaattacctggccaaatgggctaaataattgccgcaagtccttttcagttgcttcaaatgctacattccgcacgaggagttttgttgaactcttatccttttcatttttcttagtctgaccatcttttctcccatgacacagttgcaagatcaaagcatgtccatccaaaaccgttccctattaacacacacaacatacagcaggctgaacatcaacagagatcatggtgcggaaaagagagaagagaggaaaacgaagggtgggaggggtacctgtagatccttgcagacactggttgcagtttcaactgagtcgaactcaacaaagccaaatcccatcgaaacattcttgccattcttaatgtgcttcttaacctgtagagatatccaacaaagatgtttgagaatgagatctggaaaactccattcaatgcccataagcattgcaaccataccgttgcacttttaagacttccactcttcaattttgtgctgaaatgctgcttcaaggattcatccgatgtcttgaaattcaaattcttgacaaatacagatcgcgactgcaatggacagttgtgtgttactaagatttgtaattatttgggcctaaagcaaatagatgatatttaaaggcttgcacatgcagccacaaaaactcgcaggcaggtgcaaccacaagaaaacacgaaacagcctctagcatcatacagtaaaagcggtccaagtatataaggaacaccgagtgttattcagacatgaacagttgaacacaaatgccaaaatccaacttggacatggccacacgggagtcagtgacagttaagagatggttataataaagatttaagtcaagagaaagttccaaacctccaccctgtcaggatcaatctcttcagcactcactccttccacagtttgctctacaattgctttagtaacaatcctgtcaccaacaacatccttctcatcatcttccacaggtgctgaggtgggagataaaatattttcaggtgcccactccaaatacagtggagtatccctgcagtaaatagtaacaccaacttaggaaatatacatgtgcagatttcacaatcacactaatagctagaattatataacattcacaaaaagtcagaataataaaacataaaaaaaataaaccataaggatgacagggtataattccatagagagcatatcgatctataactagaaagcattacaacacccttagatcaaatagactaaaatacaagcatcaagtatgaatatgcgtctctcatgctactaaaatacaagtatcagatatgaatatgcatctctctctcttgcgacatgcatgccagtgcaaataggatctagctgtatcaacgtcgataatgggttttttctttcagttcctaggcaaactttaacttagattaccaggcacatgcatatgaaaagtcgattaagaatggagaaaacaaactaaagaaaacccctcattcttgaagtaaatatcgatggctgcctaatttatttaaagaaaatatgttaactatcatgcattattctatcttaacagaaaatttactacattgatttatcctaaaagctcaataaaactgtattcaaactagtcattaagagtattagatgtggactagcactattgcagatacttacttgtatcttgtgtacagtaactttttgaaagcatgccgagcttctgtcgcttcaacaaaaactacctgacatacaaactcaaggggtgaaattattcgcaatacaggtaataatgttcacttggtaatttgtagagcaaaagaaatacaaaagtgaaacattccagacagtaatgtaggacactcaaacactcaaaagtgtcatgatataatgaccaatgaccaatgaacaattgaacaaaataagcagaaatagttacataccaaggcaaacactctggttggagggaggatgattttatccaggcttccatgtttgcgaaacattgtggcaagatcttcctcacaagaactatatggcaagttctttaccaatatcacatggttgcttcttttaaacttctcatttcttttggaagcaagctcttccagtgcagcaacattaactccagaccttgataaatatttcttggtctctgcaatgacatgtgtctcaccaagagcaatacgaacagcaaggtcatctgcttctctatcaagtaattcacttttactgattccattcttccttgctatgttttcagcaacctaaatgtgaatgagtttgatcggttagcatgatacacgagagtttgattgttttttttttttcaaaattcagcaaaactatcctaaccctaaaaaggatacaaggaaatatttgaatgcagtatagggtaaaattagtagctaagtacaaaccatgtcaatgaaaaaacgttgaacacaagcaaaatgcagtaaatccacatcaaggtatcaaacattaacatacagtatcttggcgcatataaaagctgttccaagctctcgtatccccactgatttcagaagctttcctctgatccaacttttgttgtttgagactcattttcttctcttcgtaactagatctgaaaattttaaaacaaattttaattattgaataattaattgaagagaagaatggccacaagggaaacttcttttcttactcaatctttttattatttagtggcttagcagccttaacacgcaaaagtcgcccctgaaaacttgagttgtccaattcaagtgccctacaaggcaaaaaaatattagccaagccaaacacataagaatcaaggatagtctcaatattttgtgatacttttttgttctattcaatcatttaaattatgttctgattcctgaagtttgcagaagtgtatttttttttgtgagctaaatcagtgttacactgttccagatttagtccatcacaattaagcattggattataaatgccaacggtttgaggcaaatacaagacattgttaacctcttttttccttctaatttcattccttcctaataattctgtacaaccaagtacatagagggctagcagaatacagggtgtgagtataaactgctactgaacaatatgcgtctcatttataagagtggccaacagtaatggattaaattatcagcagtaagctaaacaacaataagttcatctacatttgaaatcataaacttgctgaccaaatttacctgactgctgagtctggaaggctaaagagcacataacctcttccagttgatagctttgtggttttatcaacgacaatacgtgcttgatcaacatcaccatattggctacacagctccactaaatcaccttcactgaaatcatacacaaaaatactcttttaagaataatcaggcagccatagcttcgattattccatatgacacacaaacactgatctcagaaaggacaagcaataacatacgtagttgcatatggaagattgcagaaaaataaacggccagtctccagtgccaacttcttctcgtcagtaattaaagcagcttcttcatcttccttttcttgattgtcatcttcttttagttggctgtcaagattttcaacctctttgttgtcagagtttcccgcctcttgcacagtagagccttccagagtcatttccttatctacattttttttcaagttcagactatccttctgatgagctatttcatccttttcatctgcatcgtgtgattcatcagatgagtcttcatcatcagtgctgtggtccgattgatcaccagaatcttcgctatcagattctgaatctgaccaatttttcttgattttactcttaaagaagtccatatctgtcatatctttgccttgtttactttctatttttagctcttctgaagcctcttctgaggaggaatcatcagattctgactgatcattcgccatttcctcatcagaagaatctccagaagatgagtcattctcagaaactggaacattcttctgaggtttctcaggcttttcactaactaccatgctatccttggcagaagcatcaagggtacccatcgtatcattagcccacatctttgcttttgagcggggctgcataacctcaagaaactcttggaacttgggatcactagcggcactgcctttagaacctcccacatcatcagatactttttggcccttggaacttttgagtggtgcactaacatctccagtcttagtcttgtctttgctattatattcaggcttctttaaagaatgacggctccaagggcgaggagcttcaggatcaccaatcttacgagcaacctgacacacaccggaggaactgttaagtctgtaaggtaaggaaatgcttatttccttacattaacccaccatagtcatattcaatcttctataggcaattcatcaagtggatagcagtccaatgagggaaaaaactaaaaatagttgaggaatacgggaagtacctcgcaggtgatcttacaagtgtcgatgtatgtgttgttgaaatacttgagtgcttcctctgcctcctcgttagttctgaaaccaacgaatgcaaattgcctgctctttccatccctacccaaaagaaagacatcaaactttatgccttgctcgcactacatctataaccactgaaaatattttattcaagcagcagcacatgttgcatgtgttaatggtgtaaatcaggtacatcctatcttcgaaagcctagcatcatagccagaggtgacaaccaaactcgaggtttcctgacctaaagggccaaactttttcgagatcaaggtccaattttgaaatccaacccacaactgaacagaacaatgcaggatagtgagactttgattctcttgcccatcatcgcaaaaaaaaaaaaaaaaaaaaaagagcacaatcttttgtataaactagcaaatgctcatcctatcgttatgtaggaatatatacatccagcaaaaagaacaaaaagaagcatttattttgctggtcctctgcagttacacgaaccactaagacagccaccaagctgccatggaagcagtagcagcaacgacctaagcctctaaacgagcagcttcctctcgattattacttacttggtgcggatgaccttggcgtcggtgacctcccccttccgcgagaacacctcccgcagccgcccctcgtcggcgcccttgggcaggttcttcacgcacagccgcgacgacctgcaccaccacaaccacaaccacaaccgccgccaaatcagccaccgagaaaacaaaaacagcaagacacgcagcagtggactcaatagagaggattcccccacatgccgatgccggcgaagtcccccccccccccggcttctgcggcggcggcgaggtcggaggaagaagaagtgcagaggcggcggcgctcgaagcctcccaaactccgcaaacaagggttgctcttgcgcttgcgcgacgatgaggatactgggctcccgacagtaaatgggacgtacatgggctggatcagccagccaatgggcctcgtcgcggccggcgagaggagaaattttctcatttttagttttatttaatttcaaaaattgtttttattttgaagtattacatatctcttctttgtataaaggtaatgtccactaaatgcctaaagctcgacatgcaagcatgtcacatcaacacattaagcatacaaagctcaacatacgagcatatagtaattatatctacaatttattttattctaaaactaaacatgcacatgctaaatcatcagtctcaaataatttttataatatttcaatctaaatcatttcagcatttctccattatctaacatatatcctgcagcaaagcgcgaggcatatttgagcactctttgcgagagatattttaaaaaacacccttcaaagaattttttttaatggcgtggcacacagcaattagtgtatgctaactatctcacggagcatcccacattctacaagcgatcccttgcaactttctaaaatctctaggagtgtgataagggggtcacatgtaaaatagcattacatgttagaaaattgattcactggtgccattagtgtcataatacagtaatattgcttaactcctagtgttatgtttgttgcctaaacaatataaccatggatttcacatgaggttgtcggggttggggcttttaactatttgccactcttacgagtggtgcttaacgatttgccactaggcccacatgtcatagacacgtaaaggcccacatgtcattaatagggtgtagtaaatcgttaattgccatgtcagaagagtggcaaatagttaaatatcccgtcggggttagctgacctagcgattgtgttgtagctccaccactacaagcggtccctttggaagccctctacggcaaggggccattttgcaggcaccttcttacactcttatgtaaggacataaagggggccacctgcagtagccggtccttcttcgttaagctgttaggggtatagattttgtcggtgatatgggaccggggatacgcacagtagagggaagtcaccttcccatctggccacgtggccgcacggcctggccttcccccgccccctcggggggtgatcaggtaacactgaggtggccagggggcctcggggtgccatgtcacgcccctcgggccctcagcgcgtgctgccctgaggcccccagccggccatcacgtggcggggagagtgggcggagcaagagcgccgctcaccgctttcaatgcgcggcgccccaaccgtcccatgctgcatttaatgcggtgtgggcgggcgtgcagcaccacccgattgacccatgtcaatcgggcttgaccggtctgtgaccggtcacaggcgattggactggtggcaatgcccccacgtcccgcccagtgtcaggcggagtgggggcaagtatgccccgtcccatcggcacattgccgagagcgccccccctccccggcgcatggtgagcccgccaaagactccatacatttaaaagagaatgacaggagtgtcccccgtgtcaggcggaggacggcgttgagccccacctagagacgcacaaccaccttgcttccggttgaaggcacggatggcggtctgatccaggttaggtgggtccccctcccatggaggggtacgcatagacggtgcatgtggtatcccttgaactataaaaggaggacctcgcccaccgagaaatgggacgactctcaatagcttgagccctaaaggaagaacagttaggtttccccaggagctcaagacctcttgcaagaactcatcataatcccacgcataggagtagggtgttccgcttcccagcggcccgtacctgtatgatcccttgtcttccacacagactcgtgagcgatctagtagttagaccacaagcggaagtgcgctcttgaacatcgcgccatatcccctggccgaactcacaaaggggggtctcacgaccacccgctagagaggataactcctcgacagatttgtaatactttaaaaataaaaattatttgtgaaaatattttaataaatgaaattaaaaataaaaaactagatgaaaacgaagcggatatggacggataatgctcataccatattcgttttcatattctttaccggatacaaaaacgaatacgaaaaataatacggattatctcgaatatgaataacaatcgaatatgatcagacacggatatggaaacaaatttttctcggaacatgaaaaccaagtcaagttctaatagaaacaaatatcaacatatatattagctcattttatataaaatgaattataatttataaatatctttttaaaatttaaataatagtatggactagtgataagagataaactactattaaaatctataaaggtatattgaaggtcatagagttagaaagaaatgagctatgtctcatggcttctgcagatatccaagggacatttaacttcttgccacttttaagatgtgtcaattaattatttgccactcgttgtctatgacatgtgggtccagtggcaaataatttagcaccactcgtaagagtggcaaatagttaattattcctatcccgaatagaactgatcaccggatatccgaattattgtccatattcgacgaaaaccccgataccatatccatatttgtatccgaatccgagctatccgatccaaaatgtatccgtatccgtttttgttcggagcggacggaaactatccgctccatttttatccctaccccatgcgttgctgcagaagttttgtacgatattagtagaaacaatatgtatgatagttgcactttgtatagttttcatttctgatcgactattgagaaaaagctaaaaacaataagataatgtggtatataataatttaaatcatatatggattgatcgttaaaagataaaattaaggtgatcttgctctatcagaaaagaaaaggaaataataaccatccaaacacgaaacggaagtgatatgattttataacagaatagaaagataaagatgataaatataattaagatgatgtgatctataaccagattagagagaaatagcattaagaagaaggaggggaggtggggtaacgacgccgcccggcaccgcgctcacgggcgccgtcgccgtcctcgacagcggcggggggcgagcacgaggtactcgaggcgagaccacgcgagaagccccactcggtgccccgggaaatggctgcaagcaagcaagcaaaagcatcaccaacccaggcgacgaccggcggcgagccggagaccacaagcgcccccgcgctaagcacgccaaactcgtgcggggaattctgatgagcagtcacaaattctgataagaacgtggagagcgcgaacaggtgactgctcaggatttgttctgatatgtcaaaaggagatgctcttatcatcaaacagtgccttgaggtataatgaactcctataataattgttcccttctaaaaaaaacactcctataattgtatgtagatcattttgtttttgacatgtgacaggttatattggataaaagagttaacggtggttcaaagtaccacataccctccgtactcgtaaaggaagtcgtttaggacaatgtttaagtcaaaccttggaaatataaatcatgaataacttttaagttgttgagtttgaaaatgtaaaaattatatgaatagatttgtcttaaaaaatacttttataaaagtatacatatatcacttttcaataaatatttttatagaaacaagaagtcaaagttgtgttttggagaccgtgtcgctatcctaaacgacttcctttatgagtatggagggagtaggtaagatcatctggtctaaaatgaaaagattggttaaaagatgttagattaatgggctaagcctaattaaatcctaataaatttcattgcccacattaagtgttatgggtaataataccaccttgaaaatataagtgaagaggtctcaatttaaaaacggagctagtagagagtctctgttgattggttgactctctctcccgttttgtaacggatggtagaattgattctgtattgacgagcgcgtcaaaattaaacactgagaattgcttccgtattaacgagcgcgtcaaaatttaataccttcagatattaggtatctcgaggtgtcaaaattttttagtataaaatttatgtccctcaagatattttcttaagtaccataaaatttcttgatatatgcatttttacagaactacaaattaatgctagaaaatgtaatatctttcagtatcttttttataacagtagaaactctgattttctttcatcctttaggctaaaaagacgattgaaaaaattattaagccagagaagtagtaactgtacgatgatttttctatgtgagataccatactgatgtcttcgcggtagtaatacagcatgacatctcctagcatctaaaaaaagtatgtgaaatggacattcttctagtagcccccagatcttgtagacaaccccgtactgtacgaaacagaggtttttctcctgtacatgtgtcccatgccaacaacaggaaacttgtcgaatcctaggctttcctctgttgcttggttgcattgcatgcttctataaataaactgcatcaccacctttgtccatcacacacagcttcggctgaatcactaacgaggccattatcatcatccatggcgttggaagccagggccgtgcagatatctatcccaaccgatgcttgctgcttctccggcggcaagtcctcccacagaatgtcaccggcgacccagttggtcagagccccgcagcatgccgtcgctacaggtacagatgattgtttacagagataaattcagtctaacatattacaaagttgttaaaagatgtagtagcttaaaacaagttatatttaagtaatgctgatgtagaaagtttctgaaaaaaaatcgtacttatggaagagtgccacaaataatccgtacataatccttcagccgtatagcaactcgtttcactattattggtgaacgatgacacctatcttgttcttattatactccctccgtttcaaaatgtttgacatcgttgactttttaacacatgtttcactgttcgttttattaaaaaaaattgtgaaatatataaaactatatgtgtacataaaagtatatttaacaatgaatcaaatgatatgaaaagaataaataattacttaaattttttaaataagatgaatggtcaaacacgtatttaaaaagtcaacggtgtcaaacattttaaaagggagggagtaattcctctttatttatttttctttctaccaacagcatacgctgagaagagtttggaggcaggaggaaatgcagcaagcttgccaaacaacatggtatgagtttccctggtgatcttttgatctcttattttcttcccctgttatgtctgaaactctgaatatgacaagatcaggctcatgtttcagttagaattagtgaacgtcgtcatgcaccagaggaaagcaatagaggatacaatgaggaagaagaagaagcagcagcttcacaaattcgagatgttgccgtctccctacgacacggcatgggtggccatggtgcctctgcccggatcatcatctcagcttccatgcttcccacaatgcgttgagtggatactacagaaccagcagagcaatggttcttgggacctcaaccagctggactcaatcaccaaggatgctctcttgtccacactggcttgtgttcttgcactcaggagaggtaacaaccatatatatgcaattttttatatatcttttttttaagataatggaaatcatcttggtctttccttcaaagaagctatagccgactactgcaaagtttgcagattgaacgactgcgagtgacaattctttttatgcgcgtaccttttttttaagataaagttgtgtatttttacctgcaagttcttttgtttagtactccctccatcctaaaatataaacatttttagcatagtgccaagttaactatttttaactttaaccattaatagcaaaaaaaaatcaatcatgtaaaattgatgttattaaatttatcattaatcaaaatattataatatgtaactctttttatttaaaacattttatttttatagatattgttagtcaaagtagtatctcgaagactgtgtcgaagtccaaaaaatgtttatattttgggatggagagagtatcttaatttggttgttatgatcaagttttggaaatgtttgacaaaaggtggtgatgataacaggactgctttttattggaaggaatttctccattgctatggatgagcagctggctgctcctattggattcaatataacttttcctggtatgcttagctctgtaattgagatgggtttggaggttcctattggacaaaccgacgtcgaaagagtacttcatctccaggaaacggaattgaaaaggtccacaaaattatattttattttgtcattttggattttggtgcacatattgtagcacttttcttgttgtaggctgtttccttttccagtaatcataatatttagggaagtgggccatattaccattattgtctatttgtgactatgatgagtttggaatttcttatatctgacaaaacgatatccacgggatacttcatctccgagaaataaatgccacaacaatttgtgttttattttggcatttctttctttttcctgaatgagattggcaatttttatcctcatgatctaaactaaatacagtagtcttcttcttgtaaatagtcccctttcataaccataattgttagtaaaatgggccaccttatttcaccaaactagtctagaaattccaaactttgaaatttttaatagcatctctaagtaactgactgaaattcctattttgatttaaagagaatatgaggagaactatcgtgggagaaacacatatatggcatatgtgtcagaaggattagggaatgcccaagactggaatgaagttatgaatttccagaggaagaacggatcattgttcaactccctttccataacagctgcggtgttagtccataattatgatgctaaagctcaccgatacttaaatttgcttctgaacaaatttggcactgcaggttggttttaacacttctccattccaagttgccaagaatttcttcctaaagtgcatactattagtaactaatgccattttttttattttttcatttatgtttgaaaccgagtgcagtgtatacgaaaaatatacatcgccaactttccatgcttgatgcgcttgaaaatatgggaatatctcggcattttgatggtgagatcaagagtatactggacatgacatacaggtatcagcccaagtaaccttgagtaaggatcagttgtctgcttttttttttcttagctcatgcaattgacaacagccagtttgcagttgttggttacagagagatgaggaagttatgctggacatcacaacatgtgcaatggcatttcgtattcttcggatgaatggatatgatgtttcttctggtatttttctaattctggatttttttcctcgttaaccgtgtttaatcttaggttatcttcgatcgttttgacacaattattttactctattttaattattattattattttactctagttgacacaatgatccatatgaaaattttggtgcagatgacctgtgtcatatcgctgaagtttctgatttccatagttcgcatcaaggatatttgagtgacacaagaacattactagaactatacaaggcttcagaagtcagtgttgcagataatgagtttattctagatagaataggctcttggtcaggtcggttactgaaggaacagcttagctctggtgcgttgcaaagaacttcatcaatatttgaagaggtagtttcaagaacataaatactcctttgatattgtgtgattgtgtctacaagagctaagttcttcttacatgtttttgataccatgattttgtatttgaaggtggaacatgctcttgactgtccgttctacgcaacattggatcgtctagtccataaaaggaacatcgaacattttgccgcgatgagctatatatcatatgctcaaaacaacatacctgtaagcttcctgtttcacaaaaaggtaatctagtgtactttagtacaacattcttaaatgtattgctgaaacaggccttgtcaaaccgctcaagatcttgtagctttgggtgccagaaatttcagtactactcaatctatttaccaggatgaacttgagcgtatagacaggtaaatatgacagttactctctcttttcatgtacaattgtacaaaccagtaacattcagcttatttctgcaaatttcaaattttgatgcaacagttgggtgaaagagaacagacttcatgagctgaagtttgcacggcagaaatctgcttatttctatctctctgctgctggaacggtttttgatccagaaatgtctgatgctcgcatttggtgggctataaacggggtgcttacaactgtcgtcgacgatttctttgacgttggaggatcaagagaagaattggaaaacctcatttcactagtagagatgtacaatcctttacatccatgattttagcttactttttaaataccattttcttaggcttaattcaatttttgcccattttgccaatggttgtcacaggtgggatgagcatcacaaagaggagctctactctgaacaagtagagattgtattttttgccatcttcaattcagttaatcagcttggagcaaaggtttctgctgtacaaggccgtgatgtgaccaaacacctaatagaaatagtaagtttttgtctgcaatttcttttgccaaaatcttcagtttgtagtatttatgacaaggtaaactatcaccaaacagctactcctttgctgaaaagaaaatttcagttttgggtgttagagcaattcaaatttcttctgcagtggctagatttgcttaggtccatgatgaccgaggtagaatggaggatcagcaactacgtgcctacaccagaggagtacatggaaaatgcggccatgacatttgcattgggcccaattgtgctcccagctttgtatcttgtcggaccaaagatccctgaatctgtcgtcagagattcagagtacaacgagttgttcagactgatgagcacatgtggtcgtctcctgaatgatgttcagacatacgaggtatatgcaacgatctgccattactcccaacacaaaaagatcaacaacatacataagcaaccatttaactatatgattatgacccagtatttacgactgtttgggaagcttttagctgttatggcttcttttagaatctctccagctccctaaacattccaaataaaatcgataaaataaactactctattcgtttcaaattataagatgtcttagactttggtcaatgtcaaactgcttcaagtttaactaagtttatagacaaatatagtaatatttatattaccaaattagttttattaaattaataattatatatatatatatatatatatatatatatatatatatatatatatatatatatatatatatatataaaataaatttatcttggtaaaaaatatacctattttttataaacttagtcaaacttaaaatagtttaactttagccaaagtcaaaacatcttataaatgtttatcagaatcttaagctcctacaaacataaagcttactaattggtactcacaattgatcttgttctaattggcactcacaattgatcttgttctttcgctgctgatgcagagggaggatggcgagggcaaggtgaacagtgtgtcgctgcttgtcattcagagcggcggttcagtgtccatcgaagaggctagaagagagatcatgaagccgatcgagagatgcaggagagagctgctggggctggtgctcaggagaggcagcgccgtccccgggccgtgcaaggagctgttctggaagatgtgcaaggtctgctatttcttctactcccgtggcgacggcttcagctcgccgacggcgaagtccgccgccgtggacgcggtgatccgcgacccactcgatctcgccgccgtcgtcgcaagccaagaacccatatatatcattcctgcttcgtgactcgtgaggaaattgaactagagatgtgatcgtggatgaagaaactgtgaacgtgttggagattgaacacgggaccttagggttgaaaccacgtacccctttctactgcactatcaagtgcatctcctgctctttcttttatgagataacggaaatattttaagtctccgtacgcatgtagtcattagttagttaattctgtttggacgcctagtgcccgcagcgtgaggataagctcgcagcgtgcggatcgtggggatggaagcggatcaaaccgcggcgtgggtgatcaaaccggggaaacgctttctatcttgcgtgttccagcatgttccacttcgcacaactataaatggagaggagaaaaccccgaaaggtttgcatcacaaatcctctcgtgttctcattgttcttcctcttgagttgagtgtccgtgttctagctcaggttctcaccgatcatttgtccagggaaacctgacaaatggtaccaaagtgggattcaaggcttggactcgataacatgtacttgagagcgtgttaatgcctcatgggtacacatactcgccatgctagcggtcctcgtcaccgatcgggcgttctcctagaggctccggcagccgcccctcgggtaacagctagagtgcccataggcagatgggctagctatacaccacgtggtcaaggaggcgagaggctctccaattatctgttactagcaaagtcggactacaatgatgtctttgttgatgaagatcaagctacaaagcgtgttgcatgtagggtatcatcgagttgggccgcatcgagctccacgagatgtgatggcgtcggatgccatctacagcgtcgtcccaccaaagatgat

SEQ ID NO: 70654 - DNA, 10237 bp, Oryza sativa
  unsure (1)..(10237): unsure at all n locations
gtcggtcaaaccgatctcatcgaaattgagggtaacttttatttccgctaaaagttttcggtttttaggtataccaaccattcacccccctttgattggcttggttcttgtgattcgatcctacacagatatccacgcgtgatgcctcgaaggattttaggagcctgccctagctgccatgcagctgcagttctggcgatttaacaagaacagtttaggtcgggttaaattatcctaaagcttcaggtttgcagtaaagcaccatcgaaatactccaagttacaagttaattacaagagtcttcaggttagtaaaggcttcaggagcaactaaccaatttaccaacagagacaagtgttcagaactgaagaccattttcttttctgaaggaaagttcagaactgaagaatgtgcaggacagctcgcagacagtgtttcgtttcagggctgtacacttgattgccaattgctttattgcttagaaataacgaccattgcctaaacattccattctagattctgaacaagtcatcggaatccaatggcattcgtcaggcttctccagaaccagccaagcagtcataatcagggtgttcttcacttcttctagaccaattgaccagagatggatgactgggataggctacatgcatatcctgaaaatgggacaaggatgtggaaatcaaatgaatggtgctgcattaatttgactgggattaatgtagattcaacaatctgactcttcagagtggatagatgatgactgcatccacagtattccatccttcttgtgctacattagcatgatctagcattgatcaccatcattatattcagaggtaaaaagcttcagactttttactaggctcgacaaaagattaaaacttgctatctgaataaagtgacggggcattctatctactactagtctactactactgtaactacaatctttatgcttcagacatggttgatgatgataacacatgcagatcagatcatcacctttactcactcacaggtggaatagtactagtacttacagactattaagaatgattaggggagatgagaaagttggaacaagaatcattgtgcaaaagtgtaaattcagagctagcatagcaatactagcatgcaagcagggacaagttcatcagagaatgtcggtaaacagcactgcaccctgctgctcaatggccctgtgctggtgcttgtctattgcatgcacagaagatgctttacccaattctgacttttgtgtcactttcatttgttgttgtttttctttctctgcagcttcctcccccacattgtactcaatcaaccatacactgatcccatctcgttttcttgacattggtttgtttattcagttaatcatcttgccaactcacatgcaaattatgggcaggagagagaggagacaattggagttaggtaaagatggggatttttgcattctagaccctgaattttctgtttcattttcaggatgagagcatggttgtttcagtaggttcaaccgttggatttagcccttccaaatcgtctgttttcttattaaaatgtgtacatggagtgcggatacgtgcaatcactccatgtttcaatgggaatgtgatctgagaataggaactagttaaatggtgtaacaggaagatgaaaatgtgcggacaaaaaaaacaagaactaggaaaatgatttcgatagaaaagtagtgtgagaatgaagttgatgtggaatgattgaagtattaattcttttaaagtgttaactgggtggtggagagaaatgtcattgtcactactttaaaagcaccagatgcatgatgaagtgcaaaagagagttagcaaaaaatgtatcccttccttcctagccaagttaaaaagtccctcttaacaagaaccaccaaccatcaacgattatacaatgtctacttcgtcgcataactcctctacaagatatgtcttttctttctacgcaaatttcaataattttgttggtgttcacacatcaagcaaatgatcgcggaatgtagggtctattttaatgcatgcgcttcatcgattcaatagatactaagctcattgttaaaaaaaagaatatacacatttgagatattttgtgagtcgaatactatttatgccaaaaggaaatccataactcttacacaaatattacaaccattttttcatccatccactttgtatatcctaaattaaaaggacttatctgcaaattttgacaaggaaagaagtccaaacacttgcattctcccaaatggtgaaacgtggagcactcgtctgcaaaaaaggcatggaattgggaactgggaaggaaaagaagagagagaagaaaaaaaaaagaaagtagagacaagccaatcctactcagcaaccacaatcattattccactctctccaactgacggctacggtggtctactaataaagaagcagtatataagtgtttgagcaacccatggccatggccggattaaaccaataaattaagcagctaatctccgggtaaccatgggtaattaacaactaacccacctgctaatctaatctaatctaatctaatctcctcttcctcctgccgcttccgtattcgttgtctctctcgtgcgtcacggcttcctctttccatgggtgtcagttaattaatcagataatgacctatccgttttggtaaacacctggttaccagcttgacagaatggcagtgtttcagacacacgataaacttcctttttctgttggatgatgttgatttcttttaggtgtccgtgatcttggctacttttatttttttttggtagattcgtatcacaatagttgtgtaaattgtgatgacgtggtaatatttccggcaacattttcttcggagtttacggtgtttgaagcatacggagcacttccctgaaaatcaatacatctctcttcagagttcagacttcagagtgtttgattaacattcagagtttcccatcacaataatttgtgtaaattgttggcaagattttcttcagagtttacagtgtttgactaatcatttccgaggaacattttctttgaaaaaaaaacttattcagagtttcaagtgttttattgactatacattcagagtttggagaaaaacaattaagcaaatgaaaaaaaaaattagcagcacattctttatttcgttctttgataagtatctaaaaaattcaattcatttaagcgaatatttatctccaccgacgatagcagcaggacgagccaataaaataagagggcggtgcaaagaggtggaggagcaaaattaatcagggcaattagacaactgaaaagcgaagctaaggcgcgctaataattgaccccggactctctgatagtactacttaattaactaatcggagcaaggaaaatagcaaactatagtttagctacaaccacatgcgaagaagataggagaaaggagagagaaaatcgtactatagatttatattcagctatagtataagtataataaattaaaatgacactagatgatgtgtcaatttttagaagctacaagttaggtatagtattaagggtccgtttggtagagctctaactcgtaaatttaactctagaagttggatttagaatgcagttatgaagcagccaaaaattcaacttcacctctctaatttattttacgagaacactctacttagcttcagatcgctgaaactgtttggccaaacttgaagccgtaacaaaaagaccctaagtttaaactaatcctgcgctaatcttgtacgctaatccgtctctgggctgtgcatccagccagcgccgtgctttgctgtgctgtgcgagcagtgaagtgtggcggctttgtttaattgggtatcgcgtccctgtccggccaccgggtggtggttcgcgtccgggttggccgagctgcgagagcgacctctcctcctcctcttctcctcctcttcctcttcttcctcgtctcgtctagttctacatcgccttcctatcgcctccgctgcggaaaggctctccctttccgagctcttcccgagctctcctgcttgttcttggggccggggaagattcttgctgctctgaatcagaggtgggtgctgatacctgcttgctcttcttgttcttgttcgtcttaatccgagctcgtttggattgggagagagggctagcgttgtaggcggattgatttttgtttgggttgttgggtagtggcaagaacgtttgcttttggtgattttggcggctcgagctctgttgaaagttacttttttttttgggtacatggggtgtcgtgaaagtgaatgttaatatattgtttgtttgtctgtttgttcgtttgttcgtttgttagtttgttttcccgagttgaatttgaaattttggatgttattaatagtggtgttcttgccgttctgacggttgctgctgggcttgtagtctctgatttgtggctgcgaaattggatccaatcttttttttgggggaaaattggtgagttttgggatcaaattaggatcttgtgagaatataagcaggtgaactcttgcattcttgcccgcttcaatccccaaaactcgtgtttgctgctgtcctggtatttttgacaaagttctattctgacgtttgaattgtccattgcttggatttaaagcttggaatttttcttctttttttttctcgaataatattcagcttttaggtgctttgccggagaattcggacgcgattcttcccttggccaatcccattgagagatgccattcatgtttctgtcgatccatttctttttttgtttgttttctccagtaacctttctgcaatcacaacagctctactttttttctctatgtggatgtccttgtgaatttgctctgtaggtgagtagtgtctgccttgctggacattgatgtgattgatggagcatctgttgcctaatcattttagctcaatttgatctgagctggcgttcagtacattttgaaagtttatccgtacagagatttcggcgctgtacgttgcctgtttaatcacttctgtatacagctcatttggatccaattcctttagctgatgccatctggatccattgttatatcctaaacagtttgtgatccaactgtttcgttgctgtttgttatttctggttgatgaatttgaagtgtagatttatttggatggatcaagatttatttagagcagataatctcatttgtagtatgtttggttctntgctgcatatcagggtcaagtagtatatcatctgtgagttaagnagaatgcaaggagttggcactcagccgacgagctcagngaagtatcttggagccctcaaggacaccacaactgtgagcttggcaaaagtgaacagtgattataaggtcgaaaattctatcaatcctctgaagaatgtttggaaattctcatgctcaattgcttactgttatatgctttactccgccgcgggcttagcattgtcttttttcaaaacaggaattggatattgcaattgtgaaggctacaaaccatgttgagcgtccatcaaaggagaagtacataagaggtggcatatcctgtctcttagctgaaagcttgaaacactagtgccagttcatagctgcatcttttcacttgtgttaatcttttttaattttcattgttatatataattgaatatatagtgtagaaaaccaatgaattgtcctgctcctgcttaaaattcagtgattttttgttatgtagtttttgttgaatgaaatggagtattatattgattgtgcactaatttaccttcagactgtcaaaacttgcctcatattcatttgtttattggtttgcagaaattttttattccatttctgcttcaaggccacgagcagatgtagcttactgcatccatgcccttgcaagacgtctttccaagacacgcaattgggcggtatgtaccttttctataagactttagtgttctaactagaatgtagtagtgcttctttctgtccaaggaaccattttacaccaagtatcttctcgttctgtctaaggagcctttttgtaacattttaaaattttgcatttctctgtagtttatggagctatgttaaaatggactttgggaaactatgaaaatatttgttggcattagcttcctttgttactgtctccattttctttgtaaaacagatgggtctacgagtttagtcctttttctttagagtagttacaaaatggttttttgtttaaatgcatggtggaattgatggtttttgaactttttgaaggattgccaaactgctatgtgattagaaggattagtttgcatttaacattatttgttttgttttattgatagtgcttttcctgggtgatgcactgtaaaaaaagttataaacttatgaatattctttgcttcaatatttatacctcaggttgcattgaagacattaattgtcatacatcgcgcccttcgagaggtcgatcccacttttcgtgaagagcttatcaattatggcagatctaggtcccatatgctaaacttggcctactttaaggatgattctagtgcaggaggtactaattgacattttattactagtgttgtcacttttatagctgtattagacattctaactctgaactataatgactatttactcttatcttgttcagcttgggatttttctgcttggatacgcacttatgctttatatttagaagagagacttgaatgtttccgagtgctgaagtatgatgtggagacagatcctccggtatgtaatccaattactactcttgcttatgcgaggttttatcaaatttttatttctttaaaacttaaatgtaattttgctggaaggaaactgtgtttaaacttcataactaccttgtaagttccaattttaaggtttcctccttttctcctggaagactctgaggaagtagattgtggaagtagatctatcaccttagaaaactctaaaggagagaaagtgaatttcaaaaccatagttaatcccccttggaaaggagccctagtgcaccacatggaagtttccgaactacagaaggttacctattgctagagaatatccagatatcttccagaagagttgacaggcatgccaccgcatagggacatggaacattgatttatgtaattgaaactttatcatgagagatgagattacaagtgccatgttgccaacggtattctttctaactttctgaaaattctggtctctgcagaaaactcgggatcttgaaactggtgatttgcttgatcatctgccagcattacagcaacttctttttcggctccttgcttgccaggtaattagtttttgcctacatatgatttgaaatttcaccacattccatcttcatgttccactgtcaggttaaatttgaattactgaatattatttttgtagccacaaggggcatcatcttacaatgtcataatccagcacgcactttcaatggtaagtagcatgagttagcatgcttgtttcattttaagtgcacaacatgatggtcttggcatgaatgctgactttgcttgtgcattactggaaggttgctctggaaagtgttaagatctacactgctattagtgatggtacaattaatctggttgacaaggtgagttttcttattagttattctagtcattccagataagtttgtaaaatctgctattcgctagcgatatttctttacttttctcatctaacctacggattattctctattacagttctttgagatgcaaagaagtgatgctgttagggcacttgatatatacaaaagagcaactaaccaggtgaagttctgtccctctactgttgatccattaatgaatttgttcagtggattattttcacttgcatgtagcaataaaaatcaaggttctttcttaagtttaattaattaaggacttgggtatgtgttagggcttcagaaacttagaagctgatcgattgaagaatgtatgagataattcacttaattgctgtgaatagatcaaatctatttacactattatgttgttttattatccctgaccagtttttccccccttcaatgtttgattcatgacaaagtgataaaaaacagtaggacagaggcagataacaatccatctgagcatcttgctttcctccatggtctctcctttgatcgaggattagctatgtgcacttttaagcaaccttgtctctaattaaaatttaggtatcatatctgtgatggaatatgaaattaaacttagagcacaaggtttttttttcacttcagcatcatcagctctgttgatgttgatctgtctaaaacagaagttctgaaccactgatattaatcgttgaattatgttgaaataagaacatttagggcactgttgctgcttcaccttttaatttcttaaatttgttgcacaggctgaaagactatcagagttttatgaagtgtgtaaaacgatacacattgggcgtggtgagaagttcttaaaaatcgaacaggtctgacagatattcgatttgcatgtatttgttgtttgttttccattttagcaagctactgattatactgaaacttctgcagcctccagcttcattcttagtaaccatggaggaatatgtgacagaagctcccactgtagctcaaaaagataaggttcgagaaatgttgaaacttgctgatgtttagagctcaaattaatgtgttgattgattgtatcagtacattataaatcgagaagacaatgaatctagttagaaccatcttatgcatgattttctgctcttcaggctccttattgagtttgcttatcacacatcttatctgtgtttaggtactggcaatcgaatacaagaaagaggcagaggaggaagaaaagccggcatcgcctcctcccgctccagagccagaaccagaacaagaaccagagccagagcctgaaccagtaaaagaggaagcacctaaagaggagccaacagatttgctggtaacattctgtactactcacaagaggccactaatcctgcattgtcatgctaataactcaatttctctgccagggtctgaacgaaccgaaccctgccgcagccgagatagaggagaagaatgctttagcccttgccattgttccgataggtaaaattccccacgaacgaaaaccgttcaattcttttgtctccactagaagttgatcggttgtaagacatgcttctttactgttcttgcttttctgtggcagatgatgtacctaaagttgcacctgctcaaaatggagtcactggctgggagctggcccttgtcaccacacccagttcaaacgaaactgctattacttcaagcaagaagctggtactgaacctgaacattttaccttgacatgtagcgaaattccagatagacgcggcaacactagcatcatccttagcttgaaatgccagcgaattttcagataaatgcagcaacagtagcatcattcttaccttgaaatgcagcaaattttcagacagatgaagcaacagtagcatcattcttaccttgaaatgcagcaaaatttcagataaatgcagcaacagtagcatcatttttaacttgaaatgcaacaaaattttcagacagatgaagcagcactagcatcattcttaatttgaaatgcagcaaaattttcagacagatgcagcaacaacaaaagctaaccatctctgaaactctgaaatcttttcttcaggctggtggactggacttgctcacgctcgacagcctgtacgacgacgcgaaccggagagcgagccagccgacgagctacaacccatgggatgtcaaccccggcgtcgccggcgccggcgccgccccgatgatgcagcagccgatgatgcacgacccgttctacgcctccagcggctacgcggcgccgcacaacgtgcagatgaccgccatggcgcagcagcagcaggccttcatgctccagcagcagatgatgatggccgccgccgccgccgccgccgaggcgcccccgcctcaggtgttccaccaccaccagcagcagcagcagcatctccaggccaacccggcgaacccgttcggcaacccgttcgccgccgccgcagccgcccaccacccttacggcgccgccgccgccgccggcaacggctacacggggctcatatgatgatcatcatccagctccggcgatgtcggtc

SEQ ID NO: 70655 - DNA, 2497 bp, Oryza sativa
  unsure (1)..(2497): unsure at all n locations
agtaccaagccccgggcgggcacccgatcgccgtgaagaagtgccggaacacggtcagcgccggcggcggcggcggcgccacgccggcgcggcgccagagcgcggcgaagccggcgaggaggcgccacgcgttgggcgtgagctggctcggcgcgagcccgaagtggaaaagcaccgcggcgaagaacggttgcagcggtaaccgcatcagcctttcttcctccatcgccgcgacgtacacgaacgccgcacccggcggcggcggcgcgcacgccgggaggtcgccggcgaggagcgcggtaancccgcgcgggatggagcacctcccggtgatgtctctcagcgcgtccgccgtgcgcagccacgacgttgtcttctcagccacggtcaaagcgcgcgcgcgaccgccgccgccgccggtgctgggcgagcgggcgcggccgaggcgcgcggcggccggcggcgaccacgacgacgaggagcgtggagaggatggcatggcgagctgtggttgggcttcgcgaggaaataccaaccaacagcgcgtactacgtgctgtggttgagtgtcgcgctttgcacttaatttatgggattgaaatcctttgcctatattgaatccacacgtgtcaatgataaagtcacatgattttaaagacagaggatacttatcctaatttatggggaacattcctacatctctcgtaatatatcatttcattcatttaaacccattcgtttgtatataaaaaatcttattgaatttagtaaaaattatacaatacatataccacttcataaaatctcaagtcttaattcaaacccatattgaaaaataataattaaaaaaggacaaatcaattgtttggtattactcaaacctaaatttcctccaattctttttaaaaaatatgtaggtcaattttgaaattgattttggtggagtgattagtattattatgttgtacattatcaatttttaaaagtaattttacagccagttgcaccaaatttaaaagaaaaatgcgtgcgatgaaacattcgccttaagggattacaatcaatccatttcccaatttatacacgggagattgttttttcaatctcttgaagagatatttccttgtgtacattaacatattaaataaatataaataatgataaaaaatgggaaaaaaactctctctagtttcgcaacataggccacaaccatagataatataagagaatanctatataaaaccattccaatataactctaatataattgaagtgtaattatattgtaaatataattacaatgttactcttatgtaacaacaagcggcgctcggtttcaaactcacagtgagagtatgattccctagcnccacatgcgaagaaaatgtctttctcccctcgaagcacatctaatggctaaaaaattaaaagcttcccctacccgttttctttcattagcagcttaatcattcgaggagaaaagaatgaaggtggtgtgtccaagggccatggtggtgcgacaatcaactccatcgccacatcttgtagcttggagagatgaaccgcgagggatgccgccatcactgcttcgttgacccgagtttatcccaaatcttcgcctcatagacttggctaagaccagtgggttgaaccgtggttcataattgctctcactctcacatttccacatctgtctcttaatttttttttgttaggcttgcttgagctgtggttcgtaaatgctcttactttcacactttcatatttgtttcatatttccacatttgtcgactctccatttctttaatttacctctccagtttccttccccatcatgaacccaacacaacatttgcaccaaaatgtgactgccccctgcagctactctgttaccgtgcaacaaaactactggagacgtgttagttgtcacgttcatcctttccctaccatccacgacaaaaaaaaaaaaaaacagctaaagagcaacgaaagataacatggttagtattttcagtttgtaaacagagtttacagaactcattcccccccttccaattccttttcaccaattgctcagcacaggggagtctacctctcccaactagatacaaaaaatgttttatctttagaggaattctatctttccaaactgccctcatttcaatatccctaatacccttaaaagttaaaattatgtacattgattttgtggtgaacacctcttttttagtatgaggccaataaaccttgtctttatcagtccccaactgagattccccaattatctctacaagctccccaacctctctacccctttgttcattaaatttcttctaaactccaagctccattctccttctaccaccatatccttgacagtagcattttgatcatgactaatttcaaatagataactttcaaaggtacattatcacaccaaacatccttccaaaaactcacatctctcccactgtgcacttcttttgtgaccagcctag

SEQ ID NO: 70656 - DNA, 2530 bp, Oryza sativa
atctcatcctgtatcttatcccatattatttccttccaatcggattcgagaacggatatctatttgtatatctaattcatagatattaaatataataaagtaattgaagtattaaaagagatacatcaagaaaaatttatccaatattacatgtgagtatgtaaaatagttattaaccaatcttttatcatattttttatcatatttttaggtgaatcaataataatttttcatacatattttataatacggaacatatgggcggatacatgttttcccgtatcctaacccatatttatggcatgccacatcttaggtactaaaggtttggcaacctgaaaaagcatcaaaacaacccctactagttaaaatttgaagcacccaaccaaaatatattcgtgaatcattttaagcatagtactataaagtcttgttcaacatagttcattcatttcagcccatctcattcacaaaaagagtgaagaaaaattcgagcaaagcaaaaacatctcaaaaccacaaataacaagaaggaatcctgacacaaatcatctatcattctcaacatctcccacaatcataaacaaattaactaaattaaccaaacttgcctgatgttgaggcaatcaagaaagcggggattagataagccaacacacatggagtgacttctatcaaacattctcccgcgaacagtgctggtaaactcgagtagacgggcagcaccaacatccacagttcttaacctcggttgtttttttcttgtgatgcttctccaccttcgcacacagtttcttcgctgtcttgagcatagaacgaagcgaactatgcaaaccccttttttggggcgccacggacgaactcgctaccaaacccgccgcctcactacgagggatgaagagagagtaggggtaatgtatttagatttgaaatgggttggtttctacaacagattttaaagagcagatactatctaattggccttatagggtgcagatggggttttggattattctgctcacttgtttgaggagatggctgagggttatagagtgcagagcgggttttagattattggcatgttttgctcacttgtttgaggagatgactgaggggatggagtgctaatctaaacagtgctaagaaggaattgaaaaatgctttggtagagctggataacaagacatatgacagtggactttttgacagtgaatggaaaatcagatatgagatggaaaaggagatggaaaatatttacattcaggaggagatctggtggcagagaagagtggcagagaagaggaggggaaacttgattttacaaggagatgctaatacaacctttttctataagccctgcaaatggaaggtaaaggaaaagccatatcttctcttaaggggatgttaatatcacaaagctctcacaaattaaacaacacatgcatattataaggggttgcttggaaaagaagaaagcagggaagttcatctaagtcctgaaatctggcaagataagttgagactgactgagaaggaaaaagtttagatggttagacccttctcttcaaatgaagtggacaaagtgatgaagactatgaaaaacaatacagcttctagccctgatgggttgcctgtgggtttttataaacaaatgtggcctcatataagggttttagttaaagagatgttagatgacttacacatgggtgagctgcatatagatatgatcaattatggggtgatttctcctttgccaaaaatcagcgatgcaaacacaatcaaacagtatagacccatctatccacaaaatgtgacttttaggatgattgaagtggcaaacaaagtgattagttggtctcaaactgcctttatacatagaaggaatattttagaaggttgttttattttacatgaggtgatgtatgagttgaaaataaaaagggatactgggattatcctcaaaattgactttgagaaggcttatgacagggtaaaatgggattttttgtatgaggtcatggagaaaacgaattttgactccataatggtgggatggataaaaaatataactgaagatgggagagtgagtattaacattaatagtaaacagggacattttttcaaaacttacaggggtttgaggcaaggagaccacttgtctcctatccttttcaatcttgtgggtgatgccttggctgccattttggataaagccaaagaatggggagtccttgaaggtctggttccaaacttagtggatgggggtttgactcaccttcaatacgctgatgatacaatcctattcattaagaattctgatgagaacatccttgcccttaagttcttattattctgctatgaagagatgtcagggatgaagattaattatcagaaaagtgatgtatatgtcataggggtggaggatagtgagggattaagaattgctaatatgctgaattgtaagattggtaagatgcctttcacatacttgggtttgcctatgacggtcgacagaattgggatgagagac

SEQ ID NO: 70657 - DNA, 7777 bp, Oryza sativa
ctctaatagaaggaacaggactctgcttttgttgtagttttaccaaaaatcacagtatttgtaaaaataagcaatgtaaatatgatgacgcttcaagtactgtgtgtacttcaaaaaaaatattgtgtgtgaatccatgatcgttgcacttctatcttacaatgtttgaaaacgcagtgcatacttattataatttttcagataaaatgttttacaggatagcactgcagaatataaatgcaaataaattatgatggatttaagtcatgttcacacatgaacaacttaacagaagcaatacctgactgatttcacccctcatacgatttattctgtctgcgtttgggtcattcgaatagtaatccatttgctgactcaagaccctcgagaactcatcattcatgccataagcaagggatgtcaatgcagcacggccatatgtcttcacgaaccttccatggatatcctcaaggaacgcaaaggggattcgccctacaacagaacgaagttaataagtcgctattaagccattcacatagtaataccgcacaaaaagagtctgcagcaagccatgctcagacaaatctgtggttatcaaaccatttagttttaggtgacgcttaatgtgaaaggcgtcgattgcgcaatacagaaagtcagaaatctgactcttaacacgcataaaccgcaacctttagaggcactaaaatttattgttggtttaggaaggttgctctagcccagctctcctcttgcttcctagctcaaaaagagccttttgaagcattgaatttcgtttgatcaggcaattgcaagacccagctgaaaagctcaactcgtcaagtaccatctattgtcagatgccaattggctagctctgactcgcacaatcccaaccctgtttgtccctactcccgatctaatctaccaatgaccaatccccgaagagaaccacctgcaactgcaaagccagcagctatcggagacgcgcatacagacaaaccccgcaatcaactccaccggacggatccccgcgattccgcccgaaacccacccaaacgaaactcaaaaattcccccaccatacatggcgcggcgagaggtgggatggggaggcttacgtccggcggcctcgtcggccatgcagagcgcggtgatgccgtcggtgcgcttggcgtggaagacgtagcggtcctgcgtgtaggagacgtggctgtcggctcccccgccggggaggcgcttgaggacctgccgcgccacggcgcccgcgttggtcgccgccgcgctgtgctccgccagcaccaccgtcccgcgcgccaccaccgcgtacaggatcgccatctccgccgcgcgcctcgcctcgcctcgcctcccgcctccggctgccgtgcggacgcggaggaggaggaggaggacggcggcgagggggaggttgaattagtactaataataattagaagaaaagaaggaaaaattacaggaagaagaaggttggggggaggagtagtatttggcggagacaggttggatggggtgggctggatggggcccaccgggggggggggcgtgttttgagctgggggtagagccccacctttataatgtagaattgcggtgttggaatgtgtttgggctggaacgctgacgacgtacgccggtcggtcgtttattctattactactaccacttgggtatgagtatgactctatgagccgccgtcccgcggttgggttgcaagttggcaccacctgcacattgctgcgttcgctccgctctctccgttaatttatttatgggattttttcttacacgagatatcgctttattatgattcgtacaatatcatacttttgatgcaagttgactccgccgccgccacgactcgatcgagcaggcactcgatcccctaactccggcgccagcgagaccccctcagtctcccatcccctactttccttcttctcaagcctacaacggcgaggtgcttacaccctaaaaccgtgttttgtgactccccgccgttgccttctaacccatgtcgtcatttgtccttgccacaaacactgacccaccgtcagttgccaacctaatggttctagcgccttgccattcacctgtgtctactgtccactgttggtccttcgtcgctcttggccatccatcttagccctcggaaaaccctatcttcccccacccttatccccctccgaccttaaccctgacctaaaaccctaatctgcatctcgacagtttcataaaatatagttgcatttgaatagcataggtaaaaatgatcataaatttttagctagccatcaaagtaggaaactaaactcggttctacaactcttagctgtatcactaaataaaaggtgatgagaaatagatagtttttaagggtgtgtttagttcacgtcaaaattgaaagtttgattgaaattggaatgatatgacggaaaagttagaagtttgtctgtgtagaaaagttttgatgtgatggaaaagttgaaagtttgaagaaaaagtttgaaactaaactcagcgcaagtcatactccctccgtcccaaaaaaaaaaagctcaacctaaacaatgatgtgacatcccctagtacaatgaatctagataattctttgtccagattcgttgtactagaaaatatcacatccccttttaggtatcattttttttttggacggagggagtactgtacacagcaaaattatgaacaggggtcagaggatcagatcaataggattataggtgtgtcacttgtcaaccactttttgcaagatgttttcgagtcgacgaaaacgtttgtaagaatttggagataaattttgatgtaaacatctgaagttttgtatatttagatatggatgacgaaaaatatgtaggttcagtttagtggaacctcaaccaaaccctctgctgtttggaatcagactcctttgtttattgatgaaatcaaatggtgggtgaagctttgatcgatggtgtgcatccggatcgcagatgatttcacataggaaagaaatctgtagcgaatcatcttgtgtctgaattttgtactacgttacatggttgagtaaatgaagcgataaaaattgtgagattttcagagttcagacaaccatgtggtggagtcttgaattcttgacgttgtgcaacattcgcgacatgtataataatgagagcaagtttaatacttatagtatagctcactactagctccaattcatttatagacaattcatataataactgcttactatactattaatatatggtcccacctatcatacacacactgtgtcttggagtccacgctgtagctggctacagatctatagcccacctgctcttctctcttatcttttgtcttattaaaatatatttacagccggctaatagatgctattgtacctgctctgatgagaaatttcttaggccatccacaatgggtacccctaagcgtgtccctgctcacggccgtcgccgctccgtccgtttgccgtcccccagcagaggggcgcgtctccctccactcctcggtcgcttttcgttgagccatggagctaggggacgcgttgggcgacgtcgtggcttgaggacacggctcccgcacctgatttttcccctttcacccttggcctcttcgctgggactgggaggcccatggcggtggggaggagacggagttggcgacgacaacgaccggcgacgaccccgcgatggagactgctcggcgacgaccccgcgccgctcgccatcggccaccgcgcccggccccgcgccgctcgccgtccgccaccgcgctcggcgagagagaaggagaggtgacgacgggtggctcaagatagagagagaggagagaggcgacggcgacgaccagatccggccaccgcgcgtcgcggcagccgtcggccaccagccggcgacgggcggagggcttcctcgcgcggcggcggcgaccagatctggcgcaagctgtcggcggcgcgccggtggctggggagggcgcaagctgtcggcgcggcgacagctggggagggcgaggagggaggcaatggcggtggctggggagggcgaggatggaggggacggcgacgcgcgcgagagaggggagtgattggcgatgcgcacatgagagagagagaagagaagcatcggtgcggtgggggaaaaatgtcgtcggtgggctggaggatagaggaagggtagtataggaaaataccaaatatgggctttttggttgggacactcattgtgggtttgagtgtcttcatccagttgccttatattttgaggagcccatctagggataccctccattgcaagttgagttcccctagagtgtcctcagttagtgaggacactctaggagtgtctcacattgtggatgcccttaggcctttcacagtgcaatgatgtggcgctttgcttcgttgacatggaggagaaaaggaggtgggtcccgtgccctcgcgaggtttacgcctcctagctagggtgcgagttgctcatgcccaaaaaagcaaaaagcaaacggtcccctctctctgctactcccaaatcttccccattctactcttcttccccgccaactctcaccaccatgccaacaatcgagcgggcttggagtcaccggcgatgctgccgagtgccgacgaggaaggggagaaaccgaaggatgggaaaaagcggcagggcaggttggttcgcggcgatggcgagggaggagcgggcggaaaggaatgagcagcttgccagatccgcggtgccaagctcgccgccgaactcgtcgccgtcccccgctccggttcgccgagctcgtcgccgtcacccgcttccgcgccgtcgacattgtcgccatctcccgctcctgtgccgccgacctcgtcgctgtctcccgccccgcgtcgccgacctcgtcgtcgtccccgcgctctgctccgtgtcgccgagttcgtcgccgtcctccgctcccgcgccgtggagatgagatcaaggacatcgtcgccgtccctgcgctccgctccgcgccgaatccgtcgtcgagccactgccgggggtggaggggctggtgagccctcgcgccgctgcagccctccgcgccctcgtcgccagccagaagtggaggggctggcgagatctcgcgccaccgccgccgaactcgtcgccgtctcccgccccgcgctcccacccgcgtcgccgagttcgtcgccgtccttcgccgaaggagaggagagccggcgccggcggagggaggaggggagccggcgccggcggagggagaagggttgagagagccggcgtgactgtgaggaagtagttgggggatttgggtatagtagtatgggtggagatttatatttttctctcgattttagggtggttactgtaaaatttggactcctttgcaaatttataaacatatgagagctgacatggaaagttacaggggctgaaacaaaaaagtaagtcactcatgaggctatttgcactatgggaatacagaaacttggatccggctcttcatcctacgtggaatgagataggggaacgctgtactgtgagaggcctctttgtgcaggtccatctagtgtgtgctggagggagggaacggggaacgtggcaactgacacgtctcgaccttttttgttgcaggggggcgatggtcttttgccattttggtccaaatgtgagtgcgttgccgttcgagagggaggaggagaaacagtaggagaggttaatgtgaaaagcgagttctacaggtggagtagcggagatggtccgcataatgttcgtttccaggggttgcggctgtgtttagagcagggtgaaaaattttgtcgcgttgtattggttatacggacatatatttaaaatattaaatatggttataataaaataaattatagattttgcctataaactgtgagatgaatttattaaacctaattaatctgttattagtaaatgtttactatagcattatattattaaatcatagagtaattaggtttaaaagattcgtcttacaatttacacgcaatctatgtaatcagttattttttcgtttatatttaatactccatgaatgtctaaatatttatacttcatgaatgtctaaatattttgatatgatgtgaaaatttttgacagggatacaggagtgaatgccccgttgctggatggactgagaaaactcgcacaaaacacgatgcattcctcctcttcctccccgtcgtcctccgttgagatcatcgacgccgacgccttccgctctcgctccaccgaccccgaccaccgtcgcgcagacgccgtcgccgccgactccccgttcccgaggtccgtcgccgaccacatcgcctcgtctctgcgcacgcaggaagcggtcgacgccgtctgcaagaagtacggtgtcctggcggagttcgccgcgcgccccgccggcgacctgcgcgcgtgctcggcgccgccgccgggcgccgcgtgcgtgtacgcacgggcgctggaggccgggatgcgcctcccgctgcacccctttgcctgcgagcttctccggcatctcggcgtcgcgccgagccagatcactcccaacgggtggcgcgtcgtggcggggttcctcctgctctcccaccacgccgccgcgccggcgtcgctcgccgtgttccggcgcttcttcaggctgttcttgtccaagctgaacggctggtaccacttccggggcaagcgcggcgccggcgccgacggggtgctcttcacggggttgcccaagctcaaagggtggaagggaggcttcttcttcgtgtcgtcgccgtcgccatggccgtgccaagtgcgatggggcgggcccccgccgtccaagagctctaccgccgagccggtgctcagcggcgaggagatggaattggcgggaaagcttctgcacttgcatggcggcgccgcggttgatctgaggacgtatctctgcgagagcaacctcgccgcggtgttctcctccaacctcgccggcgccgcaccaccgcagccgccgcctcctcgtcctgctcgtgctaaaggtaagtttcctttctccggcgagttcaacgcacagaaggtgaagaccgagccggagagcgacatgccgtggtggtcgccgttgtccgggaagaagagggggtttgaagcagaggagaataacccgccgccgtcgccgacgccgacgccgcctgctccgcatggcggctcgtggtcgtggtcggcttccggcatgtgttccccgccgccgggcttcgcggcgcacgtgcccgacaagcacgacggcgactcggccgactggaaggccgcgcggcagctgctccaggccatcgtcacgccgtcacgggagcgccggttcccggcggcgaagccctccgacgtcgtcgcgtcgagctacctgacactgcttcaggtacgcctccgccgcggccgccattgacgcgaaccgctcaagaatcgtcgcgtgcacttgccttcattcatgtcgtcgttgtttggcgcaggcggcgaactacgcgtcgttctcgttcggctacgcgctggagctggaggagaagctgcgtgcgcgggagcgcgaccccgccgcggaggcggacgccgtgcggaaggagctcgaggagaaggcgctgcgcgagctcgcggcggcgaaggcggcgccggtgcaggagtacctgcgctccgacgagcacaggcgggagctcgcggcgcacgcgctggaggggtacgagcgcggcatggagcgtcgcgctccgg

SEQ ID NO: 70658 - DNA, 12947 bp, Oryza sativa
tagtaatagtatgaaccaatgtgacagtgtgctgattattattattattattattatatctgaaacctgatgctctgtgtccctgattgaattaattattgtgatgaaatgcagcacaggaaggagctccaggcaaggacaagggaccagctccagacattggagttatctacgtctttgtacgacacggcgtgggtggccatggtgccactgcggggttcccgtcagcatccgtgtttcccacaatgcgtggagtggatattacaaaaccagcaggatgatggatcttggggtacaagaggattcggcgtggcggtcacaagagatgttctgtcgtctacgttggcgtgtgttcttgcactcaagagatggaatgttgggcaggagcacatcaggagaggtacaaacgactgtgcatttacctgtcgatgtttgttttaattgactctgtatgtatctacacatttaaggcttggaatgtcttaacgctatgaaaatggtactgtcaggactagattttattggaaggaatttctccattgccatggatgagcagattgctgctcctgttggtttcaacatcacttttcctggtatgcttagccttgccatggggatggatttagaattccctgtcagacagacggatgttgatagacttcttcacctccgggagatagaactggaaaggtctgttaattctaacacgaacatggatattgtatgtcattagtatttgtattactgttgttacgagtatgtaaagttagtatgcaagggttgattgtgtggatgaagttttaccatcaggcgttctaaaaataactgtcagcttagttttattccctagttccccctgcattctttttgaaggaaggaatataatgaccttctcctctctttttttccaagatcctatatttggaggaaatgatcaatctcggttttaatagtgcctatgagtaacgcactgaaaatctgatatgattaaatgcagagaggctggagaccattcttatggaagaaaggcatatatggcttatgtcacagaaggattaggaaacctgttggagtgggatgagattatgatgttccagaggaagaatggatcatttttcaactgtccttccacaactgctgccacattagtcaaccactataacgataaagccctccagtacttaaattgtctggttagtaaatttggcagtgcaggtgagtctgcacgcattttcttgtcaagaactttctacagtgtagactgctcctaaatacatagtaatacatttggtccattgcagtaccaacagtgtatccactaaacatatattgtcagctttcatgggtggatgcacttgaaaagatgggaatttctcagtattttgtcagtgagataaagagcatcctagacacaacatacgtgtaatgactttgagtaagtattttatctatctttaatagttcaaacttaattttagctagtttgcagttcatggttagaaagagatgaggaaattatgctggacataacaacatgtgcaatggcttttcgcctgttaaggatgaatgggtatcatgtttcctcaggtgtgttctaaggcttgaaaggaatattttttttgttggtttcgaactatattctacctttggttttcatttaacatgctgaattattttttatttaacatgctaatttaaatgcggtgcagtcgagttatctcctgttgctgaagcttccagtttccgtgaatcacttcaaggatatttaaatgataagaaatctctaatcgaattatacaaggcttcaaaagtcagtaaatcagaaaatgaatcaatcttagatagcataggctcttggtcaggtagcttattgaaggaaagtgtgtgctctaatggggtgaaaaaagctccaatctttgaagaggtgcttgcatgaagttttgaatttccatttcattcggaagttcattttgtgtttaagtatatgccttttgtgatttcagatgaagtatgctcttaagtttcccttctacaccacactggaccgtctagatcacaagaggaacattgaacgttttgatgcaaaggattcccagatgttaaagacggaatacttgtaaggttttcattgaaaaggtctgccaatctgagtaatatatatgttaggcaccaattccactatgttgtttactcaggcttcctcatgccaatcaagatattctagctttggctgttgaagatttcagtagttctcaatctatataccaggatgaacttaattatcttgagtggtaggtaatccagcctgctgtcaatctgtcatgttatgctcctttattgtactaccttggataaattgcaaaattttgtttgcgacagttgggtgaaagatgaaaagctcgatcagctgccatttgcacgccagaagttgacatattgctacctttctgctgctgctaccatattcccccgtgaattgtctgaagcccgcattgcatgggctaaaaatggtgtactgacaactgttgttgatgacttctttgatcttgggggatcaaaagaagaactagaaaacctcattgctttagttgagaagtacgtacaatcctaattcattctattcgatctatttgtctggtcttttgtaagtggcgctggttatgcacagctaattcatcttctctgatttgcaaatggctgtctaggtgggatggacatcaagaggagttctactcagaacaagtaagaatagttttttctgctatttatactacagtgaaccagcttggagcaaaggcttctgcattacaaggccgtgatgttacaaaacacctaacagaaatagtgagtcccatctcatggttgatctattgattctgtggtgaatattgctctgttgcatagtgtttagtgataagctcaaactcatctgcagtggttatgtctgatgaggtctatgatgaccgaagctgaatggcagaggacaaaatatgtgccgacaatggaagaatatatggcaaatgctgttgtctcatttgcactgggacctattgtgctcccgactctgtatttcgtaggaccgaagctccaagaggatgtcgtcagggatcatgagtacaatgaattatttagactgatgagcacttgtgggcgtctcctgaatgacagccaaggctttgaggtacccggatccctttctgtgacaaacctccttgtattctcatatttctacaagatttagcatgtaaataaaattttcggttttacttgatgttatatgattgcagctatctcattctctgcccacaaatttgttgactaatctgtataaatgtgatactaattatgaacacttttatttttctgttgaaggattaggacgtggctacagttcgacccaactacccaaagcttgcaaacttattctaacaaataatttctctattgctgcagagggagagcctggagggaaagctgaacagtgtctcactgcttgttcatcacagtggtggttctatctccatagacgaggctaaaatgaaagcccagaaatccatagacacttccaggaggaacttgttaagattggtccttggagaacagggtgctgttcctaggccatgcaagcagctgttctggaagatgtgcaagattgttcacatgttctactctcggactgatgggtttagctcgccgaaggaaatggttagtgcagtgaatgcagtcgtcaaggagccacttaaactcaaagtgagtgatccatatggctctattttgtcgggcaattgagtgcttctccgttctgttttatcagggatatcagcaacgagctttatacaggttgatatttcttttctttttctttacgataagggtttaaatcctagtacccacgattatagctgctgtgtgctttaagtataataaattttacactcttaccatttttttttaatgtaaatgttggtatatattggtacctgacataatcagaagcaccaaattatacactccttttgtcccagaatataaaaatcgtctagatttgtagtactagaaaatgtctcatccaataattcttaactaccgtcaaatacatttttttaaaaaaataaaattactctttctgataattttgtgatcacgtggcgtgcatgctatttcacaaattttcttctacggtattttacaattgaaaagattgcttgctacattcagccccatctacgtgctaataccaatcttgcacgagataatgatgtatgtgatggttggcatgacttttttcattgttttttttaaaagtacattaatttggcagtagtttggactctagactgtagacagccttattgcaacctatagactatagttttataatgcattggcacatgcaaaaccgagtactccctccgtagtcgtaaaggaagtcgtttatgacagcgacacggtctccaaaacacaactttgacttcttttttctataaaaatatttattgaaaagtgatatatgtatatttttatgaaagtatttttcaagataaatctattcatataatttttatattttcaaactcaacaactttcaacaacttgagagttattcatgatttatatttccaaggtttgacttaaacattgtactaaacgacttcttttatgagtacggagagagtatatatttctctattgctttaaatgcgaagtccgccaccatcgtactttcccacacacaaaaaaacagtcttgaaaaaccaccttacccaataggtatacccacgttaaactaaaccccataaattcatttatctatgtttctttatatcccgctgcaacacacggatatatcactatagcattagttaatagaagaaaaactgaagtgagctgaaacaaaacatccttgtctactccactatgtccctttttgtaataaataaaacgaaatggcagcgcgaatgctgaacaaacgacgtcttatgtgcgcctgatgagtgacatgctatttttagtagtttagtatatatgatcacgctataaacgagtagtccacatgcacaatggactgaatctcaccgacgtggataagacttgatgtgttttggaaaatactccatataaaagtaacatatgaatgcattcccttagtgggaagaatatagtacttattatattattattaggaaaggaaaaaaaagcactttgatgtgcaacaagctaattaagtgcaagtgttaggtggtgtttggatctttgatgtgcaacaagctaattaagtgcaagtgttaggtggtgtttggatctttgatgtgcaacaagctaagtaagtgcaagtgttaggtggtgtttggatctagggattaaactttagtgcttgtaacaaaatgagtaaaaaagttgatcagatttgaggggaaaaaaaagaacataatgagatgtcctcttgtaacggtcaactagagacaacggacaacggacataactcacagaacaacatacattttgtgtttgccagtagtaactatagagaggaggatgtatctcactagctacccaaaaaaaaacatccctgcctgcacatcacatcactgttggttcggtgtgaatcggcaacgatactctatatatcattgttggttcactttaatttactgtttaaaccagagtaaacaatatcggctgtgtttagattcaaaatttggatctaaacttcagtcattttccatcacatcaatctgtcatacacacacaacttttcaatcacatcatctccaatttcaaccaaaatgcaaactttgcgctgaactaaacacaaccatcggttcggttgaggcctagaacaggtagagatacatcattcctggttcataagaaaaacgtgtattcatactcaacgggttagattatttttgagaattacacagtacaacgcagacacttacaatgtacgcacactcacccctacgaacgcacgcatgtaaactctacccctatgagcatattcgaagactgggccggcaaatcctagagattgacgaagtcaccacaggcgtctcactgtcgacgggtacgtcgcctagactaggtgcgaactactgtccagagaatatcgagccggcaggtattggtactcaaattatagtttttcaagaaaaataataaaatttttcatatgaagtctgatgaaaacaaactttacagagatgcacttaatagtgcagtggcaaggggtgtgtggtttcaactcaaaggtcccatgtttaatcctcaacacgcttataatttcttcttaaaaaagtttggagggtcgtctctccctcgcaacacgctcatgatttcttcttaaaaatgtttggagggacatatctccctccaaatcttgttttttaaacaaactttatatcgaaattatagagtttggcgatgataaatacacgttatagaacttaagttctctaatctacttcgattttttttttagtttttcaaacaacttcaaatgcatggagacaaactccatatgaaaattttagatcttcacgagattcgcaacttcttagttgataaccttttcatttaaaatcatttacatagcttaatatgttttcaagacaggaaaagtcaaaagaaaatattatgcaatatcaaatagctagcattcgttattctaccttccgtcaaaacatgtgcgcgcttttgatactgttgagttgggtatcatggagagcagatccatacgatcatatatttaattgttcaatcacatcaccaaaagaaacaggttttcaatatatattgaagtactataaatcatgctatatatacccctcttcccctccacaatacaattcaattccctcctaggtttgttatgatccatttgacacacgaacacacacatacactacactctccctagctatctttttccaaattctgatcacagatcaattactcttgatcgcccatttattacttcttcattttaaaccctcttttcgtttaattaacgtggcaaggagtgatatatacgatgctgccgtgcttgttcccggcgtatggtagcgtcgtagcctgcaaaccttccgcgatcgatcggtcgccttttggattgttgtcccagcccaaacaaactaataggactcttattcgtcgtcctaaggttactaaaggtacattatgttcatcattttatgcttactgtaaatatacagatgtgtaaggccggccatatattaatttcattatgtaatataaaagatacatatttatttatttattagtacaataaggtagttttttttaattccatatatattttctataaactttactaatggtcaggactgcctaccaaagaaagacgtgggcccaaaagataacttactgtacttcattttcatttaagagcaatacaaatccatgttaattctaccgatcgagataaaatttcgaaagaaaatttgtgtaaatattaacatccgtagaaggactggttgcatttgggattttctttcggatcgatacgaggacaatgccgctaataaatacctaatatatataagttgcatatataattgcattgtttgaaccatgttccacataaatatttcaacgatttatatcacatatcttccaaattacagcattcatggcgatcgaggccatgcggcactgcagcagcagcagcagcagcgaggaaggaggagcggcggcgacgacggcggccagatcagcagtacgggagcgcctccaattagcgccgccgtcgccgtcgccgtcgccgtacgacacggcgtgggtggccatggtgccggccctccgccgtggcggcggcggcccgcggttcccgcagtgcgtcgcgtggatccagcggaaccagcggggcgacgggtcatggcgccacgcggcggcggcgcaccagcagctcggctcctcgccggagatcgtcaccgagcgcgacctctcgtccaccctcgcctgcgtcctcgcgctcgcgcgatgggacgccggcagtgagcacgtcaggagaggtatagtagtagctcgttgaattctcagtcatctgatcgaccaatctctgatcagatctatcgatgatcgcaaatgatcagtgactgattgagctgctgctgggatcgcatatactcccttcatcccataaaaaataaatctaagaccgattcgtagtattaggatgtgtcgcatctgatactaggttgtttttttatgggacggagggagtacacatgtattgatgctcggttaaaatggagaatggattcttagagcctgtttgaagctgaagctcaaccaaacagtttcagcttcacctaaaataggagcgaagctaggtagagcactctcataaaatgctgattttagctaggctactccacaaccacactctagacctaactcctaaaggtaaattttagaagttggaaactctaccaaacagacccataattcatgagcggatgtctcctatgtcctatctttgtttttttttcacatcatctaaatatgtataatttttttataggatagattaatatgtgtgatatatcactccgcaagcatattaacctagctatatcttatcaaatttagataacatacatagtttgctggtaaatgcagggctgcagtttatcgggaggaacatgtcggtcgccatggacgatcagacggctgctccggcgtctggttccgtcgtcagtttcgcagcgatgctccggatggcgatggagatgggtttggaggttcctgccgtcagccaagctgacgtccgcgacaggttaattgatttgcatgtgaaagaacagcatttcgttcccgcgttactgtttgtatttttcagggtaacgtacggtacggtcgagcttcagaaacaagttgattaaattgtttaatttgctacctatcgaagatggattctgattcttgattggagagggtgtcacacatattacacgtttttactgttttcaaattcaatttaaaaagcgaattgagcatctctctctaatcagctcctaagctaagttcatcgttatgtgggggtgagtaagtgtttggtgatgtgagggtgagtatacgcaaggcgcctgcgtttatattttgtgtttcgagaaaaaaatatcaatttaaaaagttaaactgcgttgtatacgagcgcttacaatatttgtactttgtattttgagaaaaaaaatcaatttaaaggttaaaaattttataatataattaagcacgacatacacatatgacccgttagaataattaaatcaacttgaatttgtattttagtgatccatgcatattgtgagttgtgaggaatatcctcactagtgaagaaaaaacactttcggtacactggcaagctcctgcatttttcgttgggctggtctggctctagatgttcttgaagaagaaaccgtgttatttattttttttattactctctctaactaccaatatttggtgtttagggcgagataccatcgaactaattctatattaaattaagtttatggaatctaataaacttgtgtgttactacttttcaaagcaaacattatttgagaaattgttttagttaaagtttttaaattttttaaactactagtaagtcttattataaatgttatttttttatgatgggagggaatacttatttatctccttcaacttcatgagtcaggacaaggatctcaacagattaatttacacgtgagagaactacatttcggtccccatttttttaattttctggtacgatgtatggagcttgctagctaccttccaaagatgggctctaatacttcgagaagacgtccttttaaacacttttattttccaaatgcagtaaaaaggctataataaactatgataatataggtgtgtatgctatatatgttctgtgacagtgacatccaccagctcatgcatgctctgggggaaaaaatacattgacgacatggtagactatttattaatatcaagattaaaaaaagtagccgtcaaagtcacatttcccaaattaattaagaggtcaaaaaccatatagagaaaaggaaaacgcagtagtttgagaaaggggagataaagaagattgggaagatacgcaaaacaaggtgagccattagcgtatgattaattgagtattaactattttaaattttaaaaatggactaatatgattttttaaagcaactttcctataattttttttgaaaaaaacacaccgtttattagtttgggaagcgtgcgcgcggaaaacgagtcacaatcttcccaatctcctttgaaagaacgcagccgtcaagtcgcatcttcgaaattaattaagaggtcaaaatcatctacagaaaaagaaaactactataagtactccttccactttatattgctttgattttttttttctaaatcattactccatccgttctattttaagtgcagtcgtgtatttctgtgttcaacatttgatcatctgtcttatttgaaatgtttttatgattaatatttttattgttattagatgataaaatataattagtactttatgcgcgactttttttttagttttttcatagtttttttaaataagatagacgatgaaacgttggacacagaaacccacaactacacttaaaatagaacgagggagtattttaaattttgattaaatctataaaaaagtacagtacaaaataagtatagtatcaaaatatatatattaaatgttagatttaatgaaactaatttgatttagtgttatagatgttgttatgttttctataaatatgattaaattaaacttaagaaaatttggcttagaaaaaaaatcgaaacttcttataatatgaaaggggggaggagtatcaaaactatatcaacttgatcattacaataacaatcttgctgtgtaaattaattcagagatgctggggtgatctgccacggtggaagaacagaatatacggcttatgtctcagaaggattaggcaatattcagaactggaatgaagtgatgaaattccaaagaaagaatggctcactgttcaactccccttacacaactgcagctgcattagtccacaactatgatgccaaagctctccagtacttagacatgcttctggacaaatttggaagtgcaggtaactgcactttgtcaatggtttaataggatacgaaatataaacatttgctgaatgcctaattaatgtcagttaaaatttgcagtgccagcggcctatcctgcaaatattcagtctcagctctacatggtggatgtgcttgaaaagatgggaatatctaggcattttgttggtgagataaagagcatactggacatgacctacaggtactaagtactaccttaagataataagattagttgtttggagaccgtggttaattagcagttcaggtaaatgactaaatttggttgcagttgctggaaacagagggatgaggaaattgtgcttgacatgcaaacatgtgggatggcatttcgtatgttgcgtatgaatggatatgatgtttcttcaggtactttattctgctagaacctaaaaggataactcggtactttcttttacctacttaagaatcataaaaaaaatcaattgctagctcgattttatgattcttgagaagataacgggaggtagccctttgatctttagtttcagttccttgtaccaagctaatgtattgcattttaaaaaatgtggtgcagatgagctatctcatttttctgaaccttcaagtttccacaattcacttcaaggatatctgaatgatacaagatctttattagaattacataaggcttcaaaagtcagtatcgcagaaaaggaggtgatcctagataatataggctcctggacaggttgcttattgaaggaacaattgttatccagtgcaatgaaaagaaatccactctctgaagaggcaagttgtcaagtgtgaatttctcatctccattatttatccataacgatattattataattattattttgtattttcaggttgaatatgctcttgaatttcccttctataccatcttggatcgtctagaccataaaagaaatatcgaacattttgacattacaagcagtcagatgctagaaacagcgtacttgtaagtttttttcctttgatgaaacaagccagttccatcaaacctgacctattcagacaccagaaatcaatatatatttttttgccgggtcggccgaaaaatcgaccaaccagaaatcaatttgtcatgaataattaaatatttctgaaactaaacaggccatgtcattccaatgaagaaatcatggccttgggtgtgagagattttagtagctctcagtttattttccaagaagagctgcagcaactcaacaggtatgtacatctgacatttattgctcttttttatttcctatgtaaaccaacaaacttgcagataatttcgttacaattttttgctgcagctgggtgaaagagagcaggttggatcagctgcaattcgcacggcagaagttggactacttctatttctctgctgctgctaccattttcactcctgaactgtcagatgttcgcattttgtgggccaaaaatggcgtgctgacaacggtcgtcgacgacttcttcgacgttggaggatcaaaagaagaactggaaaacctcgtcgcattagttgagaagtaaaactaatccttaaaacaaattaatgtcttaaccaattctagttcctcaggctaacaaaaatttcagccctgataacgcttgtgatattcatatctaggtgggacaagaatgacaaaactgagtactactctgaacaagtagagattgtgttctctgcaatttatacttcaactaaccagcttggatcaatggcctctgtagtacaaggccgtgatgtcaccaaa

SEQ ID NO: 70659 - DNA, 9772 bp, Oryza sativa
ccgggattctcgaccgcgactcggtcgtatatattcgtacgacggtacgaggaatcagcgatcgaggagccgaggaatgttattctccaatccgtttttttttcctttttacagtttttgttggtcttggcccgagaattgatattgatttgttcgtagcgacgaattctgtgcttgtttcaacgttatatcgttgtcgctctgtcagcagcaacaagctaggtcgggaggaaggggaagacgtcgcgttccacggtgagttggagatcgatcggtgcacgtcgcgtggaccgcgacaaggccgcagggacagcgccgtgcgtgacctcctgtcgcttcgcgtagggtcatgcattgctgtgcctgtgccagtatgcgacaccaacctttgccaatatagcgtcaaggccgccccgcgcgtgatcgacaactggtgccactttgctctcagtttcaggcggccatatacagtcgcaaaccgtgacggcttcattaattacgtgcttccattttccattgctagtctcggaatgccatttatatttagtaaactttagccacttctacttcaataaactaaaaaaatattataaaaaacatactatcttatcaaagttatcaccgtcgttcgtatggaggttgcagtttcaaagtggaaacattaagaaactaggtggctgatatttttagccatgtaccgttgccttttcgaccaagagattattgtttctactttttttttaatcttcgatcatcgtcactcatgtggaagttagaatttcagagtgaaagcattaagaaataaagtagctgagtgtttttaatttgtaccctattatttcagatcactgtcacttatgtggaaattgtaattttcaaagtaaaaaaatcaaaaaataattaggtgactgagtttttccttatctatgcgtcattgcctttccgattaatgtttacctatcctttttttcatctctaaccgtcatcactcatgtggaattaccgttttcgaagtgaaaacataaagaaatttaggtgggtaacttcttacttttttcttatctacatgatatgccattgccttgtcaaccaacatattaactaggtgataccccgcgctttgctgcgagatttatggataagtatatattaaatattgtcgaaatgatgaaagttgaaatgttgaaaaaataatgtgagtaagatgatttgacacatgcttgttgatgatgtgttatacttacatgagatttaaaataggctagaatagtactttctagtgagtgaagatgttgcatgcttgtataggattttaaatgggctagaatagtaattgctagtgggtgatgatgtggcatacttgcatgttgagttttaacttttaataattgttagtgggtaccgactatatagaagactatatagaaagtatcgatgtgtagcagcactcactcatgctttgccaggtgaaagagaaaaaaagttattccaacttaaaacaaagtattgtaatttggcaaatatctacaagctagtatagatataaaaaagctaatgtgcaaaggcattcataaaaattaaaatacatttaggtgaatccgtacatgtaaaaatccacactaaacttaaatcaggttgcaataaaaaactatcaaattaatttgaaatacaagcttatgcatgcatgttacttatatgcactacaaattaaacaggagtgtttttctgaagataacttccatatgatgcatgcgactgttagtatagggtatatagcccattctttgactgccaagtgcaaacggaaatgttggaatagtgtcaaccattcagggcatgcgtggactattccaaatctaatacaggccattcaacagtctttgcacggttattctaaaattaaagcacctagagggtgaccatagttatgcatcgaacaaaatctaatcttataactagggcaagaattctccagtgaaattcaaagcattggtcttaattccatggtctaaagaatgtatggatttaaaaatgtgaaacatttgtgtggagattatgggtaccccatacccacacgacatggttatccgactagtcttaggggatagcttatatctatggaatatgtaacagatcatgacttgggtattacgtttccctgtatattatggaacggcctaaagtcctggtttgataagattgtaaagtagatttaggaaaccgataccatgttggttaaggtttctatcttgtaatcctgccctccaccctatataaggtgggcaggaggccctctagggggcatgagacaacctgatcgtcagatcaatacacactcggcggattcaaatccccaaacaggagtagggtattacctctcattgagagggcctgaacctgtctaaatcctttgtctccgcatccatccacttttaggtctcgtgcgctacccccttttattattgccgaattcatgtttcgacagttggcgcgccaggtaggggttgcgtcgagttatctatcaagaagcgcgatggaatcaactttacgagtcgccggcttcgtcttcacttcgggagctgcaacttcctcgccgccgacgaattccctaagcttttcttctccaactcagatccaatctagccgggaagattaatctcggcgatggatccaatcaccgtcgccgccgagtcttttctttgatcggcaagaccggacgtcagtcaccgagttttgttcttgatcagcaaaagatttgaagccaacagctattatgagcctccataagtagttgttcctgtcaattctattttatgcaatgagatcaaatctgtcgccatgtgctgtcaagcaacagatcaagcatcagcagaaaacatgcatgcaaagctctgaagcatcggcgtctttcctcgtcgacatcaaaatttgttggcgagattcaatttcggaatcgatatggactccaacccagctgattggagcaattgtcgcacaagggcatcgatcaagccacttctgtccaagccatacatgcaggtgcatgatctacctagacagatacatgcacgcagcgacctttttgctggagtctctgattcaatcaagcaagccatacaccgctgatgacatacatgcattaaaaatcttggattacaagccaggtttatcgttttaaattctttcgcaaattagattaattcacagattactaattattgtttgatctgttattgtttatgcatgtatgtcggctgctgtcgtcgccgctggctggcttctttgcgtacatggctggtgtactctgccaccattgctggtggcgacattgtcttcaccaaccggctgcctccgtcgccgctgactggtgtcctcgcctatatggttggtcggtcacaccaccgttcatgggcgtcaacgtcttcatcgaccggctagccttcgccgccgccgactggtgtttccgcctgcacggctggcctattatgccgccgctgttgggcgtctacgacttcaccgccggcctgcctccgtcgccgccgagtggtgcctccgcctacacggttggcctattatgccgccgctgttgggcgtctacgtcttcaccgccggcctgcctccgtcgccgccgactggtgtcctcgcctatacggttggttggtcacaccaccgttcatgggcgtccacgtcttcgccgaccggctggccttcgccgccgccgactggtgtttttgcctatacggttggcagacttcgccgccgttaatgggcttcatcatctacaccactggcttggttccactggcgccgactggtgtttttgtcaccatcgatggactgcttcgttcccacatcggctacttttgctgtcaccgagggaatattacaaagctaagtcatcatttattttattctttatatgatattttgtcttttcctttgcctcactacatcaactggttcgccgttgactagtgagtcgggggctatagatgttatatcgtattttttaaacaattttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcagaataaatcaaaagcatagagatgagataaatttattttctgctcttaataattgcaaaagtacccgagtagtaaattctgattcgtgaaactttgttccattaatggcgaactcatgtcactcatatgcatgtctgggaagtgcctaggccgactcccggtgcttgggggctatgactagtcggacagagcgtttaaacgtaatgaatcatctgctcggggaaatcaaaattgacaagaggagaaatacacatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccgccgccgactggtgtttccgcctgcacggctggcctattatgccgccgttgttgggcgtctacgtcttcaccgaccggcttgccttcgccgccgccgactggtgttttcgcctgcacggctggcctattatgccaccgttgttgggcgtctacgtcttcaccgaccggcttgccttcgccgctgccgactggtgtttccgcctgtacggctggcctttatgccgccgttgttgggcgtctacgtcttcaccgaccggccgcctcgtccgccgccgactggtgcttccgcctgcacggctggcctattatgccgccgttgttgggcgtctacgtcttcaccgaccggcttgccttcgccgccgccgactggtgtttccgcctgcacggctggcctttatgccgccgttgttgggcgtctacgtcttcaccgatcggcttgccttcgccgccgccgactggtgtttccgcctgcacggctggcctattatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgctgccgactggtgtttccgcctgcacggctggcctttatgccgccgttgttgggcgtctacgtcttcaccgaccggccgcctcgtccgccgccgactggtgcttccgcctgcacggctggcctattatgccgccgttgttgggcgtctacgtcttcaccgaccagcttgccttcgccgccgccgactggtgcttccgcctgcacggctgacttattatgccgtcattgttgggcgtctacgtcttcaccgaccggccgcctcgaccgccgtcgactggtgtttccgcctgcacggctggcctattatgctgccgttgttgggcgtctacgtcttcaccgaccggccgccgcatccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggccttaccatcttcatcgccggtcgtctcgtctgctgctgactagtgcccttacctctacgtctggtttatacagctaccactactgatggacatcatcatcttccgtcgccgactgattatgccgcctccgactggtgcttttatcttcacaactgcgcgtcttcactaccggtttgcttctgttgccgccgatttgtgttcacttcattacggcaatacaactttgtcatcatggtggagcgacttcatctttattatcttcggcaccggcaaactctattgttgctacttcgcaagttttactacatcaccaaccatgacgttgttgtgaatctcgacatctcggcatgcgatgccgtgttattttactacaacaagtggctctccaacattcatgatttctacttggacatcttcaacacatatcttcaatcaagcaataactattcgacgacaagatgctacagttctcgactctatgttcagttgtttcccaactaatcaaagagtcgggggctacacaaatacaaggctcaaaatttgacaaattttatgtcaagctgaagaaatcaattcatcaaccaacgagtcaactccaggagtcattatcttcatctttgatttggagcagacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcttcaacatagcctactctgctgccgttgatgggaaacttcgtcatcatagtcggctatctctgttgccgctaatcatcattaccgtcggatgcgtttgtcgccgccgattattttcttcatcttcatgattggtggatttcgccatcaccgttgatgcgcgtctacgtcttcatcgtcggtttgcttttgtcaccaccgactgttctttcgttgttgttgggcgcctacatcttcactgctagctgacctgactgttgccgactggtttcttcgcctccatggttatgcaacttcattacctttgattggtgtcactgtttttactaccactgacatcttccgttacttctgatgagcaatttcgtcttcatgttggtcatttcatctccatgccgactgcgtcagctattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcacttttcgcttaggccaaagtgcgcgtgatcaagtgcccaataccttaaaatccttttataccgcagttactcgactttttaggagttggtacaatgcatcttaaaaggtgtcaaacagtaaagctttatatagctgccccgctgacttttttatatagtcaaggtgctgtttgggtttatcaagcaattgattggatacaatatcattgctttttgccacgtaagtgtgcatttttattgaccaatattatggcttaggctgattatatattatggtcatttttcaggcggttggtaaatcctttatgagtttacttactcggatgttataccacatgtgccatatatttccaggtgtggtgaaacaatgtgtcttttatggacttaagcacatctgttaaagcagtgtgcgcatggcgtatgcccaatactttgaaaatttctttattcacagcattcaagcttctttatagttgttttgctatgtgaactttcaaagatgttgtcaactttaggttgtacgcatcatattttgccaagcagtcggtatatcacttggatcatattattcggggattcacaccgcatatgctatacattgatatcaagtcacttggttgattacaattatcaaaaccactcggttggttagattatttattccttgactatatgtttggttggttcaattaaccacatagtcgggggctacacctattaggtgcatctattcgatgcacctgactatatttttcagccctccacagtcttcagatttggtaaaagtactcgggagaccatggcgaagataattgaagcactcggctttggagtaatctagttcgagagaaggttatcttttcggctgtgaaggtctcaggggctactgtggagattatgggtaccccatacccacacgacatggttatccgactagtcttaggggatagcttatatctatggaatatgtaacagatcatgacttgggtattacgtttccctgtatattatggaacggcctaaagtcctggtttgataagattgtaaagtagatttaggaaaccgataccgtgttggttaaggtttctatcttgtaatcctgccctccaccctatataaggtgggcaggaggccctctagggggcatgagacaacctgatcgtcagatcaatacacactcggcggattcaaatccccaaacaggagtagggtattacctctcattgagagggcctgaacctgtctaaatcctttgtctctgcatccatccacttttaggtctcgtgcgctacccccttttattattgccgaattcatgtttcgacaatttgttttcttctaaattaagatccaaattagaggtattatgaaaccatgtgcagtgtggtatagcgtggagtggaaacaagagggggccgggtcaattcttttccattgtatctatgccgtccttttccctcttacacgatccatctctcctcaactttacatttaattacacaagtaactaattaattaagggagagagaaaagacaccatgagtgcatgaccatgaggggtgccctttgtggaggggtaaggtatttacgtagttaaaggcagctttggaacatttagatttaaaaatactccattcatcccaaattataagacatatttttttacatagtctccaatgatatactttgatcattaatttattccatactatattccaataaatatgaaattagcatcacacgaaaataatttaaattataaaactagtgatataacatgcataatacttagcatatactatatgattagtatgattagcagttaaaagttaccgagtttaatttttattataaaaaaagggtgccctataatttgggacggaaggaataataggtattagtgttcaattacagatcaatgtaaaactagagatattttaccgtctttaagggagtattatatatagtttttaacatttaccccaaggtatgtactcccttcgtttaaaaaaaaagacaacctagtattagaatgtgacatattctaatacaacgaatctagacatagagtatgtccagattcattgtactaggatgtgtcacgtcgtaggacgaggttgagtcttttgggacggatggagtatacatgtactcctacaagacatgattcatgcacgcgtctaatttaagcagcattatatctaaagtaagtttcttttatctagtactttatatacaaatcttgagcactactgcaatatctttaa

SEQ ID NO: 70660 - DNA, 1600 bp, Oryza sativa
  unsure (1)..(1600): unsure at all n locations
cattgtgcattcgctacacaacgcagcagcagcctaacttcggttcagaggagtttgtccacaagaacaccattttatttttatttttctgtatttgaactcagcagagcaccaaacttatgcagtgacactgaactgcacccccctttttttgtcgtttggaatctttggatgttagtttccatatgtttaagcgtttctgcaaattaaggaaaatttcctggaactattatcaccctagctcccagaattatcttgtcatatctgcttgtgttgcacgagatgttgagagtggatgctgacttgttcttttacctttttttcagttcattcactctgttagtgccacacttcagttatgtcagttaggatttttaccacaattcttatgcctgtttttttacctgagtttgacacgtttgtacaatgtacagtacaggtgactgaagtaaaatttgagctgtacacgttcaacacgttggtacaagggagtaataaaaaactgccgaggaaaactttcatctactatactgtgactgcaatataatttcaccataacttaacaaaattacaaaattatacctaagttatataaatattacaatactctgcattgtacctatagggtaattatattacaattatcctataataattatattataggtacactataactatactatagttaaatttggaagtttggttagcaagttttttaacaattcccttgtacaatgtaaacaaatatgagttgtgacttgtgagtngcacgcacaacagcaagagaagtagccagaaaacaagtacaagcacaaagggccgcagtatgcagacgcagctgcagcagcagcgaagaatattgatagagtaatagtagaattcccatggtcgtacagcttcaaataggcggatttatggnggggcaaagatacatttttcattgagttcgcacaatcaacacagcatgattacacaataaatagtaatctctacacaaaaaccaccctgacctattgcaatggtgttgcaatagttcagcagcactcaccagcacaccacacaaagacatggatggcatctcacctaatacaagtaggcaaggtgaagccatggcacataaagacgagcacaacgtatattattaccgtgaggaggaatatcaacgcaatcctgcacacggagtaatgtgagccatgttagtttctgcagaaggcagatggaaaaggatacaacagcagtcaagtaaacagatctgagaactcattaatataaggacaaatcttcagaaagtgtgagctatgccacatcactgcttgacgcaacaaaaggaaaatgagaaactgacacttgcttgacgcaacaaaaggaaaatgagaaactgacaaactatccagaaccccaaaagtaaaaccagatttcagaaaccagaatgttctccttggctccttatttacacacgataacatggttaccattccaaatcgtatcaatacagttgcttcgatttccaaaccttgcttcttctttagccagaagacttatgcatgaatcttacaaataccaaattacgcagaactactaaacaccaaaataatta

SEQ ID NO: 70661 - DNA, 68110 bp, Oryza sativa
cctccgccgccgcctcgcctcgccgcgctcctgccatgccgccgccgtcttggagaagagagagagaatgagagatagaagagatagaagagagagataaactgacaggtggggcccacctattttttaataaataaattgctgactggaccgccagaccaaaaccaccgcggatttgggtcgaggggggtaattcgtccggtttacatagttcagggtgaaaaatgtccggttttgtggttagggggggtaattcagacgactgctatagttcggagggtaattcgtactttttccttatttttttttaatggagtagactttgcaaggcatggaaatgaccgagggttatccatccttttcttgatgctcaatttaatcctttggccatcaggtcagtaggtggttgccctacgtacgtattcttctgatactgacatgcgtatgatcaatacagcttaacgtcatttttcgcgtcagtaatcgatcattagtgctagtaccatgtgtcatcattcgattagtagttagttgcatttattcagcgattagttgcttcttagttagtacttacactgtgacagtaacctagtagttgggaaatcttcttaccacttttatgtacatacactcgttttatgcctgtcactataaaaaattaaaacattttgataagatatatcaactataaacatacaatttaaaattcgacctacatatagaaataaaaaaattataaatatgacaataaaaaattatgtactattagcagtttagatgtgttgtttttctctatttgtatgtcagaactagaattttaatttgaatgtttctagagtgaaatgttatatgttgatatttttttaaaaaaaagagagtgactttttagttgcatgagcgtagttccactcgagtgaggaaaaaaaaacagtttctgaattagtggagtatactgtatacttcagttctgttgggttaattaccattcgcgcgcgtgtgtgcagccaccacaacaacgcgttcttcgcgcgcgtcggcggcgtgagcaacgcggagatgaacaggctggagctggagctcctcgccgtgctggacttcgaggtcatgctcagccaccgcgtctacgagctctaccgcgagcacctcgagaaggaggcgcggagggacggcggcggcggcgacatgctcgccggcgcgtcggccgccgccgccgccaaggcggggagaatggcggccgtctcgccgtccaagctgctggaacgcgcggcggtgaacggcgccgcgcagcacgacgactggaggagcctgggtacggcggcggcggcggaggcggcgaacggcgtgcggcggcacaggtcgtcgtcgtcgtcgcggtattccttcgattgctagtatagccagcgttgccaaagagcgcgttctgtgtgtatatatcaggttatcaacgagagtttttgaggctgtaaaaaaattaaagacggattaattacctgccaaagtgccaattagcaaatgtttgccatacacgaacattactcgttgcctgttcagcaattcagcaatgaaaatgaaaatctggaacaatcgtcgagtcgttgtagagttggttgtttgatggaatttcttttcatgcattaaacaacctaataccggatataacatattctaatattatgaatcatgttgatttttttagaacacggagaaaatatacatgaacacaccaccatcttgtgtaaaacggaaaaagaaactgtttttttccgttctttttccgtgtgtcaatgtgtcgtaaaaacaccatctaataacctcgcagagaaaaaaaccacagtacttcaatagtttgtacagaaaacatgatggatcaggctaagtttgttgaaatcaaggtctcaaagggaaaaaataaagaggaaatcatgtaaagctcataccgaggagtacaaaattagaccaaccatagaagaaaaccaactcatcaaatggccagtttagttccccgccaaaaaaaaattttacacatgtcacatcgaatgtttggacacatgcatagagtattaaatataaataaaaaaacaactaattacacagattgcgtgtaaaatgcgagacgaaacttttaagactaattgcgccatgatttgacaatgtgatgctacaataaacattttctaatgatggattaattaggcttaataaattcgtcttgcggtttatatacggattctttaatttattttgttattagattacgtttaatactttaaatgtgtatccgtatatccgatgtgacacgttcaaattttacgcgtaactaacacacccaaagtcatagttcgagcagttggttggttcaaccatgaagactgtgactgggagtaaaacaaaaaaaaaactgaaagacctattaccaaaaataaagacactcttcaaggacctaactgcaaaataaccgtctcctaccacgccgcaagcaaaaacaacgagcttccctctcctccgccctcattccctccgacatgtcgcagcccgccccctcgtagaagagacggcacaatttacacttcgccccctccaaatcttctcctcctcctcctcctcctcctcgccgtcgccgccgcgagcgggcgcgctagggtttcgggccgccgcggcgtcctcctcctcctcctcctcttgttctggtggtcagcgggggcgcgcgtccgatgtcgtcgggggcagcggcgtcggcggcgggggtggaggcgggggcggcggggggcgggaaggacgacgagctggctgatctggtgcggcgcctagtggacgccctcgcccgctactccgatcgcctcccgttcgacctcgatcgccaggtttgccgctcggatctgtgatcccccccgtgtcgcgcgtgtgttttgcggtgttttgataatctctaggttttcctcgctgtttagggatttgtggtggtccgtggtgtaaaggtggcgcgccttgcttgattgtttgtggggaaggctagtcttttttgtttggaactatattttatactgtggccattctactattgtttagttgttattacatacatatgagttcgaagcatcgatttggtaattcgttcttagcagctgtacaagctagaagctgtagtaaatttttaggcgtggattcgcagttcgctaatgatatgtctcccttttgggaaatgtggtcgtatttgggtcattgtgatagttgagattttgatgtatcctttaggttagtaataggctaatagtgctgcgagaaatagttactatgtagaagtgttggttggccagaaagatgcaaacttttatgatggcttgctttatgtgatatcatcgaatgatctacttacctctatagtcagttaatgaatcactaaataattcgttaatggcatgttgtcgttttgtaagttctcttgactgtagtgttttacaacgctatttccaagaactcggtagtaatacaacgtgcagatcctaggctagtaatggatgcaagcacaggcatacacatgcgaacatgacatgtgcatgcacggcgaggtaaaccgatttctatgctcagaaatctgcgctacaacgtcattaaaacgactttaggtatcaaatcacgtgaaagcacttaaaagtgccgtagcgctcgaaaatcgaccttctgggccctatgttgcaacttgcaacagcatgagcattcatattattccacaaaagattgtacttggtgtcaatttttaatcccttgtatcagtcgttgttgtggtttggatgagtgaattggtgccattttttgtgatttctcacacacaaagtccgttttattaattcttgctacaagaattattgaattacttcaatcttctattttagaaacttcgctcatttactacacttgccgcaattacaatcacacttatctttgcctggaaactgttgagagctcctcaagagcaacctcggaggccacgtagacgcgttgctccatcacctagcaacaccagcagtagatcacggccaggtgctttgacctcaacggatgcttgttcatcttcagcagattcaagagcacaggaagcaatcaaccagcttttccagccagtaaacgtattgcctgtttccttttctgaatactgaaatgatgtatctgcttttaggatccttggactgatagtttgcttatattcttctccagctgactcttgagcagcttgttaggcataaactgagcgaaggacgaagggtattttgcaagcaactgctttcacacctttttttttcacgaaatttaaagttttgttataccaatgcatgtttctttcccatgtgtgaattataatgtttaggttacatgccggttacttggtgtgattttggaggaaacaactccagaggagctccaggtgagcaaaagcgctgctgcaaaaaaaatttcctgttttttgttaacgaatttaatttagcggaattatacttttttttcagaaccatgtcacagtgagaccttctgtcctggaggttcttctagaaattgcaaaattctgtgatgtctatctgatggagcgcattcttgacgatgaaagcggagtaagtaataaggaccatgcattttttctgttgcatttatgttttacgctttacaagtatgctcaagacttgatatgtcaatatatactgatatcggcatatgcacgcggaataaacagtaatcaatttaccattgatatcggaataatacgatgaatgaacaactacctggtctgctattttatttcattatgttcaggggttctttttttttttaaaaaaagaaaagcagaagagtatttttggaatcatcactatagacacactgcctagtacggaatttgaatgagctattatagcttgacatcagcacaactgaataatgttgcaggaaaaggtgttatctgccctgagtgaagctggactttttacgaacagtggattgataaaggacaaggtaagccgcatgatgaggtcacttcagaaatataactgcttaatcgttttttttttcatttgggtatagccattggatgttcgcaatggaccttatgtaacatttcttcaaatggcaggttctcttctgtagtacagaaaatggccgcacctcttttgtgcggcaactggaacctgattggcacattgatactagtccagaaattgttcatcagctagctgtaagtcacaattttaacaatcaagtatcatacttatagaagcaggttttgagttgctatgctcccttgcagaggtttatcaaatatcaactacatatttctccacaacgagcagaaagagtagcatccaatgttttcagctctacaagcttggaacaattctttggaggccttgatcagagatgataatatgaggtagagcaggagagaatttattatttgacatgtgcatcggcgtgtttctcatgaaattgatagcagcacctgtatatcatcaccaaatttgacataaaacctgtatgctcaaccgaccggaagacatgacggactgaatatatgtactgcacaattctacacgccgttcctctaatttatactgtctatctctctgcaggtgagctccagcaaacaatggcatagcgagaactgagacgaacatcattgttcattttttttccttgaatgatggaactcgtttttcttgtaccatgtgtaaaagtcgtgtcatgttaaactggttctgcaactccccataagctatggaaagagatagcatctgtagcataatccatgtatcaattgtgttcctgtataaccgaaatacttaaaattgtcatccagttatttgttcggccattcatcccagaaatgtgttattttcacaaaaggaaaaatctcaactgaacagaaggaataaaaactttctgcagcatccaacattagcacagcaaaatccagcatccactcaaataagtacgtatcatatcattctttccgcatatcctatcctaacatttttggagttgtcaaaatctcaattgcatatcctagacaaaaaaaataaaataaatggagtcgtcaaaacttcaattgcatattccacaccaaaaaaataaatttcaggaacctccaaactgtggatcttgttcagttgggcttttcttcttggcacctagggcacgtacagatgaatccataatctgcaagctccgcctgcctctcctcgtaggagacatcctcatcgatgtaggatatggtaatctagaattttcacagttagtacttggcaaaacaacgttttcaatgttttcttttttcactggcagcacaagaaaaaaaatatttgagataagcgttaacagctcagtacctcatcgtccttcttgataggctccagagcaattatcactgcattaccatcagtatcctgcaacggtagttcaatggttttgtcggattgctgactggcaatttggtgtgaaaaatgagcgaatcaactggaagaaatatagattacctcatcccttttatatgctttagcatttggacaacatgaatgattcatacagctttgcaaaggaaagaatgccgtccctgccaacgagaaaattcacaagagaatgaacgaatactgctgggtaaatagaaaatgacattactgtggggggagataaacttgggaagaagctccacataccctcacaaggagctgcatagtcttcacctaaagcatctagaaatggccttgtaaccttttcagcttcctcctgggatatgttgcacttcagattaacaatgccacaagaaaagctaaggctaaccagtgaaaataccttctcatcatctggaagatcatcaatatgtatgaaatagtcttccactggagacggaacaaccaaaccactggaataaaagatggaaatatattgaggttattacatcaaatgcagtacagaacttatttctgttgatggaaagaaacaatgacagagtatgtaatgcacatatacaaatgaaaaataattagatttacttacagattgttcagctcaaacatgccaattaaatggccatacacgtcaagtgagaacactaggaaatgtcaaggtgaccgtttttttttacgtgagtcaatgaaacttgattacttgaatgtgaagggaagctacttatttatatatatgaactgatctagtatatgccaaaaaggatacagggtgcacactcagaatcaaaaatagcatccttgagaagctgcaatgactgcgaaacacagaagataatgatctgcccatcaatccattggtatgtgggacacttttcaatcaaaacaataaccacttcttgtgtgccatttttatattttaactgacgagctagtgaataaagcttcgtttcagagcacaatattgtgaatagaatacctatatagtttcaaaagaatgaaatatgtgacagcataattaccgtaagtgctagatccctaatttgctgcctaaatgtatcttcatcacaggaatcaacatcctcaggcaaagcaacagagtcccaccacctgcaacaagattttttttttttgggacatattagggtggaacaacaatgcaaacaactcaaaggatcttgtagagctagagcaaggtagtgaaagccacactgagctgaaaataacatcttgccaacaaatccaaaaaaagagaacaaaatatgcaaccatgcaacagagatcttattgactgttataaatgagaagagtggaaatatactagtaccattgaattattgatatacacttgatgaagaaactatcgattgtgcattaaaataacactgctggtagtgccatacgcgcagctactttatcagaggggatgaatagttgcatgcgaattcatgactttacctctttttgtagcccatcgaaagtggtttccatgcttccataagcaaagaaaagtttgattcatctgtgttattttgaaattcaggctgcgttttgagtttcttgtacctcagcagagtgaaagtgatagcctgacatgtaaaattgtatcgagctcatgcatcatgatcaggagatattaaattgactgcaattggtagcaataaggaaattgcaattgaatcttttgtttggggatgttcttgatatagctactaaaactcgtcttgtgcaatagtctgtcctggtgcattgataagtagattgctgacagccattagtgataacagtaccaactcaagtgtgatgcttgaatgctttttgtattagccatggacaatggcaaagttctagtatccccataaaacttttggagaatattagaatctgagatgagcacataacacgatgtttagtgcttagtacactaaacattaatctatatttctatcacataccttggcagcaacaagaaaaatatcattggaccctgaaaataaagattggtcagtagcagataacagactgacaacctcaatcacaatcatcactaatcaggaacaattgatctaggcatgctgcatttaatgaatagtgaacacaacataaattcgtaatgatggtatataatgatcactgcatactgcacttaccatttgcatgttctatgaatttctgaagagcagatctctgggatggttcagtcttagatccagtacacagcaaagagtgataagtttcccagtcggaatcagcacatgattggctaaacaaaaatgcagaatcaacaagttatgtttttaccccaagattacatttctatctaagacggcaagaacaagttacatgttctgataagataattaggttttaagttttaacacgaccgacaactataacctatgatggagaatgaattgatcaacaaaatatttatgcctcaaacaaaattcctaacatctttgggtgttgcagccaaaagaaagtgtgaactgtaaaatggttagtgactcaaacctgcagtagcgttcttcctcacatccacgacaaggaacaacttgaggcaaactaaaatggtctgtgaaaggcagtgacatgtcaccagtaataagtgatcctaagacctcttctggcaaagtactactgttttcctttgttgcaccagaagaactggcactcgatcccaaatcactctcatggcaatgcctcctattagtgcagtcactgcttgaaccaacgctttgccaatacaatcttcgtccaatctggaactctatagaaccaatgaagcgaaagcaataactgcacacagcgcaatcaatctgaaataaaacacaaaatggacaccacacttcagggaggagcagttcacacaaaaaatagaagggaacaaatacctaggatcacttcaaaagcagacgaaccttgttaagactgtgctgagcaccaaccaatatttgatccttcagaataaggtccccttctgcaaactccttgttcgcacaaacacctgcaagaaccaactggttaagtatcttggcttttacccgacaccaactttatacaagcactccaagtttgccggattgcattgcacaagatatataagtattcagtaaccagtacctttcccatgcttgctgctgaagttcactcttataccatcatgtttcctggactgtatgagcccattgtagtattcctgaaaacaaaagtagcatagctgtgtgtcagatgggagctacagatcgtcagcaatacatgaactaaagtaaccaaggaaggagaaaaaaagccataaaagatttactacaattttactggcttcaaggagacaattgtaactgcaacacagaaagaagccaagaacacaaaagattgtttctattctgtcgaattgatacctccatcgagctacattcactacacactaactgggatacccaaaaaagacaaacttaagattgtacttctgcaaataaaacattaaactacaccgttactgttgtaaactaaacaattcgcctctcatctcaccaatctaaaaaaaaccatccatgcggaccaaaaagaaatcctcctttctcagtaagataactgaaaccaatcatagtaagatatacccatcatagtatcacttccttataacgaaattcccgacaatgattacccaacctttctacagggaaaaacaataatcgcagcacaagcaattcccaagcagatagatttgagacccggaggatggatgggcaagggaaggaaaaagaaaacgtacctgcgcgggttggagaggaggggtggcgaggagctgggcgatttggggcgcgaactccctgtccaggtcacacgggcttgcgctgctcccacccatgccgccgccagcgcgagctgctgcctcttgcggctgcttcttccgccgccgctcgccgccgccgccgtggggtttggggggttttgttctcgagaccttgtctcgtacttgggggagaggtgtggatatgaacatacgtgttcgagctatgaaggcggaaacaagggaagtacgcctccttgttgaaaacggaaactgccatttttggttcaaattgacagccggtgtatgcataactgcacacacataaggaatatgtgaatgttacttgtaaactgcatacatatggtatatgtgaaattgcgattatcaactccagtcaactaacattgtcatcatatccctgatgcttatgcaagaattcccccaaaaagaatgctaaagcaattaaaccaccaccaagtacctaatccgtagtatagaatgtaattcatcctctagtactatgaatctgtatagaagtaggtaggatgtatcatattatattctatattgggttaagggagtatatgtactagcccagttccattccgagtttatgtgttcgtcaccatcaccatgtcaagtcaacatccagccttcaacctttgtaaccaagacgtgcatcgagattgcttgtgatgatcatttcaataatgcaacatacactgctaattactagtaatatttgtgagtgttagatacaccgaatacagcagaaaacaacttcctaggtccccaatgcacaatacataaacaatatacaaactttttcttttctttttgtttttttgagatggaacttaattatctaccacttgctgggtagctagtgagcgccagctcgatcgacaattctcattagatgcatagcagtatagcccatgtatatatatatctatgaatttagatatatcctatttctagatttatagttagaaattggattttttttttggagcgagtataatcgaattgctgaattgataccttgtcaactccttcgatccgatcaatcaaacctgccatagtcatagtgccgtgatcatatatgtatgaactcccccagatatgcgattaatccaactaactattgcctaaattacttgtatattagccatatcattggcataatgctgtcaacctcttagttagttggattgcaaattaaatgggacatggcacgagcaggtaactatacaaaattttcatcgtcatccacgatccaaccaccagctggtgcaaaaccagcagcttgatatataaattcaggcagtagctgcgccattgctggtattagctagcttctctgcagcctcttccattcctagctagcttgtgcaagagctcgcaacaatgtcgtcgtcgtcgtcgtcgttgaaggccttggtggcgttcatggccgtggccaccgtcgccgagctcgccgccggcagcaagacgtgggccatcaagtgggcctccggcgggaactacggcgactggtcgtccaagaacacggtcgccgtcggcgacagcgtcggtgagtgagcttctccattcctcctccgttcttggcatctggcaacaatggcgtctgagctgatcgatcggcgtgtgtaatgtggcgcagtgttcacgtacgggacgccgcacaccgtcgacgagctgtcggcggcggactacacggcgtgcagcttcgccgccccgctctcgtcggacgccggcggcagcaccaccgtcgtcttcgacaagcccgggacgaggtacttcgcctgttcgtccgggtcgcactgcagcatgggccagaaggtggccatcacggtctccaactcgacggcgccgccgtcgtcgtccaagggcggctcgtcgtcgtacggcgcggcggccggcggcggcgccgagctcgcctccaagctggtggtgggcctcgcagtcggcgccggcgccattcttgcgctctgaacatgaactcgatcgtctctgaattattggcagcatttccgtcgtttgagatctttgcgttgcggtgttcctatttgtgtaatgtgcagtggattcccttttgttatgatcttgttttttgtatgcatattttcttgaatgaatttagtagttatgcttgattacacaaaatcagaacttgtctaatgaaaattttacacagcatcgctagcacttcacaaatttgacttctacatattgtaaaaaaaatatcaaatttgaatttgcatgcttgtgcagtgaaatatcacatattaatccatcctgcaatgacagtttttttttacatttttttaataattatttaaataacatcgcaagaaacgaagggcatctccttaaagggcgaaaaagacttccccatcacaatcataggagtaacagtttgtactttgtaatgcattccatcagagaaccaacattaaaattagcatgccatatatatatacacacaaaaaaaggctgcttctgatgtaagacctcctaacatcccattccagcgacggcgaacataatctaattacaaaagctaactaaccctctctgtccaatgatcagagcaattcaaaagacatggcatcacccatggtgaggaacatcgggtgcataaattaatggtgctaaggctttgtcatcagctatagctgataggactatgtcagtcttgctacgacaaaattcaccagctagctccacaaaaggatcatgagctgccctcatattccgaatagatattggagatcatctatggtgagccgagttgcactgccgccaggtttgtcctcaccaaaagcagattggaccatctttctcttcttctcctggcaagagaacataaaagttgtgttgacaaaaatggagagtaaaaaagaaaacatgcacaagcatggtgacactgtctaaaatgaattgatcaccagtctagctccaaagcatgtccaattatttaacaacccttacaatcgagagaatcgaaaaaaaatgcatgaaattgcctacatgatttcagctactttgtaaaaaaggtaaacctcatattagtttcaagaaaaaaatacatgctaaccagtatacgcaagaatggaaaattttcattttgtagaaatgcatctttaactgatgaagttaaatatgttcagttcatatcctacatccagacgactaatgaagtgcataccatctaaaagaagaaaggctcatgcttttgaaatgaaaatgtaacagccaaaatgatacctgtagagctaaaatccgatcttccactgtgtctttgatagttaagcgggaaacggttacaggacgggtctgaccaattctgtgtgctctatcaactgcctggtcctcagcataagggttccaccatggatcaatcataatcacatggcaagcagctaccatgttgagaccaagatttccagccttaagtgacatgagcatcactctcacctgaagaatgaaatttagttatatttgttgaccatctacatgtaacatcaaaaaaaagaagatagagatgaagggcgtcagaaaagtacctctggatcagtgttgaattctctcactgctgcttctcttaagttgagagacattgcaccatcaagccttctgaattttatacggctgctatccagcgaaagctccagcaagtccagcaagccagtccactgggagaatactatcgccttagaaggggctacttcacttggacttgattccatagtatcactccaagttagagcaggtgtattcacgattgagttaagtatgtcagtggttgccctgatcttagaagatatgtaactgctttcacagattgatggagagccatctgcttctacagaactactagttgttgcaccagactccaatttatcagctatacaaaaccttaacactccaggtgaaaaaactgtttgagcgcttaatttcttcccacaagaaggggagggacagacattctcatcacttgttaagctcttatgcacacactgataacagaaaacatgaccacatgttgctacaacaacatcctcaggtgggtcctgcaaaacgcgcagaaatcaaattaccgtagttatcttagtatccatggagtaacaaacagttcagataaaattaaactactgattgtttaatcacacacacatgacagttcagataaaattaaaccactgattgtttaatcacacacacatgacaatcctgttctgatatccttattttgctttttcataaaagaaactattcgaagataatgtaatactatttttttgcatgtacagtatgtgattagattgcttacactgcatctggaacaaattgcatagtctccttccagctgtccaagcaaatttatcactgtttccttaggaagtttgtttgccacttctacagaaccagtatcaatcaaatctttttcctttcccttcaaaagaagaggatggtcacaagcctgccgaagtcgcagcagcaatacaagaatgtttgcaaaattttctcttatcgtcccagcagaagcatattcctgtagtatgaacatggagtataaacattttgcattgaaatttctgaactactgcaaatattttgaaaaagaaaagtaatcacactgaacatggtaaactattgactagcaaacctacttgtgcttacgaagataaatgtaaaaacttggcttctgttcattaaaagtaaaaccttcacaattgctgtgggcacaatacagctaagtgttcatcggataagacaagagtagaaaacaaaatgtatggagtattgatatggtgctattctaagaccttgcagcaacaactgagttaggaataaatcaaaaccgagcatatctaagttcaaataatgagtatctagagaacggacagtatctatctatgcaccataactgccgatcgctttttcatttaagatctaatagttgacatagtaatgcaatattttcgatagaaaaaaaaagaggcaaaattgaagtggccataccttgaacttttccctagaaccttcttcaagcatcatatagaaagttcgctcctcttttgagaagtctattttgctcagctgaatcgtttttggtggcaattttatgattggttctccatcgattagtgtttctgtatttgaacagtccaaaaaatagattaattagacaacatcagaaccagtgaaaacaaaaaaacagccatatgcactgaaactgaaagcacatcttacaaatttaagatatgcaaccaagtattgaagctgaaaacatcaactcaagcaacatataaataaacagaatgttacggggtactcaatatgattccacccaaaaagatagtactctttcaattatgtttcccaccttcacaaattccagattttcagatgtatttcatgacttccataaaatgctagagatccaagataagaggttgcatttttccaagtaaaagttgattttgccatgatatcgtattatcatatatattagctccagcacacacatatataatgaatgaatcaatatcaatatttttaaattttcatagttgtgagtaataccaacgattattgtcaggaattagtaagcatcagaggcaatgggatgtgggtttcatatagcagataactaaaaggtacaaagttgcagacacatatgcagtcatgattttctattttaccttttgtgcgccgcaacagaactatcttcaagacagcttggagtttcttatatccacgagttgcatctctagaaatttggtattttatcatagagcgaaaggaaccatacacagaatatggttcatacttcaagaaacggaaataactatacagatcatcaattgtattttgtataggagttcctgataaacaccatctccgttttgctctcagtccacaacaggctctagccacttgagtattgtgattctttattgtttgagcttcatcaagcacaactctgaaccatcgcactctggcaagtggtccaccatcaaggtcagcatctgaatttttgggtttctttttcttctttggttcgctgtctttctttcttttattgccaatagaaaatgctggacataacccatatgtttcgctgttcttttcctccatatcctcatcaaagttttgtttgggtacctcattggctacaatagtgtatgtggtgacaacaacatcatattttgtcaactcagttggatctttagtccttgaacctccatgataaaccaaaacagacaatttagaactttcagtaaccttggcagccaactcactagcccactgtctaagaacgctggctggacacaccactagtgttcccgcagttgatctattagcagacctcaaagttgacgaaggcgatggtctcactctagccttcttcttgggttcaactttgacagcatttaccattctatcaacagcagaccccggtagactagcccagggcttcagatctgcggcatcacttgctgcttctgatgatggaaacagtgttgaatcctgtagcatattcacagattcacccttcagttgcttcttgtccatgactatcactacttcatcatcctcatcaaggttagctacagatttcatgctgcccacatcagcagacatgaacttagactgctcaaccctctccttttgtataagggcaatagttgatattgtcttcccaagaccctgcgtcacataaagttatgtccctataagataggggatccagtaaaacaagtaacagttatcaaggtagaaaatagaactaacctgatcgtctgccaaaattccacctgaacaatgtgagctattctccctggaaaccatccaagctaatgctattctctttcaataatgaagaacatagcagtgaacaggatcagtagaataaatagaattatcacacaaccaagattttcaaaatataaactttacctggtgcttaaggagtgatactgacataacaccttcaggcaaattttcttccgttgtttcttgactgatttgctgcacaatatatttttttgttttaaaaaggtataatccacagtaagtacaataaaattgaatcaccacacaattatattctataccttcagggcttcatcatacaccaccctctcatcacggccaaaaagcctcttttctatatttaagtggctctgagtgccaaggccattgactccaaaattgttaacagaattgttgtatggcactgatggaggaaagatcctatgtgagtttagacctccatatgcagagacaccacctgcaagtttcaaacagagagaaaaaaattactaatatcgcattttatactagtaaaactatttttatgtgatcacccatcagaatatttgagggaattatggtacatgaacatcatcattatcagttttaacttttcagttgctattaataggtagcttccaacctgttgacattgcagatgtaggcatctcgattccataggcagaacttgtttgaaaaccattgtacttccaagtggattcttcctcgatcttcttgtcacctaaactcgaatgactgaacggaaatggttgatgcagaacctcatagacatcatctgacaggtttcaaaagggaaaaactttagttgtactaatcgcaagttacagcagtatacttttcaagttaatcaaggatagttctactcaccgtcatcatcatcaattgaaacaccctggccataactaacatatggcttgtagccacttgcaatagcaggtgaagggaacccaattccattatagtgcacagtgttaggcttcacagtggggtgtgtactttcaacattgttacctcctgttagagaaagtggacgagacttgtaactgctgctcatgaaggtatgtggaagagtcctgtattgccaagcactattctgacagtcagtgttgacaccgctgctgctttcaataatgtctgatctattctcagcaggtctatgagaggataaagcatgagtgttgtttaaccagttatcgtcatccagcccgactagtagttctgaactattattgccaaatgctgtgttgtgcaaaaccacctggttaacaccatcattgggatcgtcaaaatcaagattgtcttctgtatctgagtacgggctgaagtactcttcactgtctgaacacaagtcaataatatccatattgtgctagcaaacatgggcatcaactctctgttgtcagatatctgcgatgcttagcttcactaatccccaacaagcctggtcagaccacactatctccagcacactgcaaacaaattatcttgatgaacccacttgaatactatcttctgcaaaataatttgtgaattggaagtcagaagtctgaacaaatgatgcattcagtaatttgcagcagtaactgtggtttaattcttcaaggggcactgcaatagcccagataggaaatacaatttcaacttggtgcatacaagggttgcaaataacacctaaaaatatttttttaaaaaaaacacttttttacatcaagaacaatatttgcctaaaccaggcacagtgatgtgcaataaactgatacataaaactatttaaggaagtaaacactaatgcattcctaggctaagtgtattgatcaaaatgcagcaccctattcaaagaaaatcacaaatgaaagattaactattaatccaagggccaaaattttgaaagaaggaagaattgtcacaacatgaactgagtgtgccatcacgcaagcatcgccttcgacaaggaacggcaaagccaactccacaacaatcaaacaattcgactacaggaatgcacaaccctaatcaagcccacgatcgcttaaaacttccccccaaaaccgcccaatccaccaaaaccctacctaagcgaaatccgcccaaagccaccgccttctcctcctcaaaaatgatccgccgcaatcaaaatctcccgcaaatcgcaacaaccctctcacacctccccgaaacaaaacatctcacaaaagcattccatccatttgaaccaaaaccgctaataaccccaaagaaagaaaccagtcttgcaagagagagtagtaaagaagttacctcctccgaatcgtcgtcgtcggcggcgattatccgttggagggatcgaaggcggcggggagcacacgaatcaaatcaaatcaaaatcaaccaaatttctttttgaggggaactgcgtggagattttatctggttcgtgacggccgcgcggcggccgaatcggaaaaactctctctcgcaaagacgagtgggaaacctgggacttatcaaggcgtcgccggtttctccgggggcgcgctcgtgtgtggctgacgcgtggggcccacgtgccgggccccacgtgtcagtgggcgcgggcgagcgggaaagggtggaaatttcgattggttcgcggcttgaaatcgtcgtggaggtgccttgtgttggaaggaaacgggtcgtgtgtgttttaaattgtttttttctcaacgcaaagtatgatgcggtttcggaagaaattcctcggaaattcagatggccccacctgtcagtggctattgggcgttgcaacgggggctgtcaacccctgaaaaatcgactgatattttgaaaggaggaaacgaataagtaattgcaacggtaaaattatcttgttaccgttcaaagaaaaatctcttgttagcaatagcattcggactaaccatcattatcaacgcccatgatcttagttaattgggcattaacatcggacggtcctggtttactgatcgattttttgctgtgctgcaacttgcaactaagcagatataaacagccacgaggattattaaaaacaatataaaacaagagaggattagagtaataagcccttgtttagttctcaactttctcttgaaacttctagcttttccatcacatcaaaaattttctacactcataaactttcaatttttttcttcaatctttcaattttagtcaaacttctaattttgacgtggaaccaaacacaccctaatatacttattttgcacggactactacaggtcttcaaagatgagcactaagggtatgtttagtttttaaacaaaaattttcacgctgacacatcgaatgtttcgacacatgcatggagtattaaatatagacaaaaacaaaaaccaattacacagttcattaggaaaatgcgagatgaatcttttaagcctaattgcgccatgatttgacaatgtggtgctacagtaaacatttactattgactgattaattaggcttaataaatttgtctcgtaatttataatttattttgttattagactacgtttaatacttcaaatgtgtatttgtataaccgatgtgacatgcatggataaaattttttgccaactaaacaagccctaaacacatgaaccgaagaacacttggaatcaaaatcgttatttatatccaaccaaaatgatcatcaacggcacagaaggctagaccagcttaaaatgcagaaactcaaaactgtagaaataattcacagccatcatagtatttcaaattcagaagaagaaaaatacaacagaaaaaaaaaagaagaaaaaaaatatactccgaagcgacttgctttcacccatgggccggggcgaggcccactgcgaacgggctgggcggcccaaggtacggcatgctcgccgtcggcggcgcggccgacgaagcagaggcgacgccggggaacgcggccacggccggctccgtcagcgggacgccgggcggcgtgtcgccggcgccggaggtggccgggagagggtcgccgccgccgccgccgccgccgtaggccggctggagctggcagtcgggccaccggcagtccggctggaccttccgctcgccccacgtccggtgggccagcccgaagcccaggacgaggcccactacgatgagcgccgccgcgaggcacaggaagatcttggtcgccttccccacgtagcagcacattgcaaagctaagctcgtcgtcttcttcttcttcctcctctccggcgagctcgtccggccaccgctctctcacccacaattcacaaagagcatgcgatgcaacgccgcagccgcactcgcagcagagagcacgagaggggaagagaatgaggctggagagagagagcaatggcgagagggatccagctccaactccaactcgcctcgcgtttttggcggtggtgctggctgtcggctttgcactcgtgcgaggcttcacgtgaaggagagagagagatggagatatagagaggttcgttagtatcacgacctaatcatcatattattaaagtgaaatgatcaccatcggtgactgcatgtttctgaacattttaatctcttttgcagtcagtgcagctcactgttcagttagtcagtgttgtatatatgaacagcagaaaacatactacagtaaagttagaaattcagattatggcaagtctcgtttctgcagtttattccagtaagtcagctctgcatcgatctaactaactcaggtacaaacaatagttgctatcatatcacacctaaacttgtctgctgttagtgataggagatgcactactctgccgacacatctagtaaaaaggtagtaattgattgaaggtaattaactggagtctgggacaagatgataaatgaagtgtacaagttcagaataatgctacagtgggtcttcagagaattggatggtgcaggttatgtggtgagggtccatggtgttggtccaataattctcttacttttatttctcttttgcccttttttccccttagcttttaatactctcattttggatgattgaatagtggagcacaaagatgaaggaaggcctcaagacaaccagtggcatgtccatagttggtcacatgttgcactgggccaaagaccagcttgcattttttgttcattcctaggtgtggttaggtatgcagctttaggttagagccttttatgatgcaaattcttttgattgaaatgcagagcttttgctaagctaatcattaattagtagtaccctgcaacagcaagataacggtacaacctactaacatgatctgcagattttacaatgaataaatcagctgctcgtgacacttgcttacacctggggatgtgcactttctgcggtggctgcagagatcatggcaatttttatagctcatcgtcagagtacgctttggaactacaccatccatcatcatgtgaagtgaaaaggcaaagcactactaggcatgccagatactgtcaacaaatctttttagtctaaactctgaagtctgaaccacatatttttcaactggaaacacatgtaagtaaatttcatagagcatggtaaagccacagctgcagcctgcagaacaaactaccgcaaggcacaagcctatcagttcaaagggacaccattcagagtcacaggagcaaagctagaatgtacacatggacgcatttttccggacctgaccaagaagcacccacggtcacagagaagtttctgaagataaaggcaacatctatatatctattccaccactatatcaggaggagcagtaactccaaaggactcagcagaagcgtccaccatcttcttgacctcatctgggttggcaccaacaatcttgttcaccacctccttgtccttgatgagaaaaaatgtcggcatggccttcactccaagcttggacgaaacactctgcatgcacacggtatatgatatagcagcttggctcagtaaactaatttaatgagcatatatgcatagcagttttgtaacaaatggttatgccatgatattcagtagaaacaattgaacatcaaagatgaaagctccgaagtctaaggacattttctagacaactctatgtgaaattatcagtttaggcatccactttctctactttctattcctcaaaagacacttcgctttcagaattcagaacaactcagagaaaatacgaccatgggatgtattccaaaaatacatgcataaacaacacgtcatgagaccaaaaataggagaatggtttccttctttaaaaaaaaaacagagagaatggttacctggacatcatcaacatccacatagaggaacagtatctcagggtgtgtctgagctagctcctcaaacttgtagttcatggacagcgaagtcacacaccatgaagccccaaagtgggcaacaacctacacaaagtcgaggggtcaataaccaagttaacttctgagtgagtaaaaagaaatttctggtgcaactgcagcggataattatcatcaggaaaattttcaatttggaactcagtttgtcaattacagttacagtgaaagaaaaacgagaaagacccagaaagaacgaaaagaacatgattacagaaatcaggttgcatgaagcatccatccccacaaactattatacatatatcgttctaacaaaattataatctacaaacagcaattacaaaaatcgtgggccgaccaaaatatgacttgagaataaacaacatcaatattcatcatgagagacaaagcaggaaagatgtgggggaagcccggcgaaaaaaaaagaggtgggggaagaacaaggcaaggaagaaaaaacccacagggtggccttcgttgcttgcttgattgacgaacagatcccatgactcctccttctcaaccttcacaactttggaattgccaacccccttctgctgctggatctccatatggcctaagaagcaagaacagaaccctctccctttcactccgtgttcttggtctcctcctcctccttgctcctttccccaagaccccaacaagaagagaacaaaattatcacagactgtctacaggaaagagaagtggcaatcctcctgaagattagataagcatggggatttatattctaaagctggtgggtcctgccttattttggctggtagtttcttctggagtcagtatcctatgcagtacttcaaaagctatgagcttatatcaaccacataaaagatatgcccaacgggaataagggccgtgatgcagaaagggtagcaaattaatagagagcttatctcctagtggaaaaggaatgcttatcaggtgggtactagctctgaaatggtaacgtattctacatgagctggtcaatttattagcaatacaacaaattgtggatgttagaacatattggagatggtaaattacaaagcgatgtttttgtgttcctagctccttgaaatcggatatatcataaagtatcatcattttgcagagcgcacctactgcaatttccatatatttcttattgcaataatcgaataacaaagaacaataagtttgtattctcccgctctagagtaataagttttgcatgtggcaaccttgcaataacatccagtttaaagctaccaagtgaacaaattaggagatccatacggaagggaaaacgtagcttgttttacttaaggtagcacacatgtcacagaatcacctcaaaaacatggactgcctgaggttagaagattagtttgctgccattcctagaattcctgcaaagcaagtaataactgtgaattgtcattttctgcgttaactaaaagtagagacgagaccaagaaatttacaagtctggatgtgttcaaatttgatggacatcatagtaacttcatataaaatatctcttactcagaaaaataaataaaaaataaaaaatctcaagttcagtgttacggtttagttgaagactttgatactgaacagaaccatgagaaattaatccagtctctaggagagctttggcaagtttaatcgtttcaacaagatttggggtttaactgctctcacttatgaaaaaaaaaacagctttttgagagaggaaaccctctagaagttcccttgttccttcaagcaggccacgagtccagaatacttgaaaaagaaagataacatgatgatttgatatggtgcgagtttaataccaacaaccctatccattggtggtcctaattaaaaaaaaaaggtgatggcaaacagacatgccaaaatcaatcatacaaaaaaagaactaccaaaaagagatttatattccaatcccccattagcttgccaaccatggtgactgtagacggtagatacacaaaacctagaaagaaagggggaaaaaagcaccgatgaattgcaaaaccacacgcaatttctcacagcagtgaaacagaccactgatctacaaagattgaagcgtgcgagctgtgaatcaattggaagtacacgatgtagcatagcgtagcatagcatagcatagcgccattctactcaaaactactacacacgatttacttcgattcgagcatgtgggaagtggtaaaaggagatggaaactacagagggttttaacctgaacccgacaaccaaactccacgcacaccacgcacgcatacggaagaaggatccgaccactccgcgggctggggggcagcaaaaccggggattccggtagggaaggggagcgccgcagtcgcagatgagaagactggtggcggaacgccggaaaaagccgcgtccgaaggcctctgatcttcttgtgatgggctagctggcaatcgcatagtgggggcacctctctcattctcgcttttccttttttttttatttaagaaaatagatttactacttcctccgttctaaaatataatcatttttagaattcatagctaaaagttactgtattttgagacggatatagtcattgaacggattatgcaacggataggagcatatacttgcatataggaataaattaaatattttaaaaaataaatttaataatgacttcctctgtcctaacatggaggatacttccaaatgaatcctagtaatattttgagatagatgaagtagtttaaaataagtgatccggaagaaaatgatctgacacatatattaaatatcttaaaggtgctggattagctatcttaggcctcctccaacaaggatgagtcagctagctcataaatctccacatcagcttttgtatgatgtagaagagagagaagataaggagagagagtgcactatctcttcttcaagagctaagctcctaaacaaaatatgagaggggttgtggaacccaaagcattttgaacaatgtgctatgagacaacctattaaaaaggtaggctttttgctatctcttgtatgaggtggacaagcatgagctagtgcactagctcaaccattgaaggaggccttaaaggtgctagattagctgctctcctagcgatttggagaggcgcatccaatacggtgtggacacgttgtttcgttacagtggtcctgctaccatgggccagctgattgtttggcccagcgaccgacggccttttactggccatcgtggcatcggtggcgcggccttgcgtcgtcgtggtttggctgtatgctcagccatccgcgagccaccgctaccgtcttgacgcgtgcccattctccaacccatgtccggctaggattgagcgaaggctgtgtttctcgtccgctccgcttcagcgaatcggcaccgccgcgtgtcggccatcagcgagacagcgacacctccaaggctccaatgcccagcagcccctctctcatccatggtagtgctctgtcatggtgtacgggaatgacagggttggctgctccactaaaaatacgcgcggagacccccatgaggagcagatcgagggtacctgcatcgctcctttctttctttcattcgaagctggttctgttccttacttcttcctcttagttcctgttttttgtggagacggtactttccctagtcgcatcatcccgtatgctttgatctttttcagttgtgcttcgctctggatttcaccattgtgatgtcgatgttcttctgaccatgcctatgctcattgattttgatttttgttttctgccttctaggttgcgcggccaacccttaccgagacgtggttttactgctcgccgagccatccgcgttgcccccttccacttctcggcatccgctcgtcgtcgtcctctccgcatccgcatctcttcccaatttgtttgttcccctttatgttcttcactgtggctgcacgtacaacaagcttgaatagcatcacatactccccatcccgtcctcagcatcggcgtgccgcatggcatcgcagcgtcgccttcttcttcggcatcaaggtcgactcggtggctcactgctagcacagatggcgggcggggagtggatctttcaattcttcctcagcgacttgcccgacggtgttgctagctgacacaaccatttcctcaatggcagaaatcggcgtacggtctacctgtcctcctccggtacggtttcccttctcttatctctcatctagcataaattgaagataatgttctgaatttaggctaaatttatcagatgtttgtttgggaagttcgttcaaagattcagatagaacccagcacatttccgaatattggtgcctccagatttctctctctatttcttttttaaatgttgccttctgataattcgaactctgcgccaattcctcttatggaaagagagtcgatgtgatgtcatgaggcaaaacatgaactggtgagcttccctgaaacctgttgattccctggcaacattgatgttttattaggatgaattctcacattaatagcttccttccattagggctttcaatgttctaaacttttttttagagaaatcatgttctaaacttttgattggtgaaagaagttacaattactaaggagctctcatcctctcctgcgaatgagattctattcatttttctgttcctgtactttaagcatgtcagtatgccactacttcattgtccaaaactgagctccaaagaaaggtcaaagtggccagcttaggattaaaacaagtttagcagaatcttcttacacaaattatttggtgtttttcagcatacaggtaaacagacggctagacttcatgatacatgctaatgttgggaggggcaagccactatgctcagctcatggatcttcaggaacggagctgccagcatattactgacaaacaaatacaaggtaaataggcagaagagatccttcatgtgctttgctctccgatgttctccgtagagaaaagaaaagttaatcatttcaattatttatttttattcattaattatatgtaattagtaaattgttgtgttgtatatgtgttaccattttgacaaaaaaaagagcactccgattgatcattttctgaaccatacaggaaaaatactccatgcttttgtatgagctgttcttagtctcttatagaatgtgctgtggtcttaatctctgaaggctgagctgtgttagattggagcactccgatccaactcttttgcccaccaaatcaacttaccaatgcctgttagatagatctctctccccttgagcccaacggctcaagggggccttgaccgcgccctgatcgggggcgcccagcccaatggctggtgggcccccgtcacactgcgccatataaaagaggggtggaggccggcacggcacatggtacgagattcaccgccgccgccaactccaccctacaaaccctaatccgatcgagagggggcgcagccagtgacgggaagcgccaccgccgcgccagacctcatcgccgggacatctacgaccgtcactcccgcagccgtcatcgccgtcgacctcaccggcgccgcatccacgacaaccgagcgccaacgacgacgatggccggcacttcttcatcctccaacacctcaaccggtcggtctatctaaaccctctcccgttttcaatctctatagttcaaacatcaaacccaaatagaaccacccgactagatctaacctaggtgatcctagtgcaaagtttaacaatggtatcagagcaaccctagtgtttagatcgtttcggggaaagaaatccaaagaaagaaaagcacaagatccgcacggatcaaaagaaccaaaaaccctaaccctaattcttacctcgtcgccggccgtcgtcgacgccggcaacggagggggggaggggcaaagaggcgccgcctaggagccactcgacggccgcgcgcgcacctgcacgcgcgtgccggcgagggggcccgcggcggcgccgccatctccgtcgtcgccatctctctctcacacggtgggggttagagacggtggggggagcggagaagagaaaagaaaggagcgccggccatggcgcggcggcgcgagggccgccggcgtcggcgacgccgctcggcgcgaccgcgcccgcccgagagagagaaagagaggagaagctagggttttcggcggccggccgggagaggggggtttttgatcctccgatctcggcgcccggccgtccgatcgcaaaccctagctgatcggacggccggcggcggccggaccgaaatcggcccaagtggggagcgcgcggcggcggctttcccggcccaggcccaggttgcggcctgggggaggggagggggcgcttgcccgcgcgcaaagtggccataggccgaccggcaaaggccggaacaaagtccatataaggtccctccggggccgaaaatgaataaaagagaacagtagcaatttttccattttattttgtcgatttttcatgcaaatttcaatagaattttgaatagatttttgcatgttttacctctgtttaaatttgaaccaacgggagaattttcacagagagagaattacagagattttgctactgttcatatgattttatatagtcttccgctgcaaatagatgaaattgatgaaaattagtgtttctaaaattaaatttcgaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttaatgttaattttgttctcaccgcacatgattatttcaggtggctactccttgatgggttgcattaaagatattccgaccctaaaaggagataactacgcagaatggaaaagaaaactcgaccttgcttttatcttgggagaggtggactgggtattgactaccccatgtcctatagaacctgctgaccttgtcagaggtgaaaatgagtcagatgctgactggcaaaagagacagagggacaatgctcctctcgtcatgtcgtatgacattgaacaaaagaaatggtccttagccaacaagaaatgtttggctgtggtaaagaatacgattgagcctaccatattgggctcgatcccagagtgtgacgctgtctcagagtaccttgaaagaataaagagtcagtttactggctcttcaaagacttatgctacacagctgatcaagcagcttgtgacagaaaggtacaatggaggtggtgttagagaccacatacttagaatgagcaacatggcttccaagttgaagccaatggatttgggcataacagatgactttctggtccatctggttatggcctcattgccaaagcagtttgacaattttattgtcaactacaacataagtccagagaaatggaactttgagaagctcattgctaattgtgtgcaagaggaggagagaatcaaagaatcaaatggtggttcaataaactatgttaaagataagaaaaagaaccacaagtctcccacctcaaaaggtaaacagtctcagcatctgcctcagcaacaacagttcgctgttgagaaagatcaatgtctccactgcaagaagacaggacactacaagaaagattgtcctgattttttgaaaatgatcatggcaaagaaaggtgagaacattattacatttgtaaatgaatctcattatgttggttactctagatccacatggtggattgattctggagcaactattcatgcttgtaattgtttaaaggcattccgttcgacgaggactacgcaaagaagagaaagcaccattagagttgccaatggagttgaagaaaaagttgaagctgttggagatcttcctctagagctcgcgaatggcttcatacttttacttcgagatgtcttttatgttccttctttgcaaagaaacttaataagtgtatcaaagttggattttgatggatatgattgccgctttggaagtggcaaatgtgaactatggcataataatgcatgtattggtcttgctgtgttgcgagacgagctttatttgttatctctttctgagaatgtgaatgttgtgtcctcgttgacaaaagaaaacaagaaaagaaagcgaactcccgatgtctcatcgaaattatggcactgtcgtttgggccatatttcgagggggagaattgagagactagttaagaatgaaattcttcctccattggagttctcagacttagaacaatgcatagaatgcattaaaggaaaatttgtaaagagcatcaaaaagggtgcaaaacgaagcgcaggaattttagagatcattcatacagatatttgtggtccatttcctgtgaaaagtgtggatggctatgactcgttcataacattcacagatgattactcccgctatggttatatttatccaattaaagagcgatcagaagcattggataaatttaagatattcaaagctgaagttgaaaatcagcatgatataaagattaaagtagtaagatctgaccgtgggggggagtactatggtcgacatacgccttatgggcaagtccctggaccttttgcaaggttcttgctagagaatggaatagtagcccagtattcaacaccgggcgaacctcaacagaatggggtagctgaaaggcgcaaccgtacccttatggatatggcgcgcagcatgatgagctactccacactaccactcggtttatggatggaggcgttaaaaaccgccattcatattctcaacagagttccaagcaaatcggtgcccaaaacaccgtatgagctatggacagggagagtaccctcgctaactcacctccgtgtgtgggggagtcctgcagaggccaaagtatttaacccaaatattgggaagttggaccccaaaacagtcagttgccattttattggctatcctgaaagatcaaaaggctatcgtttctactgtccaaacagttatacaaagtttgtagaaacgagacacgccgtcttcttggaagacgaaatgattagggggagctcggtagttcgagaaattgatcttgaggagaggcgggtgtctgtacccgctccgtcgactcaggaacctttcttctctctacctgctgatgttgtgcctgcaatgcctgtcattgaggtaccagcacctgttgttacccctcctgtggcaacaatgaatgagagtgaggaacctgttatacaggattcaacagaaatggttgccacgccagaggaggagctacaacagcctcaaatagataatgtgccagtacaggagactcatcaagagcctcaggtacaggatgtgccaaatgtgcaggcccctagaaggtctgaaagagtcagaagatcggctatccgtgatgactataaagtttataatatagaagagtcgcatatggaggatgatcccacctcatatgaagaggccatgagaagcgctcgctcatctgaatggttggaagccatgaaagatgaaatgaaatcaatgaaactaaacgatgtttgggatttagaagaaattcctaaaggagccaaaacagtaggctgtaaatgggtctacaaaaccaaatatgactccagagggaatatagaaaagtttaaagcgcgacttgtggcaaaaggcttcacgcaacgagaagggattgattacaatgagacattttctccagtctcttgtaaagattccttcaggattataatggcactagtggcacattatgatttggaattacatcagatggatgtaaaaacggcatttctaaatggagatttggaggaaaaagtatacatggcgcaaccaaaaggttttgtcatgaaaggaaacgaaaatatgggatgtcgtctaaagagatccatttatggattaaagcaagcttcgagacagtggtacttgaagtttgatgggacaataaagaaatttgggtttcaagagaatgtcgaggacaactgtatttattcaaagtttaagaatgggagatttattttcctaattctgtatgtggatgacattctactggctagtagtgatgtcagtctactgcaggaaacaaagaaattcttgtcctcaaactttgacatgaaagacctcggtgaggcttcatatgttttgggcatagagattcaccgagatagaacaaagtatgcattgggactttctcaaaagacatatatagaaaaggtgttgaagaaattcaacatgtacagatgcagtgctacacctgctcctataatgaaaggcgaaaagtatggggcatcgcaatgtcccagaaatcagtatgagctcaatgaaatgaaaacaaagccatatgcgtcagctgtaggaagcctacagtacgcgcaagtgtgcacacgacctgacttggcatttgttaccgggttacttggcagatttcagagtaatccaggcctagagcactggaaattggtaaagaaagtcttgcgttatttgcaaggaacaaaaggcctcatgctgtcttacagaagatcagaatcactccagatagtggggtactcagattctgactttgcaaaagataatacaaagtcaacatcgggatacgtgtttaccctggcaggaggagctatttcatggaaaagctcaaaacagactatcactgcagggtctactatgtatgccgagtttatagcatgctatgaggcaacggggcaggtgaactggctaaagaagttcatacccggtttaaaggtggttgacagtattgagaaaccactaaagttatactgcgacaacgaacccgcagtaatgtacactcacaacaatcagtcaagtggtgctgccaaacacattgacataaagtactatgttgtgaaggacaaagtccgggatcaaacaatcagtctcgagcacattaaaacagaaaggatgctcgcggatccgctcacgaaaggcctaccacccaacgtgttcaaggaacatgtagccggcatgggtttaagggaagccttatgaatcctggactacagggcccaaaagtaaagtatctgtttctgaatagagatgtgtatagtggctgtcgaatccatcggcgattgaccgtgacgatgaaacatgctctatttacaaatctgtgatggaatagaaaaagctaaaagaaaaagtgagatcaagggggagaatgttagatagatctctctccccttgagcccaacggctcaagagggccttgaccgcgccctgatcgggggcgcccagcccaatggctggtgggcccccgtcacactgcgccatataaaagaggggtggaggccggcacggcacatggtacgagattcaccgccgccgccaactccaccctacaaaccctaatccgatcgagagggggcgcagccagtgacgggaagcgccaccgccgcgccagacctcatcgccgggacatctacgaccgtcactcccgcagccgtcatcgccgtcgacctcaccggcgccgcatccacgacaaccgagcgccaacgacgacgatggccggcacttcttcatcctccaacacctcaaccggtcggtctatctaaaccctctcccgttttcaatctctatagttcaaacatcaaacccaaatagaaccacccgactagatctaacctaggtgatcctagtgcaaagtttaacaatgccaagccaattgagtgcagcaaagcacaaacaatatggtctttatagcctgtgcagatatagctcttccattggtgtgttctgccaccacatcacttccaaagttgtttccaagctaaaaatcatgctgcagtggtggttcaatcccacacttgaataattggtgtttcctgcactgatgtagtagtgactgccttttctcacttgcataattgatgtacttcgctcacttttttatcttaacatatttcataatatcatatagattctcctcaaggactgcgacaagattgaagctcatgcttagcaggaaaaccattttttttttacggaaagcaggaaaaccatttgaaatacctatggaaatatccctacacatgtgttaaccatgatgatctttttcttttcgaaatactgtaaggcaggtatatccatcatctttgtcatctacaactgccttagctatacaaatattcaactctcaaagtagtttggtagctaattaatcagacaggtgatgtaaatgtatacatcgtccattgattcacagtggatactcagttgttgcatttaaatgtctcttttcaggaaccataagttcatttacatggctattttaagagtccactgctctgattagtaacataacactgactgaaatgaggatctgttcattaatttgagtttcttctactgactcagtaacatctctccatgtgctgacttaattctccaaactttgagttctactgacttagtaacatctctcaatatgctaagttaattctccaaactattaacttaggaatgatttaacttggcacatattttcttagtgttcaagaaatgattttagcagatgcttgccattgcacctggtgatctaagttgactgaattgctgaggcggatatgtttcttgaacagaaagttctcatagtgaagtgtcaagtctcttcttaaaactaatgaatctgaaatatgtagtcggtctttcataccatagttgataaatgcaatactattgtctcatctgactgggtttttggccagttctagagtttacagatattatcttaatactgcagtcctcgcaaacaaaactacgagaaatttaaccatgttccattttcagttagttgacataacgaactgcatcttgtgcccattgatattggatgagtcatactatgcttgccacccctgctatgtattgtgaaattattgtttaaattattaactatcaggaactgtttctggcgacttcagttattaaaaaaaaaactatacaggttaaataatgttcttagtaggtacacaaggaattgactgttgttgttaggtaatcctcttagacaaaccttgcaatcgtacatttctttctgtgcgttacagtcttacatgctacaataccgcgcagcgtagcgcgcgagctcactctagtaatctaaaaagagtatggcctagtccgttaaccatagtgcatcttgaaatcgattggaagaaggaaaaaaaaaaggcatagtccgttcatttctcattgtgatacagtgatactgattttacctcatttttattagcatgtttttcaaactactagacagtgcattttgtgcaactttcttatatagaagttgttttaaattattagataaattattttttaatatttgaagtaataaacctcaattaatcatgtacctgcagttaatcttcgtccaccgcaagttctgtggttctgtggaatatattccaagtttgcaactgaaaaacttcatgagcactgactgcatttgcactgcagttcagtggatgcatcgacggagaatgaatacgcattccatgacagaactaaaacgcagggaaatacagagttacaaatcatatggcacgaaccgatacacatttcgtggcataaccatcattttgatgcaggagccagcagcgaagttctgccgggcaaaagtagtacaccattttggaacccacggttgcatacaaagttactccagaaaatacattgcaatgcagttaatattgctcaaatcagctacaacagaaagaaaacacatgatgcatgcgtgttctcttctgctcacagcgcactagcgcagtgccactctccttcctactgtacaagttacaagaagcaagcggcctcatcagcttcagccaaatgatatccccaatgctgatcgattatcatcacatcatgatggccacagcaacttcagccatagctcagcctggaatcgaaggaccgggcttgtgtgtgccgtcttggtattccgatctcgcaagcatttacccttgaagcgaacctcagtgaacaaatcgtctccccaacggatgatgcctccggagaaatgttgacaaacatcagcgttttggaatcacctccaaggcaaggctgcaatagaaagttgatataagaaatatgtttcaaataaattcagggattgcaggtttttgtattaccatccatttgcacaagtcactcacctgcaaaaggtatgtaagttttgagttcctgaagggcacatgatcgtctcctttcgcaattgcaaagataacatcgctaagagctgacaagcttttattgattgcctgaaacataaagaaaacaaacagataagacaatgtgattatcaaataagaatattgtaaatttgtgatgaacacactcacctgagtttccttcaaacgatcacccgtggagccacttttagcaaggcgttcactgccagctaaatcaatcaagttaaggacaccttggacttgttgcccagtgttctgcattaagatcaaaagaaaattagtgacatacatttgctcaagtttcagtggttctgtttagttagcatgaaaatgaaaaaaaaaatattgtgaccagtttgtaaagtttcagcactgtgattaatattctaaaatatgggtgaagcgagtacctcatttgatccagatatcttcagtgtgaaaacaaaatggctccgggaagattgttcattcatttgggtcctacccacagacctggttcaatgtggtgaaaaaaaatttagactcactgttgatatgtagactaggtggctaacagacacatgtgaattcagataataagtgctagcttgtataaaaggtaaaccctcttatgtttctgctctctctaatatatttgagtgatagatgagagaatcatctagacatatccaaagcattgctatttcaaatataacattaaactgataatggtcaatacccttagagcaaacagttacaaggcacaagtgaatgattaaaaatgaataaagcgtatttacctgctttgggatgctttcgctagaagagaagttacgtcggcgctactaaaaacatcagcaacagtaaggtcagtgacggttgtgttcccttgtggatcatgctttatggtgtattgtttactggtagacagatcaaagttattagaccgaccaggtgctaacaaatcacgaattgtctcattgtatatttccaacattgatgcctgcacataggaaaaactctcagcaacactacatagaatgtacacttcagaatctgcattgcactatggatactaacctgcatactgtacttccatccttgagattcaagagactgacttgtcttaaaaatttgctccaaagaacgaggtatgatgcctttctgatcacgccctggtggacccatcattgtataagttttaccagaccctgtttgaccataagcaaatatgcaaacctgcatcatgcaaaaataacttaagcataccaaattgacaagtacttcaaaactgaaataaactagaaacatcagtcagagtttcaagataatggtgattatacaaatgcagaatgcaggtgatatatactagaaacatcaatgtaagatgttcacggcttttagcatgtatttgtgcttatgtggtggtgctgaagagataaaatttggggtgccaccatatcaattaaaacaactttcatttgttcttgaaataaaaaaaataaagttaggatatttgagttattagagacaggaacctcatgaacagattattcaccaatacttcattgttgtagtgaaatattcataccttgtacccatcaagtgcactttgaactagttgtgacatttccacaaacacatcttcttgtgaagcaccgtgatcgaaaactttgtcatatgagaaggaaaatctctgacctacatcaacacaaaacaataaaatgaagtctccgattaactttaccactgaaaacttagtgggggaaacatagtttctgtttagcttcaacaatgaatatgattttaccttggttcatcaaatcaataccacgcccggcagattcaactgatgttggatatgaaataagggcttcttctgcaccactagaatcgttgtcttgcaaaagtggtcggaccctacaaaacactctgatgtttcctttaagctcctgcaaatagaaaggctaatcagtaacaagtagcaatagcaagatgaaaaaatttcagtatttactcaaaaatttcttctgtcagtaaaatagagaaattgtttttagtaagaagtgctagtatgctgaaacaattaccaatattgtattgtgcagtttctttcgtagcttgtcagcttcaacaatttgaaattctgcggatgccaaacgttcttccagatcttttattatcaccttttgttcttcatatcctgtcatcgcctcaattgcagtaacatcagcaagctgcaaaagtaaacaattagatcaaatgtcatataatcatatctcacatgtaaatcagcactgacaaaatattatttctaaccttcagtttatttgttgcaactgcaagttgtttctgcaaagtttgaatctgttcttgttgcatactacatgtttcctgagcagaagcataatggtgagccaaatagttgcgcacagaaagtattgatttggttaatctgaaaccactaacctcaaaggctgacacttttacactcaagctttcacagtcttttgtagacttgcctgctagttccttgtaattagcaagctcagcactcaaggtatttacttgagaaacagactgatcacggtcttctctaatttggtgtagctcaattctaaggcaatccacttctttcataagttgttctttcattctaatggcctcttgttgagaagtctaacagaaatcaaaacaattaaatgtttaagtgaaacaagaactatactgcccaaaaaaattatcaattcacgaaaaaacacaactcaccctagaagaatccaaatggttcttcattgaattgtttaaatctttcagagaagccattgtttccatcatggcactcttctctttttgcagttttgagatgatgtccccactcttagaggcatcagcttgaagattactgttgtattgctgcaagctggtgttgtactcctgcagtcttttgttcgtgtcttggaccattttcagctagttcacaatttccatccatcagaaaggaacattatatatgactcaaattcatgtaagactaatagaacatttctgaacacgtacttgctcactaaaccgttttgcttcatggctgactctttccaggtccaccgacagcaagtcgagggacgcctcagccgattccctttgctgcctctccttctcgtaggactccacagcaagctgccagtttaaaggtcaacaagtgtaagccgtggctgaaaccaatcacacaggcacacagcaacagtacataactatgcagcttattatgcgatagatgagttctaaccatcctgtcggccttctccttgttgaagctttcctccaacgaatcgcactgccgcgtcaagttcaggtgtgcagctttcagctcttccagatcactgctaagctgggcctctggaagtacagtaccccaagaacataaatgaccagaataaactcagtcactacgatgagatggtactctgatgaccaaacagcacacatgaatgctcaaaacccaaaagagtaccatcttgttctcttggtgtgatcaaataaatacaaaaaaaagagaagtgcattcgaattcattacccaacttggcgtgctgggcattctctgcatccatcgtactacggagcttctcctgctcgaccaagtagccgtcctccaactcaatgtaccagcggatgcaagctctcagcttcttgatgtactcactcatctgctcagttctcccctgcacaggtccaaccaaattcaggaaacccgccccccaaaaattctcaaacagaacgaacgccaagaaatcccccaaaagaacccaccttgtagtcggtcttgctcttccccttcatcttctcggcgagcagccgctccacatcctccctcccggtgaactcgatcacaggcgccgccggcccagccccgccctcgccgccgtccaccgacgccgtgtcgctgttcgtgccaccgccattgttgattgccgagaggacattgcggcgcgggccaggcttgacccccatcccccgccgcgcgttgcccaagttctccttcttctgcaacaacaacaacaacaaccacaccccacaaatcgcaagaactaagctcccatgaatcaaccctcccccaaaataggcgatttctttccacaaaagagagaaaattaccgggtaagggctacggggcgtgagggaggaggccatgaactgggattagtggcaggattaggggttatagttagggttctctcctcctcagtggtggcggtgggtgggaggaggggagctttcttggggccggatggagtgagctcgaaggcacaagaatctctctctctcgtggcttacaagcgccgacaaagccgcgctttagatccgaaaaacctcgagaaaaaaactgcggagccgatgaaattggggaaggattcgaagtttttgaagccaccgagcggagattaccctcgatttttcatggatttctcgcctcgctcggatctgagcgagagatgtgtgggagaagagagagagagaggaaggagaagaagaggacgaggcggccgagctatttcgaaatattttgaacgctgacgcatcaggggtacccaccccacccctccgatttcgatttatttacacccaatgccactggtgttagtttaaagcccaagccggcggtgaccaggtctaagtggctggccggctcgggcagggtcattcgcgtaatatgattggttagtcaggggtattttcggtatttctgttgaacggtcaacttcgatgttgtgggcttcgagattcgcgtcgccttgggccttgctgataatgggccgggccgggccggggcatgttgcgacgttgctctcctcgttttctttgtccttttcgggaatcaacagcttagaggtgccacgtcttgttattaagcttttgacagctttttcttcctgaaatctcaacgaatagttaagctagcttgtcagtcacctcgcgcactggaacctgagaatgatcggacaatcgacgcgatgctaattagaaatttgctgtttgttagtattagtaaattggtgtctcgtctcgtcaagttgcgagattaggtcttaattgccttgtgccttaccggtttaggttgcgttcggtagagcgtattcaaatcttatttgtcttacgcaatacgagaagatcattagtttataattaattaaatacttaattattatagtttctttaaaagactattttaaaaatatatatagagaagttttttacaaacagtataaaaagcgtgtcatcataagccaacagacagtaactgaaaagagcttaggctcccattggttcctctatatagaattaaccgctgtcaaaatttaaattttagagtttattttaatttttttcattgaacatatctctactattataaaaatttaagatgtttttatcggtattttggtacgtcatatgtgtatacgtcagtttttaagtttgtttgcttttaaaaatatgtatccgtatttgattcggtttttaaaatcgtccacttttggtaatacagaagaaatcatataagaaatttgttttaaaaaacttgcatgctaacttgagatgattagactcctaaatatagctcatgattttctaaaaatatataaagcgaactctcacagtgaatttcattttaactaaaacatataacaataataagattaaaatcgacttcacccgttgtaacgtacgggcatttttttctagtatatagaaaaatttaacctataaactattcttttctaacgcgccgtacgacgtattttcgacaattggcccacagacgagggccttaaagatggatttgtgaagggggtttggtgtaatgatgcttggcgtacgttgtcagctagccatttactatttctggtgctttattagttgggggaaaagagcatgaccgctgctgtcccctctcaaagctcctgagttttttcgccttaaaaccacgtttcgtccttgccaaacgtggtccactgaagtgccagtgctttgttgtttgagtaatcgagttataattggtacagtatctgcgagcttaatacagatgtcaccgctgttctggattgcaatcctgttttgattagggagtgtattgattaccttgtactcctacataatggcaccgatagtggcctagcgatgcccagtgatgcgttctcttgcagttcacgcaaaacgtgacaatggtatagtcgatgttagaccggtgtacctcttgccaagatgtatgtacagtagaacgccgtaccagactaccagtttctgctagctaagcgtacgtttctgattaatgatagattctagaaaaagaaaacaggtcccatatcgatcaagcgggctgatttaatactccctccttctcaaaatgtttccgttgacttttttaaatatgtttgtacatgactccatagaacgatgacgacgacgtctgtgctgcaaccagaaaaatacaagagaagaaacagaggaaaataatggccttcgttttctttttcagaaagcggctcgtagtactgtattttagtataatgtatgtacatgtcccagccgacactgctgcgtatacacggtagcggaagattgacggatcgatcggtcgcgggaaggtgacgcggcgcgcgcatgtaagctcgggcgtcgctagctgccgatcgatcggtcgccgtcgatcgccggagcgggggcagacacagggcgctgctgcgtgacggcgacccggggcatgatcgagtcactcgttcgctcgccaccaaacctggctttgtcacggacgggggcgtcggaaaggaccacgcgaccgtgggggaagagcagaatgaattatgtgcgcgcgcagggcgtgccgccgaaaacgaccgcgcagccgtcgcgcgtcgccgcttgccggtgccgcgcgtggcgggtgggtggggaggagacgctgcgtgatgtcgcgcttgcgccccccgtcgcacggttgaggtcgtgattttcgcgcgatctcacggagaagtcgtcgtgtcgtctcctacgtacgcgcgacgccggcgggggaagcgctggtccggtgggccggctagccgcgaacgattactagccaactgggcctcgtggttcgcgagaggaagaaggccttctttgtttaggcctatgagctggaaagtctaagctcttaaggtgtgtttagttgagctctggctttgaaaaaaatatctgtgggctgtagttttcttaaacgattttgctatatctcactcgaaaatttttttcttatctctcactcgattttctcattcaaatttacagtgcattttcttgtaagttacagtgtaatttatgaaacttacactgtaacttttgtaagttacactgtaatttttgaatcttcacatgtaaattttaaattttgtattggatttggtctttttcttgaggatatggtaatttaatgttcattatggtgtttcttaattgctttttgctttttattatatctatcggattttaatataaagattaaaaatctgtgtgatacgattataaaaatctttcgaaagatgtataggtactcccttcttaaaagtagctggggaatatgtacggtggcttttggaaaagctcatttggttcaatagctgtggcttttgaaataactagtcccgctgacagcgacccccacatgtcatacacacgttgaaataaaagaagagggagagatggatatggcaacggcggtgtcgtcggcctcagcggtggcagcggcgtctcggcgaggaggagcggtagcggcggttcagcgacgaagaggacgcacggtggtgaggagcggtggcgccaggaggatgaggcagtggtgacgccaccgctgtcggccacctcaccaccttcgtctcccacctccatggccgacgagcgaaggggcggcggcgtcgggaggaggaggcgtcggtcggggaagggcgggagcggcgctggcgtcgcgttgaccggcgtctgttgaggaagggcgggggcggcatcgatcagggaaggacgggagctgcgccggcgtcgggttgggcgtcgtcggttggggaagggcgggggctgcgccgacatcaggttgggcggcgtcggttggggaagggcgggggcggcgccgatggcggacacccaatgcgcccgatggccgacgctcgccccatgaagtcacgactcgcgagaaggaggagacgaggaaaagaatatcggaccgttttttcataatggcagaggtgggtaatttttccctcaaaagcacttggagcaaaagcacttatgcttttgggtcctttggttgactcttgacttttgcaaaaggaaaagcaggttgaaaagtccaaccaaacacacccctagtgtatatttatagttaactattgtataaattaactattagattgactatagattatttgaagcttatagtaggctcttaaccttatgagctggaaagtctaagcttaacaaatatgcagttctttcgtttgtactcatcatcaaaaattatgttgaagaagtttttttttcttacgctagatagagttatgaccctactattaaacttagtacttcaatccattagcctataaatcatataaactaaaaaggcgacttaaaaatccaagaaaaaattccctaaataaagaggctctaagtatatttttcttccctcatctcttgcttctaattgaattgtctccttcaatagtaaaattcggatataataagtttgatcacggttaatttaacacatcagtagaaaatcgattttcaaaccatcaaaggagtcgatttataccggtttttgaagttggagagtgcgatatacccggttttgcggttgattgatgcaatttgaccgaggtctttcaaattagacttattttctttgctagagggaggaaaaatgggccttactggtccaaatttagctagattaatgggccggacgtgtactgtaactggccagcccagtcactcgcatcgtcgactacctcttgccatcggttctcccgggaagttttgcggcggcctagggttttagcattctcacctcagcggcggcggcggcgggggacaccggattttccgctccgatgcctcgtcagcacgcgccggcgttcacgccggaggcggcgtcggcgtcggccaccggcggggccggggagcggcagagcctcccggcgctgcaggcgaagatgaagcgcgacccggaggggtacgaggaggagctccgccagctgcggcgccacttcgagtcatcggtgttcctcttccggcagcaggcggcactggcctccacgtcctcgtccggcggcggaggggaggtggccaaggagctcggcgacctcgcgctgttcctcgcccacgtcgcgcccttctacccggacgacctcgctgacttgcccgaccagattggtggcctgcttgacaccaacgcgcgcgcgctgccgtccgggctccgtgtgcacctcgtgcaggcgctgatactactggtgaatcggaaggtgacgcctgtttagttcatctgttcatttcacattaagttaaattttgttcaaatcgtgtggattggaacgggattatcgtatgactgtagagtaaattctcctcgtatacattgctttttgatgtttagattgttgatctggaggacacaatggagttatttatggagcttcaagttataggggaccgggctgtcaaaaaactagcattctcacatattgtacacagtatcaggagaatgaatcagacccacaagaatgaagccaggaatcgtaaactgcaaaacatccttttcacattcctacaggtttgtgacataccactataccacacttgcactgattagtattatcgggtttaacatagtggcaagaatacattcatgattctcttcctacctcgtttagttatgcatcttgcttcgctgtttcccagggcgaggaagagtcgagagcaaagagggcctttactattctatgtgatcttcaccgtcggagggtctggtttgatgaccgcacagcaaatgctatatgcaatgcttgtttccatggttcttctaggtacatactgccagcatctttgtgtttattaataggtgttgatctaaaatatatcttttacatgcagaattatgatagccgctatttcattccttcttgggtatgaaaacgttgagcaagaagatgatagtgatgcatccagcagtgaagatgaagctcaaaaccctcaaattattcttagtaaagaggatgtttacaaggttatttgaatttttaccattatttcgatttatagtgttttacatcttttttctgttacgtgccttctgatataatgtattttattgtcatattactttctcaggcaaatcacaagggcactgctgctactaagaaaaagaagaaagctaaattgcagcgtgtgattcgtagtatgaaaaggcaacaacgtaaatccactgaggacactggctccaattattattcaccactgacgtatttaaaggatcctcaggtgggaaatggtgtaatcccataattgttcagagtgttatcatttacatattgactgttatattgaagctttcgttttttggctgacagggttttgctgagaagctcttctctcggctccagaaatgcaatgagcggtttgaggttggccccattccttgttctgaagattccttgttctgtaaagatttaaaaagttatatataattgtcagaactatcattacttagtacttttagctttctgctgaagttttatacatgagtgtatatagttggaaccagcattcaagtaggagaattggaacccagatgtgcaatagtttattttttaaacacaatgtctgttgtgagttccatccgatggttaaacgaaaataaacgttaattcaaatttagagaatgttggttgggtgcttgcaggtaaggatgatgatgttaaaggttatagcgaggactattgggctgcatcacttggttttgttgaacttctatccatatcttcaaagatacgttcaggtatgttcttaacttggcatgtgttcttcttgtagcaaccttatggtagatataatgtttatctatactctatactaatataaaagatggtagtggtggtggacccacggactgtgagttgcgtatctcttagcccccacatgccatagatcccgtcgaaaggaaaatatgacaatagaatattatgaaaattttcatctttacgaaatgacagcaaaattagcataatgataatataatagacaattagaaaaaaaaaccgttgcacctcacgtgcattatactagttcatactagttttgataataagttttctacctttctgtgatgcagcctcatcaacgagatgtaacaactttacttgctgcagcagtacaggcttgccatgatatggttgaaacacttttgctcttctcctatatttcactacttatatcatttcttttgctttgtccaaattcagctaaattaatatgcttcaatttcaggtgcctcctgatgcagttgaaccactgtttaagcagatagtaaatcaatttgtgcatgatcgttctcgcccagaggtttgcataacactcatcacatatctaatatatttaagtattttccaactaacatggcatatttctaaccaatctcattttaggctattgctgttggcttgaatgttgtgcgagagatctgcatgagaatacctttggtacttaccttgctcaaatctgtactcttgctttctagtgctactgacctctgaccagacaccccttaaatttgtgtgatggattcattaaatttttatggtggtcatgttttgttgtacctaattcctgtgccctggacatgctctagtagaaattgtgatttcatttttttactagtcttaaatgactggttgcgtagtccaaactccaaaaggatgtgatagtcgattgctacaggttttaagcatataagtgtaacttaatgaagaattgaaaaggtataaacatggttttaccaggccacatttagtcttgtgtagcctgacacgttagtcacttatgcatgagaagttgagaacacacatgcaggtttgtatactacattaccacctgaggtactgtgcgggttgtaagatatttaggaagatattcttggtctatttattttattcatctagcaggcctctgttaatccttctgttatacctgcagttgatgaatgaagatctactccaggaccttgttttatacaaaaagtcccatgaaaaagctgtttccattgccgctcgttctctaattactttattccgggaggtcagttcttatccttttgcatattctgtgatttctttttgttcacttcagctaaaccttcttttggtttgggttcagatctgtccttctctgctagtcaagaaagatcgtgggcgtcctgctgatccgaaggctcgaccaaaagcattcggcgaagcaactatcgcttctgatgtgcctggagctgagttgctagatgaagatttttcatcagaaggggaaggctcagacgatgagtctgatgcttttgattctaatgatgagaaagagttgcaatctgctcgtggtactaaacaaaatttggatggttcgtctgaagcaaacaagcttgacacagatgaaggtatgaaagaggaagatcaactatctggggatgaagatgatacagaggaactagatgaggatcaagacatctctgacaatgatagtgaagaaaatgatgatgagctagaattggactctgatatggatgaggagaatgatgtatctgaatctgatgatgatgaggaactcagtgagaaattggatgattctgatgaaggctctgatcaggatgatgacagtgaccaggatgataagtcaaaaaacagcagtcgcaaggcaaataagagaaagttgagtgattatatagggcaacttaatgctgcagatgcaagccttcgagctctgaagaagttggcaggagccaagaaggctgaagcttcgtgcgatgaagctggtaaaatcttatctgatgaagattttaagcgtattaaggagctaaaggtatgggagttttttccagctgtagttcatgctgtggagctttcttttgggaaagaaagtgaagttgtgtatatctgacattgttatgagtttcaggcaaaaaaagaagcaaaactggctctggcacaacatggactcggcaagggccatgacacaaaatcagtaacctttaaaatgccttcttctgatcagcttagtctgaaacgggttgacccatccaagcttgaggtgcattttctctcttcccctcccgcattgcactcgtgccagcgcgctcatgcacacacatccacactttgcttatatgaacatcttcctttatgtaggctcacataaagagaaagcttacgaaagaggagagattagaaatggtgaaggctggaagagaggatagaggaaaataccaagcaagaacagctgtgaaacagaaaaaggtattcgtttatatgatcctcctttttggtgcttattttgacctatgttggctatatggcacaaccttgtgaaatctgatcatgaattgttctttcgtagttgcttttattccttctctacttatatgcttctcattgcgttttagaccggtggcttgagcaataggcagaaacaacacaagaagaaaatgcccctcgctgcaagcagagcgaaggcagcgcgttctcgacaggagaagaaaaaactgcaaaagcgctcgggaaagcaattcagaggacggaaggcgtggaaatgagggattttttgtacttgcgtttgccaattcttgtggtctactggccaaaattttgactccttcagttaatgattttcgtatacaaatatggtttcacaaaccgtgtatcatcgatttttcaagtgctggtgtattcttttgtgagtggagagaatgaagccggtatatcatcgctcacagtggttgctctatgaatttggacagtactcgtatccagaaggttcagcatcacgtgtcctcctggcccagtgtctatacgttgcagtgactccagcgagagccacaattacgatatgataaatgctgtctctgtttctgctttgatgagactgtttcgattaggccagcaacctcacctctcctatataggctgtgtttatttcagcgtaaattttggattttggttaaaattagagatgatgtggctgaaaagttatgtgtatgacaggttgacgtgatgaaaaagaattgaagtttagatccaaactttggatctatacacacagacggattcagatcatgcgcagttatagctattactgcaacttatattctgtgctacagtatttatgctacagtacgatgaatagtgcacctcgctgatctggaccgttccatctacatccgttgatgaaaactggtaccgcctaaattgcagtcccagtagcgactgcagctgatccggattcaacacggacatagtacaccctcttgttgcttcgatgagactggtccttagcacaatcatcaaaccactaccattatatcagtgcttggtgttctattgggttaaggaattctcgatcgttctctgctagtaggaaatcgagccgactgaccagcgatgtcggcggttgagaggaagacggcgtgcgtcaccggcggcaacgggtacatcgcttcggcgctcatcaagatgctgctgcagaagggatgtgctgtcaacacgacagtcagaaaccccggtgagattcttcttcttcagttcataatttcgtgcatactcgtgcatagatttgcagtagcatcagtggttttaacctcgtttttcttttctttttttttttaaaaaggaatttggttttagcctctgaaactgctgctacacattgcaattttgagtcgcagaaaacatggagaagaactcccacttcaaggacttgcacgcacttggtcccctggcggtcttccgcgccgacttggaggaggaaggcagcttcgacgaggcggtcgccggctgtgattacgccttcctcgtcgctgctccggtgaacctcaagtcagagaaccctcaggtattacatagccgtctacaacaatttgattaagtttatagaaaatttaataatatttataacatcaaattagtttcattaaaaataactttgaatgtatttagatggtatgtttgttatatgtgagaaatgttctgtattttttttatgaacttatcataataaaacataattagaaaagagttaaatcatcttatagtataaaacggaggaaggggaaacatattttaagattatctttatggatttagctagatggtggttgccactcctcaagtctcttatggttgccaggccattaatgatactaagtattcctccataaaaatgtctctttgcacttcactcttcattgttggcttatgcttacatttacaagctaacatttaaaatttagaacttaattttaagtttgatctttttctcatcatagtttatttttatttactaataagcgatttaaataagcgaaacaatgctactttctgttgcgatgacacagacacatacacagaatcacatacacgcactccttctgtctcatagaaaccaatcagtactagatgtgacatatcctaatactatgaatctgaatatatctctatccagattcgttatactaaatgtatcataatcagttatagattttttttttgtacgaagggagtagttttgttttttacttggtcagcctgatggtaatgacagaaagaactggtggaagccggtgtacgaggcactctgaacgtgatgaggtcgtgcgtgagagccggcacggtgaggcgcgtggtcctcacatcgtcggcggccgccgtctccggcaggccgctgcaaggcgacggccatgtcctcgacgagtcgtcatggtccgacgtcgactacctcagctcaccagccaacaagacatctcccggaaaggtacacacaaaattacagattttatttaacacaggtcagtcaatcagaggctcagagcccattaaatcggccacatgagaacagctccgtgtgctgatgcaatcagcgtttacaatttcggttcgaaatttccggcaagcatttacttcatccaaatatttcatattttttttaatttagaaaaaaatatttaaattcggtcaagatttgtttaaatttcaaacttttttgggtccctgatagatttgtgcatatcgaaaatattaagacatggatgcaatgcaggcgtactcgctttcgaaggttctttcagagaaggaagcgagcagggtcgcggaggagaacggcatcagcctggtgaccgtttgcccggtggtcaccgttggcccggcgccggcagcggaggccaaaccgtgcgtcgccgccgtcctctccttgctctccggtgataactaatcgaatcaagaaccggccggtccatggcaaatgcggcaacgaaaagcaattcctgtgaaatttatttgttcatctcttgattttctttcaggcgaccaggagatgatcagcaccgtgaagctcatggagaaggccaccggcgggctaatgctggtccacgtcgacgacctctgccgcgccgagatattcctcgccgagaagccgccgccggcggcggcggcggcggcggcggagaggtacatctgctgcggcctcagcgccaccatgctgcagctcgcccgcttcctggcggccaaatacccggagtacaatgtcgacgtcgccgcgtaagatcgagctgatctcactgagtaataattccccatgcgtctccatgatcttatcgagagctctgacgatggtgaactttcatgcagcctcggcgacctcccggagaagccgaggatccgcctctcgtcggagaagctcgccggagaagggttcgagttcaagaacaggacgctggacgagatgtacgatgatgccttcttggagtacggtagagccctcgggattctgccatactgataacgatgttgttcccctcgtatatcatctgtttctctggtggtgattgttagactttgctctaggatcacctaggttagatctagtcgggtggttctatttgggtttgatgaacgacattgtagatgaaagggagagggtttagataccgaccggttgaggagttcgtggaggaagaggcgccggacatcgtcgttgtcgtcgcggcttgacgtggatgcggcgccggtgaggtcgacggtgatgacggctgcggcagtggtggtcgtagacgtcccggcgatgaggcgtggcgcggcggtggcgtttcccgtcactggctgcgccccctctcgatcggattagggttttgtggggtggagttggcggcggcggtgaatctcgtaccatgtgccgtgccggcctccacccctcttttatatggcgcagtgtgacgggggcccaccagccattgggctgggcgcccccgatcagggcgcggtcaaggcccccttgagccgttgggctcaaggggagagagatctatctaacattctcccccttgatctcactttttcttttagctttttctattccatcacagatttgtaaatagagcatgtttcatcgtcacggtcaatcgccgatggattcgacagccactatacacatctctattcagaaacagatactttacttttgggccctgtagtccaggattcataaggcttcccttaaacccatgccggctacatgttccttgaacacgttgggtggtaggcctttcgtgagcggatccgcgagcatcctttctgttttaatgtgctcgagactgattgtttgatcccggactttgtccttcacaacatagtactttatgtcaatgtgtttggcagcaccacttgactgattgttgtgagcgtacattactgcgggttcgttgtcgcagtataactttagtggtttctcaatactgtcaaccacctttaaaccgggtatgaacttctttagccagttcacctgccccgttgcctcatagcatgctataaactcggcatacatagtagaccctgcagtgatagtctgttttgagcttttccatgaaatagctcctcctgccagggtaaacacgtatcccgatgttgactttgtattatcttttgcaaagtcagaatctgagtaccccactatctggagtgattctgatcttctgtaagacagcatgaggccttttgttccttgcaaataacgcaagactttctttaccaatttccagtgctctaggcctggattactctgaaatctgccaagtaacccggtaacaaatgccaagtcaggtcgtgtgcacacttgcgcgtactgtaggcttcctacagctgacgcatatggctttgttttcatttcattgagctcatactgatttctgggacattgcgatgccccatacttttcgcctttcattataggagcaggtgtagcactgcatctgtacatgttgaatttcttcaacaccttttctatatatgtcttttgagaaagtcccaatgcatactttgttctatctcggtgaatctctatgcccaaaacatatgaagcctcaccgaggtctttcatgtcaaagtttgaggacaagaatttctttgtttcctgcagtagactgacatcactactagccagtagaatgtcatccacatacagaattaggaaaataaatctcccattcttaaactttgaataaatacagttgtcctcgacattctcttgaaacccaaatttatttattgtcccatcaaacttcaagtaccactgtctcgaagcttgctttaatccataaatggatctctttagacgacatcccatattttcgtttcctttcatgacaaaacctttcggttgtgccatgtatactttttcctccaaatctccatttagaaatgccgtttttacatccatctgatgtaattccaaatcataatgtgccactagtgccattataatcctgaaggaatctttacaagagactggagaaaatgtctcattgtaatcaatcccttctcgttgcgtgaagccttttgccacaagtcgcgctttaaacttttctatattccctctggagtcatatttggttttgtagacccatttacagcctactgttttggctcctttaggaatttcttctaaatcccaaacatcgtttagtttcattgattccatttcatctttcatggcttccaaccattcagatgagcgagcgcttctcatggcctcttcatatgaggtgggatcatcctccatatgcgactcttctatattataaactttatagtcatcacggatagccgatcttctgactctttcagaccttctaggggcctgcacatttggcacatcctgtacctgaggctcttgatgagtctcctgtactggcacattatctatttgaggttgttgtagctcctcctctggtgtggcaaccatttctgttgaatcctgtataacaggttcctcactctcattcattgttgccacaggaggggtaacaacaggtgctggtacctcaatgacaggcattgcaggcacaacatcagcaggtagagagaagaaaggttcctgagtcgacggagcgggtacagacacccgcctctcctcaagatcaatttctcgaactaccgagctccccctaatcatttcgtcttccaagaagacggcgtgtctcgtttctacaaactttgtataactgtttggacagtagaaacgatagccttttgatctttcaggatagccaataaaatggcagctgactgttttggggtccaacttcccaatatttgggttaaatactttggcctctgcaggactcccccacacacggaggtgagttagcgagggtactcttcctgtccatagctcatacggtgttttgggcaccgatttgcttggaactctgttgagaatatgaatggcggtttttaacgcctccatccataaaccgagtggtagtgtggagtagctcatcatgctgcgcaccatatccataagggtacggttgcgcctttcagctaccccattctgttgaggttcgcccggtgttgaatactgggctactattccattctctagcaagaaccttgcaaaaggtccagggacttgcccataaggcgtatgtcgaccatagtactcccccccacggtcagatcttactactttaatctttatatcatgctgattttcaacttcagctttgaatatcttaaatttatccaatgcttctgatcgctctttaattggataaatataaccatagcgggagtaatcatctgtgaatgttatgaacgagtcatagccatccacacttttcacaggaaatggaccacaaatatctgtatgaatgatctctaaaattcccgcgcttcgttttgcaccctttttgatgctctttacaaattttcctttaatgcattctatgcattgttctaagtctgagaactccaatggaggaagaatttcattcttaactagtctctcaattctccccctcgaaatatggcccaaacgacagtgccataatttcgatgagacatcgggagttcgctttcttttcttgttttcttttgtcaacgaggacacaacattcacattctcagaaagagataacaaataaagctcgtctcgcaacacagcaagaccaatacatgcattattatgccatagttcacatttgccacttccaaagcggcaatcatatccatcaaaatccaactttgatacacttattaagtttctttgcaaagaaggaacataaaagacatctcgaagtaaaagtatgaagccattcgcgagctctagaggaagatctccaacagcttcaactttttcttcaactccattggcaactctaatggtgctttctcttctttgcgtagtcctcgtcgaacggaatgcctttaaacaattacaagcatgaatagttgctccagaatcaatccaccatgtggatctagagtaaccaacataatgagattcatttacaaatgtaataatgttctcacctttctttgccatgatcattttcaaaaagtcaggacaatctttcttgtagtgtcctgtcttcttgcagtggagacattgatctttctcaacagcgaactgttgttgttgaggcagatgctgagactgtttaccttttgaggtgggagacttgtggttctttttcttatctttaacatagtttattgaaccaccatttgattctttgattctctcctcctcttgcacacaattagcaatgagcttctcaaagttccatttctctggacttatgttgtagttgacaataaaattgtcaaactgctttggcaatgaggccataaccagatggaccagaaagtcatctgttatgcccaaatccattggcttcaatttggaagccatgttgctcattctaagtatgtggtctctaacaccacctccatggtacctttctgtcacaagctgcttgatcagctgtgtagcataagtctttgaagagccagtaaactgactctttattctttcaaggtactctgagacagcgtcacactctgggatcgagcccaatatggtaggctcaatcgtattctttaccacagccaaacatttcttgttggctaaggaccatttcttttgttcaatgtcatacgacatgacgagaggagcattgtccctctgtctcttttgccagtcagcatctgactcattttcacctctgacaaggtcagcaggttctataggacatggggtagtcaatacccagtccacctctcccaagataaaagcaaggtcgagttttcttttccattctgcgtagttatctccttttagggtcggaatatctttaatgcaacccatcaaggagtagccacctgaaataatcatgtgcggtgagaacaaaattaacattaaaatattatgcattaagcctacatcaccgttgggcagaattagacataacacatataaccataactataatattgcaattaacaacgttggtcagaaaattacaacatcatagcacataattaatgttcctaaaattaaattctcccgttggttcgaaatttaattttagaaacactaattttcatcaatttcatctatttgcagcggaagactatataaaatcatatgaacagtagcaaaatctctgtaattctctctctgtgaaaattctcccgttggttcaaatttaaacagaggtaaaacatgcaaaaatctattcaaaattctattgaaatttgcatgaaaaatcgacaaaataaaatggaaaaattgctactgttctcttttattcattttcggccccgagggacctaaattgaacttttccggcctttgccggtcggcctatggccactttgcgcgcgggcaagcgccccctcccctcccccaggccgcaacctgggcctgggccgggaaagccgccgccgcgcgctccccacttgggccgatttcggtccggccgccgccggccgtccgatcagctagggtttcgatcggacggccgggcgccgagatcggaggatcaaaaacccccctctcccggccggccgccgaaaaccctagcttctcttctcttctctctctcacgcgaccgcgtggacggcgtcgccatcgccggcgaccttcgcgccgccgcgccatggccggcgctcctttcttttctcttctccgctccccccaccgtctctaacccccaccgtgtgagagagagatggcgacgacggagatggcggcgccgccgcgggccccctcgccggcacgcgcgtgcaggtgcgcgcgcggccgtcgagtggctcctaggcggcgcctctttgcccctccccccctccgttgccggcgtcaacgacggccggcgacgaggtaagaattagggttagggtttttggttcttttgatccgtgcggatcttgtgcttttctttctttggatttctttccccgaaacgatctaaacactagggttgctctgataccattgttaaactttgcactaggatcacctaggttagatctagtcgggtggttctatttgggtttgatgtttgaactatagagattgaaaacgggagagggtttagatagaccgaccggttgaggtgttggaggatgaagaagtgccggccatcgtcgtcgttggcgctcggttgtcgtggatgcggcgccggtgaggtcgacggcgatgacggctgcgggagtgacggtcgtagatgtcccggcgatgaggtctggcgcggcggtggcgcttcccgtcactggctgcgccccctctcgatcggattagggtttgtagggtggagttggcggcggcggtgaatctcgtaccatgtgccgtgccggcctccacccctcttttatatggcgcagtgtgacgggggcccaccagccattgggctgggcgcccccgatcagggcgcggtcaaggcccccttgagccgttgggctcaaggggagagagatctatctaacaggcattggtaagttgatttggtgggcaaaagagttggatcggagtgctccaatctaacacagctcagccttcagagattaagaccacagcacattctataagagactaagaacagctcatacaaaagcatggagtatttttcctgtatggttcagaaaatgatcaatcggagtgctcttttttttgtcaaaatggtaacacatatacaacacaacaatttactaattacatataattaatgaataaaaataaataattgaaatgattaacttttcttttctctacggagaacatcggagagcaaagcacatgaaggatctcttctgcctatttaccttgtatttgtttgtcagtaatatgctggcagctccgttcctgaagatccatgagctgagcatagtggcttgcccctcccaacattagcatgtatcatgaagtctagccgtctgtttacctgtatgctgaaaaacaccaaataatttgtgtaagaagattctgctaaacttgttttaatcctaagctggccactttgacctttctttggagctcagttttggacaatgaagtagtggcatactgacatgcttaaagtacaggaacagaaaaatgaatagaatctcattcgcaggagaggatgagagctccttagtaattgtaacttctttcaccaatcaaaagtttagaacatgatttctctaaaaaaaagtttagaacattgaaagccctaatggaaggaagctattaatgtgagaattcatcctaataaaacatcaatgttgccagggaatcaacaggtttcagggaagctcaccagttcatgttttgcctcatgacatcacatcgactctctttccataagaggaattggcgcagagttcgaattatcagaaggcaacatttaaaaaagaaatagagagagaaatctggaggcaccaatattcggaaatgtgctgggttctatctgaatctttgaacgaacttcccaaacaaacatctgataaatttagcctaaattcagaacattatcttcaatttatgctagatgagagataagagaagggaaaccgtaccggaggaggacaggtagaccgtacgccgatttctgccattgaggaaatggttgtgtcagctagcaacaccgtcgggcaagtcgctgaggaagaattgaaagatccactccccgcccgccatctgtgctagcagtgagccaccgagtcgaccttgatgccgaagaagaaggcgacgctgcgatgccatgcggcacgccgatgctgaggacgggatggggagtatgtgatgctattcaagcttgttgtacgtgcagccacagtgaagaacataaaggggaacaaacaaattgggaagagatgcggatgcggagaggacgacgacgagcggatgccgagaagtggaagggggcaacgcggatggctcggcgagcagtaaaaccacgtctcggtaagggttggccgcgcaacctagaaggcagaaaacaaaaatcaaaatcaatgagcataggcatggtcagaagaacatcgacatcacaatggtgaaatccagagcgaagcacaactgaaaaagatcaaagcatacgggatgatgcgactagggaaagtaccgtctccacaaaaaacaggaactaagaggaagaagtaaggaacagaaccagcttcgaatgaaagaaagaaaggagcgatgcaggtaccctcgatctgctcctcatgggggtctccgcgcgtatttttagtggagcagccaaccctgtcattcccgtacaccatgacagagcactaccatggatgagagaggggctgctgggcattggagccttggaggtgtcgctgtctcgctgatggccgacacgcggcggtgccgattcgctgaagcggagcggacgagaaacacagccttcgctcaatcctagccggacatgggttggagaatgggcacgcgtcaagacggtagcggtggctcgcggatggctgagcatacagccaaaccacgacgacgcaaggccgcgccaccgatgccacgatggccagtaaaaggccgtcggtcgctgggccaaacaatcagctggcccatggtagcaggaccactgtaacgaaacaacgtgtccacaccgtattggatgcgcctctccaaatcgctaggagagcagctaatctagcacctttaaggcctccttcaatggttgagctagtgcactagctcatgcttgtccacctcatacaagagatagcaaaaagcctacctttttaataggttgtctcatagcacattgttcaaaatgctttgggttccacaacccctctcatattttgtttaggagcttagctcttgaagaagagatagtgcactctctctccttatcttctctctcttctacatcatacaaaagctgatgtggagatttatgagctagctgactcatccttgttggaggaggcctaagatagctaatccagcacctttaagatatttaatatatgtgtcagatcattttcttccggatcacttattttaaactacttcatctatctcaaaatattactaggattcatttggaagtatcctccatgttaggacagaggaagtcattattaaatttattttttaaaatatttaatttattcctatatgcaagtatatgctcctatccgttgcataatccgttcaatgactatatccgtctcaaaatacagtaacttttagctatgaattctaaaaatgattatattttagaacggaggaagtagtaaatctattttcttaaataaaaaaaaaaggaaaagcgagaatgagagaggtgcccccactatgcgattgccagctagcccatcacaagaagatcagaggccttcggacgcggctttttccggcgttccgccaccagtcttctcatctgcgactgcggcgctccccttccctaccggaatccccggttttgctgccccccagcccgcggagtggtcggatccttcttccgtatgcgtgcgtggtgtgcgtggagtttggttgtcgggttcaggttaaaaccctctgtagtttccatctccttttaccacttcccacatgctcgaatcgaagtaaatcgtgtgtagtagttttgagtagaatggcgctatgctatgctatgctacgctatgctacatcgtgtacttccaattgattcacagctcgcacgcttcaatctttgtagatcagtggtctgtttcactgctgtgagaaattgcgtgtggttttgcaattcatcggtgcttttttcccccttcttctaggttttgtgtatctaccgtctacagtcaccatggttggcagctaatgggggattggaatataaatctctttttggtagttctttttttgtatgattgattttggcatgtctgtttgccatcaccttttttttttaattaggaccaccaatggatagggttgttggtattaaactcgcaccatatcaaatcatcatgttatctttctttttcaagtattctggactcgtggcctgcttgaaggaacaagggaacttctagagggtttcctctctcaaaaagctgttttttttttcataagtgagagcagttaaaccccaaatcttgttgaaacgattaaacttgccaaagctctcctagagactggattaatttctcatggttctgttcagtatcaaagtcttcaactaaaccgtaacactgaacttgagattttttattttttatttatttttctgagtaagagatattttatatgaagttactatgatgtccatcaaatttgaacacatccagacttgtaaatttcttggtctcgtctctacttttagttaacgcagaaaatgacaattcacagttattacttgctttgcaggaattctaggaatggcagcaaactaatcttctaacctcaggcagtccatgtttttgaggtgattctgtgacatgtgtgctaccttaagtaaaacaagctacgttttcccttccgtatggatctcctaatttgttcacttggtagctttaaactggatgttattgcaaggttgccacatgcaaaacttattactctagagcgggagaatacaaacttattgttctttgttattcgattattgcaataagaaatatatggaaattgcagtaggtgcgctctgcaaaatgatgatactttatgatatatccgatttcaaggagctaggaacacaaaaacatcgctttgtaatttaccatctccaatatgttctaacatccacaatttgttgtattgctaataaattgaccagctcatgtagaatacgttaccatttcagagctagtacccacctgataagcattccttttccactaggagataagctctctattaatttgctaccctttctgcatcacggcccttattcccgttgggcatatcttttatgtggttgatataagctcatagcttttgaagtactgcataggatactgactccagaagaaactaccagccaaaataaggcaggacccaccagctttagaatataaatccccatgcttatctaatcttcaggaggattgccacttctctttcctgtagacagtctgtgataattttgttctcttcttgttggggtcttggggaaaggagcaaggaggaggaggagaccaagaacacggagtgaaagggagagggttctgttcttgcttcttaggccatatggagatccagcagcagaagggggttggcaattccaaagttgtgaaggttgagaaggaggagtcatgggatctgttcgtcaatcaagcaagcaacgaaggccaccctgtgggttttttcttccttgccttgttcttcccccacctctttttttttcgccgggcttcccccacatctttcctgctttgtctctcatgatgaatattgatgttgtttattctcaagtcatattttggtcggcccacgatttttgtaattgctgtttgtagattataattttgttagaacgatatatgtataatagtttgtggggatggatgcttcatgcaacctgatttctgtaatcatgttcttttcgttctttctgggtctttctcgtttttctttcactgtaactgtaattgacaaactgagttccaaattgaaaattttcctgatgataattatccgctgcagttgcaccagaaatttctttttactcactcagaagttaacttggttattgacccctcgactttgtgtaggttgttgcccactttggggcttcatggtgtgtgacttcgctgtccatgaactacaagtttgaggagctagctcagacacaccctgagatactgttcctctatgtggatgttgatgatgtccaggtaaccattctctctgttttttttttaaagaaggaaaccattctcctatttttggtctcatgacgtgttgtttatgcatgtatttttggaatacatcccatggtcgtattttctctgagttgttctgaattctgaaagcgaagtgtcttttgaggaatagaaagtagagaaagtggatgcctaaactgataatttcacatagagttgtctagaaaatgtccttagacttcggagctttcatctttgatgttcaattgtttctactgaatatcatggcataaccatttgttacaaaactgctatgcatatatgctcattaaattagtttactgagccaagctgctatatcatataccgtgtgcatgcagagtgtttcgtccaagcttggagtgaaggccatgccgacattttttctcatcaaggacaaggaggtggtgaacaagattgttggtgccaacccagatgaggtcaagaagatggtggacgcttctgctgagtcctttggagttactgctcctcctgatatagtggtggaatagatatatagatgttgcctttatcttcagaaacttctctgtgaccgtgggtgcttcttggtcaggtccggaaaaatgcgtccatgtgtacattctagctttgctcctgtgactctgaatggtgtccctttgaactgataggcttgtgccttgcggtagtttgttctgcaggctgcagctgtggctttaccatgctctatgaaatttacttacatgtgtttccagttgaaaaatatgtggttcagacttcagagtttagactaaaaagatttgttgacagtatctggcatgcctagtagtgctttgccttttcacttcacatgatgatggatggtgtagttccaaagcgtactctgacgatgagctataaaaattgccatgatctctgcagccaccgcagaaagtgcacatccccaggtgtaagcaagtgtcacgagcagctgatttattcattgtaaaatctgcagatcatgttagtaggttgtaccgttatcttgctgttgcagggtactactaattaatgattagcttagcaaaagctctgcatttcaatcaaaagaatttgcatcataaaaggctctaacctaaagctgcatacctaaccacacctaggaatgaacaaaaaatgcaagctggtctttggcccagtgcaacatgtgaccaactatggacatgccactggttgtcttgaggccttccttcatctttgtgctccactattcaatcatccaaaatgagagtattaaaagctaaggggaaaaaagggcaaaagagaaataaaagtaagagaattattggaccaacaccatggaccctcaccacataacctgcaccatccaattctctgaagacccactgtagcattattctgaacttgtacacttcatttatcatcttgtcccagactccagttaattaccttcaatcaattactacctttttactagatgtgtcg

SEQ ID NO: 70662 - DNA, 26634 bp, Oryza sativa
acatggggatgtatagttctttcatgcattgttttgtttttttatatagactatctttaagttagtaaaaagctttgctctctctcttcatttaatatcttccaaatagaaaaatatgctgacatggatcttttatagagaatctcttatagagaggttatagataacaattatgggggctcgaagcaatgaggtccaaacgatgcaataggaaagaccagttcattgaatggactcgccaaccattgaaaagctttgcaaattttgccatttactcatcagtctggcactctcccgttgatacaaaggcgatgcacacacagggtaggcagacaccgagaccaattttggtgttcccccccccccccccccccaccaccaaccttcttgccttgtaaccatcgcgcataccaagcttaattactgtactttgcctacacctatatatttcttccacacatacacatctccattcccctctctctctttctctaccttcctctttgctttgccatttcaagtctagagagagagagagagagagagttgctggattggacgccattgatgctgtagcagagaggtgccaaggtccaagaaagtgagagagagagagattgatgaagaacatggaggctgcaagaagaggaagaagaggaaggcaaggtggtggtttgctgctggtggttcttgccgctcttctgcttcttctccttgcattggcgcgcggcgcgagcgcgtgggcccacggcgggctcgccggcggcgccggcgccggcgccggcgagcggcggtacatggatctcgcgatgaggaggatggagagcgtcagatcttccttcgtcgcgaggagggaattagcaacggtcagtgtagtttaactaactctactccatttcatggcttcctgctgcttctgcttccattactgtgttgattgcgtcatttcaacttgttaattgcaagcctctctgctgcttccaggcttgcagctctctgctgcaaaaaaaaaagttttttaatgagtagtttgatcattttgttggggagcgtttgttgtgctgggtacatgttgcaattaattaactgcattacactgggccaaagttagcagtaaaaccatcattttcgaagaacagcaatgcatatgcacacaaagagaagttatcagataattgtgtcggtttgcttttgcactggcagtacattctttttttttttcatttgccttttgcaataaaatgagcagttttattaccccaaaaagcagcttttttcctaagcatatctccgtcatttgtcggccggaagtctctgtccacgctctcaatgaaatctagccgtcctcaaagaaatgtctttcattcataaatccgcattcacatgcccaacgcattagctcatgcatcagtaaaaaaaaaaactgcatttgcagttcatattttccaacttttggtatgcacaaacgcattacctcaacgttttttctttttacacttttggtattcccatgcacaactctttcaagagttcaagggcgtcatattttgactgcatttgtcatcaactttggaaaaagaaaaaagaagatctcccattttctcacaatttcgtcaagaacgttaggtatactaccaatctagcaatgtaccatgaaatgcttacacggcagcgaagaaattgagaagttttctcctcagaaaatcctgctcactttccaccgtgttcggtagcaggtagcactagtagcaactgcccccacataaatgtaaaaaaaaggaagtaaaaattaaaatcaaaagcttcgcggctactcgtgccaaccaaactttgaactttttaccggtgctaactttgaactttctgagttttttttttaaaaaaaactttgaactttctaccggtgctgtgctgtcacgtctgacatggcgagttcgtgcattgcagtctacggcggcgagctcgtcgcgggtgtaccacgtgacggactacggcgccgacccgaccggcggcgccgacgcgacggcggcgatcaacagcgccatcgccgacgcgttccgccgcccctccaacgccaccatgaccggcggcatccccgacctcggcggcgccgagatccacctcgacggcggctcctacctcctcaagggccccctctccctccccgcctccggcggcggtaacttgaaggttagtaatgatgtcacgtgagtatttttatttattacttcatccgtcctataatataaaaaattttagagggtcataagatacatgtttcatgtttagatttatatgtttagatttatagtataatgatatgtcacataccttattcagagataccttattcagagggagtatatatcttttcctaactcattagttgtatacatattaacagaaactagatatatgaatcatttttactatgttaaaaaaattgcactatcttcgtcccaaatgttagtacaacataaaatgaaaaatgaaatttgacaaatcatttttaagaaattctttcagtcccaaaataagcacagtaatgagtttccgtgcccaactttaattgtccgtcttatttatttttttttgaaaaaactaaaaacataagtcacatataaagtaatctaatatcaataaaaatattaatcgtaaaaattttcaaataagatgaatgattaaagttgtacgcggaaatttatgattatgtttattttgggacagatggagtaatgaatttggacaaactaatactttgggatgtagaaggtattttgacatatgggtcccactgagggtgtatgtacacgtggcagattcacagcgggtcgctgcgggcggcggacgacttcccgacggaccggtatttgatcgagctgtcggcgaaggcggccggcggtggcggggggagctcgccggcgatgagctactactacgagtacgtgacgctgcgcgacctgatgctggactgcaactaccgcggcggcggcgtgcgggtggtggactcgctccgcgtcggcgtcgacaactgctacgtcgtccacttcgcgacggacggcgtcgcggtgagcggcggccacgagacgttcgtccggaacaccttcctcggccagcacatgaccgccggcggcgaccccggcgagaggtcgttcacgggcaccgggatccgcctcgacggcaacgacaactccgtctccgacgtggtggtgttctcggcggcgaccgggatcatggtcaccggaggcgccaacgccatctccggcgtgcactgctacaacaaggcgaccgggttcggcggcgcgggcatctacctcaaggtgcccgggctgacgcagacgtggatcaccaactgctacatggactacaccggcatcgtcgccgaggaccccgtgctgctccacgtctcgggctccttcttcctcggcgacgccaacgtcgtgctcaaggccgtcaatggcgtggcgaggggggtgcagatcgtcggcaacctgttcaacgggagggggaagggggtggacatcgtggagctcgacggcgagttcgcgacggtggagcaggtgtacgtggcgcagaacgcggcgacggggatgacggtgaggtcgacgacggcgcgcgccgcggcggaggggaacgggagctcgtggacggtggacttctcgccggtgctgctgttcccggaccggatcgggcacgtgcagtactcgctcgccgccggcgacgcgttcccgggccacgctctccggaacgtctccggcaaccgcgtcgtcatcgccaccgacgccgccgtgtccgccaccgtgcacgtgctcgtcgaccagaacagcagctgaagaacaaaaaatcaaaatgctgctgctgcctgccgcgattgcgcgcgagcaaggcgttagattcgtttgttcttgcgattcaccggcaaaattcgtctatatcagagagatggcaaaattggcaatagctatagcttgtatttgattgtttctgaagatgattcagaatggatcacttcgtcagttcatcgtgcttccagtttccataaaatgcctcaagattcactgattcagccaagatttcattttttttctttttcggaaaaaaatggaatcaagagcatgcagggatgatcagaattatgacgacaaggagaacagctggtcattctttcagttacaaactgaattcactgacaagaatgatgcaattgctactatactgtactccgacgtaggagtactgtatccacaagtagtagtacttgtcccatttgttttgctggtcacccgtcagtctcaagtgtaatactctgtactagcaaaaggcaattcattcatgcacacgcttgatcatgcccaatgccccagggacccaaagtactaagcaaaattatgtggagcaataacaacttttaacaggtagctcacctgttttcctggctattatttcgatctgtcggtcggcactggctatttcttgatttcttcttgcgtgattcaactgcaaagacatgtaggtagcttatctgattatctcttctcctaatactatctatgaaaaaaaaatgttgttagcactgatatttcctcagtaaaatgtgagtaattaagcatcagaaacaaactaaatggtccaccaatcttgtttcttcttgttgctattgtctgtttaccatctttaattgatgtgtttcaacattagtaagttgtttcagagcagccaaaaggaaagcgatcactagctgctgaaattttgaggtgaaaggcagctaatcactttcaaaattccaaaatggactctttccttcattcccaattgttgatatgccaaggactttttgagctgttcatggggttagtttacctgctttctcttgtcagacgtcagtgtgtgcctcctctttcttgatcttttcttcagaaaccttccaaatggagtacttaagctgaatttttctgtataaagtagctcaacagtttctcttgacgaatcttgtgcgtttacacaccaataacttctaagttgtagaccaaccaaaggtaagctgcatttgaaaactgaaactcttcaaacgaagaaataattctggaagctgattttgccaaaggtcttcatttttactgagttattcattaggcttttttttcttcttcttgagttataatgttctcaattttgccacttcttgcagagttagccattgggctttttttttttaaaaaaaaaaccccaaatgctacaaaaagttaaaccgatacatgtgccaatttctgtgcttttggcattgtcaggtatagtgtggagaaggtggcaactctatcatgtccttggtcccagaccatatgaattatggcatatggaaatcttgatttcttgggtcactggtccaatatttttctttttctagaatccactaatccaatattatactactagtactaagctatttaaaagtctcttactagagttggttagagttgcacaatttcactgtcaccatgagcttactttaagatttggcaatcctgtacatatgatgcattgtcttttaagtttcactaatcactgtcaaaacacgagaaaaacatggcattattttgctgaaccagtcaaacagttaccattaaaaaaagttaaacagttaaagtagggggagagaaatatggtagtagctcaagaaaaagtcatgaatccgttaatatggttcattctttcgcttatttgtagaataagccaaaatcatatttgcaaacaaaaaataatttgtgaataaaacttttatatacgtgttcttagtgatctaaaagcaaatgctgaaaaataaattacgatgagaaaacccaaaaatcaacaccaaatttaaggtggaaaatttaaattttggctgataaatataagcataaagaaaagatgaggcccgtcctgtggaattcagtgtagaaattcagattattcgactggtgatccacccaagtcgataaacatgcttgtagcatggtgataaatgccttccggtgagaagctaccgaccagggttcaaatcctatatatatatatatttttacataagaaggtataactggcttaccttatagtcatttcattgatagaaatcctaatctcgcataaaaaggggatttgattcacccaaagtccatgaactgtgttgcatttgtgtcctcctttcttggaacaggtccaaagatgtccatttgagatctgcatggcatccgtgattgcgtgaggattagtctgatagggtagttagaacaaaccttgttaaggacctacttgactttgaaccgtattgatagttgttggtgagctaatctgacgaagtgaagcagacagtgatcatttgaggtcaagaactgatacgataagtacaaacaaatcatcaacgaattaagctttttgttaagggaagtaatgcatagtacggtacttgaatgaataaagtttcaaacagcaaaaatcttaactttgggaagcatagatatttgtcattttctgtaccatacaagaaaatttctcgtccttcacctgaaacttgcttgcaacctaactctggtagagccaggatataacaatggtttcttttagataatgggatataacaatgatatgcttcctctcttttccatggaaggtgacattttcttcgcttttcagtagcaaacttcagtggacgcatttttgtgcagatgcagacattcagaatccagtaacaaattgcttgcttttcacaagccaactttaaagccatgtgattgtttcagatggtgacatttagtatagattagagattaatattaaggtgcagtatgtctactaaggttcatagtggttcatatatatatatggttatttcttgcagcagaaaacacacaccaggtcgaaccaaacagcaagccaacatgcttgtgctgtattcagagctccagtacttgtacactgaaccaaaacgcgagtgaatattcgttaagctcaaaggcatcccacatctctctcccttgataattcatggatgccaacagtatttcacagccgaatatactctctcagcaagcagtacaaaaattgccaaacagaggggctgatatatcacaaaatgttcatggcaagttggcattttggcaaccttcattttcataatttaggatattgaaagacctgctaagaatagccattaacttttgagacttaagagactggtagatacattctagaatgcgtagcaaagattctgagacatagttatctaccatgtattgtatctaaaattgttattctagagctacagtgtaccaagattaatagcattatgatttatgtatccaccttctatacatcttccctaagaaagctcactaccaagcagctagccctgaagctcattccatcctatgaacaagtaagcagaccttcaatggcaatgccagcaggatcattgccttcccgctccacggtttccaccaccgcctggtagagatttgcccatgagcacccatcaccagtactcccaaccatgtcccagaacgtcaaattggggcttggtgggcatgaggcgacgacaatgtcagcaatgctgcctactttggctgctggccggggaaagtccagtgccaaattatcgactttgtgctcgtaaatcttcccgttcctgtcgaccttgtatctcgaggtgccactgaagcaaccgtatgattcccacgggacacgcggggttccccacagctcccaccggacaactatcgagttctctgtcagttgccaaatgcgtgatatgtcaagcccgatttcacggaagagtaggcgcccatggaatctgagagcccagaagattgtcttgtagttgtcgattccatggaaagtgttcaacggatcgacgaatgttatatcttcactgcagtgtgatgcaaagagtgtttttagtgcccattttacaagaataactgtagaatatatcaacaaaaataatataaatatgaaactacaagaagtacacttgtcaagtcaacaactagtgttcttcatacatgactagaatcaagaatcatttggttacacaaactgctgtaattgctggtgatatatggactgctacctgtcactgctctctgaaagtgtaaacttatcagttgattcaattctcagtctccatgtttatcagttgattcaattatcaatcttgaatatgacactctcttttaatggaaatcttgacaatgataaattatcattctaccaatcatttcctccgtttctatgttgactgacacatcattttccatgattagccaactagcacaaacactgaaaacttcagcccagttttagtggaagctttcagcttcagttccccatggacatttattcactgacgaactagcaaactaaaaattctcactacagcaacaacgataataataagcaaaagtaacaaactcaaaatctatagcaataacgataatacgaagaaagtaattagcgaagattaatttttaccggtagatgtcgtagttgggttcccggacgaacaccgccggcaggtcgtcccgcagcgtgcgcaccgccgtcccaaggttgaggtaataatccgacctccgcgggtcctccccgccgccgccgccgctccggccgccaccgttcttgctccggctcttgggcgtcgggacggcggcggcctcctgctgcgaggcgccgagcaggagcaggaggttgaggtggctcggtgccacggcctgcgccggctggagcttcccgccgccgggaaggccgagctgcgacttgagcgggctcggcggcgacttgcaggacggcgtggtgagcttggggaggaggaaagccatggcgcgcctttcttgatctttctggctagcctacaagtagcggattccttcgcctacgagctccatgtagtagaagcttccaaattggccattgggatgttcttggggagggagaattgagtggctccgatgggtgcagcgaaggcgaaggcgaaggcgtgtgtgtgggagagagatggggtccgacgtggagccagccagccagccgtcgaggtggagatgatccggggtttcatccttcgttttccttgtccttttgtaacaaagaagaaaaaagaagaagtaatttttgctacattttctagtagatagttttctttttctcctgattacgcgagacacaccactacatatgcagaccgcatacacgcactataccgtaacacatgagcttatcaccgttacatatgcaggccatatagacgagaacacgccacgcatatagaccgcatacacactctggtgaatgtattgtaatatgcgactatacctgtaacacattctaaaataatagatttgagaccgaagttaaattttcacgacctcttttctgtagtaaataattagttgatgtctcaggtcttgctaggaaatacatggagaaatacatggatgaatgtatgctgcatattgcagaaatgaaataaagtggaaatgatatggggtgataattcgatatgcttatatattaagctctagaatgtattaaataataaatgctatgttatatttgtatgtgatttaaaatattttgatagatttgcatgttaaactttaaaaagctagcgggattcaaatatataaagatattccatggtgagcgcacttctatctatcatgctctaggcgttgactagatgtagcatggtcatttgataaagtaccatactctacatcttattaaattttagcagaatatgcacacttgtttttgtttttgagaggatacttaggagggtgtaggtacacatgagttatatacaaagacagcctacgacatggctggcctgtacaaacattacttgtaaacggttgcacatcacaccacaattaaacatcatcacccaaaggcagcatacaacatagtcttctttcgtgtatgctcctcatggaatcaattatcaaacctaaactcttcctctttttttcttaaacgttggaactgtcaaagcaaaagcagttctggtgcaagaacataaaaaggagctttcttgctgtccttgtttccacagcattaaagaataagcacagcacccttaacagccaatgacactaacacacaaacagttcctcttgttttcgaaggttggactaaccatgctacctatttctagcctaaatacctaggagatcttccctacttgcaattcacgggtagataaggttattattgttgtgaattgcagcaatcagactgatttatatccccatcatgtgatccaggcctggctgaggagcagctcccatgcctgcgcctgtcacattaagaagcaattgctggagccagcgccttgttgtaggatcatcctgtggttgtcaaaagttggtgtttcaaacctttcatttagtattaatttatcaagtacaggaataagaaattggtggcagctgatgggttaatatcactcaccctaagacagttattgaacgtgccatccttcagcatgtcagggaggcaagtttgtagtgcagcacatgccctgcatagacgccgcgtagaaaaaaatagcctgttcagaatatttaagtaaaataatttgatagcacacaaatggcagcacagacctggaattgtctgacagcctaaggtaacatcggataatgtgcttcagcaaccttgtggaaggctgctcagcaagtgaaaccaccatgtttgctaaaacactgcctacagcaaagaaacgctcagcagtggcacaaatgtagcgcaatccaacatcatcgaggagaatcttctgaacaatgaaggtggccacctacaaaaatatttgactaaatcagtgaaataataatggttcattaggcctagcttggcaaatgagatttatttctggcctcatttgaactttgagctctcatcaacaaaagaagcttaagttcctcatgagctaccaacttaactatacctgtgtacctgtgtacaaacttaactatacctaccaagtttaaacagttaggtttgggtcataaaaaaatggaattaaaagtggcagcaccatatagttgccaaattgccaacctcctctcaatacatatagcacaatccaccttttaggcttataaaacgaaaggtggcatttgagcttaacaaagggaagcctggttgagaacaagaaaattccaaagatgagcggcagcctgtaataagaagattctaaagatgacaggtggcttacttcacactaacctggacaggctatcattattcatggtagcagaaattttaacctagccaagctacgattcatggtaacaaaaaaaaaaattacacacaaacttcagacagcatcatcacatacttaaagaagaaaaagatgatggtatttagataaacatgagatggttagcgacatacagtttttgacagctcacttcccatttccatggtacgcaaacacagaggaattatttcagtttgcagcagaaaactgataacttcagtatcatcaacctgcgtgtattacatgtgaaagaagctttaattccatttgaaggaaaaatatctaaaaccagttcaacacgaaaaaaagaaggtagaaaacatcaaagagtacacatgtttgtttcaaagtaattcaacatattacaaggttacaaattctgttttgtgcatttttcctcagaaccctgccagagggctagtttccaataaccaagctctgtgtctacttatatataaaattggtttgcatccaaacttaattcaaatttctacaaccccacatcattcccccccaaaaaaaacatggatacttggtagttacagtgctacaggaaccaggcaaaccactaaacagaagtaaatggctggttaccacgaggatcttggaaatcttttgcttacaatttatgcttgctgttctgcctaatacaagaaggatgcattcttataaggcctcatgcctaactactgaataataataacatggctcttcgccaagatggcagaatagaattactgaaatgtgtcaattgtaatatatatcatgttcgtatcactgtttaaacgattaactcatgtaactacatagatgaattaccttaacaagtgcaccgatgacacccaggctggtgagtcgcaggtattcaaaaggtcttgtcttgctggtagtattcaagaatgggtacaggtacaggggaatatgagctgaaaagaacaaaagaaaatgagagagggaaatggaatttttcacagaaacaaaaacaagagctaaaaggttctttagtgtgttattttcttatgaagattaagactttacctcgatttttgttagcacgcttttcaaactaataaactgtgtgtttcgtgcgaaaactttctatatatatgttgctttaaaatatcaaatatatctatctgtcaagtttgtaataattaaaaattaattaatcatgtgctaatagctatcttgttttacgtgctccaactttatcttcatcttcatgagtttcaaacactagtactacacatttaggaattaggatacgtcaaatatagattacaaaagcatgatcatacacgcatatgagagacagagatgcaaaggaccatgaccattaccagttaagaaaaggatcctggtctcagggtgagatgcaacacactgaaattatttttgaaaagcaaaaaagaaagagttaatcagcaaatctatgtcataaatccaacttgggtaactcaaaaggcaatttctactgtaaaatacatcatgaaatgcaagcaaccagaagacaacttttccagcattaccgccctatttcataagattatgtacctgaagaagtgcaagtgcattgcagactcggttcgatgcacctggtgacaatgttgggggtgaaagtgcagagtagattgacacaatttcctgtatgtgttggcaagtatggatgcaccaagtgagtaagattgctgaaatttgagtaagtttggattctaagcaacaagtgctaatttgaacagcatacaatatttgacctcaacagcaaactgatgacttgagagtaggattaaaactataaattatttgtgagtttaatcttcaagcatgcaaattgtaaacatatacgaacaggggaatcatgcagacctgaagaagtgcagcaactgttccaaaagaatgccaaagaagtggggccagatcttgaaatatctctcttttctgaaaagaaaggattgaattttttttgaccaaataaactggcttatcatgttaatgactggaacatgaagtctacaattattttgatcaggaaaattacagaactaattaggtacaaaacaaaaatttctaaattagttactacaaagaacatagggttctaaaattttctttagcaaaacattgctgttgacaatgaagccatctgctctggaatatggtaaatctacaatccaggtctgtgtgtatgagcggtaatctgtataaacactttacagcgtaaaacgccttaaagagttaatggaactctcgaaggctacccataataaactgagtctaattcgctattgtgctacccaataataatggtaatctagcgggaagccgggaagtttcaccgaccacaataattagagatgctaatgttatcttgatcaaaacgtagtgtaatagcccatttcatgatagatgcgcatcaaccatacggtaaccctaacaccaaatcaccattcaccaaccctaaaaaaaccattgacattcacaatgctaaggcgaaaccttcccccacaggcagtgtgaattccacaaattaccaccagtgccccagatagggtaggctatagaaccctagaagaacgcgcgctggaccttcgagagctcgaggagggcgttctcgcgaagctcggggtcgcagaggtcgagcaccagctgctccgccgacgccatcttcatatccttggctggctgccccaccccgccgcccacgccaccgccgccgatcggagaaggcgatggcggcgaggccccggcgaaggagggcggaatggaaagcgagggctgcagattcgccattatccccacagcaactgcacaacaccaacgaaaccaccatcaccatttcttcccaaaccacaaaattatccaatcaaaaaacacacaaactcgatcaattccacaaatgtagcaaaataagggattcgactgctcacaggctatacagcacggagcgaactaggacgaaatggaagggatcacccgaattccgcgacggatcaccactctccgctcctctccggcggcgccgcggccgccgtgggctcgccgcgacgggaggagaacgacggcgaagtcggaataatgcgaaactgcagccgaggggagagagatcccctctctcgccccctatggcgccacacggacggccaggatcaaccgatcgccgcgatcggacggtccacattgcaccgtccgcgacgaacgggcgtgatgaagcggaggttgcgtacacgggccgaggacccatgtagatccgtgatggcccggagtttgggccttattgggcttgaggttttgtggcccgtaaagggaggggtgtatctgcatatttgacacccgcggcgctgcgctataaagagtggctcactagggtttacctccgcgccgccgcatcctccttcgcaagcctcgcctccactccccgcgccgccgccgccgccgccgactcgccggtcgtcaccctcgccccgcagccatggctgagcaggtaaggcccggcacctcctgttcttccgtcgagcttctccgtcgcttgctataggagtcagttctaggtgggggcgcgttgccatgtgatgcgcgtgttgcgatgtgagactcgatttctcagttctcgtgatttgggctggaacgctagcgatggaaagttcgtgtgatagtgtcatgaatttgttgaggtcttcttgttagatgtggatttgttgaacggtgggtttgttatatcggtactcgtaattctctcgtgttaaattagcaatagaagttttgggttactggatcgaagttttgctgagatattgttactggatcgaagttttgctgagatgttccaatagattaacgcaaccgtggatgtattcgatgtttgggttcattaccgctgccgtgttcatggtaacgaatgataggtctgtgcttaatattcgtgatgctgcagttgtgtgtttgtcacgttttaacttcttttatggttgatgtggagcttatctgctactgaattagatacagatttgtattcttgtttcccatttgttcaatccaaataagtgatgcaagtggttctagctatgttgtgtagagtgttgatgtttttcatccatttctgttgtgcagactgagaaggctttcctgaagcagccaaaggttttcctcaggtagggttcttctgctctttcaatgctttatgtattctgtgagcagttcacatgtcttaacgatgtttttctgcttcattttagctcaaagaagtctggcaagggtaagaagccaggcaagggtggcaaccgcttctggaagagcattggccttggcttcaagacccccagggaagcaattgaaggtacaataggttatttgcctctttgtttagctgattctgtctaaaagttgtatgctgtacagaagaactttggtgttttcactgtagccactgaatgatttgtagtgcgttaactttaaaattgtcactgaaagaacagttgtttgtcatgcattgacagtatttgttaagttgtttttatacactattgccggtatgtttgactagcaatttaaattcatctgaatattacagacctgagataaatgctactatttgttttaagtattgaacagttgattaactgcaattctttccagggacatacattgacaagaagtgcccattcactggaactgtttctatcagaggcagaatcattgctggaacatgccacagtgccaagatgaacagaactatcattgttcgcaggaactacctccattttgtcaagaaatatcagaggcaagtaaactaccatggattatatacttatgtttcctttccttttctccgttctaacatagggtgcaaacctcccaccttgcaggtatgagaagaggcattccaacattccggctcacgtctccccatgcttccgtgtcaaggaaggtgaccatgtcatcattggccagtgcaggtaaaacttaactcccataccttagtttttgactccttagaatcatcttaaataacagaggtgctattagttcaaacattgtcagttcacccagctagtactatgagatttggttgctgaagtacaatttctgcattttcaacaggccgctgtcgaaaactgtgaggttcaacgtcctgaaggtcatcccagctggatccaccggcggcagcggcggcaagaaggccttcaccgcagcatgagcttgtactcgcattattcatgggtagtttatagacagatccttttgcttgaagtcctggcagggctggtgttttgaccctatcgatttggatattgttcccaacaaaacgaagtcttttcatcagaacgtgtttatggaatctactctatgcaaagttttgttaagatgcctgttaatgctcgatatgctgtgatccttgattttcctggctggctatgtgttcgcttgtttgttgtgtttcttcgaaagagtattggtggatatcctgtgcctgtgcatgactgagattctgaataaggttttcccaaacccaaacctgacctaattcagtttttttgacaaggcttgaatcttataagtttatcaatggacctgacatcttcctatcgcacctaagctttgggaggatgctaatatctggtacaacgtttacatttcacaatcaaacacaactctgaaatgttcgaatatctgaaatgttagcctggtacaccatttacatttcacaatcaaacacaactctgaaatgttcacctttgtccttcagagaattagagttcagatcaacgaaaaatgttcagtctcgtataactgctacagtcttgcactccaagacgatgcgatcgaccacaaattaacgagaaatcactgccatttttttttagcatagacgatccatcaaatgagtaatgcttgaagtttaattcgcacgaagtgcaggttggggtgatgattgttagtggtaaagctgcaagaacaccgctctgagcttcttcccggccggagtttgggccttcttgggccgatatttacggcccatatagagaggggtgtatctgcatcgctagggtttgcctccgcgccgctacctccttcttagcaaagcctcgtctccactcccctcccctcccgcctctccggatcccccgcgcgccgccgccgccgcccgcccgccggtcgatacccctccgcggcagccatggctgagcaggtaaggctcctcctagtcttaccctcgagcttctccgtcgcttgcttagggtcagttctatggtgtccttgttatgtgactcggatcttcttgtcggtgttgctcagtggtattgcgtgatttggcctggaattgtagggagtgaaaactggtttggtagccttgcacatcagtatgttggtcattattgtcgattgtagatttgatttggggttctagcctagtctcatgagtttgttgaggttttcttgttagatatgggagtagttgggcggtgggtttgcatagtaccattctcaactctcacttgatatgttgtgacttgtgagccatgttcatggtagcaaatgccaggtgcagttttgtggttagtgtggagcttatctgttacagagttagatataggtttgttatcttgtttcccatttgttcatgcaaacgagtgatgcaggtggttctagcagattttgtgtagtattgatgttttacatccattcctgttgtgcagactgagaaggcattcctgaagcagccaaaggttttcctcaggtagggttctgctgctccttcaatcaattatgtactattctgtgagcaattcacacgtcttgacaatgtttttctgcttgattttagctcaaagaagtctggcaagggtaagaagccaggtaagggtggcaaccgtttctggaagagcattggccttggcttcaagactcccagggaagcaattgaaggtacaatagagtcttgcttctttgtttagctgttaccagaattccaattcattacattttagattcttgcttactatcttttgtgtgctgtagagaagaattatggtttgttttactgttaccactgaagtgatttgtagtgcattatgaacattaaaaattgtttctgaaagaatcgttgcttgtcatcagttgacagtatttcttaaattcttttgatacactgttgctggtatgtttgactagtaatttaaatgcagctgaataatgctatttcttttatgctaattctttcaagtactgagcagttgattaattacaattccttgcagggacatacattgataagaagtgcccattcactggaactgtttctatcagaggcagaatcattgctggaacatgccatagtgctaagatgaacaggactatcattgttcgcaggaactacctccactttgtgaagaaatatcagaggcaagtaaacaattatggattctacttatgtttcttttccttttttttccccatttctgacttgggttgcaggtatgagaagaggcattccaacattccggctcacgtctccccatgcttccgtgtcaaggaaggtgaccatgtcatcattggccagtgcaggtaaaacttaactcccataccttagtttttgactccttagaatcatcttaaataacagaggtgctattagttcaaacattgtcagttcacccagctagtactatgagatttggttgctgaagtacaatttctgcattttcaacaggccgctgtcgaaaactgtgaggttcaacgtcctgaaggtcatcccagctggatccaccggcggcagcggtggcaagaaggcctttaccgcagcctgagcttgtactctcatattcatgggtagtttataggcagatccttttgcttgaagtcctggcagggcgtggtgttttgaccctttcgatttggatattgttctcaactaaacgaagtcttgtcatctgaacatgttttatggaatctactctatgcaaagttttgttaagatgcctgttttgctcgatatgctgtgatcccatggccgtgtgactcgagaatacttgcttgttcagcgtttgcatgactgagattctgaatagggttctctataacctgagcaaaatcaggtgttcaatgacaaggggaccagcttgagaagtttatcagtggacctgacatcttcctgtcgcacctaatctttgcaaggaaataagatactcccttagagcaggtacaatagcaggctataaatcagctgcaaacatattttaagcagataaatgaggagacagaagggcagcgggctacagatttgtagccagctgtagcatggactccaagacgcagcgtgtgtatgacaggtgggaccagatattaatagtgtagtatgtaactattctatgaatgagctaatggattagctatagatgaattggagctagtagtgggctatactattaaacttgctcttagtagttccagaatatagcaatcatgcatgctattatcctagtatttggacgtgtctaatctggttttaggttactatattttactaggatagaggaagtatgaacttgcgaatgttgacctgctaggctgctactcccccttatcaaaatataagcatttcaccatgagatcaccattactctcaggataaaaaaaactgagattaccatttcaccatgaaaaacacagctctgaaaattcgtcaccttttcagtaagagttcagacatgcaattctcgtatgatcgcttccctccactcctggcaccgatccaagacgagaaatcactgccattttaatttgcatagcgtgatgatccatagtcaaatgccaaatgcttttccagtttgattcgcgcgatgtgcaggttgttgtgatgattagttgggtgttggtatagcggctaattaagctgcaagaacaccgcactgagcttctttcctgccggagctcccggtatcctgctggttccctgaatattcagagagttggacagttcaaatgcatgtttctctgaaatgaaatcatgggcattcaaagatctatattgttttgaagggggaaaaaacatctacagattacatgggagcaacacaggactacaggagaaaccaaaatggcactgccacacaaatgtttttgtgtgaaaatcaagatggccttagaattttgggggctacattacaatactcacagatgacacaacataaaacaacccggccaatatctgaggagctcactgaactgtacagcatccattcatcccatgacatagggaaaatggaaaccctgtgatcttttttttttttctgtttgagatgaaatcctgcaatcctttctctgccactgttccacaaatttgaagttacagagctgtttgtgtcacaggtcacctagaaggaaatctcactcggcgcatggaatgtccgtccgcggcaaatggcttccaagttttctccagcataggagctaagtggagaaacttccacacctacaagcaaaatcaatcatgacaatattagtaaaagaaaatatcatttttccttgttttttgttcttggcaagtttctgaatgtattggacaggagaaaatttacctgtcatgtacaatgggacagaatgggtcaagaagccaccagcagcaactacccatctactatggagacgaagcagcatcagctttgcgctatcaggggtatcataagacgcgccattcgcattctttacaggcgcaaattcctcctcccgcaaaacctgaattttcagatatgtataccgatgagtttctcaaaatcataacaaaaagacacagcatgacatctagaatgttataagagcataggcgactgagaagttgaacctcaaaaagtgctgtggatggggagtaactgaacgcgtcgaatatatactgttcaagcttcaagcccattgcgtacccatggatggaagggatcttcttctcagcaagatgataactggacacaaaagttttgtaaatttcatgtgctacaaatacaatagaatgaatgatggagcttgcagttttaaacatggctctcactttcttaggaagagtaagaggggcataacgagaaaatagataactactgtaatttgcaaagaaagtaaacacaatgaattcctactgcttcagacttaaaacagttatagaagcactcacgtactgtccttctcaaggctgtttgctacttgattcaaaaaatccaaagtgaacatatgcaagcaaatctgcagtgagataagaacatgcggttgttatacacctcaagagaaagtgcaaccaggagggattgagaaacaaaggatagaacatacattgctccaacaataacgaaggcgtcccgttgactgattaatttcagtagccatagctgcgtccatttcactatactcaactacagagagaggtccaccacgtcctcgtcgaacaaatactccaacattctcttgtgggtaagcctgttcagcatattatttactatcaacatggtgcatattggattaatgatatgaagcatgagaagtatttgactgtaccttcctaacaacctttgcagcagaagatacagctttgtctatgaagtaacctaggaacgtcggatcagcaacgcggacctgcatacataatattgataagcgaatgaggagaaaacgcagaaggttatatggattatcctatggggaagttaatgtcctcaccagtgcattgtcaaccccgtagcaatctacatactttacaccccgtgaagacatatcttccagcaaccttctggacttgagggctgtaggatgttgcagtagtgaaaaccaggcatcagaaatgaccatgcaacactacaactagaaatacaatacatctttttgggagattaccagcataaactccaccattgccatcaggagcctttgctacctggtttcgaacagagcatgtgaaaaaaaaaaagaatgccatcatttaacattttaaataggcagcatcaaaacaatatttgtaggtatcacaattgcacttgaattgtgagatctcagaccatgtgtcaaactcgaaaatcaagttgttacaaaccgcagtatcacctcctagtaatacaagatcaatcagtggaagattagaaaaataatagaagatggtaccttgtatggtgtctccataataaatctgccatcagcagaaacacatggaagggtgccttgttggaaaaatgtcacctgccaagaaaatgttcagctgttcaaacctacctattaaacattactagtgaatgggggatcctgttggatcttttgttgaaattccattggaatagttaacacaaatgaaaaaaaaaagtacttgatcttacttggtctgcctctaagccaaagtatttacggctttcgaagaatttgcgagtgatgtcatcggtgaaggggctggtcattatataccaatgaataggtacggtgttatttggacctgcaagttatttcaaatttcagggtaaagatgtgaaacgaaattaaaaaagagagtaaaattgtggttaaaagacattactatcacttgattgagcagcaagcttttgaacacacaaaatccgttcagcttggagttggaaaagcgactttccagacggaagtccgatacctaaagggcagaaataagaggttaaaaataagccatgatatatacatagacagagttggaccaagaattatcgaaaagagcaactgagcaattccacactaatatggatggatagagataaactagaatatgtcatttcctttgattaaatggcattaaggtgatgtagactacatttatcattattattacactctaaaataaacaatctgagagctatgaacaaaaaagattgtgtaaaacagaaataattcagagcacctcacttctttttttggctcaacaaatatccatacatttgtgcgtacaaactcaagtactaatatacaaagattgaagtggaatcaacttactgaaacatcctttaggatcagagctaccaagccgagtcccctgcacatacatgaaaagaaattaaaccataaggaggctgcttctcaatgcacaaactatagaaattgcaaattcaggtaatctttccatcagagcacctgaccaccggctaaaaggacgacggctagcttcccctccgaaatggccttcagccccttcttccaccaccgttctttgtcctccggcaacctctcctccaccttggacacgctggactccggcaccggctcgacggtgggcaaagtgaatcctgcacttagaaagagcataatcacaccataaaactaaggcaattactgataaagtgttctcggtacagttctatcatcttgatgtaattgactgagttcatcaaaagcttccattatctataaataaactaaggcaagtgcgatgataaaaaaatacaattaactaatgttctacattggaaagataattgttctttcccttcaactgagagacctctcaccttgtgatccaagggagcgccggatgatccgatcaatccttgaaagatccaggctctgaaaaaaaaatgcagtatatgtagctccattggtcactgtcgaaatggtaagctcaaatgacaataaaatcatgctgcaggtttctcttgagctattgtacagtgtaagcaatgcagattaagacctatggagagcagataaataattggtcacactggcaacaaagctgtgaaagcgtgaagtaaattatcactcaaaatccaaactccttttccccacaaaccgcagtaaaaaatttcaactgataaatcaactcctgcagaattcacacttagaccaaaaaaccacattcaaagaccagagcttacaggcagaattccggccaaaaaaggggaaaaaaaatcaaacttcttatgcagagttcgtccctgacaaacagaaacggacagagagctcccgacagaaaacacaatcccaacgaaagaatcaaacattcgacgcgaaattccggcgcaaaaccgaatctctctctctctctctctctctctctctctctctctctctctctctctctctctctctctctctctctctctctctctctctctctctctctctcccaaccctcgcagccgcattgagctcactcactcgctcgctcacctcgatgtccctgacgagcagctcccggtcctcgggcgagagctcgtcccagagcgcgaacgcgccctcctgcccgtaatccttcatcctctccagcatcgcctgcggcggcgccgctccccacctccccaccgccgccgccgccgccaccgaccaaccactatctccttcatccctccccctcccttctcctcacccaagaaagaaaatggtgggactagagagagatctgtgactgcagcaatggcgcgctgcgcaagaagaggagaagagatggaggaatgccaactcggacgaacggcgaatcggatggatggattgttcttggatcgccgccggcgtgtgcggtgttcgcgccctttatatacctcctctgattgggcgtgcggtgttccaagctaattttgcttctcttctctcctcgctgacatcgaaagcacaagttttttttttcctttgacacttttttagcagttttttcatatgtgtgtcaaggattaatcactattacttaaaaaaagaattggtgggagatacgaatccctccgaacatttttttaataattttttcatatgtgtgtcaaggattaatcactactacttaagaaaaaagaattggtgggagatacgtcgctccaaatatttttttttaaaaagaaacttataagtatgttagggattgaacaccagatcttagggttaaaactacgtatcacttatcacgatgctatcaaaatgtatctcactactttatctattaattatttcatctacagcttatcagcagtcaaaacaccactaaacaaaaattgtagttaaattgtatttatagatttaaagctaatgctgaaaaatgaatgattataaaacatcaaagcacaagttttttttttattttttgagcagcttctttttttttaaagatagtagaaattttaagaaacactgccaatgatatcacaagtgacaaccataaacgctctcagtctatgcgtgttaaggatcaatcgcctcgtattttgtctattaattttttttctcgaggtactttgtgatctactacctccatcctaaaatatttgacgccgttgacttttttaaaaatgtttgaccgttcgtcttattcaaaaaatttaagtaattgttaattctttttctatcatttaatttattggtaaatatacttttatgtatacatatagttttacacatattataaaagtttttgaataaaacgaacagttaaacatgtttaaaaaagtcaacggtgtcaaacatttagggaaggagggagtattaattactccatctacttcagaaatcgccggattagaggagaagaggggttaactagccggacatacagactgtcggtcacacgggttcaggcaccagcaaacagtgtcaaacccctcgtgactcctgcagcaacaacaacaaagaagaagaaaatatattttataatctatttatccatttcgttattaagagcacctcttgtttaggacataaacacacatgtattatacatttatacccccattccatgatttccatcttgtacataaccttcacaactcatatgtgggaccccagcagcagcaccctggaatgggcccacatggcagcgacagggtattgcagatcgtccgagctttgaaagcgagcagcgaggctgaagctagctagaagaatggtacactctcactcacaggtgagcgtgccactgtactgtgtgtacactaattgtcctggcaaagtcttctttggaggttgctcttgatggcccagacctacctctcccagttgagtgctctgaatcaaatcaatgtggcattcatgatctcctgtaaaaatcttaacaatacaggtcccatatataaataccccatcatgtatatacatcaccatacattttgtattaattgtataaaaatgtataaatggtatgttcctctcaagaatacgttcaatcgtacttgttcagatacatagtcagaaatatttatattttaaagaagagagcattatgttttaagaaattgatcggcatgcggatgaaacatcggttgatagatcatgtaagaatcaatcaccgactttatatacataacaaaaatatttatattctggaacggagagagcagatcatgttttcagaaaccggttggcatgcagatcatcagatg

SEQ ID NO: 70663 - DNA, 1107 bp, Oryza sativa
cgacatgtagcttttattaacttgatatcttcttcacacttttgcagttgtgctcaggaccgaagctagtgtgttgccctgaaaagaacctgcatataagatatagatggtgatttgtcaaaaaccatatcatttctattcaaccatagagcccaacatatagcggaagctcctaccaggataagtttactggttttttttttatcaatcccaacaagccaagcaaaattgtgtttataagggtatttttcattggcaatattgtgccattatagccgtgttaaaaattcgcataatttcctttggcacaactaagaaaggtttaaccttacgtcccgacccaagcattcgttgtagatatcctgaaacactaggttcggacctgttttacacttttcgaccgttggacacattttaaatttatcggccattagttataaatatatggtcttatatcatgttactccctcaaatattgaaaatatgttgatttggatacattttaaacttctcgacctttggacacattttgaacttctcgacctttagttataaatatctggtatgtacgagagcaatggttttaatttttaaaacacaccgttttgcacaagttccaaactcccaaacctcctatcaaagtgctccatccggtcttaaaaacaaaggtccggtttcccacacaaaaatgttacaccctttcacatcaaacgtttgaagtattaaatataagctaaaaataactaattgtacagattacgaataatttgtgagacgaatcttttaaacctaattgctccatgatttgacaatgtggtgctacagtaaacatttgctaatgatggattaattaagtttaataaattagtctcgcggtttactgacggatactgcaattagttttattattagtgcccgaacaccccatgcgacaccctatataatacccgatataacacgcaataattttacactcttggatctaaacacccccaaagttattttggatactacattccaagttcaaatataaaactctaatggcaggtacaataatagactataagtcagctacaagcttatgtggtgaagataagagaggagata

SEQ ID NO: 70664 - DNA, 24292 bp, Oryza sativa
  unsure (1)..(24292): unsure at all n locations
cagtccatcacaaagcatgacattttattatatgggaatcctcatccccatttctgagtggatcattcctattagcttgaaactggtgaaggggaggacatacattgacttaaaaatgattagatacagtacctttgatgttaaaaatagaaatctgaacatgttaaagatgacttaataatttcagctcaatttatcatgcatttctgttcagatgattacatacagtgcctttgatgtattttaagagagcaaaggcaatgtgtttgtgttatcctcaagctaattaatttactgcttaaacaaaaaaacacagttatctcacctatctatctatatatttttctcaggcgctgtttgtaaagttacggcagctagctagtgttgctggtgatgtcttactgggtaaagagaagatacagaaggtcttgctctcaaggctaactgaaacggttgtcatgtggctctccaatgaacaggaattctgggatgttttcgaggatcaatccatccaactccggccttcaggactacagcaggtatattttctcaagctttcatgttactttggttcaaatactaaaagatcattactttatgatttcagcttattcttgatatgcacttcgtcgttgagattgctgtctgtggacggtatccacacagacctgttcagcagcttgtgtcggtaatcataactagggcaatcgcagctttctcagtgagaaatgttgacccacaaaggtctgtaatcatgctttctgccgttcacattttttccttttatttagttgcctgtctttcatggccgaattgctcagactgttgtcttcttcctctcattattcagttctctacccgaggatgaatggttcctcgacatggccaaggttgcaattaataagcaattagggacttcaggatctgagtccgagcttgaggagcctgtggttgtacatgatgaaatctcggattctgaagagagtagtatttcaagtccatcgacgataggatctgaagattcatttgcttctgcaaacaatgatgatctagaaactcctgtatatttcacggatcccgaggcataagagttatttatgcagggaggtgattgtagttatttaaacatctagtagtttaatgtcctatatacttgcagaaaaattgataatccatatttactgtcctcattttcttttccgtgcataagtatccaggaactaaaaaatgaagtccccatggtttggcttatttcctaataatccaaaacggtttattaggaaataaaaatgaatttgtaggtgaaatttttataaatgtgttcttggtgacttaaaagacaatgttaaaaaagaaactacgttgaaaatatctcaaaattaagcttgaaaatccaaaatttagctttttctttggctgattaggctatccaataggagcctgaacatggtaaatcttcattcaactcttacatggcacataagtacaaaccttcaactggacagtacagccttgaacatactctacttgcaacatatgatttgcttatacttgtactctcaatagccttagaagcacatgtcgaggaggcaacagcagcaaagggcagcacagctgcaaaacaacagaacggttaagtatttcagttcttcagtctactttcgcatatcactactattataaaaattgaagatgtttttgccggtactttgtacgtcgtccgtatatgagtcggtttttaatttcatttgcttttagaaatacatatatgtatttgagtctgtttttaagttcgttcgtttttaaaaatacagaaaggactcctaattgtagcttatgattttgtaaaataaatatccaaacgaatttccagagtgaatttcaccttagctaaactgtacaacagtgataagattaaaatagcttttacccgttgcaacgcatggatattttttttctagttatgaaaaagagtaattgtctcattacgaaaaataggggtaaaaaagtctacttcataccccaattctagcaacctctttttaatcataaataaaccctataacttaggtgttgagttaggttttctataaacgtaggaagatactatgggcttgttcattttataatcgcttttaaccttattaaattttagtaagataacaaactaaatatgatgtcaccaatattatcatactactaaaatttagtagttctagaactttcctatcataaaaacgctagtactaaattttgaaaagacatcaaacgctactaaaattcgataacaccaaagcttgtcaaaagttgatattgccacagtttaataaggttaattttggtaacaaagtgcacagcttatgttgtccctgctattaggttatgatcgattggagtaaacagaaaatggtaggcggtaggctcagccactgcctcacacaagacattattatcagtgacaccgagcttaattaccatccttccaggaaggccttgtcaccgcggctctgtgtctgcgcgggctgcggcgggttcatgcccacgtcgaagttgcccgggtatcccggcggcggaggcggcgcgtagttgccctgcggcggcgccgtgtacggcgcctgccccgtcggctgctgcagtggcgccatcgccggcggtgggtacgctgctcgcaaaagaaatcaaggaagcaaaaaattcgaacaccgaaatcactccatcagtaaaaaaaaaggaagcatgaacgcaaccaagaacagcagaagtctcccaattaattcccaaagtcatctgtagcattaccggtcacgggagccggctgctggccgtagtaactcatgatcgatcagcgagacagtagcacgctagcagtagcagacggtggaaacgcgtgcgcttgggcgagacgagatggagagagcgagtggccggcaacggcaacggcaacggcaacgcgtcgtgtatatatagccaggaggaacaccgaacacacgagtatcgagtactggtcaactggagcagagtctagcggatcaacgtacggtggaatgaagacaacgggggcggcttcggttttgaagctgatcgaaggaagctagatagccaagcgacgacgaagggccggccggacgagtgcctagctaggttggctgcgaattgaacctgtgattgccaattgggcgagagacaaaactgggcggagtcacacaagcagctaggatggagcatgcatggaggaaagaagacgcggtcgtccaagatgtagcgatagtagacactagacacttagagcaagtttatagtatagacactggctctaaatcatctatagttaatgttatagccaatttatacaatagttgctgactataatattaatacctggtctcacctgtcatacacatatttctcttggagtccgcgctgcagctggctacaaatctgtagcccactgctcttctctcttcttttatctctttaaaatatgtttatagctggcttatagtctgctcttacagtgtgttctttccttcaagttcccaacccttctccctcgttttccgcgcgcacgcttttcaaactgctaaacgatgtgttttttgcaaaaagtttttatacaaaagttgcttaaaaaatcaaattaatccatttttgaaaaaaaaaagctaatacttaattaatcatgcaataatgcgtgctccgttttgcgtgccagggaggaggggttctcccgaacgcagctggcagggttgtaactgcaaaatctgcaacttagtactccctcattccctaaatatttgtcgccgttgacgtttttaaatatatatttgaccgttcgtcttattcgaaaacttttatggaatatgtaaaactatatatatgcataaaagtatatttaataataaatcaaatgataggaaaggaattaataattacttagattttttaataagacgaacgatcaaacgtatttaaagaaattcgacggcatcaaatatttttggatggagggagtaagcactaaacagggtccttttcgcaagagttccgaatcgcatgggccgtattatgggcaggagagttagctgggctgctgggctttaattgggcatagtgagtcggacgtaatcacgtaataggctggaccgatggaacctcaagtgaaagcatttcatgctggctcgtggttagtaaaaggaataagttcatctaaggtcccttaacttatgaacgaatccgatttacgtccttcaaccgcaaaaccagatacaacgggtccctcaactatcaaaaccggtgcagattaggtccctcggtggtttcgatggcggttttgactgacgtggcgcctacgtggctaattttactcggtctcgatctgacatggcactgacgtgggcgcttactggcaatttgatccgaaaaaataataaaccccgtgggacctatatgtcagtttcacacacaaattaataaaagaatggcgggcccacgtgggccccacatgtcagtctaactcacccctcctcttctgcttcctctctccccatcccctctttttatctctcttgcgacgacggcggcggcggaaatggagaagagtggccaccggccaactcgctcttgcacgcgctcgccggtagaccagggagctcgcctagctccttcccaccgctcgtcgcccttgtccccgatggccgccgtccgccacccttctcctcgatgaccgccggcgggagaggagggagcggcgcgcggcggcgtcgaccggtgaggagggagcggcgccaccactttcaccagcgccccacagcgacggcttgccggcgccgctcgccgcggtgacgacaatgaccgtggaggcgtggatgcggcggtgccagcgctggcctcgtgacgccctttgctggccgccggcgccgccgacgactcttcggaggacgaggcgccgtcgacgtacattccgatggcggccttcctgacctcgagcacgaacagcagcagcgtgaaccagacgatggcctggaagacggagagctggacaactgttagcattatttttgtgtggcagttagcttcgtgcatgtggctagctagtggctgccgaattaattggatcgcgtgctgcgtgcgtgtacgatgcggctgaagtttgtttgcttagtggtgtgtttgctgggctataaaagtcatataatctcctgagttaagtgtcaagtgaatgagaaaaactagataaggtgttgtcgtcgagaaattcttctgtgtttgtccacaaagattttcgctccagctagttgaagtgcgcgtgttgctgtaatccttggccagagctgacaacgacgagctgctgcgcccactcgccgtacatggcgcgcgccatgggcacgccgacgacgagcgagttggtcagcgtggacagcgagaagctggtgatggaccagcgacggcgcagccgcctttgctcatgaaccgtgcccagacgccgatgacggcgacgggtttgtcctgactagatccagatccctcgggatccaccaagagaggcttgagctcggcagtggcggcgagggggtcgggtgaggcgcgggcagcacgaagtcgagcagcgaggtcggctacgaggaggcagcggcgaggtgctcctgccgctcgtggagctcgtggcgggcggcgaggaggcggtcggagaggcctggggacgaggagagcggggcgagcaccgaagcgagagaggaaaggggagagagatgaagagatgggagatggggagagagaggaggaagaagaggggtgaaatgacatgtggggcccacgtgggccccgtcattttttattaatttgtgtgtgaaactgacatgtgggtcccacggggtttattattttcccgaattgaattgccacgtaagcgccatatcagtgccacgtcagattaagaccgagtcaaattagccacgtaggcgccacgtcagccaaaactgctatcgaaaccgccgagggacctaattcgcaccggttttgttagttgagggatcagttgtatctggttttgtgattgaaagatgaaaatcggattcgttgacaagttaagggaccttagatgaacttattccttagtaaaaccacgtattctctccattttgaaaagcatgatattattgacttttaaacatcagtttgattttattttattaaaagataatgtaatataagttatactaaaataactttaatggtaaaataagccacaaatgatattacatagggtttttttaacaatgaatgatcgaatgtctttcgtattgacttttctttaagggaaaaaggcacagactgccttttcattgaatatagcaggaaaaaatataatccctaggggcgaaaaagggaaaagtacactatacaagatgtggcaggagctcacgcaatcttctggcgctggccagcatccagagcttggcctcttctttgattttggcaagcaaatacgtcgctgtggactccttgtgctagaaaatctgctgattctgctccttccagatctcccgcaccacaaggaggatgagagtgcgccattcttttttgggaactcctaccgtattggccagttccagtttctcccactattcctggaccgactgcgtaggctcccatgccctggttcaagaagatgattctcccaatgatcgaatgtcttccgcattgactagtcagccgaatcgttgctagatactacctccgtcccaaaataagtgcagccatggatatccgtgcccaacgtttgaccatccgtcttatttgaaaaatttgtgaaaaatttaaaaatatttagtcacacataaagtactactcatgttttatcatctaatagcaataaaaatattaatcataaaaaaaatttaaataagacgaacggtcaaacgttaaacgtgaatagtgtaaaactacacttcttttaggatggagggagtatgttaatcaatggccagggttctgatgcaattaaaagccgttcctttatttcagttagtacaatcagagccatttatgacaaaagtataagagcaaggataacagtagagcttacttcctactattagcctatcttaaagccaacatatataatagattagctataaggttggctataattttcttctcctctctctatctctcacatatacatttaatatatttgtcttggagcttgtgataagcttgctcttgcatgagagccaacactcttgatttttcactacctctctcctccacataagcttatagtaaacttatagcttactattatacttgctctaagggcccctttgatttggaggaaaatcataagaattttggaggatttcaatcctatagtaaaatttcctatgaaacctttgaaacaaagcattgaatctaatccaattatttgaaatttctatggaatggacaatactatagagattttggaggaaatttagtaagagcttcaacctcttggtaatttttctttgagtctatctttctcatctaattcctgcggttcaatcaaacgtccattcctgtgtttttcttgtgttttgcaattctctgttttacacttacattcctatcaaaatcctacgtttttcctgttcctacattttctcaatcttgcgattcaaaggggccctaaatgaacctagcatttcttaccaaccaaaaaaaaaagatcttaccgatttcaccctactgatccattggaaatgtatttgaatgtgaacagtgcatcttggatccaaatcaatgctcacgatcgcaagaatgaccactcacattgcagcaatcccagctttagcgtacggagaagaggcaacaccagcaggccggaactggatggaaacagtctgtgtggctcacgagttgcccaatcctgtgctgcccccaatcatgtcaaccaacctgatctgcgtcctgaaatatcatgtcatcgcctcggccccagccttttcgtgtccatctgctatgtgtccagagatttatcctcgtgatctgtctaatgcaaccgcctgtatatatagctgtagttaagtattccatcgtcatatcaccaaaaaggaaaaaaaaatccaagagaaacagcgtcccttctgtattgccgcggttcataatttcatacagcaacccaattgccgcggttcataatttcatacagcaacccaattgcatcagtgcccctatgtggcgatctcgtctgtgcccctctgttggtctagtggcggtcggttacgtttagaagcggccgatccggtgctagccctctcctgggcgtgtgtgttggcgatgtcggcgtgtgggtggtattttttttcttttcctggttacgactctctatggttgtaatcttgtaattttttcatactctatcaatagaacctcgcaccgtctcgtgtgattcgttaaaaaaacccaattgcatcagagcacgaaaaacagttacaaaatcctactctctttctgatttagtataaggcattatctttattcagattcgttgtattatataatgttcaatttattttaggttgtttattttgagacggaggaagtacaccgatacgtgcaaacagtcactctcgcaacagctaagctaatagcttctcaaagtcgttgcgttgtaacaagacaactgaatagggcataaaaccgtgaaactgaacagtacctgttgccagtagatttgcgagttttcgatagagccgacgggtaagctgtcactattcagctattcagctatgacaataatattatcaagttaattatcagaatccggccgtgcaagcacctctccttaattattttgtcatttgtcacctcatcacctcacatcatatcctgatccctggctcccctgtccacaattaaatcgatcactagttgacgacctatctaataatccaaaatttcgatgaagcagcagcaggcagatgatgatgcagattgcgactttgcggatatcttgctcacgaaagttcaagttctttttggaggtagaagagttctattttgtaattgaaatggtgttgttcatggcaacctggagagggaacgaatgatgaagcctatacgattatattacaagcttaatcatcggccaaaatactactcacaggaggaagaacgatcgaatgaagtagctagcagaaagaggataatgaatatgaccaagaaaagctgcgacaggtgaatcgacctggctgctactgcgatcatgtgatcaagaatcggggctctcatggtgggtatcgccggcgacggcgacgtcggcgtcggcgtcgccgtctgtcggctcccacgacgaggcggtgagcagggacaggtccttccacccgagcttgaggcagccgtcctcttcgacgagagtgtagcccttccatgggtacatgccaagaagcagcctcgcctgcgcggcggggctgccggccagggtcaccggccggaaccccgctcgccgcagctcgtcgccccaccgctcgacgcgcacctcgccggtgcgcttggggcccccgacggcgacgatgttccgtatctccgcgccgaggagctgacgctccaccgcgtgccgctccgccgcctcctcctcggcggcccccgcgccgtcgcccagcgcgtcgaacagcgccgagtagtagtgcagcgcctccacgaagcggcccaggaagtcgccgctgtggccgaggtcctgctccacgatggtgatcagcttcggccggaggctcttgagcaggcgcaccgtgccggcgtcggagcccgtcacgtcgtagaggcagtggtgcatccagtgcacaacggtggcctccccgtggtggcgcgggccgaggagcgcggcggcgtcggcgacgtgcccgatcttcccctcgatgggccggaactcgaagggcaagccgagcgacgcggcgaagtcggcgaggcggcggccggtggcctcgaggacgtcgagcgacgcgccgaggccggtgatccggagcgagcgcggcttggtggggcgggaggcgaggatgtggaagaggcccggccactgcagcccctgcatgatgtcgaggtcgatcacgtggacgcggtcctcgccgtcgagcgcctggaagatggcctggttggccgtgaagtgcgagaacttgacgagcggcgacagcgcgttgtacgcctggaacgcgccggagatgcggcggctctgcgcggcggcgagcgggcggagcgccagcggcgagtaggcccccaggtaggagctcagcacgcgcgcgcacagcgcgtccccgaagtaggccgcgacgcgctcgggcgacgacccgaacggcgacgccagctcggcgatctccggcagcaggtcccgcgcctccggcagctggtccatcgccaccgcctccgcacacctcagcaacaaactaagcagccgcagcccacgcgtctccgccgccgcctcctcctcctcccccgtactcaccaccactaacccttgcttcccctcagcagccagccgcttcccacgcgcgcgctcccgctcgccgccttcctcctcgtcgtcggccgcgcgcttcgccttcatcgctgccgcgtcggcgccgggagctcgcgacaggactccctggagcatcacgtcagcctaaacaataatttcccggtgacccttctccgtggcaaaaccactgcaacaagcaagcatagcatagcaagcccgcagctgatgatgataacgctagcgggagagacactgtgagagaggcgcgggtcgccgttagcgttggacgctggcgcgcgcgggagggggaggccgcctgtgcggtttgtcgggttgctggtagctgctctcgcgtcccgtagcgggcggcgcccaggcagagggaatcaaaggacgggaccggtttttttttctactacacaataacacccgatttttctcacgatcgcgcgatggcgagggacgctaggtcgggtcgggtcggcagcagcaggaggccgtgggggaaagctgcacgcacacgagacgacgggggtgagttgatggacagcatgtgatcatttgatggtggaagagacgagcagagcagcgggcgagcgagcgcgaacagtgcgggggacgaggggacggacaaaacctccccctcggataccagcgatcgatcggtggtggagtggggcgtcagcgtctctggttccagcatgcagccttgccgatctctgtagtctgtactagtctgtagagcgctggcccggctggttggttgtctggttgatctcctgcgatgtgagaaggttgtgtacttgtactgggttttttaccagcgtcgttgatgatgtcgcgattggtgggttttcccccgtgagccgcgcggtttctgtactgggtactgactggctcgtcactgtgcgatgcatgtcgccacaggaaaagacggtgtgcggcgtcggcggatccccgctgtcaactcaactaccaaactgaacaacgagagtacagttcaggcaatggtaaaaccgtaacagtgaatccaaatgggccctttgtgatatttttggttaggtttccaattggaaaaagtgctccgaaggtccctcaacttgtcatcgagttacaaaatcgtcccccaaccataaaattagatatatgacatccctcaattttcgaaaccggtcactttacatcctcaagcggttttgatcccggttttgtcctacgtggcaactgaatcaatatgggacccacgtggaccccacatgtcagagtagccacgtcatggcaccctcaattcctctgtctttcccctattatcgtcttgaagacatgggcgatctcctcggacagcacgttggaggacacccgcttcttggtcgtcgccagcggcggcggcgctcactccagcgcggcatcagccgcatcgtccaatccctctggacacggtgcggcggtggcagagcggcaggtgcggaggttccacggccgttgcggaccccgctgaggcaaactgccgacgccgacgccgtcagtggagctgtgggcggtcttctccttgtccggcgacggggtgtccggcaccgcgggtggaggcgatgaggcggggttcttggagcagcggaggaggcggtggttgccccagctgaggttggggaacgagaaacgatggagctgcgtgcgcgatggcggcggcgtcctcgctctccccgttccctccccgccaggccccgacgcggcgcgacggcagcagcctcgttctccccgtcccctccccaccagaccccgacgcggcgtgacgacgacggcgtcctcgctctccccgttccctccctgccaggcccggacgtggcgcgacggcggtggcgtccttgctccctccgtcccctccccgcggctgcggcggcggctgctgctcggcctcgagcgggctttgcccgagcggttgctcgccgctctcgttggctcgggctgcgcagaacgacggggcgaggcggagcgagtggtggaacgggagcgggaggaggcgggtggaggtggtgaagaggatgaggcggctagtggcgaaggcgtcggcgaggaggccggacgcaacgaactgggcgtggatctggaggaggtggcgcgcctgagctgcctcgggtggtgcggtggctttaggcacacaccgtgccggcgtggactgtcgagcgagtgtggcggagccgcggcgtgggaccagcctacagtcaacctccgttgtccgccgtgccatgaactccatcccagagaagagaagaaaagagtgaggggagagagagaggaagagaaaggaagtgagatgacctgggctcctgacatgtggggcccacgtgggtcacacgctgactcagccgccacgtaggacaaaaccagggacaaaaccaccgaaggatctattgtgaccggttttgattagttaagggacgccggatattcggttttacagttggaggacgatttcgtaactcgataacaagttgagggaccttcggtgtatttttttcctttcctttccaattccaaagccccaaaaatgagcagagccagactcggggccgaatgcacgtgaacttggctaatctcagcaggaaaaagtccacttcacctctctcagctatagttcaagtccaattacaatagtaaaatcaaatataggtgctccctcaactatgaaacccggatcaatttatcttccttattggtttataaggcggtttcagctaacacgtcaactatgtgtcacgttgatttggtcttcattcatgatggcaattacgcgacattacaatcagaaaaataaaaaaaagagtaaaagtaaaaaactccaattgaaccacatgctagtgacactgaaaacaatccctctttaatctctaaaacatgaccaacgtgccattctccctcgtgtcttctctccgacaacaacaataccgacgttgatttgtgctgcggaactcaagctcctctttggagtagatcggagacaacggcttctccctagcagtggcaagcggtccccacctctcaagcaagagaagttgcgggacgttatcaccgtctccgtgaaaaaccgctgtctcgatgccacctagatctgagcaactaagtcattggggacataaggaattccctatcctctgtctcattttccctttaagggaattcatcgccggggtgaggcttggagacaattgtctccactgccactatcttttccacacactgttgccaccatgtaggatagcttgagctctgccacatcgctgggattatcctgtccactcaggcctcctcgatactacctccatactcgtctgtaataacagtcacacggaggatgaacagcaaataaaggcaaataggcacactaagcggcacacacggtccgcactcaccatcacttcccctagagagatgggagagggaggaaggaggaaggctgcggagagtggaagagatatggaatgaatggagaggtagaggaagacgatgactagatcctattgttttttattctttttctgattgtgatgccacccgaggtggtacattgagaaaactgtgtcaacgtgccctgcaggatgaaacgaccatttaaattgctcagagagacaaatgaaccagttggggaatcttcatgtctggttttgtggccaagggatactcccttcctcccataatataggaagtggcaaaaggacaatgcatagtacaaaatcaataagtgatggttacgagaataaaatagtaaaactaaactagtaggtggggaaaagatgccagttgttagggattaaactagtactccatctatttcatattatataagtcattttaaacattttatagttaaactctttttaattttgactagatttataaaaacatataacaatatttctcacaaaaatcaaacatatttaatttatattaaaatgagactaatttggtgttatatatgttactaaattttctataaatctggtcaaacctaaaaaaattgaataggaaaaaaaattaaaatgacttataatatcaagtaaaggggtactataaaagaacgtggttgggaaataaagtactacctcaaaattataaaatccattattgtcgacggtgggtactcgtagaccggatatagagggtattggggtacgctggtacgaggatctacgtaatacgacatcaagaaaacaagagacaaagattatactggttcaggccccttaataagtaatagccctaatccagttgatatgggattatatggggatgaccacaaattacaaagggaataacagaactcgacgataccgacgagatcgtagtcgagttgattcgactagatcatccggcgacttggctcctgtaggcttcggcttcgtaggctgtggtcgttgtgttggctatgagattccatcctttaggtcttcccggggggtcccttttatatcacaggtcaggtggtctacaagtaggactcggagacatcggaccctgcacgatatagtgacgacccagtcctatacgggtaggaacctttccattggtggacttcgagacgaatttccttaacgtatacagagaatgtccgtacacgcgccgatgtaccgtattgccgtatagcgtacatccaagggtagagggtatatcttatccgtaacctgacaattatattttaggataaatttagagggcataatcttttatattatggaacggagggactactaaagtactaattagacgtgcgtagtggagagaggcaaatggacttttttcatctcagcacactgtcaacagatgaaattggaggcccaataagcttttgtttgagaacccgcggactcgtagtgcgagcacggcccataagttaatcggaccaactagaagaaactctccttgcatcaatctcatggtgttcgttggggaggagagtccatagagtacgagatcgcggggggacggaatcgccgagcagattccccagtccccaccgcgaccgggcggttcccgatgagcaggagaggcggcggcggcagcggcgggcggcaggggtcagagcccgaatcggcggcggccgtgcacgtcccggggccctgcgccgcgacgcagcgggcgctcgccgagtgccaccgcagcgcggcgcgcggcccgctgaggccggaggtgctgtgccggcacctcaaccgggcgctggccgagtgcctggtgacctcgtgctgccccggggagacggaggccgtccgcaccctctgcgggagcgccggcaccgcgctcaagcggtcccagtgccagcgcgcgcgcatcggcctctccctctgcctcgagtcgcatcaggagccctgagggcaatggagcctacgctggtatagtgaacaagacactttgttctgcaattttctatggatttattgattttgggagatgtgatttggttctggaacaccccttgctgcgtagtgtactagggattagtgtttttatggtatagagatagagcacaaagctgaaggagcaacgagaataacattaagattgtatgtatttgttgggttccagataccactataccatcaatatacatgtttaattgttgcgttcatcaactgctgactgtcatgtccttggataggttggcatgagctacttcacattccccacttacctacttgttcttcttttcttctttattccaaaagcggtctctatgcaaaactaaaccaacgaaaaatggcagcagtatctactcagcaattatagctacttcggaacttcttttctctaagtaatgctaaaaacacattaaattttctgagtcttgaatgcattgctcatcgtctactcaacttcattgttatgaaatcttgtgtagttatctgcatgttcatcatgcaacaccagttatgaccactaagttatgatgtggatatttctttgttagttcaaacaaatgactgtttcttttaaagttttacctaactcctgaagacagtaaggaagtcactgctcttatatatgttttgaaacttgagctgtgaaatcgtccattaaaattcaaaaagagaattttctattcttaaaaaaattgatgccaggttcaaaaattaaaagagatgattgcggcgaatcattttggtccaacatctggtgtgatttttttccttttttaaaaaccccttgtgttctgaagtctagagcgaataataaaacgagtctcattctcccaagtcatgtttttgccaagtacatgttacggtctctcaatgatctctcatttagatgggtcctttgatattgtgcacaactaatttatatgcttacacagcacaaaccgattgcaaacataggtgaccatcatctgttaccttgtttatatgacacttgcattcaggattatctgaagttcatagcagtgatgctcaaatgaggcagaggttagaggttgccttcgaaactttaaaggatgacatgttgctgttttcagctactcatatatcaatgaacttcnnnnnnnnnnnnnnnnnnnnnnaagaaaccaatgagttcaggattaattccagttcctacatctctaccttgcattgtggttgggatgtctgctatataagttatattagatgcatcattttagtaatatattgaggctcagaagtcaaaatcactgtgaactccagattagcagatgtagaagttcgaagcaagtaccctcaagaaacatgcaaattagcaaaataatggatattagcatggctttatgccttacacataactgacataagttgagattttttagccagatttaatttctatgtggaatacttgaccaatttcttctgttgtaaaaggctattatgttttctgctattaataaatcaaaaatcctcatatggatgtatttcaaggtttggaatttttttttttttttgggggggggggggggggagtaagatttgagtctttgagatcttcgattctttccgtcaaaaagatcttcgattctgaattatgacaaatatataatatcccatctgatttttgcatatttttcatttaatttggtagtgttttttcttttttggtgtttatcgtccagccttcatccaaatgtcaatacatggtggcagtaagaatttgtatgcaggattccaatttgctcacgaatcatggggaaaaggaattaattctccgtgccgtcgatattcggaccatagaaagtccaaaattcagcgtgcctgctaagttatacaacccctgcatcaggggaaaattgcgtctgctgctgtgacaaccgacaactgccgttcaaaccttacatcttgatccaaatagagtttaataatttgtttcctatacttcctaccaaatgttctgattttactgaacccggcgttggtgagctgttccattgtgtctataggcatcaagcttcagtggtgcacaggccagcatcactgcatctgccacgctataaaatgtctaaacaatacattaaactttttacactatattcaaagaaatgggcaccgtctagtgccaatttgttcaaaaaatacgtgctgattcgttcaaaaatacgtcttaaccatacattatgttctgatcttactaagcctgacccgtctaatccttttggacattacgtggctgctatctgaaccacgtcaggctcaacactgtcctccaagattagccttgtccccggtgcgacggccgacgggggaggaagaagcagcagctccatgcaccggcttcctctggcctcacggccaccgggtccgcatcgcgcggcggccgccgctcatcgcgctccccagaggacgacgacggcgtgctgcggccgcctgaagcaggaggcgacgccgtcatttgcctctctcgccgtcgctgcgtctgcggcagcagagcgcgcggccacgccgctgttggccgcggcggcgctcctcctttctgccgcatctcctggcttcctagcttccacaccatcaggttaatcctctatctcaaacgtcaggatgcgtagtactagaatctagttcctcttgaagttttttagtggggaagcagtagaggaacataacagaagtaactctgaatgattctacacaagtacaccgagcatgattaattgccaatttaccatatttgctgaaatgtacgcgtcgcacatcacattctttcccccccttttgttgttgtagcttttgctcaatccgaaggcgcagcgctgttccggaaggcgtgcatcggctgccatgatatgggaggaaatatcctacagccggtaagcttctgaaaccattactcgatggccggacacaaattttcaacctttttattagcttgctgatttgtcatgtacagggcgccactctgtacatgaaggatcttgagaggtatgtgtgctcttgaaaacttttaactgctcgaaatttactgcccattgttggattggatcaaggcaaaattaagggcaaatttgctgcagaaatggagttgccacggaggacgagctatacaatataacgtactacgggaagggaagaatgccggtgagtaattcttagctgctatcatgatgatgtttgagtagtatagatagatactcattaatttcttgattgtatgtttgctgcgttaagggcttcggagaaaaatgcaccccgagagggcagtgcactttcggacctcggctggtcgaagatgatatcaagctactggccgcgtttgtcaagtcgcaggctgaaaatggctggcctaagatcgacggcgatggagattagttcaccgacacaacagagacaagtggcaaacattgttcagtgaaccagtgtatagtttggagtcaggtgtgctgtttgcatctgtaaaatcccaacgaaatccatacaaataaaaagtagcttaggccgtgtttagatttcaacttttttttcaaacttccaactttttcgtcacatcaaatgtttggacacatttatggagcatcaaatgtggacgaaaaaaacccaattgcacaatccgactgtaaattacgagatgaatcttttgagcctaattacgccatgatttgacaatgtgatgctatagtaaatatttactaatgatggattaattaaatttaatagattcgtctcgcagtttacatgcggaatctgtaatttgttttgttaatttgttttgttattagtctacgtttaatacttgaaatatgtgtctgtatacttaaaaaaaatttagcacacgaactaaacacagcattagtttcaaaaaacatgtgaaattcatacaaaaaatgtcatgtcaagtgttgtacataggtggcaagtcagctctctgacggcggttggtagggttggtgaggccgagcgcgacggcgaccgcagcatgggttgtggtttaaacacgaagaaaacacgaaagcttttgtgaaacgcgcggcctagttgtgtgtgggtgtgtgaggtgaggggggaaagggcgaaggaaggaggaggaaagcggcgtcgcatcgcacggacgcgcgcgcccgcgcccgcgccgcgcagagatgctgccgcgctcccactcgcacccggccgcgcggcggcgctccggcctgggcgcgcagctctgcgccgtggtggcggcgctcctcctgctcgtctccctcgccgtcctccactcccgcctctcctcctcctcctcctccccgttccccctctcctcctccggcgacggggtctccaactctcgctcgtggaggacgaggacgacggcgccgcggtgctcgaccccacggttacgattacggcgaccaccaccaccaccaccaccaccaccaacgccgccgctgattccaccaccgatgcctcctccgtctccaaccctgaggacgatcccatcgacgagctcgacgtgctcgacgaggacaccgcgtccggcctaggcgcggccgacgaggtccccgcctccgcgtccgcgtcgtccctcgtctgggaccacgccgttggcgtcgcccgcctgcccttccgcctccccgccgccggcgaccccctcccggcggggttacctcacctcgagcccgcgcaccggatcgccgccgccgccttcggatccgacgacgagccggtggatctggagctccgggtggagatctcgtccatcgccggcgtcgaggacgcgttgctcctgaagcctgcctccagcgcccccgagactcccctccgtgctgggtgggcgcggtggctggaggggaaggctgactacctccggcgcgatcggatgctgcggtccaacctagaatttctcaatccccgcaaccacccgctgcttcaggacccggacagccccggccttacctctctcacccgtggcgaccgcatggtgcaccggatgcttctcgccgagatagagaaggctgcttccaaaaattttgagcggcggagtctgcaatcgtctgatattaagcagggaatgggagtaaccgagaaggtgcagcagaggaggtggggatattacccgggaattgatccacatttgggcttcaatgagttcatggagaagttttttgagcatgggaagtgctccgtgaaggtgttcatggtgtggaacagcccacagtgggcgtatggcgtacggcaccagcgtgggctggagagcctactgcggcaacaccctgaagcttgtgtcgtcatgctgtcggagacactggagctggagttcttccaggaatttgtgaaggaagggtatgttcctgtagttctcattctgtgactcttgttaagggtagcatttgattaatcataggtgctaattttactatctaacactaattaacaaagaaatgagtttatgcttctgacccaaaacctgaaatgatttgattggtatcatatagaatccaggattactatttagtgtttgatgtatcacatactactaatattggactcattagtaatgaaactagcaaaaatgtttctggagtcttgtcttattgacacatggagtgaaatctgatcaagtagaggggcctggtatatattccagtttgacttaatttaacaatttttaaatcttacaaaatacaaatgatgctcatagaagtagaacctaggtaattcctagccatttcagtgtttgaaattctgctacagacagctaaggtgttgtcgacatgttaatatgttattttgaatcagcttatagttttcactaccagaactctctctctctcaatggccagtgtccgttggtggctatattgtactgttatttgagctctctctctctggaactcattgtattgttagtggcacttaaaactcaattctatagttttttctgttttgtgatggatttggttcattttctgccactttgcttggaaagtctatagttctgataaccaaactgtgctcctctatatcttttcttttcagctagaaggatccaagtccttcccatttccagtaaagaaatggcagatagtagctctttacaactgaaaggaaagcaacataaaaagagcagctaagctatcacctaaaagatgccatcccatctgttgtagtgacctagcagagagttcagaatgtaaagacacaacgccagctactttagagcttacagacagattactggctgaaaaccaacgaaagaaacaggatgattattgtgtcaaaacacacactcctctttatatgtgcatccatgcatgctttgagccagagtaacccatttaaccccttccccaaatagccacccatgacctacctcaccccattgttttttctcctccattaccttctgtcctgtgtcattaggtcataaacagttcagtaactaacagtctgacatattgaatgctcaacagctacacacaccatgattactaccttgctcctgctgtgctcaagttttttttataaccctgttacttttgtaatttgaagatacatttattttaacatttccttttgttatttgtggagtgggaaagcaacttatctatatattaccgttgctactaactgctaggtactggagtcaaatcatctgttgtcagttgatttcttatattaaataataaaattaagatatttctccacagtaactattcatttaatgttatatttgaacttcacatttacattccagaagcagcttctatttattttgtgtgataactaatgccacttgcatgtgactggtttcctcttacagatacaaagttgcagttgcgttgccgaatcttgatgaacttttggagggcactctaacccatgattttgtatcagtgtggaatgaatggcggaaaacaaaatactaccccttgcattacagtgagctagtacgccttgctgctctttacaagtaagacaagaaaggaccagacttgtttagttacatgcaagcttaacttcactctttacaatctgttagaagaatatagggagatgtcaatataccttcttgaaaataaaatctaatgtagtaatatatccatgtagacgaatccacaagtaatttactcttggtgaaagaataatatctcttacaaaggaactgaccgacaataccactgaaagaagatgagcagctttctgctgaatttaatacactgatttgtaatatatatataaattcatatgcctctaaaagtgtaactagcatgagcgaacatcaaaatgcaaatacagtcaccaacagattaatatattcaattgcttacaaacagccaaagccaaatttacattcatactgaattgaaatacttccttcacaaataaacattcagctaaacagagcataaacatcttattaagaggtgtaaaatgttctttcctttagtggaccactttagaatttctctggagctgacttgagctctgtgtatggattctcagttctgctgagctaaatcagtattttgtttgaatgctgccatgaaaacagttgagtagttgacataacatcaaaaggggggaatcttcacattcacgtatgaaaaaaagatgagtgctacaaactgtgcgaggtttaaatgccagtagcattcttcctgtaaacaaaggaaaaaaagttgaccagcaaatattatgagacttcatagaattttactttcgtcatactttattattactggaccaatagtttgaaagacagtatacttcaattttaattagttatattgctatttcgtctgaactaaacatagtcatgaatacatgtttagttccttttcttttttgaataggactattattgactgctgcctctgtgccctatctgcagatacggtgggatataccttgactctgatgttgttgttcttaaacctttaaacgcactccggaattctattggtgttgtcaaacaagtttctgaaaattccagttttagtggtgctgtattagcatttgaaaaaaacaggtaatagtattatatacttttctttcattgtaactgtttttttttgctttaattctggtcatcttggttaaaatgatatgtggtgcttttctgcattgcaaattggatgtgatttagccagttacccttcaagggctggcttagtaagccaattgatcaagagcaatgtcggaaacgttgttcaaatgtcatcaaattaaatgagaggtctgtgatgtattagccgggtgttactgttatggaagtaataagtcttttagtatgctttaataaattaatgcaatttagtcgaaagcacaagtcagtactactgtactgttatctactccctccgtcccaaaatatagcaaccttgtactggatgagacacttcct

SEQ ID NO: 70665 - DNA, 709 bp, Oryza sativa
tcaccacccagcaaatcatcaaccgaagaagtaaacatgctattccccattatcctctcgctaccttcctgagctgaattttgagctcctgggtcatcttgatcccctgtatcaatcaaatcaggcatctgtgcagcaggtactgttgtctttgtttctgaaaaattattgcttccagtaggttgttccccaaccagcagatttaagacctaagaaaatggcacggtttattatatagtaataattggaggtggaaatagctatagcctagagagagatagaatcaaagagatgcaaagcatgtattctacatagcaatttgcagaaaataaatggtgcattatacaaatttatttattaatggcttgcaactttactgaccttcgaagccttttctctgagagaaacgtgcggaagctcacagcatctaacaacagatgcactgttctcacagaaatatgaagtaatgattgaataaggatcagtatcctgtttccttacaattgcttccaatacacaaattgccttcatgcgaacctgaagtagaacaaatgcattgaatatttatgaatatataaagtgaaaacaatggtggaagtgcttggtcaagataaaatggtattataaatatgatctaatcatgtatataaataatgtgagataatattgtatcaaaaatataagaaaaggtcagagaacatcatagata

SEQ ID NO: 70666 - DNA, 116249 bp, Oryza sativa
cgcgttaattacgctcgccaaccgaagcgacgttaccatatcttcagatgaaacgaatcgccatgtccagattcgtgtgctactcgagtaatgtggcagtcttgaagagaccgctcattgttgacagccgaattaccactgccgatgtgcgtgatttgtgaccgtttggttttctgcccaattgtggagaccggtcccacctgtcaccaggccttaggagtggcgtcacgcccgaccgcttcccttaaggagggcgatcgccctggcataacgccgggggctactgtcggtgacatgggatcgggagtatcatgactagaggtttgaggcagacacaatcgcccacgtggcctggcaccctcgggggacgtcgggcccgagggtgatgtgttcgccctcctcttagtccccccgagggggtcgggctgcacccccctcggccccgagggccgaggcgccctgacccctcgtgggttttcgctccgcgtgtatgggttaggtgagcacagtggggctcacctaaccacattaattgcggtttggctgagcgtgtcacaccgcatgtagcgcagtgcagtgcactcgtttatccggtctgtgaccagtcacagaccggtcagatcgcgggttaggtggcggcaggcggtctgacgcacgcctcgccccatcccgtcaggtcgagggcttctaggcgctcgtccccagctggagctagcgtgttacctcccagagatggcacgttagccctgatcagatatatgccaggcttcatcctaaccattacaggcaaaatgtagtgtgaaggagagccaacgtgcagatagctaagctgacgcgtggtggacaagaatgaccgatttgtgaccattctgacaccggtcatgtcgccagcagacagccatgattctacgtcgcgcctgctcccggcgaaagtggaggtaggtgcgggccgttccatcagaaggtgactcgaacggcaaccatgcaaatctccgtctatttctgagaaggtgggggaaatccccacagaaaaaagagggaaatggtgcatgtggtatccccttaagatataaaaggaggaccttgaccactgagagaagggggagctttttcttggattgattttttccagattcggaacctagaacaagggagaggttggctcacactttgtagctgcttcatacacagatccaccaaaacacaggagtagggtattacgcttctcagcggcccgaacctgtatacatcgccggtgtcttctgtgcttccggtctcgcgaaccttccacatacagattgggagcttagagtctcacccagggtccccggccgaaccggcaaaggggggccagcgcggtctcccggtgaggagccccacgctccgtcatctggcgcgccaggtaggggactctgcgagtgatcttctgagctcttgcgctctttcgtgtgcaccaagcttttcctgttcagcctcatggctgagcaagcaaaggcgcacgacctctctccgagtgtgagtggcgacgacggggagccgaacccacgccgtcgagctcgtactccaccgccccctccacgccaaagtcctaagcggggggaggcgctcgagagggtcgaaagatccgcgacttcaccgatcgcgggcgatggaaaagaacggcgagatggggagcgtcgcctcctcgtctacggcgacggcagcacgccccagggcgcgctccaagctacgggcgcgctcttacgccacccgcctgtcgtccctgacccggagtctccagcccaacgatggctggacgacgtggccaaattggtcatgacggcgcggcagcgcctagatgctggtgggcggtcctccgccaccaaggcctctggtgctgctaccaccggctccgcgtcgtcaagacggagggcacgacgagcggcagccgctgttcgccgttcggccgtcactccttcgtcgactccttcgacccgggaagatctgcgtggggagcaggacgcccgcaccagcatcgagcgccggcgtaatgaccgaagtgctgcccacgcaacggagggcgcttcctcgtccagagtgtcacctcgacacggacgtgggaatcagccctccgtgcccccggttggtggtgtcggctgtagagcctttgtggcgagtcttcggaatgtccgttggcccccaaggttccggcccaccatcgccgaaaaatatgacggcagcatcaaccccgccgagtttctccaggtctacacgaccgggattgaggccgccgggggtgacgacagggtcatggcgaatttctttcccatggccctgaaggggcaggcgcggggttggctaatgaacttgccacctgcatctgtccactcttgggaggatttgtgccaacagttcaccatgaacttccaaggcacatatccgcgccccggtgaggaagcggacttgcacgcagtacagcgaagggacgatgagtcacttcgatcgtacattcagcggttctgtcaagtccgcaataccataccatgcatccctgcacacgcggtaatctacgcgttcagggggggcgtgcggcacaaccgcatgctcgaaaagatcgcctccaaagagccccagactaccgcggagctttttcagctcgcggaccgagtggctcgtaaggaggaggcatggacctggaacccctccggttccggagtggcagcttcggccgcccccggatccgccgctcagacagggcggcgtgacaggaggaggaagaagaggtcagtccattccgacgacgagggtcatgtcctcgccgtcgagggcgcttcgcgggccacccaaaaggggaggccagcgagcgacaaaaagaaaaaggccggcgctcccagcagggagcgcccagccggcaagtggtgcaccgtccacaacacttcccttcacgacctcgcggactgccgtgcagtcaaaagtttggctgagcggacgaggaagtgggaggaagagaggaggcaggagcgccgagagggcaagtccccggcggttccttccggcaatcggcgaagtgaggccaagaagaaggcccccgccgaggacatcgacgacggcgatgatgacctaggtttccaagagcctggggccaccattgccactgtcgatggaggagcgtgtgctcacatttctcgccggagcctcaaggccatgaagcgagagcttctggccgcggcccctactcatgaggcgacgcgccgggcgcggtggtcggaggttgccctaactttcgaccagaccgaccacccaccgtgcgttgcccggggagggcagattgcgatggtggtttctcccaccgtttgcaacgtgaagttggggcgtgtcctcattgatggaggagcagccctcaacatcctttcccccgcagcctttgatgccatcaaggccccggggatgatgctccggccgtcccagccaatcatcggtgtgacgccggggcacacttggccgctaggtcatatcgacctcccggtcaccttcggtggacccgccaatttccgcacggagcgagtgaacttcgatgtggcggacctcagtctgccctacaacgcggtcctggggaggcccgcgttggtgaagttcatggcggcggtccactacgcctacctccagatgaagatgccgggccccgatggccccatctctgtccatggcgacctcaaagtcgcgctcgcttgtatggagcagcgcgcggaccgcctcgccgtcgtgtccaagcccgagggtggcgacgagaggcttggcacatccgcccccgccgccccgaggcagcggatagtcacgtgcgatgaggtcccagtcaaggaggttgtcctgggcgacggcccgtccaagaccacacggatcggtggtctcttggatggcaaataggaagacgcgctcgtctctttcctgcgggcaaacgctgacgtcttcgcatggagaccggcggatatgcccggggtccccagggaggtgattgagcaccgtctcgccgtacggccgggcgcaaggccggtccggcagaaagtgcggcgccaggccccggaacgtcaagccttcatccgcgaggaggtggcgtgacttctggaggccggattcatccgcgaggtcatccatccggagtggctggcgaacccggtggtcgttcccaaggcgaacggcaagcttcgaatgtgcatcgactacaccgaccttaacaaggcatgtcctaaggatccttaccccctgcctcgcatagatcagattgtcgactccacagcggggtgcgaccttttgtgttttctagatgcatactctggttatcatcaaattcgcatggctagggaggatgaggaaaaaactgcgttcattacccccataggaacttattgttatacgacaatgcccttcgggttaaagaatgcaggtcctacttttcaacgtactactcgaatttctttgggtagccaattaggacgtaatgttgaggcttatgtcgatgacttggttgtaaagacgcgcaaccaggaaacgttactttcagatctagcggaaacttttgagagcctccgctccgcccgcataaaactgaaccccgataagtgcgtgttcggtgtacctacgggcaagcttctcgggttcttggtctctgcccgaggcatcgaggccaaccccgagaagatacgagctatagagcggatgcgcccccccagcaagcttagggatgtgcaatgcgtcaccggttgcatggtcgccctaagtcggttcatatcgaggctgggagagaaggcgttacccttatttaagctcctcaaacgctccgggccgtttacttggacggaggaggctgaacgtgccctcactcagttgaaggtgtatctcagctctcccccagttctggtcgccccagagccaaatgaacccttgctactctacttagcggcgaccccgcaagtggttagtgcggcgttggtcgtggaacgcgatgaggacaatcctcattccgcgcacccccaccttgtgccgacttggcccgggagagagcagggaggagaggcccccgagccgaacggtggcccaaggcccccgacgaccggagatggccctctgcccgcttgtcagacggtgctaggagcccccgacccccaggaaggccccgaggccactgcgggaaggccgcacctatcgccctctgaccccgaggctaaccctgtgccgatttggcccgggagagagcagggaggagaggcccccgagcagaacggtggcccaaggctcccgacgaccggagatggccctctgcccgcttgtccgacgacgccaggggcccccgacccccaggacggccccgaagccactgtgggaaggccgcccccgtcgtcctccgaccccgaggtcgtcggcacagaagacgagtgcgccccgcgaggccgctcgggtgaagagcgccccagggatgcggcccctagcgaaaaggatcggccccaccgaaaggtgcagcggcccgtctactttgttagtgaggccctccgggatgccaagacccgataccctcaggcccagaaaatgctttacgctgttctgatggcctcgaggaaactgcgccattatttccaggcgcatcgggtcactgtggttacgtcttaccccctcggtcaaatcttgcataatcgagagggtactggacgggtggtgaaatgggcaatcgaactttctgagtttgatttgcactttgaaccacgccacgctatcaagagccaggccctcgccgactttgtggcagaatggaccccggctcccgagctcgtctcggtccccgaaaccggctcgggtccctcgcagctgcctcacaccgcccactgggtgatgcagttcgacggctccctgtctcttcagggcgccggtgcgggggtcacgttgacctctccgagtggagacgtcctcaaatacttggtccgcctcgactttcgagcgaccaataatatggcagagtacgagggactccttgccggactcagagtggcagctggactggggatccgccgcctcctggtgttaggcgattcccagctggtcgttaaccaagtctgtaaggagtaccggtgctctgactcgcagatggacgcctacgtgcgccaagtacggcgtatggagcgccattttgacgggattgagcttcggcacgttcccagacgggataacatgatggccgacgagctctcacggctcgcgtcctcgcgagcccagaccccaccgggcgcctttgaagaaaggcttgcccagccgtcggcgcgacccgaccccttaggggagacggatgcgcctaaccggcccccgaggcccgtcggagtccaggcctcgggacccgaggggagtgctcccagctcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcactcctcgggaacaaggcgttgtgcttcttgccgatatccatgaaggcgaatgcggagcacactccgcctcgcgcaccttggttggtaaagcttttcgccaaggtttctattggccgacagctctcaatgatgcggtcgacctggtccaccgatgtagagcgtgtcaattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaaacacggcgattcatggatcgaggagttgccagcggtgctctaggcgaaccgaaccacaccaagccgagcaaccggggaaacgcctttcttcctcgtctacggcgcagaagcggttctcccatccgagctcaccctgaggtctcctcgggccaccatgtactgcgaggctgatcaagatcagctttgtagagatgacctcgactacttggaagaacgaaggcggcgtgcggccctccgagccgcacgctaccagcagagcctgcggcgctaccatcagcgccacgtccgggcccgatcactctgcgtcgacgacctcgtcttacgccgcgtccaaacgcgtgctagattgagcaagctctcaccaatgtgggagggtccgtatcgagtgatcggcgtcccccggccgggctccatacggctggccatgggcgacggcactgagttgcctaacccatggaacatcgagcaccttcgtcgcttctacccctgaggggggggtcgggtgtcaggtttcgggctcgggccaaccccgtaccccccccctcgggtgtgcatggttggccgggggctaccacacatgcacattctcttttctcttatttcagtatttcaataaaagcagtttcaatttcctaagggctgtatctgtgccgttttttcctttttgaagaattttgacttgaaataagatcactcgtgctcaaccttgccctcgggggctcggttcggtcagctaaaatcgccaaacggggcccagaaccgagccgtgccctggggcgtggtgaactccgggggggggaatcggcaaaaacccacaatcgggtcacccataaccctcggtcaccacgttcccggcctggccagcctcgacatgtggatctccccaggcactagccccgacccgcgcctttcgaggactgggacttgggcacgagtccttaaatcaagctaagacacaaaaggaccacggcacagatcatcctcatctcatttgtatagcaaagtaaaattaacacaaaaattttcatcatttttgattgcagattaagttgatctatacaaaaaagaggcctgaaggccttagaagaaagaaaaagaaaaaactagagattagcgggggcctgggggctcaatccgatgcgcccgggtcgccggcctcgtcgtcactgtcgtctgcaccgctggcgtcgccctcctcgtcggagttgggggcgaacgcgagccgaggggccgagccctcgaagctgtggacgatgtggtcggcggcatcccggacctgcgcgcgcgcgctgtcttcagtcccaggagggaactcatccagcgccatccacggagagaagttggggtccctggcctggtagctcgccaggacgagctccaccgctccttgggcgaggtccctcgaggatgacttgacggtcttctcgagctcctcggggagctgctggagagccccggccatcttcgagaggtgctgagcgaggcctccctggttggtggagtacttcattgtctggcctttccagaggcccgcctgccgaccggcgcgatccagatgggagactgcatcccaaagcatgccgggccctatctcgcccgccaagcggagggcctcggcttccccggcggatgagtctagcgcgcgctgcatgtcggcgatggtgagttcggtagctgcgaggcgggtggctaagtcactttcgcccgcagccgccccgccgctgcgtgccctcgagtccagctccttctcccgcgcctcgaggtcagcggcccgctggtccagtgcggccctctcggcgcggacacattctagattgcggcgtgcctgctccgccagcgctgcctcacggagggacaggctgtccgtcaaccgttgcgccgcggcctcggcctcttcgagagctcgctcccgctcggtaagcgcgtcctcgcggaggcggagtgcagactcctcttcggcgcaggcagactcgtgcgccgccagcgttgcctcccggatggcgacggcggcctcgcggtccgccaggtccttctccacgacgcaggcgcgctcttccagcgccatggcacgcgcctcaagggcctcttcacgccgccggagcgccgtttcggtctccgttgctcgctgctctcgggcagcggcggcatcaaggaccccctgggcggcgtcgagctttttctttagctccgcctcccagctcccgtattgaaggcggagggtgtcctgcgcctcgttcatcacggtggtggcgatgagggcagccccccgctcctcctccacctcttgagcgatctccgccagcgccgtcttacgggcttcaagatctgagacgtgccggcggtgtgccttgcggcccgcttccaccatggcctccaccgatcgccgcccctcctcgacacgcgcccatgcggcgtcgagctccgcacgctccgcctgcagggcctccacctgggcacttaacccatccaacaccgcggtgtttgcggcggctaaggcctgcagaaggggctctgcgctcagcggggcgacggaaggcgtggggaagagctgccttggagaagatgtcgcgcggctcggcccgccaatggacgtgccggactcggggatgttccccggacctgtttggtcctgggcgtcgcccgaaggagtgggcccaggcgacgcgcccgcagcctcgtcgccagctgccccggaagttgtcgcctgagcgtcgcccgagggagtgggcccaagcgatgcgcccgcgacctcgtcgcgagctgcctcggaagaaaccattgcctcgtcctggcgaaatccggctttctcccgagcggcttcctcggcctggtgggctcgggcggcctcctcccgagcggtatcctcagcctggcgagcccgggcggcctcccgggcggcctcttcagcttcccgtaggcgatctgcggcctctcgccggtcagattctcgcctccgtgcctctgcggccgccggatcctcggcctcagattggccagacttggaatgacgggagggacgcgacgggatctcgctaaaacagaagaaaagaccagaagacgaacaaagacgggtgagtgaaaactcgcgttgaagagaatggatacagccacgatgagtgagagatgaacctgcgagggggtcggttgaacgaccactttggaggggagatgaggtttccccgagatggttctgtctcccccatcttgcggagccgtttcttcttgcgctccccctcgggctgtgatgttggcgcggccccctccgggcgcctgctgctggcacgcactgccccgccccctcggggaggagatgggggaggtgttcgtcccagcttcctcttcccccggtcgtcgatagggcggttgctccccgagcccctgacgcggggcccagaagcacgaccccctcctggggtagattgatcccccttgcggctcccgcctgcgccgtcgtggccctttggagctccctcctctgaggccccgactgccgtcataatggtcaagatggaggcgcggtctggatcgctgcagagggggaggattccttggggaatgagggccgcctccacggagttgagattcagcacccgttggaccaatatcttgaagtcctcaggagcccagtcccatctcactccctggtgggtcctcatgtagtcttcggacccggtgtactcccaggcgccccgagcgcgccgctggagcggcgcaatccgacgacggaggtagtcgccatacaccatggcccctgtgagcccctgggatcgcaggcccgccaggcggtcgaggacagcgtcatagccatcccccagatctaccggcgcccgccaactggaggcctgcgccgggggctggctcggaagtcggaggcgcgcttcgtcggcgaggggagtgtagaaccaatcgctcttccagtcgtcccacttcttgcggagggcgcaggggatgtagcggttcagcgccggcccccgtggctggaagtagcagccaccgactaccgatggcggcgacaccgactgcacggtaaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatagcggaaccagccctgccattgcaaaagggagaaagaagacggaccgccccgggtagtctgtgtcgcgaccgggaaaattgccttttcccgaacgccagtgtattaatccccgtcccaggaaaagccggggtacaccacacaaacatggtataaaagacacatctttattatatcgataatatttacattattacaaaggcacttcaggcctgacaaacaaaaataaacagcagcggactagcgggcctacggctccatcttcacaggcgctcaactggggtataagccaggactccacctaagacttcttctccaaagcttctcttactgaaggggggaaaagattgagcaagaatgagtacaaccacagtactcagcaggccacaccggagatgcacaattaatgcaaaggagtacaaggggataataagataggggttaagttttgcagtaaacggcatttaaaagtcacttagttgcccaaagccattttataaagacgatcctagagctacacagtattattaatcaaggccgtgaacccacacgaacctgccttaacccaaggcctacgatgattcagaccgaactggcaacccgaccctgggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaatcctgcctacggccggaacccccgggacaggcaggcaggactgagccccaagcagcagggcaccaaccctctgccacgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaaggggaagagaggtgtatgtccaattccaccataaaccaacaattccaaagtgtccaaatgatatgagaattcccaaagtctaaagttataaaatcacctaatgttgcctaattaaccagcgaagcatctacctaagttcatactagtggaaccataaatagagtacccactagttggggttttattttcctagggtgaacaaggtaataataacaatagcaataataatgtcttaacaacgataaataggcatggctaaataaaacagtgataacgcgggaatttaaataaagcggtaatgcaataatttaaatcaaaataattttataaactgtgattcaatatgctcaaggatgatgtgacttgccttgctcgctttcccaaacaccggcttcaacttccacgaagagcggatcttccgaagctgcagcgtctacacgactaacggaaaagaaacggcttttactctaataaactccacataacagcagaaacaaagcacaaaaatgggttcttgacttcttaaggaaaaattagagacttgaacggtccaattccgagttcaaatggccaagatatagccatttgaagtttatatgctctttaaatggatatttacgaatttcttcatttaaattttaattaaaaactcatttattgcgtcagccgggagagagggcgcgcggaccgggtccacgggagtggggcccacgcgtcagcctctcggtccacggtggaccgggtgcacgcggctgacggcggccggcgccgtgggtcccacgcgtcagccgcacccgcgggcgcgggcggctgacggccgggccccacctggcagccgcggggcgcgcccgaaggcggcctcgccggcacggccgacgggagacggcgcgcccgcgccccgatggtcaccgccggcgaccaccggcgcggcggagcggcgcccgagagagcggagaagagagggaagcgaaaggggcggtccacggttcaccccgggacgacgaggacggcggaaacgacgaccggagtggaggaaagcggcggcgcggttcgggacggcgaggacgacggtgctccggcggtcggcgggcgaaacggaggagcggacgaggtcgacgacgacgcggcgaagccgatggaggtgacgccgagacgggaggaagtccggggcgacgacggcggcgaaccggagctcggcggcgacggcggagagagaggaggacggcgcgagcacgaatccgacggggagagcgagcggcgagcggcggaaacggaggagagaggcacggggaacaattatatagcgccgggagggagagagagaggccggaggggaaggaaacggccgcggcgatctcgggcgccattgatgccggcgaggtttaggggaaagattccgagcgaatccgagggagagagagagggaaaagcggggggaaacggagagggaatcacggggagtgatttccccctctttaatgcgcgcggggatggcgggatgcggcggaatccgcggcggcggcggcgctagggcacgggcgggcggcgggagcggcgcgaggaaggcgatgacaggtgggccccacccgtcagcgagggtggcgggcgggcccgcctgtcagcggcgtgcgcgcgggggaggggccgagtgggccgcggggaggagagagagggaaagagcgaggtgggccgagccggcccaagagaggaagggggggaagaagacttcttttagggtttttctttttataaacctttttaactttgtttatttcttaataattattatttgtgctctgaaaattccactaaaatttgagggctctttttagaccaaggagaatttaacaaaaattctccgggccacatttgaatttttcttgtacgtattttagtgtttgccaatttcttttcgaattttaattaattctattattccttttagcgaatgatttttaattcgggatgaatttatcaggacgtgacagtctggcgccgggcgtccctcgcccagcgtgactatctcccggccggtggccgattccggcatgaagcggcgcggcagcccagcctgcctctcgctcacgatgcgggagggcggcagcacgctaccatcgagcagagcggagccccgtgccatggcgccggaggaagagaagattaagagcgagcgcgtgtggcgagggtagggcgcaggaaaggaggagttagggcgcaagcagcaaagacaaggggaataatggcgaaaggaaggaaacaagtcccttcctcagtgcctttatacccttgccaacgctatgcccggctcctcgtttctcgcgcccactatttcgccccctcgtttctcgcgcccacgcttccactaatcccattcgcccgcttgcggcgcatgaggtggatatgcggttgtggcggtcgaggtagatcatatcgtgcgcgcgttaattacgctcgccaaccgaagcgacgttaccatatcttcagatgaaacgaatcgccatgtccagattcgtgtgctactcgagtaatgtggcagtcttgaagagaccgctcattgttgacagccgaattaccactgccgatgtgcgtgatttgtgaccgtttggttttctgcccaattgtggagaccggtcccacctgtcaccaggccttaggagtggcgtcacgcccgaccgcttcccttaaggagggcgatcgccctggcataacgccgggggctactgtcggtgacatgggatcgggagtatcatgactagaggtttgaggcagacacaatcgcccacgtggcctggcaccctcgggggacgtcgggcccgagggtgatgtgttcgccctcctcttagtccccccgagggggtcgggctgcacccccctcggccccgagggccgaggcgccctgacccctcgtgggttttcgctccgcgtgtatgggttaggtgagcacagtggggctcacctaaccacattaattgcggtttggctgagcgtgtcacaccgcatgtagcgcagtgcagtgcactcgtttatccggtctgtgaccagtcacagaccggtcagatcgcgggttaggtggcggcaggcggtctgacgcacgcctcgccccatcccgtcaggacgagggcttctaggcgctcgtccccagctggagctagcgtgttacctcccagagatggcacgttagccctgatcagatatatgccaggcttcatcctaaccattacaagcaaaatgtagtgtgaaggagagccaacgtgcagatagctaagctgacgcgtggtggacaagaatgaccgatttgtgaccattctgacaccggtcatgtcgccagcagacagccatgattctacgtcgcgcctgctcccggcgaaagtggaggtaggtgcgggccgttccatcagaaggtgactcgaacggcaaccatgcaaatctccgtctatttctgagaaggtgggggaaatccccacagaaaaaagagggaaatggtgcatgtggtatccccttaagatataaaaggaggaccttgaccactgagagaagggggagctttttcttggattgattttttccagattcggaacctagaacaagggagaggttggctcacactttgtagctgcttcatacacagatccaccaaaacacaggagtagggtattacgcttctcagcggcccgaacctgtatacatcgccggtgtcttctgtgcttccggtctcgcgaaccttccacatacagattgggagcttagagtctcacctagggtccccggccgaaccggcaaaggggggccagcgcggtctcccggtgaggagccccatgctccgtcacaggtgattgggatagatcggtcatcatgccgagaccgtataaatcacttagatcgaaatatacatctataacaggactatatatgtttatagcgtagccgatcagatagatctagcgtgtatcggctaatactccgatactactctatattaagatattgaagcaataataatatatcaaacaagagtttaacatatttagttatggcagtatcttaacataaatggcagatttaacatattaatgaagcaaataggataactgtagttaaatcagatacgatcggctgaaactccgatgctattctaatcaacaactaggtggcaggctagagatcaatattctaagcacgacttaatagatcaaactcgattgatgcagcattaagtatgaaaagaagaacaatatctagacaatcaagccgctagaagattcatagaatggtagatatcttatataatctaaatcaacgttgagatctaacctaatcggctgtcttttgcgtgcaaatgtctgccgaagatagattagacaatgatactgctatagattatgtaaaatatatgataacttgacgaattatataaatgagatacgagtgtcatgaagatggaagcgctaatccctaagaacataattcgtcataacgagttttacctcttgtcgaagatcgaaaccgatgcagctcaacccgaaagcaagaactcgtcgaaataaaactaaagcaaaaggtggcgatgcgccggaattatattgaatgtgtctgtctaaattacatagggctcggggtctatttatacccgaggattacaagatatgcccataccggacacgactattatctctaacaaactctaaactatcacaagtctttgcggcagactcttgcccacacttatctataaggaatttacataaataatcctaattaatagatacaattgatttcccaggactctatccatgcgtggcaatcatcttgaagcacatcaacctgagccggacgtcgcgcacaagttcttttgtcagaatcgactgtatcggcttatttagcttaacccgacattaggcgatcctagccatagccgatcctaaccgtagccgattcagactccagccgattcttgctctgttccagaactcgatctccgcctccaactcttcttgaccaaatcccctttactgatacgaatacttaccaaattctgttgttaacagtggcgcatacaactatacgatacgggggctgctagctggcgcgtgcgcgccaacagcgagcactccctcctcccctttagtcttaaccactatattagttaatatagttaacactaatggtggtaactaggaaagattctggagattttttgggagatttttttactaacagattgaaaatattttaggttagatttgaaaactttcgatttaagttttaaattttaaagtcaaattttgaaaactttcaactcagatttgaaaactttcaactcgagaatcgagattcaaaaactttcaagtccagatttgaaaattttgaaaactttcaatttgagatttgaaaactttcaactcgagattcgaaaactttcaactcgagatttgaaaactttcaactcgagatttgaaaattttgaaaactttcaaatcgagatatgtaaactttctagtcgagatttgaaaactttcaagtttaggtttgaaaattttcaactcaaaatttataaactttcaaactcaaaacatgataaagataaaaaaaatcagaaaaaagtaggaaagaaaaggaaaaaaaggttaaaaaaacgaaaaaaagcgcggagaagtcgcgcgtgcgccgacgcagcggcgctgggccttctgggcctgaaacgcgcgccgccggcagcacgcgcgctaactagcattagcgcggacttaccgggggttcctaggaggcgcgtgcgcgccgactgcttaattcgcgcagccgcgcgcgtctcctcgacgtcttgtccgcgcgcttccgccgctaattatggcaattagtgttaattactgtcattagtattatttttaaaacagtaacaacgtaaataattcagttaccagttttttttagaaaagtaatggaaagttttaaatttgtagtcaaaagattttgaaatttgagctgaaaattttaaattttgatttcaactttttaaattttgatatagaagttttcaagttgagttgaaagttttcaaaattgaagttgaaagtttttaaatttgagtaaaaagtttcaaaaattgagttgaaagttttgaaatttgacttgaaagtttgtaatttgatttgaaagtttcgaatttttagttgaaagtttttgaattgagatgaaaattctaaaattgtgagttgaaaactttcaaatttgaatcgaaagtttttgaattttgagatgaaaattctaaaattgtgagttgaaaactttcaaatttaaatcgaaagttttcaaatgctgagtggaaagttttcaaattttgagttgaaagttttcaaaattttcaatttaaaaatttaatcttctgttaaaaagtttagttaaatgttctaatcactgcgtgcatgtatgtacgtggattgtccaattacaattaggagatactattactaattgagtgtgttactcaacgtgcatatggggcatatatacgtacatgactgaatcatcgttaatcaccgttgaaaagtcactaggcccagcaggcccatgtcagacgcgaagctgaggcgctgccgtcgcgaaacgctcgctgacttgcgggaactagcaatcttgatacgggcgtcctgcactgctcgagccatgcgcgtacaaccagacgtgtataaacacatggtggacgtactttgacctgaaaaagaaatatacatggtgcacagtggagaaggggtggacaggacagaggacacacgggactagtttgtggatgcaagactctttcggtaatgaattacaaacaacgccttgcatgattgcatcatcgccctaaattgaaacagcgatgatatgataccatctctggttgttgcatttagcgacaggcgatcagatcagaggaacgccggtaataactgaactatcgtcgtcctagctagttctcaggcggactgggaggggtcgaagtaggcggcgtgtcctcccgacgagatgtcagcggttgagatgaagacggcgtgcgtgaccggcgggaacgggtatatcgcttcggcgctcatcaagatgctgcttcagaagggatatgctgtcaacacgacggtcagaaacccaggtggtattatttcccgttttaatcttctgttcatacgtattcagcccttgttaagttccaaacatttttatcaaacttccaacttttccatcacatcaaaacttttctacacacaaacttccaacttttccatattctaatttcaagcaaacctccaattttgacgtgaactaagcacagttaaagttttccttcctttcagattcaggggtggaatctttggtccgcagtagcatattttctgaattgtcgtcatgaacaacagaaagaaagtcctactttgtgataaaaaagattctagaaaaataataagatatataccaatccagagatatattcaaatttcaacttatacaattattagaacaaaaataacaaatttggttgcaaattacacgttttatttgagtcaaatttgtcgttttcatttctacttatgtaagctgattttgaacttgtattgtttgtgaaataatatatcacatattgatcaatcttgttaattttttaagaaaaataatgattttttttggcgaaatgcaaaataacgagagaacattcccgaggatgaatatttttttcgcgaacgcgcaaaaagattgcacttcaatatatattagaagaaaatgagtttttgttacacaacacaatcagccagactggcttatgccaaggaaagaggaaaaaagcaaaaaaaaaaaaaagtaaactaaagcttaggaagtactacggcggctaaacgcaactcctaacagcgggaaggggcatagccacgctacactcccaaaaaatccccaaaagtggcaccacagatgaccctccgagaggatggattccaggaccacagggactgaagagagcaccgagtcaaaaacccagaagttccgttccttccacggctgccaagagaccagagcaccagggtcctgaggatgaatagaattttcccttctacttagcaaatgccaaatgccactcttacctgcaccatgtagaaaatattttttttagataatgtagaaaatatttacatgttcaaaccgatagtcgcacctaattcatatagtgaaatatgctggaaaggatgcaaatcgttatgatctcaattctcaagacgacgctactacgagtttccagagttcagttctgcctctgaagatcctactcttgtgtattcagatgacatgaagaagacttcccatctcaaggacttggaagcactaggccccttggaggtcttccgcgctgacatggacgaagaaggcagcttcgacgatgccgttgccggctgcgattacgccttcctcgtcgccgctccggtgaatttccagtcacagaatcctgaggtgaacagctagctaattagcgcgctttctctaatcgacaccactgcatgttgtgttgtctcatctctgatgatatatatatatatatatatatatatatgctctctaagtctccagttctgaaattaatttgctcttgatttctacgatgacaaagctgcatttgtacgttaatttatggcagaaagagcttattgaagccggcgtccaaggaaccatgaatgtgatgaggtcgtgcgtgagagccggcacggtgaagcgcgtgatcctcacatcgtcggcgcccgccgtctccggcaggccgctgcaaggcgacggccatgtcctggacgaggattcctggtccgacgtcgagtacctgacgaaagagaagccaccagcttgggtcacgttctaccttttttgagcctccatctcatccctacaatttttttgataatgcatagaaatccatctctatatccactcaaacaaacgttacgaatagaagtacttaaactctaaaaagaagaaacaatgctactactagaagactagtatactccataaagatgatgacgccctaatgcttatagatggccatatggctcgagacccgcggcccagcccaaggcatgccaatttagcccggcccaagcacgtcacagcccaaccggggtcgtgctcgtgccggcctgacccgacagccgggctgtgcttgggccactcccttggcacggtggaccggtccggcacggcatgatcgaacaaaaatagtggagggatgtaaaatagacttatgctagcccaaagacaagaggaatacaaaatagatttatttttcagccatatgaacacagcccacagagtttaggtaggaaaaatagacttattctgtagagaagcacgataggttgtcgtgccttcgggctagcccagcacggcttgagtcttactgggccgtgtgtgtagcccgtgagctggcacggcacgtcccggtgtgtagggccaggccggcccgactgacctcaccctaggcatggctgtgccgggcgatctatttggcatctatactaacgttagcataccccattattgtttttcgcaggcgtatagtgtctcaaaggtgctcatggagaaggcagcatgcaaattagcggaggagaacaacatcagcctcatcaccgtgttcccggtgttcactttgggtgcagcgccgacgccgacggccgcaacaagcgtctcagctatgctctccttgctatctagtgagaacctgatcgagagacatgcgccaaattagtttaagaagatcagcgagcacaaattcgactgatcgatgctagctgttttctgttttttcaggtgatgagacgcagctaaaaaccctgaaaggcctggcagcaaccggccccattccgacagttcacgtggacgacctctgccgcgccgaggtattcgtcgccgagaaggagtcggcgtcggggaggtacatctgcagcagcctcagcaccaccgtcgtggcattcgcccgtttcgtggcaggaaagcaccctcggtacaacgtcaaaactgacgggtacgtacttacgtacgaactggcaatctggcactctcagtttcgagttatagcgacacaaacttctactacattcgttttaaaaaaaatccaattctaaatttgaatctggacataaattcaggattgggtttttttttacggaggtagtacggtgaatcagggaagagaactgacggtgaatcggtgatcgtctcttgtatgcgtatattggcagcttccaagggttccctgagaagccgagagtgtgctattcgtcggagaagctggtgagggaagggttcgagttcaagtggacggatctggacgaggtatttgacgacctcatcgagtatggcaaggtcctggggattctaccgcaatgaaccgctgatgatgctccttcactttggagtttggactggtcactcttgtgtgaaatgaagtcattgtcgtggtgtgttagtacttgtcacgacacacggtatggcaagatacgataagtacttctattgttatgggctctactacaaataaggaagcgatggatcggccgcacaaattaggcccatcacaatgcaagcgtcatatcccgcacgattctgaatcacaccacgcgacgcgacgcccgcacgggcaacagcgacaccgcactccgcacgcaggcacccgcgatcgcagcggaaaccgccacataatgctgttcgcgatgagcccccccgcgtaccggtgaatctgcgtgcgccacgcgcgcgcgacgccacgcgacgcgtgcagaatcgatcgcgcgcggccgggatgggatccggacgggacgacgattgatctcggagcgagtgaggtgcggcgttaagatccaacgcaggagtcgtgacatcctgcacgtacgtacacgtgctggacttggactgacgtggtggcagcagctactactgcatgccaaaacccttgagacgtcgcgagcgaatagaacgccactgcccgggcggacaccatgtgggactaaaaaaacgtacacgatcgtacgtgctcgatcgatgacgggagaattggaagggagcgcatggtggacacgaggaaaagagaagatttagaaggaacgtatggtgaagtattagtatataatttattactccttctgttctagattacaagacgttttaactgttttaagtttgaacaattttgtaaaaaaaatactaagacaaatttattaaaaaacatatttaattattgatttgatgaaactaatttagtattataaatattactatattacctataaactttgactttgaccaaagttaaaacgtcttataacctaaaacggagagtaattataaactatcttgaatttaaaaataagttaatatgatttttagaataatttttctatataattttcttaaaaaaatccatcaatagttcgggaaacgtgtgtgcagagaatgagagaaatcttttctcagtgtacaactgcataacacggtcttaaagagaaatcttctctcaatatatagctgccgaactaaataatcatagttctccataaaaatgaaaaaaaaaaaccttatcattagggatgtgtcgggcatggccagctatgggcacttgggcagcagtgcagcactgccccactccgatacatcgatggcaatccttttcttctcagccggataaagccttgtagatataaaaaattgacttctcaaatcatctggttggactatgagtagaccaaatacattacgcacatttctcttgagcatatatacgccactaataaacagctcaagacaaccaaacgcaggcgcccatatcagccacggcatgcattgccatacttaatccatgttagattcaaagtcgccttatcggataggtatttttgtgcagcacggcaacctgtccaaaaagcacacaagtactagtacatgactgtaaaatgcaaagccaatcgcaattacagtcttccaattccaacttgtccaaagatacttcaccttggagtgcgtttagtttacgttaaaattaaaaatttggttgaaattgaaacgatgtgacaaaaaaagttaaaattttatatgtgtaaaaaagttttgacgtgatgaaaaagttgaaagtttgaaaaaaaaaaggtttagaactaaactcagccctaatgcatccaacgatggtaatcaccacgccagatgtgacaaatacgctgtagatccaaatcctggatcggaagagcatgtactagcagtagtccagaaaaatgattttgtcgcaactgttgacagtaagcagagttaagaaactgcgtaaataacttccaaataaaacaaacaaaacacacacaactcacacaaagtacacaactcacaaacacaggcaactcgctctccctacaaatacaacagggcgcaccgtgcaaaaacgcatcgccccccacgccaccgagcgacacgcacgcacgcacacgcgcgcgccgaccgagcggatagccatgtcgacggaggcgctcctcgccggcggaggcggcggtggcggtggaggcgaggtgaagcggcgcgtgagcatcgacgacgcgctggcgtggcacgcgggggagttcgggcggtggcagctgcggcacttcgtgctggtgtcgtcggcgtggctgctggaggcgctgcacaccatggtcatcatcttcgccgaccgggagccggccatggtgtgcgccgccggggacggccggtgcggcgaccgctgcgccggcgccggcgccgccgcggggaccgggtgggagtgggccagcgggcgcgcctcgtcgacggtgtccgagtggggcctcgtctgcggcgagcggtacaaggtcggcctcgtccaggccatcttcttcgccggatgcatgattggtcagtgctccaattctcgtccaaattaccttcgtttccaagtagtttttttttttgacgaattacgcaacggaatgccaaaatgcaaaatactaagattggatgaaacgcttgccttaattgtggcatcgacgtgagaggcaatacgtaatatacgagactaatccgtgaaacaaaaataggctagcatttcaaactagattggacgatggattgcagaccgcgacgttccgggagatttcgtggtggtgcatttttgcagcccggaatcgtacgtgtggctccagctagtttggttgcatacggccgcatcttggagctagctagccagccagccagccagccagccaacatcccagcgtgtgctactgtagttcattgtcccatccgtttaatttttctactagtaacagataaagggtccgatttactactgaacaattgcatatttgcatcacactcgttaacaatttagattggttgtcattacacatgagattagatttgacaggtcaactttatgccatcagccactcagcattagcatcgtcgacataatggatgtaaattactgagcattatctgcacaagcggcgccgtgccaatgcctcccttatctttccgcggctgctggcggctgggagattaattaattaggttccggacagttcggtgttcagcttttgcttgactcctgtaccgtcttaacatcatctttcgctaactttaattccaaaagctgtcgatcgatcgaacccaatatgctgcctggaccctgttagccgtgggttcctgcatgcgtggctgcgctcactgtcgttatttgctttagcccaacctgtcactgttgttaacctactgtcaatataattgatcaggtcactgaattgattacgttatctcacggtgctcgatgaaaagctagccgtctagttcggctgatctgatctaaatcacgtggcaataggccggatgcagattgtgtctcgcagaaatttccttccttgtttctcagcgcatgtttaaatagctgttattttcaagctttttgtttggattggccagaacaagatatactttcgaatcttttgactggtactagcatctccctgcctgacaccggtatctttggaattttggatggggactggaagccaagatgtgagatcaataaatcatttgaatcgcattatatcggttactacataatcaccaaaatcaagcttgtcgaatcctggtagtgatcaatagctcctaaccttttttttttagaactactaatagctacttcaccatgtctgtttcggcggtggcattaaccagtcaagatcgccggcgctggtggcccatttgggcctaattttcatcatcaacgtaggctagttattaggctgggccttggcccagtagctgacacagtcgatgggccagttttcctttcctttttgatttggtgacagaagtaattgtagctgagttccacaaagaaaaagaaaaaaaaaagaagtagaaataattttagctgtgttgtcttggcaggcgccggcgtgttcggacacctatcggattcgttcctcggtcggaagggctcgctgcaggtggtctgcgtcctcaatggcgtcttcggcatgctcaccgcgatggcgcccaactactgggcgtacgccgcgctgcgcctcctcaccggcttcagcgccggcagcgtcggcctctgctccttcgtcctcgccaccgagcccgtcggcccctcccgacgcggcgccgcggggatgtccaccttctacttcttctccggcgggatcgccgccctcgccggcatcgcggcgctgttcccgacgtcctggaggatgctctacgtggtcacgtccctgccgtcgctcgtgttcgtcgtcgccgtgctgccgttcgtctcggagtccccgcggtggtacctcgtgcgccgccgcgccgacgacgcgatgcgcgtcgtgcgcgccatcgcgtccagcaatggcaggagcattcctgacgacgtgtccctcaagctcgacgacgagggagacgacgacaacggcgccggcgcaggcaaggtcgtcgactcgtcagcgtcggcgtcgggctccatcatcgacgtgttccggtcgcggacgacgaggttcaggctggtgctctcggtggtgatcaacctgctcgcctcggtggtgtactacggcctcagcctcaacgtcgtcaacctcaagaccaacctctacgtcagcgtcctggtgaactcgctcgccgagatgcccgcctacctcctcaccgcgctgctcctcgaccgcttcggccggaagccgctcgccatcggcaccatgcttctcagcggcatctcctgctccgccggcagcctcatcgccggcgccggcgccatgaggtatacgtaatctccaatcatccaatcaaattcagctacgcgaacaaatttctgatcgatagagggcagggtggcgaggctggcgtgcggggtggtggggatcttcggcatggcggcgacgtacaacctgctgttcatctacacggcggagctgttcccgacggcggtgcggaacgcggcgctggggtgcacgtcgcaggcgtcgcagatgggcgccatcctggcgccgctggtggtggtgctcggggagcgcgtgccgttcgcgctgttcggcgtgtcgggcctcgtcggcgggttcctcgtgttctgcctgccggagacgaagaacaagcccatgtacgacaccatggccggcctggaggaaggggagaagaccctcctaaaatgatcatggaaaacatgcatgtgatgcgagtgattctgctcggaatcggcgggaattggtggattcttctacgtgttggtcgctcgtgcaaccggagacaaattgattttgggccgttttccgctggaaacaccgtgtttgggctgggcttttgtgactacgctcatgagtcgccctggctactaccacagcaagtctactaagcagtacagctacagcaaatttctttcggaatcctgactacacttgctgtgttgctctgttcccgtcttaatttcttcctttctcattcaggagctagtaatgaaaacgctgaaccgatcagcctccatcatgaaacctgcttcgtaccagtaactactactgtgagtacctgatcgaaattcattgtcgtttgaatgggtagttaactgagccactagccgtatttactcgtgaaacaactccaaacactgaaacgagcaggaacagagccgctgttggctgcaccggtacaagactataaagcgccgtctacttcagaatactaactgtgcacttaggctgtgtttagatctaaagtttggattcaaacttcagtccttttctatcatatcaatctgtcatacacacacaacttttcagtcacatctccaatttcaaccaaaatacaaactttggatccaactaaacacagcccttaacccacatcttggatctgcaacggcaacggtagactcagttatatactggggacatcggttagctgaataacctgaaatgtgcatcataatagtttgatcaaatcctacgggacatctgatctctatcacctgcttaccaccctagtatactcctacttctaccttccatgccgatgcgaaatgcgtgaccgcttgagacgcaagtggccatctgaaggaattcagaaatggaagcaacgacatgtccagcttcttccccatgcatccatttcccggccatggccaacaacaacgccattgccgcgggagtagtcactcggtactgtgctcaatgcgatgtgacgcgagctggttcgcaataatttcgcacgcctgacacacagaagcccatcatctcatcacacatcatcaccacacacgccgagccaaccctgtcaagtcactgccaacacgatgctgccaatggccaagggctagccactagccataaccatcacgtgttcttttttttttcatgtagtacaactcatttaggactaattaatcctcctctgagcaccattagcttcacgtactgacagtcttaaaccacacttccaaagttactagagcagttactgtacgtagtactccgtaccgtgggggcagtttactgtgctccgctgaacacaattatcagtagtacaagagatgggagaagcacagtgcgagctgcaggctgaagcgtgcacgaacgacgtttacagccagcctcaggtcgttgtcgagcagcggttgcagctcgtgtggtatactgcatacttgaatcggatgcgtcacgagtgcaacgggacaagccgagcaagtccatatcaacctatccaatgccgcggtgaacagcgacgcaccgtggcgggagcaaattttcaccgggacgacgacgaggtaaaaaatgggctcaaaaactgcagcgtccagagcagagcattcgggtcacgttgattggacggccatttatgctgtgaaatgcacggtgctgtgcggataattgtataatatacggtggccgtatatgtacgtacgagtacattcatttctcgtatacataggcgctgtttaggctgtgtttagatgtaaagtttggatccaaactttttcatcacatcaacctgtcatacacacacaacttttcagtcacatcatcttcaatttcaaccaaaatccaaactttgcgctgaactaaacacagccttagttctaaagttttttttctaaactttcaactttcgatcacatcaaacattttatacacacacaacttttcaatcacatcgtaccaatttcaaccaacttccaaatttcagtgtgaactaaacatagtcttatacagctgttagcacactagtaacagtaccacacaaaatgatattcccccattacattttaagtgcagtcataagtttctgtgttcaactttgatcctctgtcttatttaacctttttttgtaatgagtatgtccatattcatagtcatataatgggtctcatcccatcctatgctgctacattttgggacggagggagtatttttattatttttagatgataaaatataaataatacttttatgtatgacttatgttctttaattttttaaaaagtattttaaataagatatatgatcaaagatgcacacaagaacttatgactacgcttaaaatgggacagagggagcacgtaacaattttagtgcggcagtgctaatgttgacaagagtactccttacattccaaattaaactaatttagaatgagatacgagtatgagatagtatgacacacaattttactactactccccttgtctcaaaataagttaaataagatttgatccattttaatactaaaaaatccaaaggtttcaatttttaaaaggaaaacatttagaaatcctttaaacgccctaaacgttgtctctaccatcaacggtacaatttttaaatttgaaaacaaaaatcaaacacttgagacctgacagctggagagggggtccagcagcaggagaggtttgcggttttcacttcgaaaagttgcggattgaaaagatgagtccaaactcccaaaacttttgcttttccacggacgggacacgggagacggggagagtactcgcgttgtacacgggagaaaagcataattattgcaggttcagtgggtgatgtcactattatccgctgtaaaggaatgtccccacattcagtaaatatctttactggagtacagtaaaggttataaggaaaatactacagaatggtaaaccgttcggacgaaatgagtgtatccaataattatcggttgatattctgtttggacaaaagcttgatacctaatatcagctgctatctctgatgtataattccgtttgaattcgaatggaatactgtaatatgctatctccgtcttaaaatataataatttttacatagctaaaaatacttatattttaaaacgaagagagtatcattttccgaaagctaatcacgattgaaatggacaccaggcaagcacgcattggttatgcgcatcctccataccgtaccataccagcatgagccatatatcacctctttccgactgtatcttccttgaagaacaatgcagatttgcgggggatgaaagccagtaagccactgcccactagtcctactaaaatggaagcttagcgtacgattaaactctgatggcgcggtaaaaactgtaacgttaacacgagcggttttgtgacttttgtgtgaactcgacaaggacaaaagattatgcgcatcggctggggcgtcgcgaaagcgaaaggaggaggaggagagagcccgtggaatgatgcgtcatgagtttcgttctctgcagtaaaaaatcgacggggcaggagaggcatcatcgtcgttctctgcaccaaaactcatgccatcgatcgcatcgcagcatttttttcacaaccgggggggcgcctttgataaagggtggtgatggctccctgctcattcacagctggagcctacgcctccctgctccctcctggggaactgttcctaatcgagtgattagcattaactaaattggctaatcacgtggattgacagccttaaaatagggtgctggtattaggcttcgacgtcaccgcctgatccttgaatgttttttactgcttgtagtatagttgctgcagctgagattccatttctgatctgaacatctagcatttcacatttctaatccaagtaccccgtatagtgatactttgtactgctgtgttagttctacttaatcaaagacttgactataatccacacgggtaagtgggtcaatagatctgcatcaggtttttgaatgctccttccgttgcaagccatcctgcagactccatcaagccgtgctagccgtgcaatgcaagtgcaagcaggctagcaacagagggcgcagcactttatgtatcgctgatcttctacttcccctgcacgactctgtttgggccaagctgtttttactgtcacctttttttctctttaccgtgtcacgtactagtcctacatacgggcccactcgccagctgtaaccaactagtgtactgtttcacgtacggctagctggctagctgtgctgagcaagcaagagcaagcgaggcagaaacaattctttccccgactggtcacagcggctgtggccagtagccgcgtagctcagcgagagaaagaaagaaagaaagggtgtgtttagatggggaaaaggaaatttttgggtgtcatattgaacgtttgaccggatgttggaaggggtttttggacacgaatgaaaaaactaatttcagaactcgcctggaaaccgcgagacgaatcttttgagactaattaagccgtcattagcacatgtggttactgtagcgcttatggctaatcacggactaattaggcttaaaagattcgtctcgcgatttccttcataactgtgcaattagtttttctttttatctatatttaatgcttcatgcatatatccaaagattcgatataatgtttttgggaaaaaaatttggggaactaaagaggcccaagcgtgctgaaagctcgctgtgaacaaagccgcaaaagttggagaaatccacagcagctgagctgtgcacgcagactgtagtagtagtagagcgctagactgaccactggtccctatctcctgacgcgtgggtcccccgttgcccaacggctagcttggcctccgacgtggcgccctcgtgtcacgtgccacccttccaccgtaagccaaacgtctcgcctatataaacatcgcacccagcttcagcttgagattgagcccatcagtcgagtcgatcgaacagcacagcaagtgagcagtgacaatggcgtctctggccgtcgtggtggtggtggtggcggtggtgtgcgccgccggtgtggcggcggcgggcaagttcgacgacgtggtggagccgagctgggccaacgaccacgtcgtgtacgagggcgacctcctcaagctccgcctcgacagctcgtccggtacgtgttcaactgttcatcgtcttcgccgttgaagtttttgtggtgaatgggtgaagatgttctcgatctgcatttgggggacagatgaccagaatgttttgtgttgtggatgcaggcggcgggttcgcgtcgaagagcaagttcctgtacggcaaggcgaccgccgacctgaagctcgtggcgggggattccgccggagttgtcactgctttctatgtgagtgagtgcatcaggctgtgctctgtgcttcgctacgctttcctccatctgcttcgaacctgccattattgattcttcatcctgcattagcttaaacaagattaactggggtaaatgacaccattagtagtatgcactactgtagtaaatacagtacaaacgtttttcgaggcagtgttggggacatgcttgaccatgtctgtcgggggaagctgccaagaatcaatttacaaagaacagcggcacgtgaactcgtgcagcaataggacaacgttctttaaagatggccgcttttcactaatcacccccgattaatccattacttaattaactggagttaaaactaaatttagctgaatttggcttgcagctgtcgtccggcggggacaagcacaacgagttcgacttcgagttcctgggcaacgtcaccggcgagccgtacctggtgcagaccaacctgtacatcgacggcgtcggcaaccgggagcagcgcatcgacctgtggttcgaccccaccgccgacttccacacctacgccgtgctctggaaccccagccaggtcgtcttcctcgtcgacgacacccccatccgcgtctacgagaacaagaacgccaccgccgccgtcaagggccaccaccgccacgccgccgccgccaatggcaccagcaacgccacatcggcggcggcgtccgtgccgccgttcccgtcgccgcagccgatgtcggtgtacagctccatctggaacgcggacgactgggcgacgcagggcgggcgggtgaagacggactggtcgcacgcgccgttcgtggccacgttccgcgacgtccgcgtcgagggttgcgcgtgggcggcgaacgccacggactcggacgccggcgaggtggcgcggtgcacggggagctcgtggggcaaggaggggaggtactggtggaaggagaaggacatggaggagctcaccgtgcaccagaaccaccagctcgtgtgggcgcgcgcgcaccacctcgtctacgactactgcgtcgacaccgaccgcttccccgtccagccgccggagtgcgccggacggtgaccgtcgatctcgtcgccggttaggatggatcgatggatggaactgctggtttctttcttggttagcaaatcaaatggcaggtagtttatctcagatgaacttaggtgatggtagttcatcgtaattctgtgtctctgtgggggtgtatctgtaaaaaattgttactcggcttccactgctgttctgctgctgctgcatttcttcagtcttccgatctggacgatgctcacttttaacttcaaatcgaaatgcaaatgcccaatgccatcattcattcatttggtcctcctcacggtgaaaaatcaatgaatgccatctgaaagatcactgatgtattgatggctttaattcagagatcaaccgagtaataagaagaggtgtaccgagaggtacaataaacctgtggtccatttgatcgactcgtacattattactattacagatctcactgtttggggtgcaggacgagagagtccgaagagataaggcatcgatcagtactagtactaggactgaccaggcttttgccttgcccctcctcatcacgggtcagtagaatcagaatactgaaacagctgagatggtcacgagatgatgctcttgccttcgccttgatccctcttttgcatgctcactttgttctgaagggaccagcctagttttcgctttagccaaactctctcggcttgtctttcttttgccagctacacagctggacaggtcgcagtagtactatacgtatgccggtagagtggtagaccgtagagggaatgcagagcgagtgattgattggcacgttctgtaccaatgtaggactagtgtataccaccgaaaatacagatgcagatgtgccgcaacggcgcaacttggagacgtaataataccttgcttttgcttttgaatgcagcaagtgcgagagagctccaagctaggtgtacacctgtgaacgaggcaacactgtatctacggatgaaaacggccagaaaacgtttcaatcgtatccatcactatattttctcgaagacggaattcaaaacataaatactggaaagaaaacggtatcgaaaatataaaaaaaaacaactgatactacggatgattatcaacggaaaaccggtaagaaatatcagaaacattgaccataaaaatcacaattcaatttgcatagctatatgttctgatgaaataaaatcaaagttacactatgtaaattacaatttgtctttctttcaacaatagattaggggtttgattgatgaattgacgatactatagactatgggttgagtaaagaattagatcatatatatgatggcgcatttagaaacagtaaaatataacagcaaaattgtttccgttttcatttttgtcggtaaccctttccatataactcgaccagtaaaataaaaggaattgctaactggctacctgctgatctaccctataattcaccaacttgttttactcatctttcactcttacactcttacattcatcactcaacggttgagatcatccctgtgaaatccaacgctccatgtcatctccacctcccacctcgcaccataaccccaacccgactcccgtcttccacgcgattcttcctcccctttccttcccgtcttccacgctacagattgcgcctcctcaattcctcattgtctcgcgaatttttgcgcctaggtcgccctcactcgaagcgacgacaccctcgtttccctctctgcccaccatgccacgtgcaagtcctttgccgatgaccatggagagaccgtcaaaatctgttggtcgccgtcaccgatacagccgatagcgcctcctttccctattgatctgttgctagagaatggggcgagggtcaagcgcaatgcccaagcccagactccaacccaacccacaaatcgtttgcacccttctgcaccgatcgccgtaaccggtcggctgccataagcggttctctgtctacccaactcgccggtcaatagatcgcaacgccccaccacatttcgtccctggtcggctgctgcttgctcttccactaatttgatcttgcaatttcaaaatcataatgcttcagcagtggaatttgcggataaggtcaggtacatttatctcaaatttacctgattcttgatgttgcatgcaaaatttcctagccgcccgggttgccatagatgagacttgtggcgttctttttgttgatatgtctgcaaatgggatagcttaaccaaattatggagttgtggcactttactaaagtctgaatgtacatttcatttgtattatggggtataggccaacaacttttaatatgagcttttgctgtaatcttgatttaattcgttgatatgctgagggatcgtggcatccttcccattacatgttcctgatctgttctgtcagtgatgcttggtgtcaaggtacgcccactgggcttccacacgaaccatggcgaggtgctgttccgctgctgggacatggtaaaatcttttagaccaaaccatttgatgtgctagcttatatcgtgcttgtctatacctgctaaaatcacttctacaaaactgtatgatggttccggtaagaaagtcaaatcgatcggtaatgttcagaattgagaaacatgaatattgatctgtgcagtcttcaggaagtgttgagttctgtgtgagtaaatgagtatgtaagtaggggagaagcactgcaagtagtgatttgtctatggcatatatcatcatgatctgctccttgtataaagagcttcagaattcagattaatttttttagagaaataattcagattaatttcacaaactagattgatcagggttttgccgaaccttgtctatcttaacttagtgcaaatatcagtttgtcaaatcactgttcacgtttttttttcccatgtggatatgcatttgcaaataagtacgtagcagtattttggagaccttgatttggatgtaatatatatgtgtttcttgttttataatttaggtcttcttaattcatagattgccttgtacctcttgatgggtggctatcaaagctctattagtctaaaacaatagtattaatcttactttgatactttaatgtttgatatgccctttctgtaagttgttcatgggtccttgcaaaagaaacaaatgctcattgctgtctagattagtttctagaaattcgatttggaccaggtatgtccaacagaatgagattcggattttcttttggcgtactatatatggctgcaagttcgggtgcgatcgtctgaataactgaatgtactgcaaattgcaaaactagctcattaacttggatcatttaccaatttgctaagtcctattcaactgtaagctgacgttgatctacacaccttattcagtataaaagcagcacaacattatcttaacaatgaagaatgagaggctttcaacccggaaaaaaaaaagaatgaggggctttcatatgtttcgagatgcatagtgcactattttctggtctaaaatggagctgattcatatgcttgtctatacttggagcaagcaattcagtccatgaatctcctttctatgtgtattgacaatcatgactccaacacagtatgcactaacctgttttagccttttatatgcccaggcaaccagcagatctcttgcttaattgcataaaaattttaattctatgtctttgtacttaattaaaattatttatttagggaaaacgagttacatatatcgtttgcagataatgttaccatctatgtgtacacgctctactaaatcattttaaaggataaccatagctttttagtccattattaattaatttgggtataacagcgtaaccacaatcgttacttgcaacttttgatgaatgagaatagagcatttcgttatttctgaacaaatatattactgcctccgttttaggttataagattttctagcattgcccacattgatatatatatgttaatgtgtgtctagattcattaacatatatattgtaaagagaataggagagaacaccactctccccaatgaggggggtgaccatatattatagtctttccaatatacaagatccttagaggagtatacaaggaagctaaggatacaaaagaatcctatacatatatggctatacattcctaatgcccgcccgcagtcacaacaggaggatcacgaatgcaaagattggacctgaaatcagtgaacaactgcacaagcagccccttggtcatgatatcggtgaactgatgggacgacggtacatggagcacatggacctgtcttagagccaccttctcccgaacgaagtgaatgtcgatctcaatgtgcttcgtacgacgatgatgcaccggattggccgtcatgtagacagcgctgacgttgtcaccgtaaacaacggttgcagaggcgatgggagcatgaagctcctggagaagctgtcgaagccagcagcattcggcgacggcgtgagcaacagcgcggtactcagcctccgcgctagaccgggagacagtcgtctgacgcttggaagaccaagagatcggattgtcgccgaggaagacgtagtatccggaggtggagcgccgggagtcgggacagctggcccagtcggcattagaataagccgtcagagacttgacagggccggtgctgatgtggagtccggtggagagagcctttgacgtaagcgcagaatgcacttgaccaaggcaaggtggggctcccgtggatcatgcatgaagaggcagacttactgaacagcataggcgagctctggccgagtgagagtgaggtactgcagagtgcctgcaaggctcctgtactcggtcggatccttgacgggggcgccgtcggaggcggaaagcttggcccgagcatcaaccggggtggcggtggggtggcattcagacatgccggctcgctgaagaagatcgacggcgtactgtcgctgggacaggaagaggccaacggaggagcgacggacggaggttctctatcaaatatgatatttccaaaaatagccatacatatttttaaacctttcttaaatgctggatagagaattgtgatacaaatggtgattattgatgaaaaaaatagaaaacctttaattgatatttgtttatgcatgtagaagtagaaaaataatagtgaacagattacttctcttgattgcgacttgaactttcatactgagagctactccggtttgtgataataatatttaaataaatttggacctcgaaatagtaaaataatttttaagtagaaaatttgctagatatcgccgtagcgttagcatgggcaaattactagtttattttggttggttaagaatttctgtaactgtttttaccactaaccatgtttccactttctacggctccatggtgtagccgaaggcctgggttcattttaggaaggaaggcccagcagcccagtacatgacaaccatgtgcacagacctagagtttgagacaatacaaaacaaaacatgggagggcgtcatttgccaaacatagtaccacctcggaagtcttcaagaaatgaatctagcttaaaatgcaaaacctttgaccgctaagcacgaccttacttgaacaggatctgttctataggctcgtaccgttgcatccttgactaataaggaggcaagcactcaagcttggttgatgacgcatgacctgtgggccagagcgtgattgacggcccggatcatttccgtgtgaattgatcccgcggctgtagaggatcgttccttgccgggctttcgcttggtcagggttggcccataggttgtctgacaggcatcattttttttttcagttatcttcaccactccattaattaggccgttttttcaatatttaggagaagcctgaattactaacagtaaaatctttgacaagcccaagtcatccgcatgacaatccaaacagtaatttgtagatttttgtaatcatagtgtgttattatccttcatcaattgatacttctgctgctcacattgatcattcatcaattgatacttctgctgctcacattgatcatttggactacctcgtaataaatggaaatccaagttcatgctacggagcattggactgataattaaggtgttttagtcacatcatgcatatacacaacaaatctgaggtacaagatctcaacaacgtactccctccgtctaaaaaagacaaatcctaactagtgaaattaagtgagcatacatagtggtactactaaggctatgtttagatttgacataccacatcgaatatacggacgcatatttaaagtattaaatgtagtataataacaaaataaattacagaattcgccccgagatgaatttattaagtctaataaatcaatcattagcaaatgtttattgtagcaccacattattaaatcatggcgcgattaggcttaaaagattcgtttcgtaatttacacacaatctatgtgattaattattttttcgtttatatttaatactctaagcatgtatccaaacattcgatgtgacattgtgtaaaattttatcaaagggattgccctgaagactgctatgcaggtccagacttggacgaaattaaattacagcatctttcatgattatgtcaaggccctgatcacatcagctgggtcctcagaaacataaacccccatgttaaattgcattatcatcagtttgggcacggatcagtacgacagtacactattggatacaatttccatctactaatgtttacaggtggagtttttaaccacgtgatggctatgtgaaggagtaagataaactgtaggagaaaagcatttcgtagtgggccatgaagcctttcaggacatgtattgcagtatgggccggcccattacgcaattggaggacaacaaagactagtattagtaccacctcggctatccacatagatcaaagctggtttaaaagagttgtgcagatgatccatggcacgaccttacttgaacaggatctgttctataggctcgtaccgttgcatccttgactaataaggaggcaagcactcaagcttggttgatgacgcatgacctgtgggccagagcgtgattaacggccggatcatgtcactggctgattcgatcccacggctgtagaggatcgttccttgccgggcctcgcttggccaggatggctctcaggttgtctgacaggctcccaattttttttttcgttttgcattgagttttctccgtcgcatgtttgcagcgtgttcaaaaagttcgcagctgtatttcacttatttacggcgccacattttcatgccgtttgtgccaactatcccgagctagtgaatacagcttagcttcacacaacaccggtgacccgctgacctgctcgtacctcgtaccgtcgtacggcacagcattgctggaattaagggtgtgatcgatactgcttgctgctgcagcaaccgtggctgcaagagctaaaaatggctgcagcggcagcagctgaaaaacagccacagccatagcggcagcagcagatagcagttccgatcaggccctaaatccaagtcctagctaaacaggatgctccattgaacagccaaaccggcctcacatggtctatccaaggacctgccagttagccacgaaatatttcgtgaaaagccagctgaaggctgaagccctttttgcactgaaatgagtatgcgtgcgggcctgatgatccgtggcattgttgctgcggggacatccatgcactgcagggtaatggaggagctgattgagccatatgtctcgctgcaaaggcttcctcctttcggtggttagcccagagcctctcccagagatcgacccagaccagcatgcagtaatcgaatcccgttcgatgattcgatctactaaattcgcaaaggctgtagcgcgcacatggcgccaacaggcaacagtccgggccatttcgccatgccccgggggatccctctgacgcctcacttgagattccttgaaagttgcgaacacatttgtggttttatcttcacttgtgaaagaagacgtgtcatcgtatgatctctactttcttttcaagaaagtcttctgggtgatcttatgagcactctgactatctgaacgctgcctaataattcacataaagctcgggcgccagttcacagttttcatacctggactactgctactgtgttagtgcagtagtgctatagctaatgatatggggcatccaattagttgggtcctcacctggtcggtccatacatgaacctgacgcccccgtgctgtgctggcttctacgttttcatcaccgaaaatattgcagtcccacacgctctctaggttaaggagcaactggcggcttggtgcatatacagtagtactcttgatcagtgaagacctaggtaacagggtactatagcaggttcctgtgcacaatgatgtgaagcaaaatataaatgcttaatttgtcaacattgtatacaacgcgcgtcaaaggaatcatttcaagaatgatcccatcttctgatgtagtggtgtccaaggctccatatacagctgccccagtgtataatgcatggaaagtacagaactatgtacatctcattgtgcaggaactcgtcacgaaacgcaatcatatatacagtaaaacatttttttttgtgtgtggaagtgccctttctgtgatcatgctgctggtagtgcccaataagctaagcaccaccaagtatattcccattgtcagtagtcaccagggcattcatcaagtcggttgatatatattgtcaggtagggacatcggagctagctagcagcttggccccggccgccggcgaccatcacggccgggatgatccgacgccatcccggctacttttcacagatcatcgcatgcttgccatggacgacaatgcagagaaaatactcttacctgttgctaattaaacgtctaagtcaaacacagaaactgaaaacgaatgtacactaagttttgcctaattagttcttgttgcgatctacgcaatggtttcgtcagcgacgaggaaagaatgcacacaggaaactgatgcaataatccgaaggtgactcgacaagaaattttttttcgcaggacaaaaggaaaaggagagttgtgaaaacgatcgaagtagccgggggtcaaaaagggtttgacccgcccacccaggctatgaatgcgatagacactggcttgacaggcccatcagctggcccggtatacctaacacaatcacgatggggggttggtgggcccagccggtcagcgagacagatagcgaatccgcgggcctttgggctttcgtcagagcccacctgaactgttggcatgtgcagcagttttcggggtccatcgagtgttgactctgctgaagaaagggtaacaaaacagatggagagttttccttggtttcacatacacagagtgagtacatcattaaagtaagtgaattcacaacatagaaatgcattcaattattcatcacaaaacctgttgttttattgcctttaattatggacaggatagtgtttgtttgtttatgacgtaacgggcgcgcaccagtatatattgtcactagacagtgggttttgttaggtaagtagtactgagaatgtagcctcatcattaagagttcaagatcattaacacggcgtacacttgttttgtctcaatagcatgtgttcccactgtgatgagatcagtctcgtgaacaatcccgtgcatatatgggttattaaaagcatcatcagacgtatggttgacctcttgcttggttgggttatctgtccactgtcctaaccacgtgtgttaggcgcagagatcacaagcttgctagatcgatctcacgtacggccacactacattaccatacagttacgccgaaattaaaacaagatgccagatcactcacccaacttagctaagctccaatcgatccgtgcccaacccaaccgtcccggcagctgtcgggacaaactgagtagactccgagcgtgtcgatctaattctaaagtcagagcacactttgacgaacaggttgacccactgcgacccaggaatcaaacagctagtaggaaactagcatttgtctcagcctaatagcccaaagatgccctcgtgtgtcctactgtccttagcccggccgtgtcaacgcccagcctaaaccggccaacacgtcaacgatccgtgtcgcagagcgtgtgcttttcctgacgcgacggatgccggcgctactgctacttcctacccctccgaaaccgacgccgcggccgggttgggtttgggtcttgggtcagcgtcgacgtcgtcgctggcctcgtcggtttcggaggcacgtgttacaggccgggaaccctcgatcgatcgcgcggccgcgcgcacgcacgcgcgtctggtttgctccgcgatgttgcggtgcgcactagccagcggaggactcgtcgcgtgtacaggttgccgtggcgatcgagcgcgcggcgtgcgtgtccacgtacgtacgccgccccgcgcgcacgcgcacgccgccgtgtttcgcacaccggcagccggaccattctagccggcgcgcgggcgcgagcgagcgagcggcaggtcggtcggtttcgggagacctcgtgccctgggtggcacggcagtggcaggggggacagcgtagcgtagcgtagcttgccatctacgactggacgactccaccaacaaaacattagactctataaattaaaatctgtatatatgtttgtggctagcaaaaatggtaaattcgagtataaagttacaggcaggataagtaagtgttcgcaagaggaaattgattgcacgcttctaacacaaaccatgcacgagcatgataataatactatatatttgtagttatgggtcaagctaccatcccaccttgtgctaataaccaatccttcaacgaaaacgcatccaagagatcgatcgagattactactactactactgctgtcatcatctccaggttctgcaaagtgcgaattaccggtgaagtatcactactactcgatcaagtcaggcaggcaggggaggaggaaagagatcaacctctgaacataaactagtaatttcacctctgaaaaaaacacccccagcactcgataggggaaaaaaaacggaatgaatcgaaagttgacctccattccaaaccccaatcattccgatcgggcggtcaaagcttcgtcgatacgtggcagcgacgtcgctggcccccggccacggggagggagggacacggcgtggtgtgtcgctggacgccgcgattcagatttcagaggaggatgctgtccctgtcccgccttttgactcggcgttccgatcgatcgatcggtcgatcggctaagcgagtagtagcagcagcagtggagtgccgtgcgttgttcagagttgcaggtgcatgcgtgcgtgcgtgtgtgcgcgagagagaatgagaacgggtggcgtttgtggtgtgtggcttggcaaggcgggatggagggtgagtgggcggctggctttttccgggcacgcgtgcgacccaatcgggccccgcgcttttgacgccttcgccgccgcagtcataagcgtgacgtcaacgcccggggtcttcattcttcaatcgcttaaactggctactatggctaactaattgcctaagctgtaccgccggtccgccgcccgccgtgtgttgtagcctaggccggccaccgtctgtctagaaaagattctaagattctgtttgaaacatatatattatcatcttttacaatattccaagattttgtttgaaacagattgtcgagtaaattattacgacagattatctatttaattgtaaacatatgttaagtattttgataaatatgtaatttaaaacatatgggcaaagcaatgcattaaaaaatttattccgtagtaaattacaggggtatcatctaagtaatattagctgattatattgacatcgcatgtctattattatcagtcacaaatcgacgagcctagacgactgcataggatcactggccttagttatggtgtagcagaaagtaacttttctttcgcgaatgctcattgcatgtcaatatattagaagagtttttgttatacaactcaatcagtcagacatgcctatggggggagggagaaaaaaacaaaagctacaaccaggtaaaggaaagaaaaaaaaactactacggaaaaggctactccgatcagcgggagggtggaggcagaaccataccacactcctaataagcccccaaaagcagcaacaccagcagaagaccacatacgagtatacgaccctccgagaggatagactccagaactactgagaccgaggagagcgcagagtcgaataccctagagttccactccttccatagctaccaagagacgagaaggaccggggagtcgaagttggcgcgaagatgcttagataagcagaccctagaagacagccactagacctgaagcgagctgtcacggggggagggcaacctagccagagggcgacaacatgtggtgctagatctgtcgagcgaatacacagttgaagagggtgtggttcgccatctcaagattctgtgtgcaaaaggggcaggctgagtgctatcaatatcacgcttctggagaagatcagccgtccagcaacgctgctaaaatgcaaaccagatgaagaatttacgtttaaggagaaagtacattaattatatatctgctgagtactctaaattaccaactagtactcaattatgacttatgcccttgccttcatttcaaaattttaatagtactagcgccgtgtttagttccgaaatatttcttcaaacttccaattttttcatcacatcaaaacttttctacacacataaacttctaacttttctgtcacatcgtttcaatttcaaccaaactttcaattttggcgtgaactcacagctagaacaataaccagtctcttcattcagaggatctctctatgtactacggcgaatacgatggtttcctgaccataagtagaagaataatgtgttgactatgcatgatgggcggatgcacgcttaatttggccatattgcaccgtgccatgcatctaacgtcctgattggatgtatatgtgtgccaggagcgagcggcgaggaaaaacaaaaacgtcgaagagtacaaatacgcattgactgtcgacctgcaggtctgaactctgagagagaatataatacatggacaaaaatccaaaaaggagaaaggcagaatcataagaatccaagacaaatcgccggccgatgcatgcctaacgcgacatgaggggttcttgttcctctatcacaatctgcttttccaaacgaaactgatatgagtacgtatgagattaatttacttctcattaagtttgtaatttgcgaagttatatgctacgactgtacttgggacagaggtgtattgttctttgatttattttgatctgtcactcttctatcttcacttcttacacacatacgcatgttttcaggcaactaatacactactagagaattaatctttgttggatcgctaaaaaacggttcgaataagaaccgggactaagattatctttatagtccctgttaaaaagctgaagggaattttttgatcttagtcctggttgataacatttttagttccggtttaaaaagtcatcaggccttactatctttagtcccaccaaccggaactaaagattaacatttagtcccggttatttataccaaccaggaccaaagattgaaaaaaaaattcaaccgcacactcctcggtggaagggaggcggtgcccgggcgggcaggtggaagggagggtggcataggcggcggccgagcgggcggaggggtcgtcggcaacgctgatgtcgatgtgcggattgttggttttgtgatgtgtggacttgtgttgtttgttgagcatgtgaattagtaatgtcaatgttctatgaattcgtgtagtcattttgatccgtgaattttgtgatgttggtgagtttagctgtgaatttgtgacgttggtgagttcggcgtgaaatcaatatgctgacaacaaaaatacaatgaaaaaaaaggaaaaaaaactttagttccggtttgtaacaccaataggtactaaagatttatctttaaacccagttatttgaatcgggactaaaaatggacatctttaattccggattgggcatcccggtaacatatccaggattaaaaggtgtttcgaactgggagtgacgtgggtttctccagtagtgataggagataatctcaacttgtatatatggatgtgactctgtgagaagtgcgcgagattcacagtcacattttttatttttaaaacttgtatataaaaattaaatttaaatctatatgttcgtgaatttatatatatatatatatatatatctattttttttaaaaaaaccgctttttaggtgacataaaaaagagggacgtcccataggaaaaatgactttcacacatacccgctttaattaataagtcgtttagtcttacaatataacaatcagtatatgtgcatatcattctgcatgccactcaagtactacatgatttaattagcgcaacatcatatatatactacaatgacagcaggcgtgcaaataaaatataatttgtagaggtcagagggtacgtgtgtaatttgtgtttagattgtgacgttgagtttatcttctagtgtgaaatgctatacaataaactaaagttgatgggaagattaacaataattaccaacgagaaagtaattcgtagagagttagattagagcaattgatgaagactatggtacacacaaacaagacttcttggtacaggccgggaattaggtgccgcagctcattacccctttacggttaggtgatatcatcaaacattccctctaatcgttctaatttttatttgtttctgttgctatcgctaagacttcttttgagaggtcaatgcctttgattacatagaatttattcgctagtctttcactgcttgttttatttgcagaaggataataagacattaatttaaactgattcgacatatttatcctgattctatcgtgaaaagcatgcatgcatattgctatcaattaatcaattattgaagtgatattaatattgtgtaccccccaaaaaaaataaatataagagaatctcaaaattgctgacaaatggcatgtctagctagtactagtgtgtgctaccactactggaacatcgtaaaataaaaaaaagaaagaaatggaggtaggaatttctagacatagcacaacagtatagctagatgtgatatgtttggcacaaataaagggaattttcttttttgtctaatctccttttaattaattccaaaggaataatataatctatattcctatatgagttacactgcacacatccaccccccctacatttcttacagatgctctttctgaggaacgacaattatgatccaactaattaattaccagacaaaaaacaaagctggtacattttttttacagtagtacacaagcagctagggctataggtgtccaaacgggcggcacggcccggcccggcacgggcacggttccggcacggcccgtttcagcacggcccgttaggcacggctgatgaaacgggccgtgccgtgccggcccacgtgccgagccgccggcccaagcacggcccgtggatggccgggccgtgcccgtgccggcacggcacgcccgcggcccacgggccgttcggggcacggcggcccgtgaaggcaggccgccagcccgccagcctgcagtgcacagtgtttttttttaaaaaaaaagcaaaggaaatgtataaggaaaaaaaaattaaaaatggaaataaaatgtttaaaaaaagtaatgatttactaatgttaaaaaatgaaaaaatggtatttaaaaaatggaaataaaagttttttaaaaaagtaatgatttgctaatgttaaaaaaaagaaaaaatggtatttttttgttgtgttgaaaaatttaaaaatatagattgtgattcattattttgaaataatttaaagataaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaaccatgacaaagaaaagagtacagctcaaaggtcagaactacttctaacaaaattctactggggttggtctggatccaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctctgctggcgaacttcctgaaactttacttcatatcttccaaaaacctcatataatttacatctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattatttaaataaagtagcaatttcaagaaggttgtgcaaaattatattagcagttggataataaacttgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagttttaaacctagggttatgagattgctgaatgtaatgttcaaaagcaggggactccccaaagttcaggggtaaatcttgcctggcgattaaccggacaagagattcccgagcaaccatgggatcgtactcccaactgtgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtctccgcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaactgcgagctcttcaaacctctgcgatcaaactgttgaactacgaaactaattttgatttttgacaaaatttgagcaaattttgtcaaaataaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgccctgtccgcgcctgacgggccgccggcgtgccgtgccgtgccgtgccgcgggccgtgccgtgccggcccgctacagtagccgtgccgtgccgtgccggcccacgggctcggccagcggcccaagcacggcacggctactcgtgccgtgccggcacggcccgttactgtagcaggccgtgccgggccgtgcctgctacaggttcggccgtgccccgggccgcccgtttggcccggcccatttggccacctctagctagggcatgtcaaaaccctaagactaccatgcatagactacatttatgcatgcatgcatatactactgacataactaaattaagtacacatatcccaaggggaattaagctcttctaacatccattagtgcagtagtagtactgaactctctgtgggttgttgaacaaccgctggatcatgatcagttgcaccagaataacctgacgcaatgccggacgaccggcaacgacccccggccggtttatccggcgcctcatctccggtgtggtcagacagccaaaattctcctcctcgatctcatctcccctctttccaaacggtttatatatatatacacaagctatacatctttccactacttctcctcagctcgctttccccttcaccactgcaacttgctcatcacccacacaccaagcaagcactcactctctcttgctagctctctccaccacaagaagaaactagctagccaagaaacggaggatcgatcgaggttcaggatagagattattacatcgtcgtggtcgtcgatcatgggggatcatcagatgatgcacgcagctccggcggcgatgtacaacggcggcggtggtacgacgagctctcatggcgtgtggtggagcaacgcggtgggggtaccggcggcggcgacgtgctcgacgacgacggagctcgccgggtacaccgcctggtcgtcggctctggccgctggatacgatggcatggtagctgacaacggcggcaagcaggcgaagagcaccaccacggcgtcgtcggagtcgcccggcaacaacagctcggtgaccttccaagagccggcgagcatccccgacccggccgccgtcgccgccgtgccgcagccggggctcgccggcttcaccgactggacccagcctttcatgtgagttatatatacaagccaattaattaactcgtactagctaccatatcatatggagagctagcttagctgagatcgatcctgacatgtttgcatgcgattttgtgtacgtttcatcaggaacaacggtgctggtctgcatgagtttctgcaagatggccaccatgacatgagcgcgtcgagcttgatgaatcactcatcaaataacctagcactgcagcaagcaggtcaccaccacgagctgctgtccagcttcggctcagacctgctcttgtcgccgacgtcgccgtacggcggattccagtcctcgctgctgaggagcctcatggagccgacggcgaagcagcagcagcagcagccggctttggctggactccagcagtatcatcagtaccagcagcagatgggacacgcaccagcagctgctgccaagttcgcgcaggcagttggggccagggattcactccagttcaccaacgacgcgccgttctggaacccttctgccggattcggcatgccggcggctgtggcggtggcggcggcggcggcgcaagatcaagctagcgttcgctctgccaaacgctcgtcgccggcgccgccgcgtgcggcagcaacccttgcattaaaggtttgtacatagatgatgcatgcatacaagatagctagctagttctgtcattagctactttaattttagggcattgtgattgatgttttgttatgtgtatacgtgtagactgctatggaaggagtaggggactctagctcagtgatcaccaagaaggagacagcgttcaagaaaccgagactcgagacaccgtcgccattgccgaccttcaaggtagatagatactcacagagacatagctagctgctatgcatcatgagttgaactcaatctggtttaattagtataaaacagtctgcattatttgatgtcacaataatatataggtcatgcaatttaagagatcgatatagatgcatctttactaaagttgttcgtatgtgcaaattgcaatatacttcaggttaggaaggagaagctaggggacaggatcacagcgctccaacaactagtctctccttttggaaaggtgagggaggcttttgatggccaatgtgcactatattacaaacaacaagagtgcttggaactatgcatcaacatcttctgtgcaaaagagttcttcctttttgatctcctcctcctttcgagatctatacactatatgcaaaacaacacaatcttattctcttctcgatgtgcgcgcgtgcagacggataccgcatcggtgctccatgagaccatcgagtacatcaagttcctgcacgaccaagttggtgtaagtgtgtgcaagtacaccatgattccccacctttaattatagcatcctggagcacgaactcgcacgtttcttcagatgaatcatgcatcagagattcagagaagagagactgatgatcagtgttacctgaacattgtcttgtgttttgttttctgcaggctcttagtgctccatacttgaagaacggtgcccatcaagtgccccacttgaaggtattgccagtgttggatgctgcatgcttgctctccttttcagcattctgatcgatcactgtacttatgatcgatctgtgtgtgtcatctctgttcaagccagtgctgatgatggcttctgcaattgatttgtttcgtttcagaactcaagtcctgacaagtccaagcacggcgagatatcactgaagggccgggggctttgtctggtgccgatatcgagcacgttcgccgttgccagcgaggtgcccgtcgagctgtggactccatttggtgccaactttattaggtagaagaacaagtcctggaactgaagaacactgatcagaagcgtcaaattaacgatcgagtagctagctgctaatatagtcgcctagctagcacaaatcgagatctgatgtttcttgattgtatctacgtactagttgtatgatgataatttcgtaaccctagtagtactgatgctgtggctgtaatcagcaaagcactgagctagttagctagatgaacctttggaatgagtgcttgaagacttggattcattcttcaggttcatcacagaataaggaatcggctagttgagaggggacagaattatgtactgatcatcatcaggttcttatgattggttgctaggttgcatcgtatcaatgagtagttgcggaagaatttgttatagaattgatggttcgattcaatggtggatcaattaagtaatgtagcaggtttctctctgttgattgtaccaaataaaagtgccatctctttgattaatgataccttttgcttgcttctcttttaaatctgaccgcatgttttgctattaagtagagcttcaagaatttgtgcatgtgtttcttttgcttaattatttccagaactttcaggttaacaattccatttctgtagtgcatatcagcatgccgaacacttctgcttgggcatattctactcatctactgcattttattattatatgaacaaagataggaaaaatgcaaattgatccattgataaaatcatattaggaagatattttgacgtatgctgtcaagttcctataatttcggtgctcagtattatatcaaagaatggttagatttatcatatatggaaatgcaaaccatttaatttggcaagaaaaatattttcacaaatataataattttataattaccattttgtgacttgactactgacttcggtaattccgtatatctcttttacccactgacccccttgttagggacgctaacttcgactggctggtctatatatgccagtatgcttatgctggtagcattgcaccatatccaacccggcaacatatcctatgcacacaggccctcacgtgtacacacgtgcacaccaactaaaaaatatcacaaaaaaatctagaaaaaatcatacacatactttcaattgtattacacctagggttaaaatcttaacgtcaaattcattatattttagccgtaacaaaaaaaacaaaaaatctaacagttttaaggttgcaattttgtcagaattttatcttttttgttattctctatgtagaatgaatttgaagatgcgactttgcacgtagatgtaatactattgaaagtacatgtatgaattttcctagaattttttgtgataatttttagttggtgtacatggtgtgtacacgtgagggcatgtgtgcataggatacgctcccatccaacccttatggtctagttgagtccatacgcgtggattagtgactgcatgagcgaagcctttaccctttttccagagaaaattgaacttttttttatcacaccaatgctcttcaaaagaaattcaacgcaccacatgtccaatacaattctggttctgttgagggtgttgaaatttcaaatagcatgagtaaaaccatagcttttaacccccaaaacgaactttttaccaagattcatggttggtatacagagtcaaaattcaacagaaatgctcttcaaaagaatttcagtgccaaaaagtagagggagatatgtcaaatagttgattttcacccaatccattaatatttgtactgcacgaatacaattctatttgaaccctttatttcttagaactgagtgaaccatcatgtgtatctgtcatggaatttgattcaagtttcacttgtatgagagctacaaccatacatgttattctccttagtgaaatggtaaaccaaatgcgacgaactcctgtaaagctagcagacaagaacaattcaacatcatgcgcaaaaacacaataatagaattcagtccttactgaaccactatgtacatctagaagatatatattataaaaatatataaaagtttggtcaatcaataaggagcattaccctttttctctttatttaccaaaacatttagaaatccatgagctagacatctgcattgcatccaccatctgcctccccggtttgcctttgccctgtattgtcagctcagagactcacatagctgcattggttctctgcatgctcaattctgttagaacatttttacatgactagccaccagaatgcacaatatggccggcttgcgagagtacctgacagtgacaaaagaaggctacactgcaaactcatctcagtctcggccacctgttaactgaacctatcagatccaacaaagatcagcaagacaatgtttttgtagctataatatgatactattgctgaatgccattttctttttctgctgacaaagtgatgaaatgtggatgattgggctgagttaggctgcaatgttgaagaaagcagatctctgaaatcttacaggtcatggtcacttgaaaggggctttcctaccttcctgatactgagagatttgcaagagcctcacttgctgacattgtcatttactggaagtcaagcccttgtacttccaacggtttctatcagctgcatctcaaatccgactgctcacagctgtaaaattattcactttttttctgaatctctgatgaaagtcaagcatgtgcttccatgtcagatctcctcctcgctttgctttgagatctcgacgagttctcgttaacctcgatgggtgatggacacagacgggttggtcgccgtcagttgtagtagatccgacgggattgtccgcggcggcggcgaccgaggtgacggccggcggctgcgaagcgaggtcagggaagcggaggagatggaggacgagccgccggagagcagaccgccggcggcgagggattcggcggtttcggcccatgagaagaggcagatagggtaccgatccaatcttgacccgaatttaactatttgccattttgaggtttgccaattatccaaatattgcacttaataatttgccattggagagaggtaatttcttaactatttgctatttttgcatatgtgacgtgccactgtaccgtgccagcgtggaaagtaacgtgggccccacccgtcagcccctctcctctccttctctatctccggtcggtcgtcgcccacctcccgccagccccgcgccgtcgtcggccgctggccccacgcgacagagacgaagagcaggcgaggagtcctggcagcaggcgcgtggcgcgctccctggcgaccaacaaatggacagcgcatcggcgaggaagcccgcgaggccaaagagaaggcatgcggcggagaaggccggggtggagaggaggcggcgaagcgtggcgcggcgggaggtggttgccgaggagaagaccttcggcgagctcggcatggcttcggcgaactcgccggccgctgtcgcgtggatcggcgaggcacgtcggatcggagtcgggggagacgagaaggagtagtggtggtggacactgtcgacggtgcggggcgagcggggctggcggggggatgggcgagcgcgggctggtggccgacgacggctcagggtcagtgcgggccggtgggaggtgggcggcgaccggagatagagaagaaggtgaggagaggggctgacgggtgaggtccacgttgcttttcacgctggcacgtacggtggcatgacacgtaagcaaaagtggcaaatagttaagaaattacctctacaaattattaaatacaaacataagagggatatttgaataattggcaaacctaaaagtggcaaatagttaaattccgctccaaaggtaggcccgaataactaactatacgggccctttcttcaacttgggtccaaacaaatcggcccgtacccacgagtgggccgatgcagcaggaatgggcttgttcaagttttagattgcagtcaggcaatggacaaatggcatagaagattagaagatggaactatactgatgttttccatccattccattctgagctaacccttacggcatgtttggcgacttaacaaaaagggattggtagtttagaggaggaagttgggagtttcatttttatttctcgtcccttggtagtagagatgagaatcatacaaagtttgagtgggaattaaagttcaagtgatgacatacaattcagatatatcctgacatacttaagaagggaatcccctccaaattaactgttactaaacacatattgaaaagttgagattttgctctcaaactctccttcctaattcattctaaaactccgacacccaccatccaaacaatttcctccaaccaaacgcgcccttaataagatgattgcatttcactgacataactaggatctacaatagatgtcaggacaattgtccgtcgtccatttggcaacggatacaaaatttgttgataatggattatattcgtttcaaaagcagaagcaatgaatcaccattcctacaataacgcatagctgcagaaaatgccgaaatttacagacaaggataaaacaaatataaacattcatctcccctccaaggctgtaatgctcacgccattcacggaattttccatattctctcttgcatattcagttgcgcgttttttgtgcacaaaaaatataggttgctttggttgaggtagcggtgcagtattgttctctaacatgaacacaacagatgacatcagcggcctatcatctggatggtcctgaatgcacaagagcgctatgtggatacatctcaaaacttcatggagtggacaactctccacaacgctcgagtccaccaaatcccttgcatttccatctttccataagctccaagactacaccaacagaatataagaatcagttacaaaagtatgcatcgtttgagctgaagaaattaagcattctgctgctcttacataagctataaggtttgggaagcccattatgagatggggtgagctgatcctgaagccacttatgatctccaaaagtagaataccaaagctatatatgtcagacttgacagaaaagattccttccattgcatattcaggagacatgtacccactgtttgttaagcggtgaggaatgcaccgtttgaatcagtaaacatgtaaatttgatcacattaagcattagataattcatgcatcacttactatgtcccaacaacacgggtggtgtttgcttgttgctggtttccaccaaagatccgtgccatgccgaaatctgatattttgggactcatttcagcgtccagcaagatattgcctgctttgagatctctatgaataattgttaatcttgaatcttggtggagataaagaagccctcttgctacccctttaattattttgaaccggtttggccaatcaagcactgtttttcttgtagcatctcccaatattaacatgaacaaagtgtatcgtcagccatcattcagtatatatttttactaattcactaatcatttaatataaggccggaaatcagaacataccaaaaaggaaggcatccaagcttttgttcggcaagtattcatagatcagtaacttttcatcttcatgaatgcagcaaccaacaagtttaactagatttctgtgctgcaatcttgcaataaggacgacttcattcctaaactcctctattccttgcccagaacccttactgagccttttaacagctacttccttgccaccttccagaattccctatgtgagcaaccaaatgttcaattaaacaagtaaaagccaaatattaactggaaatgtcaagctatgacattaaaaaaaaaagaaatatcaagatatatcttctccttaccttgtaaactttgccaaaacctccttttccaagcatattataactggagaaattgtttgttgcaattacgacctcttcaaacccaatgaatggaaaatccacatcttcagccccaagttcatttgaggcactcaagtattgtaccataattttgttctggatttccttgcttcgctgtttgcctaacaagaacagtattatatagaaattgttttactaacaaaactacatggactgcattttgagaagtgatgtgagtgttgttgtaccccttgatttgcatatccacacaaggcatatgcatgtgaggatcagtaggctagccacaactggaaggacaatcttcactacatcagtctccttcttgactgctgcagaaatatagtccatacaagagaatgggactttcaggttctcttcataagctgcttgcaagtgcatggactagatgcactttactattagtaatgtttcattttaaccatatttgatgctactacagacttcagatgaattgtgaattttacaggcagatttagtgtgtctgcaaacatcagaggaagtggtaaattggcaaatctttacacattgggcaatagagtattgggtcccatagtagcagaagtggcacgccaaaagataggccacaagttgctaatgcagcaggataccaatttgagtcctgtcaatggtacatgaactggactgaccaagaaatgcatcggctagaaaaaacaaattactgaaatcggtgtcaactgaacaattggtcgtaatatactaggctatgtttcgtgaccaccattatctttcctaatataacttcctcaactaaagagtaagagcaacaagtgcctaattcagcaaggtgcccattcagtatgaaatggattagaaagcatagatcagaaagaatgctttataaaacagtttagaaagctctgggtcaagttaaaaagcataaaaaaaaatgcgtaatcaaattaattaatacttaacagtgcataagtggagtaagtatgggcattaatcacaatgtagaggcatatgatgggcagggaatgataaaaagtaccagttgggctcggaagccggaggtacagattctcaccaccaccagtgacctttgccaggtctagaagctcccccatccaaaccaagcacctcgatgtgtcacccatcatgctggcagtgctcaggttcgcgtaagcatatgctgtgcaagagcagttgtgcctgcactcttccatgcactcatcaaggcttctgttcctgatgtacaagaacttgtcaggtgttttcatgccaggcaaggtcaagaaactatctccatagctacatttcatctgctcctttctcacacatcctcttgaaatgttaagaccatcaggcttgaatccatcaaggcacttgcatgttgggaatgcctccgcagcatcacaataaccaaatggtccacaggaggcatatctttcgcaagtataagagggattgctgaataacacagaccatgcaaacaagttgctgttccagatcagcatctttattgttcctgtgtagtcgagcatcaagcgcatgctaggagagtcatcagaaacagagtacatcatgtatatctcattccctttgttgatgattgtctggtatgtcacagagctggtattactctggaacatagcagagaccaacgcaccattccatgccccactacgccagtatggacttgttccattccaaaccaaaacctggaaatccgagttggggtcaccactgagggaaaagttgccggttgatggatcatcagggcccttccaagaaacaatgcgctgagcaacctggccattgtatttcagcaagagcttcatgccagggaggatggtatcagtcaaatgatcaaagctctgccacaagattgtgtggttaggagatcgaaggaccaaattaccagaattaagaagaactaccgtggctccagaacctccagtggtgatgttgttccttgcttcccaaagagtgtggcctcccgattcagacaacacaaggtcagaactgttggagatgaagagcatggcagaagaaggggcagtgattgggttgtcacggttggcaacccacaccacggtgcgattgggaatcttgtggtaccatatgccaacatataaggtagcatttgagtttgttggggagaagaaaccaagagcaaaaacaccaccatccgagattagcatgtcaccagggtagagtggctttgcaggtgttagctgatcatctgatttgcacaaagaaatcaagaacacgagtacgaaaacggtagcgaaagccgtgcccattaggccttctattctgtgtaaggttgagtaagcatggaagcaattcttccctccaattgtaggaagctcttatcagcgaggacacgcaattggtaggaactatgaacaacaagccaaacaagggtcggtctcatccagctgaacaaagttgactcaaatgatttggccatccagcaaatcgtctgcccaacttgagccagcaactacataatgccgtctgagtgaaggttccttgaatttcattaccagggacagtaagtcaaatacatcggcacatctccatccagaaatacaaagtcgaaagttcatcgaacatgtgtgagtatgacagttaaaaggggggaatattgagaaactggctggctcaccaagtcaccatcggttttagctcgcggcggaggcgactgaagcggaccttaggtctccggggaaatctcgccgtagacggccggcggctgtgatgggaggtccctggcggcggaggtaggagtagggcaccgtcgaaggggacatgacgcgagtcccccgacgaggccccggtcgtggccgtcggcgagggaggttgaagcggagggacaaggaggcaccggcgggcgggcatggtgggcaggctgtgcgcgcggcggcggcggcggcggcggcgcgccgccggctgcacaggttgtcggaccgagaagcttcgccggctcgccgccgaaggattcggcccacggacatgaattggatcgtaaaccattgcttccgaatcaatctgggcttgcccatatccatactgagctgcaaagttcatcgtggccgtttcctcaccatgcggcccagtaaatcggcccgtcacatccaccccacttcgctttcgtcagagatcgccgccgtcgccgtcgccgccgtcgccgccgccgccgctggatggaaccggatctgcctgcgcgtgctcgatagcttgcaagaccgatcagttggcgaatcctgaatgccgcagcggcgcagccgcctcggctgcttcccgtcgggcggcgctcccatggaaggatggggattggttccgttaacgcagatggtgcgtatttcttcaggccttagatccatgagagttccagtgcgccattgattaatagggtttatccagatctccactgtggaatgtggattgtgattgagagtattgcttcctggttggtggtggtgtgcaggtttcgccttggcctggggctttccatgaataaggcggcgccggcgtgctttgctgctttggacaacgcagcagcggatgcccttcaaagttcaaactcgtcacctgtaagcagactgcttctttcctatgcaatgctatcaaatgataggatttggccaaacgatttgcatttattagtctgcaaatttcagagcaagccaaggctgcagtagcagaaatagttaagtttctgaaatatggatgtatggaagcattccttttatgcaaccaagcaacaaagaaaatgctggttacaatgtattgctcagaacattttctgtgtataaatttgaattgctaatgtataagtgtacaactacaagctacagaagtttatagactaaacagggaatggtgtaataaacatttaacgtccctctagtgctgtgatactcacgttatttacagatctttccttgttttctctagtgtctttagttccatagaccctagctgtcaaataagcagactcctttggggtaggaagagcagctgtctcgttctctaacatgaacacaatggatgacatgagtggcctggcagttgggtcatcttgaacacatgaaagtgctatttgaatacatcgtaaaacttcgtgaagtagacaactctcccgaattgatgagtccaccaaatccattgcatttccatctttccataaactccacgcctgaaccaagatatacaagaaagttgtggtcaatttattttgcaatgttttactgattaaaatgttgaggattgcagtccacttacgaaggttataagattttggaaatccattatgagatggggcgaactgatctttaagccacttacaagctccaacagtagcaccccaaaactgtaggtgtcagacttgacagaaaaggagccttccaaagcatattcaggagacatgtaaccgctgtttagatcattccaaaaacaatgtaatgtgcagtttgaattagttataatgaaaacatatatcattaggtggtctacaggttacttactatgtcccaactactctggtagtattttcttgttgcttatttccttcaaagatccttgccatcccaaaatctgatattttgggactcatatttgtgtccaacaagatgttgcttgctttgagatccctgtgaattatcgttaaccttgaatcttggtgcaaataaagaagccctctcgctatacctttgattatcatgaaccgggtcgtccaatcgagaactgattttcttttagcatcttccaagattaatgtgaaacaaagttaattgtcattaaccatgaatatcctcaagaatgtttgtattatacgaccacaaataagtgagtaacaacgtaccaaaaaggaaagtatccaagcttttattaggcaagtattcgtagatgagtaacttctcatcttcgtgaatgcaataactgataagcctaactaaatttctatgctgcaatttggcaatcagaactacttcatttctgaactcctccacaccttgctgagaacccttactaagccttttgactgcaatctccttgccaccttccaacactccctgcacaagcacacactctttcaattgaacaagagaatataaaagatatttcttctgaaattgccaaggtaaaaccttttgtaccttgtaaacttttccaaaaccacctttcccaagcatgttgtgatcagaaaaattgttcgttgcagtgacaatgtcttctaagcaaataaatggaagttctagattgtcattctcaagttcactggaatccttcaaatgttgtagtctatgtttcttctgaatttccttgcttcggtgtatgcctggcaggaaagcctttcatataaattgttaccttagaaacaatgcagcctgaaaagcttagttggtgttggcctacctcttgatttgcatatccacgcaagacatatgcacatgagtatcaacaggcttgttataaccggaagtacgatcttcgggatgtcactcttcttcttgttaactgcagaatacggcccaccaagagaacacggattataaaatttgaggttgatatggagtagcacattggatatatgttctttttcctttaacagaaggtatatattccttttttgttttcttcagaagagtcctatcaagtagtgaacatttttttgttcgtggaaaatcttggcctggcaagacctctgcatattcagttcttcagaaattctataccatgccttgcaagtgtatatatggatgttgcttttaattcgatgagcaggctatctaattaagagctttattttcaccgcagggcaagagaaattgggcataccagtagagtcggccaaccggaggtacagattctcaccaatgttggccctcccagtgtcagcaagttcccctgaccaaagcaagcaccttgcctggtcggctccggtcaagttggcgtaagcgtaggccgtgcacgagcagttgcggctgcactcggccgcgcactcatcgaagcttctattccggacatgcaagaacttgtcagggaccttcattccggccatggtcacgaagcgatcatctctgcctcggcatctcaattgctgcttcctccggcatcctctcgaagaagagttggagccatcaggctcaaacccatcgaggcattggcacctcgggatggctgccgttgcgtcgcagtagccgaatggaccacacgaggcgtagggatcgcacacgatggtgggtgatgggcgctggacgacgactgtccatgacgacgcgctgtcgttccaagccaggaacttcaaggtacccgtgtagtccagttgaagacgcttgtaaggtgagccatcagaggttgtgtatatgatgtagaactcatcatccgtgctcaccgatgtttcgtagatgagagaggtactgaatgagaagaccgaagaccacatgctgctaggcccaaatccaataaagcggatatatggtctggtaccgttccaaaggaagatctgaaggtttgagctgggatcaccgctgatggagaagtctccggtggaggggtcatctgggcccttccaagcgatgcaccgcatggcgacttgtgccttgtagctcaccaaaaacctcatgcccatcagaagggtgtcagttgggtgatcaaagctctgccatatggttgtaccattcggcaaccggagaaccaagttccccgagtcgagcagcgccgcgtaagctccgtcgcctccggtggccgtgacgttcgtcgtccaaagggtgtgattgccggaatccgacaggacaaggttagagctgttgctgatggcgagcgttgcgaatgaaggggtggtgattgggttgtcgcggttggcgacccaaacgtacgtgcgctcggactcggagatgttgtggtaccatatgccgaggaagaagctctggttggaggctgttggggagaagaagccgagcgcgaagaccctgcctttggagatgagtacgtcgccgggggagatcagtcgatttgcctgtgtgagctggtcatcgcctttgcaggaagagatgaggaacagcaaggagatgaaaactgggaggcaggccataatctggtaaatctcatatggccttgttcttggctcgcctgtggctatgaagcgtgaacaattggcacctttgatttttgctactaatccatacacgactcttttctgaacagtgaatttagtacggtgggccaacgaagtaacgcctgaccgggacttgtctgcccctctggtgaagacgcagtgtcaaaccgcaaactaattactgtagctacgacatcagggtcagctgattaaactttcgagagagacgcgaccgtgaaaagttggcaagagagcgaaacctcgcggcatgcgcgtgtgtcggccggtcgccgccatggcgcgttacgcaatgccgagaggcagcaggtaggcaggtagtcagtgttgtaatgcaacttgtgcggttgtgcctggcacacgggaagtccgaaacatcttcgctgactctcctgaacaaaaacaacaaagaaaacgaaaatttcagtctcaaaacgttgcgcgtgagcgtgatgacgctgggacacacggggactttgtacactaatcaacacaggagttgatggcgtcaagtcgtcgattttttgaattttatttatttaaatatttacataataattttctagaaaacttttagaaatctacacctaaaaaacgacgtctaggagagagttttattttttttatgacgtggcacacgggtgttggcataccgcgtaaaaagaggccggctattttgcaagcaattgccttgacatcttcccaaaagactataaggaggccacctgcaaaaataaccgagaatgttattttacaggcaaccccttgtcacatcttttgagatgttgtgaaatggccgcttgcaaaatgctctagccatcatttcacatataatcccatataaccttctaataaggcggtaagaatgctacttcagcctctttctatgtgaccgttaacatgcaccaatgaatatgtgccacgtcaaaaaaaaacgttctgctaaaagtggtaggggtgtagattatagaaatttgaaaaaatatttcaataaataaaattaataataaacagaatttgtgtcgtcaacggcttgctgacgtgctccatggcagcgctgggctgtaaacagccggcctggccttatgggcttcatggattaaacatgggccgcgggtgctatatgtgggccaatccatccgtggccgtgtacgcagggccgaatcagacccagttgggccgcaggtacaaaacccttccgcgtggagttcagacgacggagaagagggcaccgaccaccgagccggcagcgggcggcgccaaccgggaaggcggttcgtccgccaccgcgagcgcgcgaggtggcgcggcggcggcgtcagcgccggtgttgccaggcgagagagctagtggttccgcgtgtccggggagcagacgtatcacggattcaccacatcgtggcagggcaggttggttaccacccccttgatccttttgcccccaaatctcttgccgatttgcccatttggaagcgacgaggagacatcatttgcattggaagtaggaaccacaggcgctgaagattcacacaacagcttcttctttttttttcagtccttcggtgctgcgggagcactttggtttggagaccttccgccaaacgaagatggactttcagagacctgaacaagcatagcaggtgatcaaatcacaacaaaactgcctgtgcaagtcattcttttcaacatctcatgagtgaattgcacatggaaccacttatttatttttacccatatgttgcaaatcggattaggggtacatcaatctgcttatgcaatgcattcttttacaagatctataaacctcagctcctactgtagtaatgtacaactgcagaaactgcttgagagtttaatctcttacagtctagcggccttctagcgctgtcaggctcgcgttattaacggaactttccgagccttgtctttcttcttcgtcgtaatgcctttgcacgaaatatataggctgcttcggtattgggcgtgccatgtcctcgttgtccagcatcgacacaactaatgacatatgcggcctggcatttgggctgtcctgaacacacaatagtccaatatggatgcattgcaatacttcattaagcaaacagctctccagaaccattttgtctacgaaagcctctgccattccatctttccacaagttccatgcctgaaagtaataacattagtaaagatttcttaacttgttttaactatattgtgttcgaattgttaacataagtattggtagcagcatgcacttacataagctataaggttcggaaaatccatcacaatatgatgaggggagctgatctttaatccacttacaatctccagtagcaatacgccaaagctataggtgtcagatttgactgaaaaaatgccttccattgcatattcaggtgccatgtagccgctatttaaatcatttgcaagcaagcaggaaaaaagtgaataagttcaagcacatgaatatgttgaactagtcggctagagaacaagtccacttactaggtcccaacgactcgtctagtacttgcttgctgttcactgtttccaaaaatccttgccataccaaaatctgatatttttgggttcatctctgcatccaacaagatgttgcttgtcttgagatctctatgaattatcatcattcttgaatcttgatggagataaagaagtcctctagctacccctttgattatgttaaaccttgtttgccaatcaatcacagacttcattgcgtgatctaccaagaaaatggataatggacaggaatgaaaccattagagaattcgataatgttgactcctccattagagtatgcactttgtcttaatggaaattcaggtggggaacctctcccctccggtgaacattccaaaaaaaaaaaatcaagacttttttttaatgcatccttttctgaaaaacaagcttttcatttaatatctgataaaacttaccaaagaggaatttgtctaagcttttgttgggtaagtattcataaataagcaacttctcatctccatgaatgcaacaaccaagaagtctaactaggttcttatgctgcagttttgcaataagaactacttcattcctaaattgctctaccccttgctcagaatccttgttaagccttttaacagcaacttccatgccatcttccaatgttccctgtggtatttcattaccatggagacatggtgttaaacaagaataaagtgacatgaatgctacactcacattgtgtaatttacaaggtaaaattttataccaccttatatactttgccaaaaccaccttttccaagcatgttagtttcatggaaaccgtttgttgcagaggtgaggtcttcatagctaatatcagggaactctagattttgatcccatgagtcatgaaaagcactcaagtatcctagctccgtttttttaagtacttccttgtttcgtcgtatgcctaatataaatatcaaaacatgtcaacacaacaatattacatttagcagctgcatattgcaagtagctgttatctcttgctttacctcttgactcgcatttacagagtacaacgcatgagcatgctgtcagtatcagcaggcatgctatagctgggagtacaatctttacaatgttcttgttgtttactgcagaatgacatttatcgtcatgttcatggagaatgtggggcaattgctagagaaaacatcatgagacggcgcatacctgcaggagagccggcgagtcgaaggtacaggttctcaccaacggcactggctttctccgagtcgagaagctcccccatccataccaagcaccttgaggggtcacccgtcgtgaggatagttctcaagttggcataagcgtatgccgtgcacgagcagttgcggtcgcactcatcggcacactcctcaaaggttctgttcctgatgtacaagaacttgtccggcaccttcatccctggtaaggtgaagaaatggtcttggccaccgcatctcagctcctcctttcttcggcatcctctggaagagttgaggctaaatccatcggccggctcgaagccatcaaggcacttgcactcctggaagctgccggtgatgtcgcagtagccgaacggcccgcaggcgccgtagtggagacagccatggcctggtcgctcgaatgggctcgtccaagtcgatgatacgttgttccatgcccggaagctcacgttcccggtgtagtccagcttccagtgtgtcaaaatgccatcagctgcgttgtatatcgcgtagatctcctcgccattgtcaacgatctgggaccatatgtacctggtgaggccggtggccgtcgcgccgttccagacaccgctgcgccacgacgggctcgccccatgccagatgacgatatggagcccccactggtcagggtcaccgctgagggagaactcgcaggtggacgggtcgcgacgacccctccaagcaactacgcgcaccgcctcatggttcttgtatgttcgtccatagcttgaagccagggaggccagggaggatcgtgtccgtggggtgatcgggcaaccggagcacgaagttgcccgtgttctgcagcaccgcggtggctccaccacctccgatggtgaccgtgttcgccgtggtccccttggagtcggatagcacaagcccggaggtgttggtaacagccagcctcgccgtatgggtggtgattgggttgtcgcggttggcgacccagacataggtgcgctccgggatgttgttgtaccatatgccaaggtagagcaggcttggggttgagttggtggtggtcagggagaagaagccgacagcaaagacgccgccatccgagatgagcttgtcgccgccggggaagatgagtggctttgccggtgttaggcggtcatcggattggcagaaactaatcaagaacatgaagatgactacatgcagtctggtcatattctcttgtaaattccttggaaagcactacaatcctacatagagacgatagaacagagttgtgagattattgggccaaccttcttgtcggcagtatagagtaactagtgcagctagcttcgtaaaagagtaggattatactatcgtaattgttatatttcccaggccctgaaatagcgcaatagatattctgtattcctgtgttgagagtgagaaaattgggattatactaccgtaaaagagtggtttcgctggaatgctatcccttcaaactgattcattaaaatgctattctaaattgaaggtgttcaccaaaatgctattttcgtttttttaggtaaatagaaatgttttttctcaattataacttttttccggaccaaaatacccctgatgcgggcccacctgtcatactccctctactctctcctcctcttcatctctctcgagggagcgccggtggttggaagcgagcagtggccgacagcgccgttgaagctcggtgtcggcctgtacgacagcgccggcgactcgccaccggcgtacgacggcgcggtgctcggcggctgcgatggcgcgcggaggcgccgctgctcgtggtacagcacctgcaccaccgtctgcaccggccacataagcatttagtggagtgattaacgaaggatttagccattttttagtgatcgatgtgaatggcagcttctaaccttcaagtagatgtcgatggcgtggtacatgccgtcctcgttgaacctggcgtgctccgggatgagctcggcgagggcggtgaactagtcaatggacaggttctcgtcggaggcgatctcggcgaggtagctctccatgagcctgccgacctgggcgacgtcgttgtgcggcggcgacaccgctgagctgaagtcgtcgtcggtggtgcagtccagccgtggcggcgccgccgccgcgtcgccctcatggtcgaggtagccggccaggatcctctgcacggcgtcaatgtcgtaggccgttgtggcggcggcgtcgggcgaggaggacgggatgaggaggtcgtcgagcacgggctagccgagctgcgccgccatcagcttctcgaggtcgagccggcacgccagcgacggcgacgcggcgccggccactgctcgcctcccgccaccggcgctccctcgatagaggggagggggagaaggagagagtggagagtatgacatgtgggcccgtagcaggggtattttggtccagaaaaaagttaaaattgaggaaaaaaatttctatttacccaaaagagtgaaaatagcactttggtgaacacctccagtttaagatagcattttagtgaattagtttgaagagatagcattccagcgaaaccactcttttacgatagtataatcccaattttctcgttgagagtggccagatgatcagaacgacacgctagtagttgtatgtcaccgttaagattgaagacccgatttattgctcaatgacttttattttcagtgcttgatgaagcaagtcagcacgcacagggcatttgctagtcttcaggagaaccacttgcaacggcagtacggcaggcaagctattttaccagcacaactaatcacagatttacaggcaagtgttttgctgtgcatctccacaaatatttcccggtgattcttcccagcgtcctgacttccgagccagtgatgagagtgagacggtggaggtgcttcaccgggcagcggcggagaggcattggcatgggccgcggcgagggaataccagaacaaattcggcccaccagtccgcgaccggaactgtgagattcgtgggccgtgaaagtgctcgtgatgggctattgggcctaggtcgattgatctgtggacgaagacgaacgtgcttcggttacttcgccggcggagtggtggttggcggcggtggggggcggtgagccggcgacggtcggcaccgcacgtcgaagcgcccggcgtccgcggtctgccgctcccggtggagctcggcgaggtggcggaggcgttgcagcctaggagaggaagcgctcggttgaggcggtggacggcggagtagcggcggccgtgggggcaggtgccggcgccaccgccaccgcagccggcttaggcggaagagacggcgggcctaacctgctactgtcccgtccccttacgcggtcacaagccattgacgccaagctggttccccttggcccttgccacttccacgccggcagcaacatccctgctacttgaggccaggtacagcttcttctttttttttttagaggtaaatggatagaaatccggcctctatggaatggaaatcatggccaggcattgctaatttggatatctatttcaataccaaccatagtctttggttattatcttctattaaaagccggcttatgaccttttggctaaaacaaatggtttaattggtttttaaaaatgccattataatttgtgtatttgtaaacatgtcacattcttttaggtttatgattaacttcagataaaagcaaccacatgtggaatagaaatacagtgtttgcaaatttgtaagcaataccttgtctgcaatgtaacattttttatatataaataccaatcaataagattaatattcacaagcattcttcaccacgcagcaaactccactgttttccattaaagatttaaagtcatatatcacatcactgaaattcattatcataagcattaaattgtaaaaacatagaattatctatgctgaaatcatgtatagtaaagcttgacctcttagtctagcgtccctccagtgttgtggtactcattgtattcacagagtacacactttcttctgtcgcttcttgtgttccgtggttcttcatttcaaaatacacaggctgctttggtgcaggaagcagcgtgctttcattttctaacataaaaacaacagatgacatcgatggtctatcattcggatgatcttgaacacacaagagcccaacgtgaatacacctgaaagcttcatgaagtggataactgtcaacaaaaaacttgtccaacaattctgttgcatttccatctttccataatctccatgcctgtagaatgaagttctgaccaaagttactaatgcctgttgctccaaaatactgctgactgctaaagtttaatttggtatcaaaattatcggcattttagagtacttacataggctgtaaggctgaaaaagtttggtgtgagtttagatgaactgattttcaggccactgacaatctccaaaagaagaacaccaaagctgtatgtatctgacttgaccgaaaaggcaccacccaacacatattcaggagacatgtaaccactgtataaaccatttcattagcaatgaatgcacaatcgttggcaaggattaattcacagtttgaatttaactagtcaataaaacctagagtgttgaaaactatctagtgggctaattactagttattacttactatgttccaacaactcgagtggtgtttgcttgctgctgattaccatgaaaaatccttgcaataccaaagtctgatattttggggttcatttctgtgtccaacaagatgttgcttgctttgagatctctatgaattattgtcagtcttgaatcttggtgaagataaagaagcccttttgctatccctttgattattttgaaccttgttggccaatcaagcacatattttcttgtagcatctttcaacaagatcagtatgtacaaaatctaatgttagtcatcataaatatattttagtcaatgtaagaacctttttgcaatgggatagaaagtcataacacaccaaaaaggaaggcgtccaagcttttgttaggcaagtattcatagatcagtaacttctcatcttcatgaatgcagcaaccaagaagtctaactaggttcctgtgctgcagttttgcaattagaaccacttcattcctaaactcttcaatgccttgtccagaaccctcattaagccttttgacagcaacttccgtgcctccctccaatattcccttcatgttgtcatcaatataaatagggaaacgctggggcagtaatattttatatagtttcaaaacgtgttatgatgtagataaatttagtactctttcttaccttgtaaactttgccaaagcctccccttccaagtagattggactcacagaaattatctgttgcagccacaatatctccaaagctaataaatggaaatttcacattttcacctccaagttcattggaggtgcccggatattctagcatcagtctcttttggatttccttgttttgtttccctgataaagttcaacacatgagatttttacaatatacttaagaaggtaccatctggaggcactatacaattttagtgtaaattcccggtatctctatagtgtcgaggcaccagtgctatctcaagaaccgtaagtcattgtcaatgcatttatctttcaaattacgaagtagctttacatttggaagacaaggccttatatcatctacctctgtgcttgcatatccaggtaaggactatgcatgtgagtagcagcatgcatactgttatcggaacaacaatcttcagtaacctgtttttctttccaactgcagaaatgtacacctcagatgttagtgttatggcatggagcataacttggaaagttaagtgttcatataactacatttttttataggaactctcatataatatcatgagcattgccactatctgaaaacgaggcgacagtgtgaaattttgcttaccaggaggctcagcaaggcggaggtacaggttctcaccaaggctggccttcttctctgagtcgacaagctcccctgtccaaaccaagcatcttgacgggtcagccatggtgccgccactgctcaagttggcgtaagcatatgccttgcaagagcagttgctgctgcactcggccgcgcactggtcgaagctcctgttccggatctgcaagaacttgtcggggaccttcatgtcaggcaatgacacgaagcggtgaccgccctctccgcatctcagctcttcctttctccggcatcctgattgcgagatgctgggatctacaggctcgaacccatcgaggcaccggcacgccgggacggcccccgtgaagtcgcagtagccaaacgggccgcacgagccatagacctcgcagctgccggcggcggggcgctggaagatcaacatccatgacgacgagctgttgtcccagctcaggaacatcatcgtgcccgtgctgtcaagtgtgaggcgtgtgtagatggagctgtcggagacagtgtatgagtagtagagcttgttccctgagtcgatgagtgtttgatacatgaataagctgctgttactcggatactgggcgccggacaccgtcacgctggttctgacgccgttacggcagtatggcttggtcccgttccaggtcatgccctggaggtccgagctggggtcgaggctgaaggagaaatctccagtggatgggtcatcatggctcctccacgcagtgaggcgtccgatgatctcggacttgtagctcatcaagaacatcatgcctgcgaggatggtatcagtcgggtgatcgaagctttgccatatgtcggtgccgtttggcaaccggagaacgaagttccccgtgtcgagcagcacggcggaggctccggtgacgctgatcttggttgtccaaagaatgtggccttgggagtccgacagcaccatgcctgagctgttggtgatggcaagggtcgctgacgaaggggtggtgattgggttgtcgcggttggcaacccacacaacggtgcgctgggggatgttgtggaaccagactccaacatagaggctattgctgaagttggccggggggaagaagccgagggcaaagatgccgcccttggagatgagcatctcgctgggaaagattggctttcccagtgtcagctggtcatcggttttgcatagaggaatcgagagcagcaggaggaacatgagaaaatagaccatattgcctgttagactttctgcttcgtttgcttgtcatgggtcaagttatatctttcattcataatgcagatatggactggtgtagttggagttcaattcccttgctgtcacctcatctgaagatcaggagaaatgtgagatggctaagtcctgattcagactcatggacagagacagtaaaggaccctgtctgaattctgatgaccaggtcacctggtcatgatactccaagtcgtgtgacaatgctgcacgaaaacgaaagaatgctgctgccatggactttggagtgataggctagtgcaggcaaaagcgaaacctcacgtgcgttccatggctccacgtggtgtcacaggcccttgatgctgccactctccatttgaagaagtacaataggtattaaaaccaattatgatttttatcccaagttatatatatatttttttgaaggaaaggcaagtaatcgtagtctttactgctctcttttagcttacctagttttgagcacagtggtttcaattctccactctcttttttcttaatcgcctagtgcagaaacttccaactcaccaataattgagcgaaattgcttatggaagaatttccttttttttttttttgtaaaccattgaagatgaaccatacacccacaaagcaatcatattcctaggttcttgcacaattgatcaagtggtgaattctacagccagctatatctgaaatttaaacatctaacgtccttgtagtgtggtaagacttgtactgttcacagacttgttggcatcctctcttgccccttctgccatgcaattccttggcacaaaatatgcaggttgcttagaagtaggaagtgttgtggcttcattctcgaacatggccacaactgatgacatgagtggtctagcatttgggtcttcctgaacgcataacagtcctacatggatacagagcaaaaactcattaagcgaatagcactccagaataattgagtccacaaatttctctgcctttccatctttccacaagctccatgcctgaacaaagagaggagatatcctaatcagtgctaaatcctagctgttgaaattttgttcatctcaatatttcatagaacttacacaggctataaggtttggaaaatccattataagatgagttgagctgatcttacaaccacttataagttccaagactaaaacaccaaagctatatgtgtcagacttgacagagaagatgccttccattgcatattcaggagacatgtaaccactgtttgaatcgtgccaccaataacaagaagtgtgggtaatttgaaagtatccaagtatataaaatttagtattttaatcataagtagtgcaagagttactcactatgtcccgactacatgtttagtgtttgcttgatgctggttgccaccaaagatccttgccataccaaaatctgatattttggggctcatctcctcatccaataaaatattgctggctttgagatctctgtgaattactctcattcttgaatcttggtggagataaacaagacctctggctactcctttgattatgttgaaccttgtttgccaatcaagtataggcttttttgaatcatctaccatgaacagtatgaaacaagacttaaagttgttcaggcacctctcccaccaaaagtgataaagggaaaatgaatatatgattaggcgtaccaaaaagaaagtaatccaagcttttgttgcgtaaatattcaaaaataagaagcttttcatctccatgaatacagcagccaagaagcctaactagatttttgtgctgcaatttgtcaataagaacaacttcatttgtaaaatgctctatcccttgtgtgcaacctgtgttgagccttttgacagcaacttctctcccgccttccaatttcccctgtgtaatacaatcattttaaatttataaaatattgtaggattctccagtgtttgtgattgtcagcctgaattgtttaccttataaaccttaccgaaacctccttttccaagaatgttggaatcgctgaaattgtttgttgccgcgacaacgtattcaaaattaacatgtgaaaattctaaattctgctcaattagttcttgagatctaaggtttcctagcagcattctgttctgatttttgttgtttctccgtttgcctaataacaccgatgctgtcagtacaattacaggaagacatcatactatgaattcataagtaacggcccttgccataccttttgattgccatttcctgacaaggtatatgcatgtgagcatcagcaggcatggaataattgtgactaaaaccaccactagatatctgttctttttcttatcttcagaagtgtgtcctatcaagagaagtaaacaaaattatgagaatttctaaaccataagtatgcatggatgttgcttttaatttgatgtgcagactatctaagattttgttgtctctgcaggggaagaaatggtgagcataccaggagagtcggctaaccggaggtataggttgtcaccaaggcttgccctcgccatgtcagcaagatccccagtccagagcaagcaccttgactgatcggacatggtgtcggctttggtcaagttgccataagcataatcgtaggccatgcatgagcagttgtggctgcacttggccatgcactcctcgaagcttctgttctggacttgcaagaacttgtcagggagcttcattccagacatggtcacgaaatggttcctacctccgcatcccaactgttgctttcttcgacatcctctcgaagagttgaaatcacttggctcgaatccatcaaggcactggcatctggggatggccaatgtgaagtcgcagtagccgaatgggccacatgaggcgtagagattgcagtcaccagcggccgctggctgttgagagatgactgtccaggacgatgagctcccgttccaactcaggaacctcatgttgcccatgtagtcaagcttgattcgtgtgtatggggagccatcagaggttgtgtacataatgtacaactcatccctagtgttcacaagtgatttgtacatcaaagtggcaatgttgctcccgtatgcttcaccggacactaacactctattaagtgaaagtgcaatgaaacggtaatatggcttggtcccgtgccagatgaaggcctgaaggtttgatctggggtcgctgtggtaggagaagtccccggtggatgggtcattcggtcccttccaagcgacaagtcgcatggcgacttgtgccttgtatctcaggaaaaacttcttgttggggagaagggtatcagttgggtgatcaaagctttgccatgcggttgtattgtccggcagccgaagaaccaagtttcctgagtctagcagcactgcataagctcggtcacctctggtgttgatgttggccatcgtcgttcaaaaggtgtggccttctaaatctgacaatacaaagttagaactattgctgatggcgagcatcgcagatgaaggggcagtgatcggcttgtcacggttggcaatccaaacgtatgtgcgctctgggatgttgttgtaccatatgccgaggaataagctctggttggaagttgctggggagaagaagccgagtgcgaaaaccccgttctgggagacgagcacgtcgccagggtagagtttctttgcttgtgtcagctgatcatcgcacttgcagaatgagaagatgaaaagagggaagcaagccataccattcatttggtcttgttcttagctttgcctagttgcctgcaaagcgtagagaaatagcacacacacatatgggtgtttaattatctgatgcatacatgattctcctgagtcttgactcttgactcttgaggagcacgcggttggaccaaaggaagcagcgtaataacgaatggccgagactattctgtccgtcgagataaagttttgctacgaattcaaactgaactgtggggagactacggtgaagtggcctgacgagagcataggcgtagctggtattagtactcagtgttgtgatgctaacttgtgcagtttgtggctggctggctggctcggtggcaccgggacaacctcgcaactagaaatatcgacgcttgaacgcttgtgcacaacagaaaacttactacaactatttctgtagacgacaacatgaaggttggaggatcaacgatttatgctcaagaacaattgatggagactactgaaggatcaaggaagttgtttgcgttacgcaaggagacgacagggattaccccaagagactttccttcttttttttttttgtaaaccattgaaaatgaaccatacacccacaaagcaatcatattcctaggttcttgcacaattgatcaagtggtgaattctacagccagctaaatctgaaattaaacatctaacgtccttgtagtgtggtaagacttatactgttcacagacttgttggcatcctctcttgcccctcctgccatgcaattccttggcacaaaatatgcaggttgcttaggagtaggaagtgttgtggcttcattctcgagcatggccacaactgatgacatgagtggtctagcatttgggtcttcctgaacgcataacagtcctacatggatacagagcaaaaactcattaagtgaatatatctgcagaataattgagtccacgagatcctctgcctttccattcttccacaagctccatgcctgaaccaagggaacaaagttcctaattagtgcaaaatcctagctattgaaactttatgcattttgatatttcttagaacttacacacttacacaggctataagatttggaaaacccattataagatgaggagagcttatcttagagccgcttataagttccaaaactaaaacaccaaagctgtaggtgtcagacttgacagagaagatgccttccattgcatatcaggagacatgtaaccactatatgaatcatgtcaccaacgagtgtaagttatttaagtgttttccaagtatataaaagttagtattgtaatcataagtagtgcaatagttactcactatgtcccgactacatgtctagtgtttgcttgatgctggttgccaccaaagatccttgtcatgccaaaatctgatattttggggctcatcccctcatccaataaaatgttgctcgctttgagatctctgtgaattattgtcatcctcgaatcttggtggagataaacaagtcctctagctactcctttgattatgttgaaccgtgtttgccagtcaagcatagacttttttgaatcatctaccgtgaacaatataaaacgatacttatagttgttcacacatggccttttggtaacagtcttccaccaaacgtggaaaaagaaaaggtaaaaaaggaatatatgattaggacataccaaaaaggaagtaatccaagcttttgttgggcaagtattcatatatgagaagcttttcctctccgtgaatgcagcaaccaagaagcctgactagatttttgtgctgcaatttggcaataaggaccacttcatttctgaactcttctactccttgtccagaatgcttgctaagccttttaatggccacttctttgttaccgcctagcatgccctgcacaatttaatcactttaatttttattaagaaagttcatcgggatatacacttgttcacacagtatcatggatgtatggtttcacccctgaggttctatatttgattcttaacacaatcatacattcttctcaattatttaacaccaagtttgttggaacaaaatccaataagcatggcaagggcttcccttcaatgggagggaggccaagcttggtcctgtgaggagatgagaggaagaggatgaaggatgagagccctttcctcgaatggttcctgtgtcatctagttcaattctgccagaacaaatacggcccgctaatgcccacaaggacgccaagcccatgttgacaagaacccgatttcaagtcgagatcaatgggttacgggtgtgtcttcttaactcgtttccggtgcgatggctcaaagtttgggtaccgaggaacaaaatcgatggtaaataatcaattttatcatcacaaaaaatgcaattgtatgccacatatgttacggtcctactcctctccaaatatcaattatacatgtttcaccatgtgctcctaaaggaagcacttagcgtgcagaaaaataacataaacacctaccgtccctctaataagctgatgctattttcacctgtttgtctgccttcaaaggccctatgtgcaaaatacacaggctgtataggagctgaaagcgttgtggtctcgttctccaacatggacacaaccgaagacatgagtggtctattatttggattatcttgcacgcacaatagacctatttggatacatagtaaaacttcagttggtgagcaactcttagaaatggatgagtccatcaaatccatcgccctgtcgttcttccacaagttccatgcctgaaacagtggaatcaagtccatataaaattagtacaattaatctgaattgtagagataaagcattccaccatacttacataagctaacaaattggggaagtccgtcagccgaggcaagctaatcttcaggcaacttacaatctctaagagtataacaccaaagctatatgtgtcggatttgactgaaaaggcgccatccattgcatattcaggagacatgtaaccgctgcttaatgatttagcagtaagtaaagattcgagcaaataaacattgtgaacattaatgcatgaatgactcactatgttccaacaactctgttagtatttgcttcatgctggttgcctccaaagattcttgccataccaaaatctgatatcttaggactcatatcaacatccaataagatattgcttggtttgagatctctatgaattacagttaaccttgaatcttggtggagataaagaagtcctctagctactcctttgattatcttgaaccttgttggccaatcaagaacatatttatttgcatgatctataagaatggtaaactatgttattattaagtatgcagccaagtttctttggatcatatgataagtttatgcaatactgtagtatataaatctgaacagtaccaaaaatgaaagcatccaagcttttgtttggcaagtattcgtaaattagcagcttctcatctccgtatatacaataaccaagaagtctaacgaggtttctatgctgcagtttggcaattagaacaacttcatttctgaactcttctgctccttggccagaacccttgctaagccttttaattgcgacttctttgccgtcatctagcattccctgcataatttaatcactttattttttttattaagaaggctgttcatttgtaaatgagtggttttacagttcctaaagactgaagtctgaaaaggtactacagtcttaatgttaatttgaggtacctccatatttgggatggtaaaaatctctctgctaatttatcagtacactgcaggggcattcctacttcctagttccttttttttttgacatgctacttcctagttcctagttcctacagcatactatacggggtcacgagaccctaggtaaaatttcaatctctagttgttttagcctatattaactatattattagttaaaaattatagtattatatatgttagtttttgtccctattgtaattctcaagatagaacttattttgtaccttgtaaaccttcccgaagcccccttgtccgagcatgttgtcatcagaaaaattgtttgtggcagcagcaatttctccaaaactaacaaacgggagctctaaattttcatctccaagttcatttgatgcactcaagtatcctagaatccctctcttctggacaaccttattctgatgacgtttgcctgacaggactacaaatatatatagtgtgttaatattagctctagtaggagtagaggatataagctgcgagtattacctctgcacttgtataaccatacaaggaatatgctcatcagcagaagcaaacatgctgctgtaagtgggagcataatttttaccacagtcctcttcttattgttaactgaatgggaagaaaattttcaccgagaaaaccataaagtaattaattgctgaacccattagtttcaggcaaatgaatgcacatgcgtgcaattttgtgatagtcatgtgtacctagttcagactttgccaatctcacatgcaagtcctgccctttgtccacataacgaacatcaaccatgtcgccgatccacatgacgcagccgcggccgctgatgtccgcggcggcgtaggcgacgcaggaacagttggccaagcacctcgccctgcactcgtcaagcgtggcgcccgtgtccaccgtggcgttgtccgtgtcggggagcttcacgccgcgcaccggcacgaacccgtccgtggtgctcccgttgccgcactccagcggcgcgttcctccggcacccaccggaggtatccctcatggaccaccgcgagggggacaccgggctgaaccccgccatgcagctgcagaagagcgtcgacgcggtgtcctcgttgcacagcccgaacgcgccgcacttggcgtagtcgtcgcacacgccgcgcggtgccttcatgtacgggatccacaccttgctgctgggatcccacacgaggcgctcggtcacgccggcctcgtccagcacgaggcgggagaagggggagccggcggcggcggcggcggtgaagacgtaggcgatctcgtcgggcgtgaccaccacctggctcgagaagatggattcgtacgacgccatctccgggacgccgctgaaccactgcccgttccatggccccgtccggtacttcttggcgccgccgcaccacgtgacgcagtccgggagccccctcgtgtccagcacgcggcggcagtctcccgtcgccgggtcgtcgtgcgcgcgccacgacgagaggaaccacgcgtcgccggtctgccggttgttgccgagcctcatgccggcgatcagtgtgttcgacgggtgatcgaacgactgccagatgaagacaccggtgttcagctggtcgcgctcgcgcacgacgaggtttccggactccagcagctgcgccgccgtcgctgatgaagacttgccagtcgtgttcgacgaccaggcggccctgccggagccgtcgagtaggacgagcccgcccgcgccattgttaaccagtacgccggcggtgtcgttcagtgggctgtcacggttggccacccagacggcgtccgcggactcggagaaccatatcgcgaggtatctcctgtttggcaagccgagtgagaagaagcccagagtgaaggagccaccggccgacacgagcgtgttgccgtcagtgaggttgcggccattgctcagagtgtccgatgcaacgccggcggcagatgttccgagagtaaggaggaccatgaagaagaaggtgaggctaaggtggaaaatgttggcggttgctgcttccataacgggtgagtttttcttgcacgtccttgcccagaattgttcacggactacagtgcacgggaacaggttggcctcacaagtatcatacatacacggaatctagtgcccgtgtaggaggaattcaaacgcgttctaacttccaacacagtaattaatatcccacgattgactagctagctagatgcatgagtccatacggataagttgcaaagcagcggaaactgtagagaagaaagatgcatgagtccatacggataagttgcaaagcagcggagtttattgcatgtcagttagatagttatgaaaaatttttaaaaaaattgacaagatagatcaatatgtattatatcactccataaacatacaagtttaaattcaacttctacaagctgtaacaaaaataacaaatttaattgtaaatatatatgtaataatttgagttttgtttgttatttttgttacaatttgtagaagttgaattttatcttgcatgtttgtggattgatatattacatattgatctatcttgttcatatttttttaatttttttcataaccatttagatgacatgcaataaacatccattcgagctgttaaaacagttttccctatttaacgccttggaaagtgcgcccatggtaatttgattctgaatataacgtactagccaagttactatgatagtgcacacatttaagggtgttcaaactactcacaaaatcaaccttttcaaaagttggtaataccaaaactttgataagttgacaatattattaaattttcatatgcattaccaatgttccgtaacaaactaaatgaatccatatatttatcgaatttacctgatatgaattaaaatggcatcaatataaataaacccttacacgtatgattggtttcaaagtttatagtatatttatgtattatctctacttaatttgtttttcaacctcaaatggaaaatctgattatttgatggaaactgtggctttcctggtgtcagccgatcatcagttcggcgaccgagaccagccgcaggagatgagaaaagtagaccataatgaaccttaggatttctgattcgtttgattgtcacgactcatgagtcaaattatatcataaattcataatgcagatatgaaactgacttgtgtagttagagtttaattccattgctatcaacacctttggggattggaagaaatgaagctgtttaagtcttgattcagaccaatggaaatagacggtgaagggactagtcgaaagctgaatatctcatggccagttcaactgatcatgataaagttttctttttttaaaaaaaaaaactggtcatgatacttccaagtcttgtgacaacgctgcacgaaaaaagaacgccatgaccacgaatttaggttggactttggagggagcgggcagagcaggcgaaagccaaacctcgcgtctgtcccatggcgtggcgggttctcctaccagcgttgggtagtacttcctccgtattaggttacacaagtcgtttaaatttgttgtcaaaattaaactatttcaaatttaattaagctcatagaaaaaaatagaaacattttcaacccaagacaaaatatattatgaaaagatattcaattatcgatttgacgaatcgaatttggtgtcgtaaatattatactatatttgtctacaaacttatttaatcttgaagcagcttgactttgatcaaagtcaaaacgatttataatctggatggagtagtaagggcatgctcaatgtataaggtctacttggataataaggtaggacccggtattagttatagtgtttgctacaatgtatatgataagagaagacattagcctgggtcccactggtcccactcaattgcatggcatgtgagagagaagatgagagagagaagagaaagtattgctattttattcttatgggtgggcattatgcatatgggtagctcatgttaaagactactatatggactactatcacaatgttgtcatggttatggataccacatacctaataatagttgactaaatctcggcatgacccaccacataccatgtcctatacggaaaccgacttcagatatggagggagttccggataaggaaagacaactagagttctacatggaaacgacaaggactactcggattgtatccatattggtttccctagttctacttggacaagaggacacctatgggtataaatacaagcccccctaggaggacaggggggacacccaccatgagacgatcaacacgatcaccacgatcgggacgaccacctcatcaacgcccaacacaatccacatacaagcctatatacgccaagacacgctgccggatatcgacttcagggataggcatggctattcccctacggtatctccggataccgtcaggagatacgaaagcgctatctctgatctcgccgggcacggattcgaggaggaagactaccttgttgtcgactatgagtcagactttcagaccaacatgtcgataacagttagataggctgcccacatattgtactggtgtgattatggtgaataagagcaataccggcttcggccaacaggatgtagggttattacctgacaactcaggggcccgaacctgtataaaaatccctgtctccatctcttttacctcagtctcgcatatatcctagcaccaacgatccccatactgtccaaataccgtagtcgagacatcaaacgtcgacagtggcacgccaggtagggggattttggtgctctaggatttcgacgagatgggttcaaacgatggattctccgacaacaagttactcgacaacttcggctctgggagatccaacctgtccaaatacatcttccgacgagatcagaatcatcaccatcgactattcgatcaggcgagatcgaccaagcttcaagacgtcgccgtcgcggaagaccttgacgaattaccgccggaccagggtcaactacacgtcgtctacccgccaatcaatcagctggccgactgcatctacacatgtattaagcatgtatgcggtgggaaccatgtacagtaatgcacggcgtgtaccgaaggcttttttagccataggtatgcttgcatgcgtacataggtgccatctagacgtgctaattgtggagtacaattcaatttggctaaaaggtaattagtggattgacttattaattaatctactaatttcgtagatacattgtaacgctccacttctcgtgagatgttaaaaactaattcggcaaatcctaattgtgaaaaattttgtcctttgagtgcgagtctaagtcgtgccgtggatctcaattcaaatcccgttgttccctctcatcgaaatcaaaatcccccgcctcaaatttcctctaccaattcaagtctccgaaatctaattccgaaagtcaatcccttcctttgaatcctcgccaaatacatttccgaatcccaaaatatccaaactcccattttgtttccttccttgactccttgaacccttgtgtacaaagtatcaaatttagattcaaagcccaaactccaaatctctccaaatcaaaatctttcagcaaaagtctattttgcctcccttgtcgatgggctgattcctctctctcccggcccatcccctcctctcggcccatctctctccctcagccgctccttcctccctcgcgtgcctcgctcgtgcgccgctctgagcgagggtgctcgctctctctctctctgtatctctcactctctccctcgtcgaactccctctccccggcgccgatttcccgccaccgctgttcgaaatccggccgcacccccgcgtcgcgcgcgcgctcgctcgcgaggtggccgaccgactggccgccgccgccatcagcccttgcgccaccgacgccacgtgctgccgccttgcccctactccatgacaaaccgcccgccgccgtcatcgccgacgtcatccatggccctcgccactccatgccgcatgcgtccaaagacgtgaggctgggctcgtgctctcatctttcttcccccccaaaacggaaggagcaaggctccctttcctcctcctcctttcgctttatcccttacgggcaaggccgcctcgctctctcccttgtcctggtgcgggagcggacacagggtgccgctgacgccgcctttgcgccctaccgcgcccacgccaccaccgcgaccatgccagctcgccgcccccaccttgaccgtgctagcccgcgctcgcggttcgattcccaccgcaaggtccaccgccttcgtcgcccaatgcatccacgtcgtcgccgctttcccaccgcccacgaaaccgccgctgtcgccagccaagcgcctcttcacctataaaatcccaaccccatgcccacaatcctttgcccttcaccccgtgctccttgaaacggagtactaccgcctcctccctcgaccccggtggccgtcgcgcggccaaccccagagcaccgccacctccttcatcgtctcggccaagaacgccaccgccgcgaccaaggacgtcgttcccacacgcttccgacccctttcccggcgcgcccgccgcggcaccatgccacctcggcatcgtgttcgtcgccgtgcgccgctgctcgtccatgcgccgccatcggccttcctccccttcccatcactgaagtccggcgacgccgttccccgctcaacagtgagctcctcggctcctccctcccgttggcaccccctttccttttccgcatcgtgtagctctcgccaccgccgcttggcgccgctgcgtgagcagccgcggcgagcttcgccgatgccgcacccggctgtgcgccaccgtcggtctccctctcttcaagcccgctcgccattgccttcctcgggaccccctcgacctccccaatcctttcctgtggccgccacctcagcggccgggcccgcttgaccgagtcagcggcgacctggttagccgcctcctcagcccctcccgctcgtgggcttggcccatcaaccaaccttcccttcggcctgatgaaacagaaaaagttcacttataatccctcctcccgagcccagtacccacacctaagagctaaagtccatctttaatcccttccccaaacacagtgaccaaaagtccatatctgctccctctcaatttactctctcttaccttcttgttgaccccacttgtcaatgagtcaaagatattctcgagaatatcttttccaatattccacaaatatttccctcttctagaaattcaaaaatcattttatcttattccatgagttaataaatctttttcccttgttccataaatcatttccattggtcccacacgtcagtgactgtcaataatattcttgagaatattatttatataaatttcataaatcaatttccccttgttccacaaatatcttccttcgcccagaaattccacttaaacttccaaaattcatatctccctatccgtaattccgattgactccgttcaacttccaataattccataaaattgagatctatttaatggcactattatttagtctaaaataggatcttttcttggtctttgtttaggttttaattgtttgcgtacagttgcggttgccggattttcgtcgatcgcgggttttctcgaagattcgtgaagaccttgagcaaggcaagtcaccctttgaccaattgctcctataattggaaaatcattattattttgtttgcaacttgcattagtagaatcacacactcaacttgattggcctcggtttgcgtgccaaaccgacggacctaccaagtagtcgcactaattcctgtaggttgtactaccctgatttcctcgtcgctccacctttgtggtacctcggtatccgtgctctttgagcgcgaataccaaatatcccacatacaccgttgtttgtcgaaaacttgggaaatgggtttgagaagccttgaaagcccgacatgtggcgtcggtgtgtttgaaaataaaatggaatgtgaaaactcgcgatgcgggggttgtgcctgtgtggcactgtcccgtattcgcatataaggaccgattcctgtgggaaattcatccgagaatataacaagtgcgaccacacgggtgcaatgggacgcccctggctgagtaattagctaatcgggggagccatgatgccaagagacatgtggattcaacggggtggtgtcggggagaaccctcgggcttcctggcacagtatggtctgggacccctcttgttggcatatggtgaacctgtgtcggctttcaaaatgccttgtcatgaaagccttaaggtctcccgacgtggctgatctcacgggctgggtgatccgggttagtaatgtcgtgtgggtaaagtgtgccccctctgcagaggttaactaactgttcgaacagccgtgcccacggtcatgggcggatgtgaggtgtttcctgtagcgtagatttgtttgcctgtgctttgtgaaaagttgttgtggtgtgggaatcgttaccagaatcagcctatgtggcagatggatgacctgagtggtcaagaaacgaatctgtgtgattcgggatgtctatgggcatcatagtctaggcttcccgagtggaagcggattgttgtgctgctgggcagctggactctaggagtccgagaaaatgaaaaaggctctgggagccgattaatcaagtggaatggctctgggagccgagaagtaatgatctgacccgggaggtcggtacattaccaaatgagctgttgaaaaacatctcttaaagacgaaacgagacgcaagtctcttttcggcctaaacttagaaagagataaatcacttagtgatttcaaaacgtcttcaaataaaagatttgcaaaacaaccttgcctctcttccaagcttgcattaaacacctaagttcccgtgacttgctgagtacgaaggtactcacccttgctctatataaatatatatagttcctccacccggaagttgaagatgaagtaaagtgaagattagggtttcgtcctggttcccagccgtcgcctgtggtgttgggtgttagtccgttggttccgctgctgccgctgttgttggtgtttcctcgttcgcgtcgtcggttgcaatctcgggctgttctgagctgcaacctaagttaaggtaaataagtcctctatttattttaaggattgcaatgattcatatttgtcaccgtgggtaccagcactatgtcctgggactggtactgagatcgcggtttcgtaggaagcggtccgcaccgtttttcctacgacacactcctatcaggtgccgttgtacggcggtgccagattggggtgtgacatacatccggcatgtatctacaaaggtacgcaatattctatatgcaatttatcgtacctattcagatcatatagcattgtcagatctataatttattatgtttacctagagcatgtttcttatacaatatccgttgcacgagtgcttccgacgttaaaccaactacagtctaacgctgggggctcactccgttttcttctgtataaatcatgcttgtttacggtttacataatgcctgataattacatctgctcgttataacctgataatgctagaagatccatgcagtttttagtacatactcgatattatctgctatatatcttgccttctagaaaatatttttcaggaacaattgagcactcgagtaggttatggtcgagtacactccattatcgagaacattctcgacaaatgcggagttatcgcacccaacctaccaacaaagactgacgacctgtctcatagcatcggccatcgctggactacttgaagaaaggttgttaacggatgattcctcgcgaacgtcgtcggcttgatcacccgacatgattgcgaacggacatccggatatgctataagttgggtacgtgagtcatgctggccacatgaaatacacttgcaataaaccaactctagcacttctatcggtgttcgagagataattctgctcgctcactggttctcgcaccagtacacagcaatctctcgcacctcaacttccatcggtgttcgagagataattctgctcgctcactggttctcgcaccagtacgtagcaatctctcgcaccgcaccttccattggtgttcgagagataattctgctcgctcactggttctcgcaccagtacgcagcaatctctcgcaccgcaccttccattggtgttcgagagataattctgctcgctcactagttctcgcaccagtacgcagcaatctctcgcaccgcacctttcatcggtgttcgagacataattctactcgctcactggttctcacaccagtacgtagcaatctctcacacctcaacttccatcggtgtttgagagataattcggctcgctcactggttctcgcaccagtacgcagcaaactctcacaccgcagcgtccattggtgttcgagagataattccgctcgctcactggttctcgcaccagtacgcagcaatctctcacaccgcagcatccattggtgttcgagagataattcggctcgctcactggttctcgcaccagtacgcagcaatctctcacaccgcaacttccattggtgttcgagagataattctgctcgctcactggttcttgcaccagtacgtagcaatctctcgcacctttacttcagatggtcaaggtacgactacaacagtgtagcggtcctcgtaccacgactccaagtgatcgagggacacctactcaccggtcctcaaccagttgatcgtagtgatctctcgtacatttgcttcaagtggtcgagttacggctactgcctggtcctcgaccagcgatgtagcgttcctccgactacttccactttcagtggtcgagttacggctaagttacggctactgcctggtcctcgaccagcgatgtagtgatccttcgactacttccactttcagtggtcgagttacggctactgcctggtcctcgaccagcgatgtaacgttcctccgactacttccactttcagtggtcgagttacggctactgcctggttctcaaccagcgatgtagcgatttctcccactacctttacttcaacaaagttggtagcaggtacacaatatcgccaagtgttttacccagagatcccttaccacgacgacacctagcgttgaaacctatcctactgacccttaacgccgtcttgacaaggcctccgaggaacctaagggatcttcggctggggacgcccagagctgataaggccttgttggatccttcagagacgaaagaccatgtaagatatggtcgtgtaagagttctcgccgtgcgtattaaccaagctgtgtaatcggaaattgacttttccaacttcacggccgggggctaggatcagtgcttattcaaccaaggcaggtcaagagtccaagagcctactcctctgagaacgattctccgacgacaaggctgggggctagggagagtgaacaactcaaacgactgaccaaagtcgtgaactgagaagacactcttacacaaaacattggtcggtaaatttaattcattttcaatttaccatacatattataacatgtcaccctttgggcattcgctcaggggctatttctatttgatattcttttctgagtattcattttaggaaaattctattcgacattgtggaagactccatgtctctatggttctacaccaggatcgactaaggcgagtacgaccaatgttgacaaagctcctttgcagactctacgccttctcgattgctcgagaacggttgctagatcttgacaaggaatacggactgaagagatggtgtacccgccgagataaaatttcttgacttcaatccaaattctcgactacagcaaaacgggagacttagtcgtacgctctgtactttttcggtcgacatcagagattcacttagacaaaccctttcggtgcccacacggggctgacaaaggaagtccaacattatctctaaactcaccgagaacggtcacatgagcttgataacagttactccaatgtctgcgcgcggttgagaataggaattcgttcatttgcatcgaagtcgggggctgctgtcatggttatggataccacatacctaatagtagttgactaaatctcggcaggacccaccacataccatgtcctatacgaaaaccgacttcagatatggagggagttccgaataaggaaagacaactagagttttacatggaaacgacaaggactactcagattgtatccatattggtttccctagttctacttggacaaggggacacctatgggtataaatacaagcctccctaggaggacaggggggacacccaccatgagacgatcaacacgatcaccacgatcgggacgaccacctcatcaacgcccaacacaatcaacatacaagcctacatacgccaagacacgctgccagatatcgactttagggataggcatggctattcccctacggtatctccggataccgtcaggagatacgaaagcgctatctctgatctcgccgggcacggattcgaggaggaagactaccctgttgttgactacgagtcagactttcagaccaacatgttgataacagttagataggctgcccacatattgtactggtgtgattatggtgaataagagcaataccggctttggccaacaggatgtagggttattacctgacaactcaggggcccgaaccatgtataaaaatccctgtctccatctcttttacctcagtctcgcatatatcctagcaccaacgatccccatactgtccaaataccgtagtcgagacatcaaacgtcgacaaatgtataaggactactttagaggcttaagacccccctcctattgctacattgtggctgccctaaggagttgtttagattgacgtcattataagatataccatttttttaaagtaaagttgccaaacatgagcaaccatttagctttttaccatattttggtaaataaaaaaaatcttaccaattgataatgttaccaaattgggagtacctatacatctttcgaaagatttgttatcaaattttaaaaagatttattttagctataatctgaacaagaacaacctctgatgcccgagccatcttaataggccacgggtactcgagatgggccgatccatgcgcgatgagccgtgaattttttttatttataatttttttatttataattttttttattaaaagttttacaaaaataattttccattttgaaaattgacggaagtagtcgcctaccgccctctgggagggcgatttttaaaaatcgccctctcagagggcggcaaatatgacgtggcagacggccgttcgctctcgggcgacggccggcatggaattttgcaggcggcccccttgccgccctccgcgagggcgattttgcactgtgcggggggccgcctgcaaatgggcggcgagggggcatggaattttgcaggcggcccccttgccgccctgggggagggcgatttttgcctcccccctataaagcccagcccctcccctgtgaaatttcattatattcactaaaaatccaaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttgagtcaatttatagttggttgttgagaggatttagaatagaccaagaagtctacacaatgtcagtatctgttgtagtgagtcgtgcaatagaaggttatttttgggaactaatgccgatggacagcactgctgcttggagacggtatgtggaaatggcttttgaacggtcatggcccctcgttatatttgtgtcggtacaagagaaagatacaaatgtttcaatgcaaaccgaagatgtggagggtcctagcaatgcaggggatgttgttggaccatcgatgcaaaatgaggaaaatcaaccaagggaggagcaggccatgggcatggcggatgagggggagagagtcggtataattgttgatgaaatggagagggaagattcggataatgagcaagcggaggacgacgcatcatccgatgaggaaggtgatgtaatggccactgattgggcaaatgaggacttctctggtcttgttatatcagagggtgatcatgtaccctgggagtataaggagaacgaggtaattgagggtgcaaggtatgctcataaggatgagatgaaggaggcggtgaagcattgggcagtttcattgcagagagagtttagggtggtcaagtcaacaaattatgtgtatgaagtgaggtgcatgaaggaagaatgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacttactatgacctacatacatttacatcggttgaagatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggctttcgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggatctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcggccatcagaaatttctctcagtggattgagaatgagcctaaggagaagtgggctctattgttcgacaccgatggatctcggtatggcataatgacaaccaatttggcagaggtgtacaactgggtaatgcgaggagttcgggtacttccattggttgctattgttgaattcatccttcacggcacgcaagcctactttagggatcgatacaagaaaattggtccgtccatggccgataacaacatagtgtttggcaacgtagtgacaaagtacatggaagataaaatcaaaaaggcacggagacatagagttgttgctcaaggcacacaagttcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgctgatgctagtccatctggacaggcaagtgatggtaggcgaccacctggtgaaggaacaacaagcaggcgcgcaaggccaaggcgtcgtcgcgcagcaggcgattccatggtgtaacaatgctttcgatttaggaaataaaatgatgtaatgagtgttcggactaaatacttctatcgtgtaatttcaattcaatcttgttgtaatgagtacctccgactattgttgtactagtagtattgcgaactattcggtgttgtatcgtaatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgttgaactgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttgaactcaactttgctttgttttgcacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttgtagaccgctggagacctgagacgcacacgttccaccttccctgtggggagatggctccgacactgcaggacgtgtcgtacctgctcgggctaccgctggcgggagcaccagttggtcccgtcgacggtgtttttgggtggaaggaggatatcactgcgcgcttcgagcaggtgatgcgccttccacacctaggaccgaccaccacccttcctccgtactctacagtcgggcctagcaaggcttggttgctccagttcactgtaagtaaataagttgttattatcatacatgcttatttgcgaccggatgagtgttttgtactaacatttcattcttaactgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgtcctatgttgcttcagctttgggcagccgagaggtttgccatagggcgaccagtggtggacagcgcaccctacggggttggtcgcagcgcgcagtggccagaggacggtcccacgatggggacttactggtgtcgacgtggggttagtgcaacttcgctgcgttataagtttatcagtcctcttctttttttttccttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgcgacagttcggacttaggcaggtgtttccgggcaacgtgcagccgaccgtcccccctgccgaccactcgtgagttcggattgttcatttctaaatttttatgataattacatcatcgagccatacaatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttccaacaattatgtcatttatcttgcataatataggacaactactgaattttttatttccatcttgcataggctgatgcggcacgggatatcagtgccgatatcaccgcagtccaggtgaggttgagcagaggtttgcacttgactgacgttgagcagaggtcgaccttcgaccggatgcaggagaagatgcgtgcggtcatgcgcgtcttctcctgtcgcagcgccgtggacgtcgtacctccagctggtccggtacacccacggcctcgcggtcctaccgtcggagcaggacctcgtttgtcttcgagcgcccctagcttcggagcagtgcgacctacagcaccggtttcgcacggtacagttcagcccagatattagttcatttttgtttcagcttttgcacgaatgtgtcaccatgttttaactgcacgtttcctcatcgcaggacctcgtatgccttcgagcgcgttcgcaggcacgaccggcgcttccgcgagctccgcaggggcgttcgccacctcttcgggcgcgttcgccagctcttcctctcacggagcgtcgttccctcgcccacacggtactttactttttattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccaggacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacgtagttcttttcattcgtatggtgcttgaacaacttatgctcacaacaacacactttcggcgcttcacggtagtgccatatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatgtattgcagtgaaaacgacgctatataattgacaatctgaaggcaacctcttcatatcttctttcccactaccacaccacacacgaaaatggaagcctattaattggtaatacgtaatctagaattgagattatgtacaacattcttcactacaattttacattttggcagcaaaccaaatatgatcaaatgcaattttaccttaccaaatatttggtagtgccaaaacttgcttatattttggcattaacaaaatatttgtacggtaacattccaaatatgccctaaaaaataataaaattgtattttaccagtcttggagattttaatcttgtatagttttcaatataaaaagatttgataactattgatatttatataaaaaaatatagagcacagtacaaaatcgccctcccccagggcggcaagggggccgcctgcaaaattccatgccccctcgccgcccatttgcaggcggccccccgcacagtgcaaaatcgccctagcggagggcggcaagggggccgcctgcaaaattcgttgacggccgtctgccacgtcattttcgccgccctctgggagggcgatttttaaaaatcgccctcccagagggcggtaggcgactatttccgttaattttcaaaatggaaaattatttttgtaaaacttttaataaaaaaaattataaataaaaaaaattcgatgagccgtgagtgctggagaccggcagagcggtgagccgagctgagtagggtcgggcagtgagccggtgacccagcgttgggtcgccgcgtccaaccccattgtcccgcactcccgctcggcgaggtagcggaggagatcaggagagggaagcgcttggatgagggctgaggcggtggccggtggaagacccaagtgacgtcggctgccccggcacggaggcgccacgtcaaccggcgagcgggcgcgggtgccgcggagccatccgtcgaacaggggcagtgaaccggcggagggcggctcggcccgcacgtccaagtgccccgacgcccggcgtccgccgctcccaatgcagcgcgcgcgagatggaggccggaggggttgcatcatgccattgccgcctagggagaggacagaagaagcgctcggctgaggcagtagggagggggacggattagcggccatggcagccggctgatgaggcggaagacacggcgagcctaacctgcactgttccggccgctcacgggtgtcacatgcttgtgcggcggtgacacaagttcgcggtgccacctcgacacgacgcgacgtcgcgagccccatccaagccaggtattgctaatttcgatttcgaattctatttcaagatcagctataatctttgggaaaataaaaaaggaaactcgtttccagtacaatgggatcaaagtttgtgtactaaggaatttgttaagatttgttagaaacttagaataataaattttgtagaatataattatatggcatatatgttatgatcctactctagctccttaagattaattactcctatgcatgttcaccgtgcattcctcctttttggtacgtataacctggtgtagaacttccgacttcttgaaacactaaaacatccaacttactagcagttatttgacgaaactgatcctgaaaggatgttgaaatattcttttgtacaacacacaatcttgggagaaccacatattccacatattctagttagtgtaatgttaatactctctccttccctaaatgtttgacgccgttgacttttctaaacatgtttgaccgttcgtcttattcaaaaacttttgtgaaatgtataaaactatatgtatacataatagtatatttaataataaatcaaatgatatgaaaagaattaataattacttaatttttttgaataagacgaacggtcaaacatttttaaaaaagtcaacggcgtcaaatgttttgggatggagggagtatatgtctcttgtttctattaattttatggaaatccacaatccgattacaggacttgtccaaaggaaacgctttgtgcctttgcgtgcaaaaagtaaatctaccgtccttctaataccgtgaggctcatgttattattagagctgctggtatttcctcctgattgtttggctccagaggccctatgtgcaaaatacacaggttgtattggagctggaagcgctgcagcttcattctctaacatgaaaacaacagaagacatgggtggcctattatttggattatcttgcacgcacaacagccctatgtggatacatagtaaaacttccatttttgagcaactctcagcaatggatgaatccaccaaatccatggccttgtcatccttccataagctccatgcctaaacagtgaaatagatcagtccatataaaagcggtatagttattttgaatttttatggacatagagcattccatggtacttacataagctaataggttgggaaagtccatcagccgaggtaagctaatcttcagaccacttacaatctccaagagtataacaccatagctatatgtgtcggacttgactgaaaaggcgccatccattgcatattcaggagacatgtaaccactgcttaacagttttagtaataagtaacaaaggatttttcaggaaatcaatgtaatagtaaaaaacaaattcctggatcactcactatgttccaacaactcggttagtattggcttcttgctggttgccaccgaagattcttgccataccaaaatcagatatcttagggctcatatccacatccaacaagatgttgcttgatttgagatctctatgaattattgtcaaccttgagtcttggtggagataaagaagtcctctagctactcctttgattatcttaaaccttgttggccaatcaagagcatacttacttgcaggatctatcaagaatggtatacaatgttcttatagtaaggataattttatcatctttgagaaagtactggtaagtatcacattgtttattgtaaattttggtaccttcagatactaaatatctcaaggtaccaaaaattttagtgtaaaatttaggtatcttgagatactttttcaagaacaataaaatttctctatcagtaagcatggagtgaagtttattggatcgcatggtatgtttttgaacagtaccgaaaatgaaagcttccaagcttttgtttggcaagtattcataaattagcagcttctcatctccatgtatgcaacagccaagaagtttaacgaggttcctgtgctgcaatttggcaattagaacaacttcatttctgaactcttctactccttgtccagaacccttgctaagccttttaattgccacttctttgttatcacccagcatgccctacacaatttaatcaattaatttttttattaagaaagttcatctcgagatgcactttttaccgcaatataagggacgtggtttcgaccccaaggttccttattcgattcttaacacgctcacacattcttcttaattatttaacaccatgtttcttgtcggttctcccttttttaaaaataaagttcatcatccataattgggattttcatatggtatcactgttttcacttttcagtagtaaactactccctccgtcctatggtataagggattttgggtagatgtgacacccaaaatctcttatatttttggacggagggagtactaattgtggcacttcttctgtaatactcctaaaaaatatgctctaaaattgaagaatattgtgcgatagttttgtcctactgtagttttcaatacagtttttgtgggctaccttataaacctttccgaagccaccttgtccgagcatgttgtcgtcagaaaaattatttgttgcagcagcaatgtctccaaaactgacaaacgggagttctaaattttcatcaccaagttcatttaatgcactcaagtatcctagcatccttttctggacaaccttattctgacgtttgcctgacaggaatatcaatatcgtgtattttaatattaatagtagtattattcttaattagataagctgtgagaactgagaagtgaggtggctcggtatctacctctgcacttgcgtaaccacacaaggaacatgctcatcagcagaagcaaacatgctgctgtaactgggagcagaacttttatcacagtcctcttcttattgttaactgcgaaaagaaatatttcaccaaaataattagtacttcctccacgctaaaatatagtaacgtagtactcaatcagacatcacaaatattatagactctaatcgagtactaggcgatgtttaaccgagtactaggatattttacagcgaaggaaatatatatgtaattaaccattgccaaacacattgagcaattctacggtccttaagaaggtatcatgaggtatcaaaaatttagtgtaaaatttggtaccttatagtacctagttaccaaaaggtaccaaatttacaatagaaaaagtggtaccttatggtacctcctcaagaacacattagctcgaacacattagtttcagtgttgtacctagttcaggctttgccagcctcaaatagagatcctgccctttgtcgacataccgaacgtcaatgacgtcacccgtccacatcacgcatccgctgccgccgccggcgcctcggatgtccgcggcggcgtaggcgacgcaggaacagttggcgaagcacctcgccctgcactcgtcaagcgtggcgcccgtgtccaccgtggcgttgtccgtgtcggggagcttcacgccgcgcaccggcacgaacccgtccgtggtgctcccgttgccgcactccagcggcgcgttcctccggcaaccaccggaggtctccctcatggaccactgggaggggaacatcgggctgaaccccgccatgcagctgcagaagagcgtcgacgcggtgttcacgttgcacagcccgaacgcgccgcacttggcgtagtcgtcgcatacgtcgcgcggcgcctgcgcgaacgtgttccaccccttgctgctgggatcccacacgaggcgctggatcacgccggcctcactcagcacgaggcgggagaagggggccgcggcggtggcggcggtgaagacgtaggcgatctcgtcgggcttgaccaccacctggttcgcgaacatggacgagtacgatgccatctccgggacaccgctgaaccacagcccgttccatggccccgtgcggtacttcttgccggcgccgcaccacgagacgcagtccgctagccctctcgtgtccatcacgcggcggcagccccccgtcgccgggtcgtcgggcgcgcgccacgacgtgagggaccactcggcgccggtccgtgggttcctgccgagcctcatgccggcgatcagggtgttcgacgggttgtcgaacgactgccacagcacgtcgccgctgccctggtcgcgcacgacgaggttcccagactcgagcagctgcaccgccaccgatggagacgagccagtcgtgttcgacgaccaggcggcctggccggcggcgccgtcgagcaggacgagcccgcccgtgccatcgataaccactacgccggcggtgtcgttcagtgggctgtcgcggttggccacccagacggcgtccgccgactcggagaaccatatcgcgaggtatctcctgcttggcaagccgggtgagaagaaccccagagtgaaggagccattggctgacacgagcgtgtcgccatcagtgaggttgcggccattgctgagcgtgtccgatgcaacgccggcggcacggtattggaaacaaaggagcacggagaagaagatgacgggacggtagaaaatgttggtggttgctgcttccataactgttgattctttttttccttgcatctccttggaaaattgttcacggccgctgtgcagggagcacgtacgccggccggcctcagtgtctcacgactcacgagcaccatacataggctgtgcttaatctaaattttggatccaaacttcagtacttttccatcacatcaacctgtcatacacacataacttttcagtcatatcatctctaattttaaccaaaatataaactttacgctgaactaaacatagccatatacggaatctaggaactagtagtgccccgccgcataggaagactgcaagtgcgttcctacttcctgccacctccgtccctccgtaccagtttaaatgcagccgtggattctcgtctctaacgtttgactatcttatttaaaaattttaattttttaaataatacgaacggtgaaacgttgaacataaataacgtgaaactatgatctttctgagacggaggtagtacagtaatatcccatgattgactagctagatgaatccatatgggtgagttgcatggtaatgcaaactgcaaagaagattggctgtccatggaatcatggatgattcgtgactgcatataacatgcatggtgtactctccgtcgtgatagccagggtaaagcatcttcatggcaatggtcaaaagagagatgaatggaaacataagtgagggatactgttgccctcgaccccaagaaaaggaaaccataattcatcaaagtgataagtccacaacacatccctatcatagtcgtgctgttgaaaactgctggtaaagtgacgatagctttattaaacttcgtttgacctagctaaagatccgtgaagtcgtgctaaatgctagtactactgtacttaagtggttcagaatcatatcgcgcagaaaagcaaggagcgtagtgatcatctgattaacatctcgcctcattcaaaaagcccgcgtgaaccctgttattttccgattaagatgtagattctatctcgattttcactattacgtttcgaaactgcttaaggatatgttttatgagaaaactttctatacaaaggtttttctaaaaccacaaataaatttaattttctaattcatactagtaattaaaacttgactaatcttaaactaatgactttctcgttttatgtgccgacctggtaggccttgagccgtctggggcctcgtatttatgggcctcaataactcagtacggcccactagcccattggaccaggagtctcccgtacatgcggcctgatttgacccaatcccgtgcggcggcggccgccggcggcacgggagcggcgccgcgcggcgggaggagagcgagtggctgcggccatggccatggccggcgagcccgcgtcgggtggcgtcaacgcgggtgctgccacgcgagggagcagacggcatcgacaggaagtttgccagcctagggggaatcgctctcggctgaagcatttggagaagtagcggcggacgccacggcagccggctgaggggggaagacggcggccctcacggggttacaagtcgtggcgccaagctcccggtggccggtgccacggtgccacctcgtcgcgagccacttgaagccaaggtatacttctgaagttctgatttggatttatattccaagattaactactaggacttggtcgaagtttttagattgaggatatttttcagacttttaattggtggtattgagtgagcctgaagaaaatgattgaaagtggataaaaagcgatagtaaataattaattttgtcatcaaagactttgttattcccatatttcccctcaaaaaaaattgtcatgccaaaatatattgcacacaatcacgcatgttatgatcctacactccatacagttgtcttgggagtgttttttgatatagcctactccctccgtttcacaatgtaagttat

SEQ ID NO: 70667 - DNA, 632 bp, Oryza sativa
ttcaaatttgaacttgaaagtttttaaatcttaacttgaaagttttcaaatctcgatttgaaagttttaaaaattttcaaatctggacttgaaagtttttgaatctcgagttgaaagttttcaaatctcaatttgaaagttttcaaaatttcaaatctggactgaaagttttcgaatatcgagttgaaagttttcaaatctcgatttgaaaattttcaaatctggacttgaaagttttcgaatctcgagttaaaagttttcaaatctcaaattgaaagttttcaaaattttcaaatctgtacttgaaagttttcgaatctcgacttgaaagttttcgaatttgagttgaaagttttcaaatctgagttgaaagtttttaaaatttgactttaaaatttaaatcgaaaattttcaaatctaacttaaaatttttttaatctgttagtaaaaaaaatctccataatctttcctaattactattattagtgttaagtatattaattaatagagatagttaagtatattaactaatagtgttaacagaggtagttaataggggaggagtgctcgctagcagcgagcacgcgctagctaggagtccccagctgagagcacacgcagctaccaaaacc

SEQ ID NO: 70668 - DNA, 540 bp, Oryza sativa
aggtgctcgacatgagagaacgcgcaccagctgttcgacgaaaggccgagcccgcgatagagcagacaactagagggggcaaatcttctgggggccctttgggcttgagcggataacaagtgttgggctttgaataagagaaggcccggtcggtaatgctaagtacgaatttaaaagccatcaaataaaaaagacatatgaatttcattaagtcacaggcttggggccaccaatgaaatacaagcttttggtttgaccaatagattaaaaaaaagattcaaaaaaaaatggaaaagaaggtaataaaaggaattaagaattgccggggtggtttttaagtgccggcccaaggccaaggggtttaaggaggttggtaacaagggggccaaccctttaacctttaaaacccaagtttttttaactaaatagaatggaaacaaaagaaaatccggaccaggaaaatttttccggaattttggtttggtctggtaaaaatccaccaatggccaaaaaaaaataccataagggccctggggtggg

SEQ ID NO: 70669 - DNA, 517 bp, Oryza sativa
tcgtcaaggacgaggcactagctgcgcaaccgccgccgcaacaacctacgagtacttgaactacgggacggccggcgacgagggcagcagccacgcctggtacaccggcaacggcggcgacgccgacgcctcgccgccgatgggtttgagcgatcagctccagcagtgccagatcggggccgcgccgccgttcgatgtgaagcctgagctgccggcgacgatggaacacggcggtagcgtgttcgtcgaacagccggagcagaagattctgccggcggcagggtcgtcgtcgtcggcggcggcgcattgccagctggagcttgggtgctcttctaatgcttggaaagttggaacacacgttattaattaattaattaatagtttctcgatttgattgattcggatatgatgaaatgcttgttgcatttcaaattttggcttgttgagttaggagttaattacaaaaataatcactagactagcttataaatagtcaagttttaattaatagtagatg

SEQ ID NO: 70670 - DNA, 622 bp, Oryza sativa
aattctgatccgtgaaactttgttccattaatgacgaactcatgtcactcatatgcatgtttgggaagtgcctaggccgactcccgatgcttggtggttatgactagtcgggcagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccgaccggcttgcctcatccgccgccgactggtgttttcgcctgcacggctggcctttatgccgctgttgttgggcatctacgtctttaccgaccggccgccttgtccgccaccgactggtgcttccgcctgcacggttggcctttatgccgccgttattgggcgtttacgtcttcaccgaccggtttgccttccccgccgccgactggtgtttccgcctgcacggttggcctttatgcccctgttgttggccgtttacgttttaaccgaccgg

SEQ ID NO: 70671 - DNA, 6317 bp, Oryza sativa
actttcgtgagcttcctgaagtatcagctgtttaagttctctgttatcgggaacacatacccgctttccgttccatagggttccgtgttcatcctctgtgaaaccagcggctttaccctgtttcatattcttgaggagtccatgcatgtccggatcattcttctgagcctcgcggatttgatcgagcaaggtaggcttggcttccaacgcagccaagaatccacgaccaactatgcttaggttcagggcttccatctgttggttaagctcgggcggaatgccacggacgttaagagtgttgcaatggctctttcgacttagagcgtcggcaaccacgttggccttaccaggatgatagtgaattcccacatcatagtccttgatgagttctaaccatctcctttgccgaagattcagatccgactgggtgaagatgtacttcaaactcttatggtcggtatatatttcacagcgattcccaatgagatagtgccgccagatttttagagcatgaaccaccgcggctaactccaagtcatgggtagggtagttgccttcatgaggtcgtagctgacgtgaggcataggctaccacatgaccgtcctgcatgagcacgcaccccaatccttggcgcgaagcatcacaataaaccatgaaatccttgcgagtatccggcaagattaacaccggcgaggaaaccagcttttccttgagagtttgaaacgccttctcgcattgcgggctccacacaaatctctcttccttcttcaacaactgtgtcatgggtcgagcgattttggagaagttctcgatgaatctccggtaatatcctgccaaacctaagaaactgcggacttgagtaactgtcttgggttgcttccaatcggtgacggcggtcactgtttcggggtccacagcaactcctttagcagatatcacgtgccccaagaatttgacttcggacaaccagaactcacacttgctaagcttggcatacaattgatgttcccgcaactttcccaacaccagacggagatggtgctgatggtcttcctctgactgtgagtatatcagaatgtcatcaatgaaaaccacaacaaacttatccaagtattccatgaacactttgttcattaagttcatgaagaaagcaggtgcattggttaaaccgaatgacatcaccgtgaattcatacagcccgtatcgcgtggtgaatgcggtcttcggaatatcttcttcacgaatacgtaattggtgatatccgaaacgaagatcaatcttggagaatacagtggcacctttaagctgatcgaacagatcatcgatccggggaagagggtacttgtttttgatggtgacttcattgagagctctgtagtcgacgcacatcctcttcgtcttgtctttcttctccacaaaaatcacaggagcaccccatggggaagtactcggacgtatataccccttttctttcaactcttccaactgtttttttacttcggccagttcatttgctgccatacgatagggtcgcttgtgcagaggagtggttcctggagcaagatctatccggaactcaatctctcgcttgggcggcataccgggtagttcttccggaaacacatctccgaactccctgacgatggggatttctgacagtcctatctgatgcagttctgaacttctgacagaggttgggggtgcaaagaaaacaaccggttgttccggccctcggtacagagtgaccgtgcgtctcgcgcaatccactactccttggaattgagtcaaccaattcatcccaaggatcacatccaagttcttggtgtctagcagaatcagatccgagggaaaaggaatcccctgaatttctataggaacggcagggctatattactttgctgtcataacccctccaggggtggtgatgagcagagggttcctaagcctttctacccccaactgatttctccccacgaatgtcacagatataaacgagtgggaagctccagagtcgaacaaaatggtagcagggatggaatgaatgaggaacgtaccaacgatgacgtctggggttgtcagcacgtcctcggccgtcacgtgattcacacgaccccgaatgacatcctttccaccgttgttggagcggggaggcgcttggccttgctgacgccttggctttgggcatttatccgcaaagtgcccgggctcgaagcagttgaagcacagacgctgctgaccttgagcgtccctgcggccttgaccaggctgcacagttggcgtaggaggacggggcgcacgagtcccttgctgattctgctgctgctgcggctgtgggacgcgcaccacgaattgaggtcgaggcgcggagcgaggttgttgctgctgctgctgctgcgaggaggatccccctggatagggattggtgtagcggaccctttggttagcaccctgttgattgcggaaattcgccaagcggcgcttgtgcgactccagctccttgtgcttggcttccaagcggatgctcttgtccaccagtcgttgaaaatccggatagtccccagagactagacgaacggacagctcagggtccattcctgccaagaacttctcttgcttctcctcatcttcccgcacatcctccggggcataacgggccagactgttgaactcatgcaaatactccatcacggagcggttgccttgcttcaactctcggaattcccttttcttaagagccacgactccagcgggcacatgggttctccggaaagcggcggtgaagcgggcccaagtaataggctgtccctctggctgcgtagcctggaagtggtcccaccatagagatgcgggcccctgcagttggtgggcggcgaagatgactttctcctcatcgctacactgcaccgtgtctagctttttccccacggcatgcaaccaatccaacgcatccacggggttgttggagctagagaaggtgggtgggcggatgcggaggaactcggcgagtttagagtgttggggaggtggtggtggagcattctgttgtggcggattttggaggtggtggaggaaagcagtcatcatgttggcttgctgagcgaggatttgggtgagaatggcgttggtgtctggtggtggtggcggaggcggaggaggaggtggaggtgggttgccctggtggttgtggttgctgccttcaggttgattgccatcaccggtgacagcggttctcctggtcgtcaccatctgaaaaccccacacagaaccagcaaacagagagagagagctgacgattaaaactaaccacccacgactactataattcttgaatttattactgctattaaattggttcattaatgttcaagttgcttaggcaaataaaataagacaggctccgacacagttatgccacacaccggcataactatgccccacacaactcaagaagacaaacgaggaaaaacacacgcgcaagcctactaactgctcgtctaccgctgcgacgggccaggacggaaggtgagcaacagcgcaccctccgtgctaccaacgccggaggcttccccctcctggggaaccacgggcgcgggctcggcacgaggggtctcgacaaagcaggtccacgccagggactgacgaaccagctcgggcctggaggtgctcttgcgggcggtgatcttctggctgcggcaaacgcggcgacgcttggggcggcagtcctctccctgggcgatcttgagctgatgcagctgcgcctccaccgcgtcgaggtccttcttgagctgcaggttctcctgacgcagctccaggatcttcatgttgttctcaaccatcccgcggcgtaccatctgatggaagtcgatacgagccgcgtcgtacgcctccaccatgcgcgccaggtgcacgacggtagcatcatcctccgagctagcatcccggaaggtggcgtagtcgcgggctcctccgcgacgagggtggtagcggtagggcgagtgctgcaactcgtccgggtagcgctggtgaagagtgccgatggcgaggagagcggcgttctggcaagcggcggggaaggaatctccacccgcggtgactgccagcgaagtccgctcgggggagccagagaggatcactgcagtgacctcccaaccagcgtggggctccgcgtcgtcaccctcctgatccggaagcggcctggcctggtagtccactccatgtggataccccaagaccacgcacatgcctcgcagctccaagacgaagccagtcatgtccaaaccacgacgggtgacgctgccggccatctacaaacaaaaacagaaagaaaaacaacattttaaagatcagattttggcgataaatgaagcagcaagacagagagagactagaggattttcacaaatacaagagatttttatttcgaaaaatactgctaaggcttgggatctacggctcgtcctagggtcaagggtagctctgataccaacttgtcacgaccggaaataacccaacgggctttcctgacgtgcgtgcattaatccttgtcccaggaggcaaggtacaccaaaagttgatacaattcagagtttaacaagcggaagcgtaaatagttaacttattacatgggcagcgaaggcccaacacacacaaagacaaacgagaaacagcggaagactagggcgacgaccacaggcgcttgacggcaggcacgagctagacaccaaagccttcatcttcaaggagctcctcttctggacttgggaaaaattgagcaagactgagtacaaccaccgtactcaacaagacacacccacaaatgcagaataaatgcaagggagtacaaggaattataccataaaggggttagggttgcagtaaacagcatttaaagacatttagttgctcagggctattttgtaaacgcgatcctagaactaaacaatattattaatcaaggccgtgaacccacacgaacctgccttaacccaaggcctatgatgattcagaccgaactggcaacccgaccctgggtcccagctcgtcctaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatctttctcacgtgcaaccacgtgccacataccaccacggtatacagacgaaagacgtgacatagtttccaacccatcctagccatagacaagagtaccgacccaatcccacctacggccggaacccccgggacaggcaggcaagactgagcccctagcagcagggcaccaaccctctgccatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaaccattttggggacttttgaatagaaggagcggtgtgaagccaattccacaataaaccaacaattccaaagtgtccaggtgatatgaatatttcccaaagtctagagttgaaaaaccacctaatgttacctaattaaattgcgaagcatctacctaaaattaaactagtggtgccatgagtagagtgtccactagttgaggttttgtttattctagggtgaacaaggtaatattaataacaataacaataatcataaggtcataacaaaggtaaataggcatggctaaataaaacagtgataacgcgagaatttaaataaagcgataatgcaataatttaaatcaacataattttataaacggggattcaatatgatcaagatgatgtgtcttgccttgctcgctttcccaaacgtcggcttcaacttccacgaagagcggatcttccgaagctgcagcgtctacacgaccaacggaaaagaaaaggcttttactctaaataactccatataacagcagaaacaaagcacaaaaatgggttcttgacttcttaaggaaaaattagagacttgaacggtccaattccgagttcaaatggccaagatatggccatttgaagtttatatgctctttaaatgaatatttgcgaatttcttcatttaaattttaattaaaaaatggg

SEQ ID NO: 70672 - DNA, 2047 bp, Oryza sativa
tgaatgaaacttcgagctaatccatctgaatttgttagtagtaaatactgtagtacaatttactggtgcaagaagtaagagctccatgacacccagctactctgaagaaaatgttcaggtgttcggcaaagttgcattcagatgttaggctactcggctactgtaagtacacatgttagtacattgtatgagtccttgttatatcgagcaactgaggtggtgtttggatccagggacttaactttagtccctgtctttagacactaatttagagtattaaatatagactacttacaaaactaattacataaataaaagctaattcacgagacaatttttttaagcctaattaatccataattagagaatgtttactgtagcgtcacataggctaatcatggattagttaggctcaatagattcgtctcgcgaattagttcaagattatggatgggttttattaatagtctacgtttaatatttataattaatattcaaacatccgatgtgatagggacttaaaagttctagtcccatctaaacagggcctgagcataggggacaaacaaagggcctgttcactttgatgccatttccaaccttaccaaattttggtaaagttgccaaaaaaatggctatatttagtttgctgccaaattttggtaactatataagaaatcttgccaaaattttggtaagttgccaaaattttggtatagttgccaaaatttcggcaatgctaaaatttggtaagattttttttggcatcaaagtgaacaggtccaaacatagccagatcaggtcactgagcataggagtccttgttatatggtgcaggccggcctgacggacaggtcggggggcattacacctgtcagttcaagttcaagtaagggtctgctcactttgctgccaaaaaaaactttaccaaaattttggcaggatttcttatatagttattaaaatttggcagcaaactaaatgtagccacttttttggcaactttactaaaatttggtaaggttgaaaatggcaccaaagtgaacagcccctaagttgatcgctagtgacatactgacatggcagtcttggcagctttgcattgtggaccaaacgccgccccgcattttatctgcagctttttctctgaaaattgttgatcgtactgacgccttcaataattgtgtcccgcgatgattattttggagtactcctacatcatattcagactcgtacggcttgatctgccatacatgctgttatccaaatagattaataactcctcggagccatggtccaatggattaggataagtttagtttgagaccaaaagttaacaaaagcaaaatgagtttaatctcactggttaggtttcttggatgaaagtagctcgagttctagacttaacataagtttcttggatgaaagtagttcgagttctagacttaacataacatgtgcgtttatatttatgactgattattgttttgatgataaacaacgtatcgacaacaagacacttatgataatttcgtaaatcttagtaatgcatgaaaaatggagacacctataataactttgtgaatcttaaaatatactattcttgaaggtgtttatatgaatatggtaagcatgtgtattgagtgtggtgtactacgataaactgaaaactgttacaggcacgtgttgtagcagcatacgattgttcaatcgattgatctaatctgagatgaaacccacaattccaaagtccaaaacatgaggtgacaaccggcagagatcctcaaattgcagcaattccacaggatcatactagtttaattaattacgacacgaaaggaggggggcaaaagagaagatgaacacagctccaaacgcaaaagctcacaattcacagggcgcgcgccatcctaaccccaccccccccccccaaccccccaactagatcaacttcaggccagcggcggcgacggagagcacggacacggcgatggccgtgaagacggagcggccaacggcggcgttgccgtgcggcgacggggcggcg

SEQ ID NO: 70673 - DNA, 36971 bp, Oryza sativa
gtttgactttgaaacggagggagtaccgttgctccagtgtatcaaaacaacgcattgaaaacataccattacgatttaattccatcactagcgcaacttattattgacgccgcgcttattagctcttttttctccctgatgaggatcaataattcgttacctcatgctgaaatctgcactgtagaatacctaagaccgacgtcgaggtctcgaggatgaagaatttggcacgccaaaaccatcctaagatcgagaggctgtgactgtgcctggtggcatattcaagatgtgatcaggttgatgaagacagcattgcacagaaatgtcttcgattgaatcaatgagcacgatcattggcgtgttttgcacgaatgaccaaaacagagacgatgatcggacgaagagatgaaacgaatgcaactcttatcgatcaagacatcggcaccgttactaccaaaggttcttttataggaaaagtattggtggagaccgggtgtcttataaccggccttatctacagcctcgccccggatgaatgccaaaaccatcctatgagcgagaggatcagattgatgaagacactaccattgacgtgttttgcatgaacgaccaaaacagaaaagatgatcggacgaagagattaaactaatgacactagcccattcttttctccaacaagagctggataaagattaagatttttatggcacgctttttaaactgttaaacggtgtgtttcgtgtgaaaattttttatatgaaagttactctaaaatatcatattaatatatttttcaagtttgtaataattaaaactcaatcaattatacgttaataataccatctcgttttgcgtaaaaaaacttattctttattttcatcttaagaaaaaaaaaacatcacaaagatgaccagaagtagccctcgggcgtgcctagttgtctctctctctccccctctctgtcgaacactatgccagaatatgaccagtggaacgaacacaaggtgtttggtgctgtcaagtggcagcatttctgatagtgttgattgcaaatgtaaaggatacgttagcgggggctttaaccacgactccaactttggatttgtttggagagcttaagattttaagaaactactgattggcagtgtcggtgacatgggaccgggagtatcatgacttagagacttgaggcagacacgatcacccacgtggcctaaccccctcgggggggtcgggcccgagggtgatacggccgcccttctctttgtctccccgaggggtcggaccgctcccgtctcggccccgagggccaaggcgccccgaccccttgtgggttttgcgccgcgtatatagggtaggtgagcatagcggggctcacctaaccgcatttattgcggtttggacgagcgcgtcacgccacatgtagcgcagtatggcacgctcgtttatccggtctgtgaccggtcacagatcggtcagattgcgggttaggtggcaacaggcgatctgacacacgcctcgccccgtcccgtcaggatgagagtctctaggcactcgtccctagccggagccagcgtgctagctcctggagatggcacgttggtcctggtcagatatatgccaggctttatcccaaccattataagcaagacgttgtatgaagaagggcgaacatgcagattgctaaactgacacgtggtggacaaaggtgaccggtctgtgactggtctgacactggttatgtcgccggaagacaaccgtgttcccacgttgcacctgcttccggcggagtggaggtaggtatgggccgtcccatcagaagggtcactcgggcagcagctgttgcaaatctccgcccatttatgaagagatgacagggtgatccccgaggtcagacgaacgaggacgcgtggccacactcaaaaacaggcagtgtttcagcttccaagagaaggcaagccaagttttactatagataggatgggcccccacccaaaaagagagagagggagaagtggtgcatgtggtatccccttgagatataaaaggaggaccttgcccacttaagaggcggggctggaaggggggatgatctggagagtagatcccacgagaggaaaaaagggagaagagggtttttagagtaagagctctctggctctccagctctttgtagcttcttcatacacagatccaccagaacacaggagtagggtattacgcttctcagcggcccgaacctgtatacatcgcccgtgtcttgtgctttttccattctcgcgaactttccacagactaggagcttagaatctcacccagggcccccggccgaaccggcaaaggggggcctgcgcggtctcccggtgaggagccccacgctccgtcaggcagatattttataagaatatggagaagtttcgtttcttagattatggcttctagttagtttttgaattttataactacaatttatcaggatttggatgaaaagctaaattgtttggaaattttgggagaaactggagctaccatagactccccaaacaaaaccctttgtgcgccacgatcggttcgcagcgtgtgccatcccacgcgctcggttcacacaccacgcagggaggctctggctcttcatgcgattctaacaaacctaacaaaccttatctaaaagagaaaaaacgaaataaagaaagagaaataccgaaaatactggtttgacacgcaccaggattttctaaaaaaaaaatccaacagtatcgatctaagacatcgtcaccgttattataagaggcatttgtaaatttgttatcgattttttcaatattgtaaggatgccactcgaatgatagttttagtagtatttttacaattttttagtggcagtcttataataacgattcaaaatagtggcaaatttgcaattgcccgttcttttatacgcagagactccgagagtcagtgcaagcaagcaggagctcgtcactgtcaattgacaaaattcagtagcaaatcctactctgtctgcatcaatggctggcccaaccatcgtcctcctcccggcctggggatccggccacttcatgtccgcgctggaagccggcaagcggctgctcgtcgccggcgggggcgccgtctccctcaccgtgctcgtcatgcaggcgccgacggagatagaggcgtcggtggtcgaggcccacgtgcgccgggaggcggcttccgggctcgacgtcaccttccggcggctccccgccgtcgagcaccccaccggctgcgaggcgaccgaggagttcatgtcccggtacgtcgagcgccacgcgcaccacgtcaaggcggccatcgccggcttggcgtcccccgtggccgcggtcgtcgtggacctcttcttcacgcccctgctcgacgcggcgcacgagctctcgctcccggcgtacgtgtacttcgcctccaccgccgcgttcctcgcgctcatgctgcggctgccggagctccgggacgacctgaccgtcgggttcgacggcatggagggaaccgtggacgtgcccgggctgccgccggtgccgccgtcgtacatgccggtgtgcctcgtgagcaagacggtgaagaactacgactggttcgagtaccacggccgccgcttcacggaggcgaagggcatcatcgtgaactcctccgttgagctcgagggcgcggtcctcgccgcgatcgcggacggccgccgccccgctccggcgatccacgcgatcgggccggtgatctggttcgacgccacgctgccgcccgagcagccgcacgagtgcgtgcggtggctcgacgcgcagccggcggcgtcggtggtgttcctctgcttcgggagcatcggcttcctcgacgcggcgcaggtgagggagctcgccgcgggcctggagcgcagcggccaccgcttcctgtgggtcctgcgcggcgcgcccgccggcggcgtgcggtacccgacggacgcggacccgggcgagctgctcccggaggggttcctggaggcgaccgccgggagagggatggtgtggccgaggtgggcgccgcagaaggacatcctgggacacgccgccgtgggcgggttcgtgacgcactgcggctggaactcggtgctggagagcctgtggttcggcgtgccgatggcgacatggccgctctacggcgagcagcacctcaacgcgttcgaggccgtggcctccatgggcgtcgcggtcgagctgaggaggacgacggcgaaggacggcgacgcggcgagatcgctcgtggaggcggcggaggtggagcgcgcggtgaggaggctgatggcgccgcagggcggcgggtcgtcggaggcgagggagaaggccgcggaggtgagcgcggcgtgcaggaaggccgtggaggagggcgggtcgtcgcacgcggcgctgcaacggctcgtgcgtgagatcgttcgtgtcgtggcaggccacactaggccggaatagctggctggttgcggttggttggcccatctcacacggtactcggcccagtctagacgagaaaattatactagaaaccaagacgtcaaccacgtgatgcggcttaagggtgtgtttgattcgtggtagggtatagccatccctacccctatgagcaaatcctggagagattgaagtcaccacagacgtttcgctgtcgacaagtacgtcacctaccactgactgaaagcacaacgtcgcgcttcgctgtcgacgggtacgtcacctaccactgaaagcacaacgccgttaaatcctggacgtttcgctgtcgacaagtacgtcacctaccactgactgaaagcacaacgtcgcgcttcgctgtcgacgggtacgtcacctaccactgaaagcacaacgccgttaaatcctggagagattgaagtcaccacagacgtttcgctgtcgacaagtacgtcacctaccactgactgaaagcacaacgtcgcgcttcgctgtcgacgggtacgtcacctaccactgaaagcacaacgccgttaaatcctggagagattgaagtcaccacagacgtttcgctgtcgacaagtacgtcacctaccactgactgaaagcacaacgtcgcgcttcgctgtcgacgggtacgtcacctaccactgaaagcacaacgccgttaaatcctggaaaattcgctcccacagggagttgaacccaggacctcatgtactactgaggctcttgtaaccactaggctacaagccctttcacgggtatagccatttatatttgtaggaatatggtggttctgtttgttttatggatatatgaccatccggataggaacggatagagtaaaatcaataacatattaatcaatgataaatatgttaattatcatcaatatagtcatatctatactaattaacaataaaatggactaattatataatcaacactaattttgacaagtcaattactccatacgcttcaaaatataagaaatctataactggatgagatattaatcatttactaatgattaagattaccaaatgtggatatcctcatccggtcaatttaacccactcatctagtatcttcgtgaaacattttctctttagaccacccaatccattcttacccatcaaccaaacatatttaaaaactggatcgtcatatcccatttagtgatatcactctaaccaaacacaccgttaccttcctcccacccttaacccccatcgcattagaagctgagaagtagctggttgatagctattccctccgtcttataacatagtaatccaaaactgaataagacatttcatattagaacaaatctggataggatggtatttagattcgttatactatgaaatgttccatccgattatagattattatattatgggacggatggactaacttttgagaatctggaaaagttgaaaaactagaaaggctaggtttccaaatttttatctttatttattttctatattctataactacaacttcttaaatctaacttaaaaatttatattatcttaaaatataacttaaaaatttatattgtttaagggagctaaagatttaaataaaagctatagcggttaaaaactcatcaaacagagatactcctagttagcaaaggagggtggcatttcggcttgggaggcccatcgacctcatatctccggcgaaacggtataagccaacaaggcaacaatgtactactacacgtcaagcgaggacggtgactttcgtggaggtagaggactctgtctgaactgttttcattgaagaaacggaattgaatacaggccaagtgcgcaggtacaccatagtcacctattgatatatatacgtacagagaaaatgaactacacgtctatctacacttcaaccgtctctcaactcacatcagtaatttaatttccggtttatcccaccgcatatccgtttgttgacatttttccatcactacttattaagtgcgaaatatgatgactgctcgctgtaaactgcaaggaccatttaacaggcttagctggagcaggatgaactcagttgctcgttttgctcatttctcatttccttctatttaattttattacctgtaatttttctcatttttcactgaaattttagtgagtccttcaaaaattaaataaaaaaacagaaaaaccagctggagtcgaggagtggtcgctgcatgtttgtgtgcagtgggccaacgaaattaaaccaaggttttctggtaatgaaggtccacatcaaactatcctctcgcatggcacagttaatgctaccaacgggtggtcgggtacagaatttaaatgctgtgtgctttaagccaaatgtagagaaaaatgggtctttatttatttcgaaatatctcatggccagccgctctcaatggtgtgactaatcacgttcaagccatgatatgatggatcaaggcgagacaagaaaaatgtatgagcagtcatgcgagcaaaagtagtagtactgatgagtgatgccccttcaaatatcataacctccctgatcttttctataattctattagaagaaataattaaaagatcgatcacacataggctctgctaatgaaaccggtaacaaaaatttaatcaacttcctctcttcatctccagcatatgtacaacatactacatgcacagggattacaagctgcatgcaaagcttagcattttgcaagaaatcaacaaagccaattaattaatactcctccaatagtagtactagtagccaaggcccaacgcaacaagcacacctcgcagagagcacagagacgtacgcagcaagtaggtcgcctcctcctctctctctctccggccatcaccgccggcggccggcgatcgtaggtagcgtagagctagctggcgtagagcctgtagtggcggtaggacttgagcatggcgccgcagaaggtgcagatgatggcgcgccacgtggccctgtgcacggtgagcaggtagcagaagcgcgtcgccgtctccatgtccgccacgctcgcgcacccgccgcaccgcgagcagatccccgccgccggcttgctgctccggaccttcctcctctggtccaccaagaagcagaagaacaccatcctcctcgtctccggccggccggctcgccggaatctcaaataacacgatgtgtggagtggtggtctctgacggcggcggaggtggtggtggaggatggcgcaggggggttttaaggaggagagcatatggatcgcattgatggcggtggtagtgaggtagcgggtaggagaggagagaagggggtggaggtattaatggcatgtcggcttgatggctggacggctggaccatgatgcatgggcatggcgcgttgtatgccactcttgactcccggactccacttgtccggagtaatacaattacagttgttgtttgttaattttttttcttttgacttaatgtttagtacgagatagatcagaattgaacaccgccactccgccacctaaaaaaactgactggcaattctggatcttcgatcagccagaaataaactgtctgaatcttctttttttttttagaaaatttctgtctgaatctttgatcagcatgtttgtatatatgtgatgtggagaagtaggttacgatgtttctcatcagttttatactagcacatttaggcttcctttagaatggaggaatctggtgagaattttacgagttttgaaccgattcctgctaaactgtcgtaataaaatccctagtagtacattttaaatgagccgtcagtgtctttttattttccagaaacagcactagagcgactgagtggcagctataaacatcgtccagaaattaaaaacagggacagttaacacgtcggtgtgagataggagtagatcgcacgacgctgactgcccactgggaggtaagagtctgggtgcgagctaggctgcgaaggaggaaggatgatagccagttggttaatggatagacagcaggagctagcagatggatcgcaagtatccgtcaaccaatttattagttgtgccttcgccaattccatttggatttcacacgaaagcgcctcgtgaagcaagcaaaatatgggtagagagagccttccctgctaagcaagcgagcagtcgatcgagcaatatattcatttgaccgatcactaacttctctttcgaagtaaatgatgggtcactaactaactgtctaactgtatagtaccatttgtaattgcagatcgtttcagagtatgacaaaggcaatctccatcagaaaaggcgccaacggtctccttttttttattctttttgaaaaagagaaggcgccaggcaacggttcttttaccaattcttacaggtttctcttgtttcagccagggatcaccctggagcttggggaggaggaccacctcctttgatgttggatgggatcatcactccaatactcagcatgttcatcaagtttgatttgatcccaggggccagggctcacattaaacttggtgaccacttctacgcaatgataggtccatatgaacacactactcttacggtcttgcccctcaagcggtcgattagttgggttgccgtaaatgaagtaccctttgaaaaatgtaattcacatagatgatggaataagataattcttatacggtctctaatagagtatttataaatatcaagttttacatgacatacaaatatggtacctcccgaaaacgataaaattacctatggaatcataatgaaagtcaaaattatacgttttcttactacttacttttttagtaatggaggaatgtacgtagtctgtctctgttcttactgtttagtgtactgctggtggaatcgaacattaaaaaataaaaacaccaatgctaatgatcttatataaaaaaacatctttttgaaccaaaaaaatgctaagaaaatatcatttccatcacattttgcatcccaatagcatgggacggaaacatatactctaactttaaatgattgacatgtgagcctcacagctcgtaggctcataggttaacgacacatgtcggagaactgtatgttagaggagcttcttcggtatgagatggcattttcctcctcaccgcttctttaatttcattttcatacacttttgtttttactacaacattcaactattgtataatcccaaatttaaaacagcgttcttaattaagcttatccaaacctttggatattagctagagaagaattatggtatggagagaagctagagagttcaaagaaccaggtgactagtcgttgtctttagtaaaggtggttctggcatctctagatgttcttccaggttttgactgccttctgttgcgtgaaaaatatactggtgcttatgtatacagtacataactataagtatatcttcttcaaatcttaatacaatcggttgtccgtttcttcggccaacccggccaaaaaaactagagaataattaattaattttcaataactagaaaaggatccataatatttaacaagcaataatgaattttatacattaaataaaatatataaataaatggatataacttttattgggttctatatatttgctcacaagtcacaactgctctctgtaattttggtcttcatttcatttatttattttagctgcttagaaggcatgacgagacataactacatagggtattgattattaaacttgtctgaaatgttatggcaccaaaagtagctgtaagagttgttgcggcgatttaagatgtgaaacgtgtgatgtcattagctttcttataagagtgtgttaattttcggtagtaaatcatggctgtcacatttgtgatgttatgttacgtacaggtcagctaccgcaataccgcaaataggatgaagcaaatgaatgattagcacacccaccatcgtccttttttcatcctactagccaagaaccaagagaaaaaaaaacaatgagttttagtattaattcgattaaacatatatttaagttaaatagtttttttatgattttccttattgaataaataggtgattttataatttaagaagaatcaacagtgaatcagccaggagatgaccgttgaagggtgtgggttgattaatggaatctatttgcctactccctccgtcccaaaatataagaatgtttttatattttgggatggaggaagtagtcagtggtgtaatataatactccctctggttctatattaattgacgttttggataagattaaggttaaacttttataactttgaccatcaataacattaaaaatatttagtttaaagaaactagaaaaacatatatagatttgtctttcaaaacactataataaaagtaaacatgcatttatttattgtatatattataatagaaaaataaggtcaaagatatatcttgtagagcgtgtcaatgtccaaagcgtcaattaaaatgaaactggagggaatattatataatactagtagggatggtgtggtagaaaaaccaccactacatatacatacagtatagaaattcttcattgtttacattattaaggactactcatacgtaccattcaatcttatcttcaaagtttccaacctcatgtatgccaagccaatccttgctccactacatggagtgcaaatgctacccaatgtatgtcaatcaataaagtgattaatgtagccatgtagggcaagtgatacaagtcatgaacagatcgatatttattgctttgctagttgctactgcaatatacatgctcaaatagtctttaattatcatcttgattcttttactatacctagcatatttcccaagaaattaaagaggggagctatgctggatgttgttgcccatgctgctggcagtataacttgggctgtgtttagttacacgctactaaaaatagaagtttaaagaaattggaacgatgtaacgaaaaaattagaagtttgtgtgtaggaaagttcgatgtgataaaaaaattaaaagtctaaagaaaaaaaagttggaatcgccttgagccatgactgcctccaaaatcggtgcttccttaactcggctgcattactccgtttggctgcattgctccgtttgtcacgctcgcactgattgtcttgtcgttgtagatcagtcagttaattaggaccacacgcaggcagcgcaattagagcaagtttaatagtataaccaactactagttacaattcaactatagtcagtctaatagctcgtccatacaatagttacatactgcactattaatacctggttccacctgtcatacacactgtgtcttggagtccgtgctacagctaggtataaatctgtagcccactgctctcttatttatcttcttaaaatatatttacagctgacttatagcctactattgtacctgctctgcctactcatcctcatatcctttccttccttcgactacagggaattagtagaagatgggtcggtctgacacgtaaacacgggtacattaagttttttggcccatgtagtatttgctgacaacgacaagttgccaatcctgccatcgatcggggcattgtacaaagtctcgaatactacaggaaaagtaagttccatgacatcgaggtttaaaagttcaaatttataccatcaacagagcagatcagagtacatttaaaacatttctgagaataaagcagtttaagcggcagcagcgacggcaaggaatcacggcgctgatcccccaacgccggcgaccggtcgattcctgaagccgccggccgccaccgtactcgtatattcctctccacccgtgtgtcgcgtcgatcgccgtcggcggcgggcggcggcaacttctggtttatggagaggaacaactagggtgggccggtgattggtccagtttcgactaaacggcccaattggttcatggcccaggcgcatcttaggggttcggagatttcttctccgtaccccgtcgaaacatacgcattcgccgttgtggtgccctcgtatcgtattaccggacacctacgaggaaccatcttcgctgtgtgatgcttggcaactcgccggtgttctttccctcgagggtcggcgcgactacgatgttgtctaccgttcatatcgacgtcgatcatagctccacaatagattagggcactatgtgaaaaaagaaaagcaaaattatgccaaaattaagattaggccaaggattttgagtaagaggtgtgtacaattctcgagtcatgaattcgtgatcatgggcacttcacctcgtagaagttgagattacacactaggctgcgtttggatcctcggcaataaacatactagcctcgcttagtaaggtgagctgtttggcactgcagctaaaatgttgctaccgtgggcaagattacctcattttagctaaaatgtttattgggctttagctgcaatgggctagcccatgcttatcaggctaggaaagccgatcaagggatctgcgcgcgcatggcacgagtagacaccgacctgctcccatcaattccattgacccacggcccaggcaagcccactggcttagctagttagcttctccccaatcctgcagatcttctcgtcttcttcgacggttcaatccaacgcctggtggtctctcttcgtaggggttcgggacttgggaggtctgcgtcgtcgccgttgctggtcgacgaatcgcgtcacccatggcgcataaaggggtaagcctactgtttccatgtatctaaaaattaattgagaagttgtgtcagtattgggacgacctcaaggtgttcgatagaatgcccagaagactcaacatgccgctgcttcgtcctatgcgccaacacaagcttcaccacgaacaccaaacacacgaattccaccactctaccaatataggttttagcattgcacgcggccactccatgatgcgcttattctacggtgactaacgaccagaaccgattgattgcagcccgacgtgcctgttgtcagtggcatcaacagcggcagcacggtgaagctcaaagacctcgccccggcggccaccaacaacgtgaacacgacgttcatcgtgctcgacaaggcggccagggcgccgccgccgccgccgcacggccgcgccgacgcgagggaggagacgtgcctggcgctcgtggccgacgagacggcggcggcgcacttcctcctgtggggcgccgagcgcgacgcgttcgagccgggcgacatcgtgcggctgaccggcggcatcttctcctaccacaggagcaacagcctcgtgctgcgggccgggcggcgcggccgcgccgagaaggtgggcgagttcacgatgctgttcgtcgagacgcccaacatgagcgaggtgaagtgggtgcgcgaccccggcgaccccaggaggatggtgcaggaggccgtcgtctcgccgcactctcaggtcttcaagccgctgcagtgactgactgactgactgaccaaccaacctaaggtttggttcttctgtcactgaatttttttgtggcaccgttgtacaattgctcaatgtcgattaaggtgtgattagctcataaaaccctgctttgattaagggcaaattaaactggatgattgagagagagaaaaaaaaaactcgtagggcatgtttggcatagtctccatcctttgtttggtttcacattgaattcccttcaaatctcacgaattaacagacctccctaggtaagagattggtgggaattggacccttaattctcccaaacactctcgaattttcaagtattccaaccaaactacaaacttatactctcgaaaataatactcccattttccatcaacaactccctccaatcaaacagactgatacggatactgatgcagggagtttttagagttattgtactttctagaagtgtggaacgaataaccattaaccaatacgaaaaatatcgtacttctagaagcgtggaatgaataaccagtatggaaaattgttttcatcattgaagaaatgttatttacatgtcagtcagataatcatcagaaaagtatccccatggtgtccgtagtctagtttaagataattttctccattacctactactcatagagtacaaccttacatagtagtttttagtgtaataacgggcgcacgggcgcgtgtctgcccgcaccgctgctaggggacacgcatgtaataacgggagccgtagagatcgcctcacccgacatgaattgattgatgagcccgcagagataatctcttatctgttcatcatcgtaaaattgaagttacgaattgggggagaaaaagatgggcctgtactttgacacctacttctcgtatgaccatgtccatgtaaagaagcaacgggaaagagagaaggagatgatggtattttcgtccaatacatacaaaatacgtatcttagtagcaccaatgaaattacaaacaaatagcagtggcatcgtttgaaatacgcaaaaagtaacagtatatttcaaaaccaataaaattttaatgatatagatctaattaatccattaataaatcatcacttacatagatgaaatttagttcagaaaaacaagtagtaagagagagaatcttccaatccctctcttccagaatgtgtggattattcagagaactgaacacacgtccagccaaatcccgaccaaaaaccatcatcaatcagccgatcctgatgttgtccctgccgcacacgagcgtggtggcccagttgaccgccacgtagaacctgttcctccagctcaccaccctcggcccagacacgcccattggctttagcttcttcccaatccaacgtctggtggtctctcggaggtctgcgtcgtcgccgttgttggtcggagcatcacctgggcggtgtttccctgtctgtcgagcatcacccatggcgcataaagaggtaagcctactactgtcttttcgcatgaatgtaaaaactcttagagaacttgtgtcaggattgggacgaccttaaagtgttcgatagaatgcccagtagaggggagtgggttataatctctcgagacgatagctccttattaccagagcaactagaggttggctgccttccactgctgtgctgtgtgttgcaatatttaatcaccaaacaagtactaataatctattgatttatctttgcacacaatatttaagtattcttgtttcttcgatattaaataggtagattattaatgataaatagattgttgtgagttcaaacatattagcaggtgctttggcttactatgcagtgtggtatggtaggggagcatattttagagggtatgcacataagggtacacatatgatctctttttttttttacgaaagccacctttggatgagcatagagtatagttgtgtgcgggttaccttgcctttaaggtgttcgttattttctatcagcacagagtatgaaactatcttaaggtgtacgttcccttcttgcctgttccgtgacgcacccatgcgcgaaggcgcgagctcagctcgtgaccacgacgccgtatcgcctcggcctagccagctcgcaagtcgcaaccgattccccatctccgcctctgctcatctccactcgcccgccgccggctcacctctcggcgacccggcctcagaaagcgtcggtggagcggggccgggggcccgtcaaccggcccatcaaacaagccgttggcaacaacgcgtacaggaagagggagaggtgtgggtgtgtgcagttaggtgcggcgccgccgccgggcggagtacatcacttcggcggcgctctcccggctaccgagcatcacccatggcacacaaaggggtaaccccgcagtttcctcccaagtacctcacatgtgggatttgattttgttgttgttgttgtgtcgaggcgttgagaagttgtgtcgatcttgggacgacctcaagatgttcgatggaatgctcagtagagccaatgatctgctgcttcggcgtacgcctacacaagcttcagcaacaacacatcactctaccgatatagatatcgactgtgcaagcggccaattcttgatgttttacagtgtaactttgactaacaattagaatggattgactgcagcccgacgcgcccggtgtcagtggcatcagcagcggcagcacggtgaagctcaaagacctcgccccggcggccaccaacaacgtgaacacgacgttcatcgtgctcgacaaggcggccagggcgccgccgccgccgccgcacggccgcgccgacgcgagggaggagacgtgcctggcgctcgtggccgacgagacggcggcggcgcacttcctcctgtggggcgccgagcgcgacgcgttcgagccgggcgacatcgtgcggctgaccggcggcatcttctcctaccacaggagcaacagcctcgtgctgcgggccgggcggcgcggccgcgccgagaaggtgggcgagttcacgatgctgttcgtcgagacgcccaacatgagcgaggtgaagtgggtgcgcgaccccggcgaccccaggaggatggtgcaggaggccgtcgtctcgccgcactctcaggtcttcaagccgctgcagtgactgactgactgactgaccaaccaacctaaggtttggttcttctgtcactgaatttttttgtggcaccgttgaacaattgctcaatgtcgattaaggtgtgattagctcacaagaccctgctttgattaagggctaattgaactggatgattgagagagaaaaaaaactcatacggatactgatgcaaggagtttttagagatatattgtactttctaggaggtggaacaaataaccaatacggaaaatatcgtacttctagaagcgttgaatgaataaccaagagtaaaatacaccagcggtccttaaacttgtcgggaggttttacttagttccatgaacttgtaaagcgcacatcgagttctctaaacttggtttattgtattattctcgtccaaagccgcgtttgaccctggtcttgcctacgtggcacgccacgtgaacgataacatggattttttttattcttttctcccttcttccttcttttttcaccactgcaacaacccttcccttcgtgccgcctttcaccaccgacgagaaaaaagaaggaagaaggagaaaaagtgacgggacgaaaagtgcgaaaaacaaaaaataataaaatccatgtattgtcatgtgcgtgccacgtaggcaagaccatagtcaaacgcggctttggatcgggataatacaataaaccaaatttaggaacctcaatgtgcactttgcaaatttgtagacctaagtgaaaccttctgacaagtttaaggaccgttggtgtattttactcaataaccaatatgtgaaattgttttcatccattgaagaaatgtttttttacatgtcagttagatatagataatcaacagaacagaatccccatgaatccccatggtgtccgtagtttagtccaagggtttgttcactttgatgctattttcaatcataccattttttttgtcgagttgctaaaaaaatatctgcgtttagtttgttgccaaatttagttaatacataagaaatcatgctaaaattttagcaatcttgccaatattttggcattgccaaaacttggtaaggtttattttggctacaatctaaacagtccctaattttctccattacctattaaggttgtgttcttttcccctccacccaactcacttcccttccttttcacatacacgcttttcaaactgctaaacggtgtattttttataaaagttttctatatgaaagtttttttgaaaaatcatattaattcatttttcaagtttgcaggttaatacttaatctcaccataatcacatgctttgttttcgggaggcaacgttgggaacctggcctcttgaacgcaacctaagagtacaatcttacatagttttaggccttgttgagatcccaaaaaaatttggcaaaaaacgtgggaaaaaaatcacatgcattgagcattaaatgtgggaaaaaatcaattgaacagtttgcatgtaaattgcaagacgaatctttcgagcctaattacgccatgatttaataatgtgatgctatagtaaatatttgctaatgacggattgattaggcttaataatttcgcatcgtagtttacagacagaatctgtaatttgttttgttattagtctacatttaatacttcaaatgtgtgttcatatacttcaaagtttttacacccaaaaaactaaacacacccttagtctaagataaattttctccgtgtaatgccgccttttcaaaagccttatcttatccgctaaaatttaaattttcaactttaaatttgaagttgattttaagatttttcatcgaagtttttttagtcttcccttttagatcgttatgaacacgtatatataagttttattcataaattatttttcgtttgcccgtttttcttattccacgtaccacgatggagccacgagtgtccagacttgaatgaaataattaccccctccagatccaagcaagttcaagagccattcaatcaaaaaaaaaaaactcaacctaaaaaaacttaacctagcagaggtcatccccttcctggatatatggtagtcagggttgatttttttttcttgagacggagggagcgaagcaaacgaatctccaccgtccgatcaaacagcgtctcatacttaaggtggtgtttgaaagtcctacaggtagacgaaatgaatcctacccaggaagaaagaaattaaagcggggcccatccagcccgtgccgtgggacgtgcgttttcttcttcttgcagcacaagccgcggccgtgagatcttccggcaagcacggggaaggctcgcgcttataaaaagaaagaaacagatcttttcggttaaataaattttaatcaagaaaaagagagagaaaggcttctcttcttcttcctcgtattgctgctgctgcttttggtctcctccggtgaaagcgacgggccgtgatggtgcagctgccgtcgcgctcgtggtgaaatcttggacactgccggtaatttcttgtcattttttccccttcttttcctcgagtctgggtggattacgcacgcacacaaaaaaagaaagctggggtttctcttcaatgcgattcgagggcgaatggggatgacgcacgaagcccctgcggcgggcgggcgagacgacgagcgatcgaatatcctcaggttttattttctttccacgccgttcgcttcccgcaatcttgtttcctacgtacgacgatgacgagtccactcggaatatccccggaggaatccatggtggattcaacgaatcatcaaaactaccaaaccgtggagtagtgtgtgtgtgccgtactgttgaagtctggccgtttcgctgggtcgcgatcttgtgcagcacacgccggcccgagagaaggttccgattcccatctctcagccagttttcttggagaagaaacgttgttgtacactttattatgtatggcgtgataaatttggagagttcgtttgctccaaaattcttgggggagggagattggtcaacaccgatgtgcttctagtacttctcttttctcactgggctccattttccaaggaagaaaaatgcgaagccaagtctcgtttcgttcgtgtatcatgtttttttttgggtcgctttctttgtgtgtgtatatatattcctcgtgctgttgttgccatcagatcagttttgtgagattcaaattgacaactctttgaattgatctgcaggttctcgtggtaattctgtagttgtttttttttcgagttcttgtgtggggcgaagcgaagcagatggcgtggtcgaggattgcgaggggctcgcagctcacgcagccgctctcgaggattctcgccgagggcaacgcggccgccaccccggcggcgtacgcgctgcgcaatgcggcggcgctgggccagcgcgcctcgtcggcgtcggcgtcgtcgtcgttccacagcctcgcgttggcggggcttgctgacaagtacgcggccggcgctgccgggcggctccagccgagcagggggatcagcacgacgtcacctgcgctgcgccccgcggcggaggcggcggcgagggtggtggagtgctcggacgccgccgacgaggcggcggcggcggcggcggtgccggacctcgggcccacgcggccgggggagaagccgcgcgtggtggtgctcgggacggggtgggcggcgtgcaggttcctcaaggacgtggacacgcgcgcctacgacgtggtgtgcatctcgccgcggaaccacatggtgttcacgccgctgctggcgtcgacgtgcgtcggcacgctggagttccggtccgtcgtggagcccgtcagccgcatccagtcggcgctcgccacccgcccgggctcctacttcttcctcgcctcctgcaccggcatcgacacggggcggcacgaggtgcactgcacggcggcggacggcgacgggctccccgccaacccgtacaacttcaaggtgtcgtacgacaagctggtgatcgccagcggctccgagccgctcaccttcggcatcaagggcgtcgccgagaacgccatcttcctccgcgaggtcagccacgcgcaggagatccgccgcaagctgctcaccaacctcatgctctccgagaatccaggtacgctttcaaccacaccttgcatttgcacctcgtccatggcgtccatggcgatggttgctcgatcagttcttgatcgttttggtgaatgatggtgtgtaggcttgtcggaggaagagaagaagcgcctcctgcactgcgtcgtcgtcggcgggggtccgaccggggtggagttcagcggcgagctcagcgacttcatcacccgcgacgtgcgggagaggtacgctcacgtcaaggactacgtcaaggtcaccctcatcgaggccaacgagatcctctcctccttcgacgtcgggctgcgccagtacgccacggaccacctctccaaggtactacatgaccgagacgataggaaagattagtcgttcttcgttccgctatatcgactaactttttttttttttggttttaacactaaatcgttgcagtacggcgtgaacctggtgcgcggcgtggtgaaggaggtgaagccgagggagatcgagctgagcgacgggagccgcgtgccgtacggcgtcctggtgtggtcgacgggcgtggggccgtcggagttcgtgagatcgctgccgctccccaagtcccccggcgggaggatcggcgtcgacgagtggctccgcgtgccgtcggtggaggacgtgttcgcgctgggcgactgcgccgggttcctggaagggacggggcgggccgtgctgccggcgctggcgcaggtggcggagcgggaggggaggtacctggcgcgggtgatgtcgaggatcgcggcgcaggatggcggcagggcggggcgcgcggtggggagcgcggagctcggggagccgttcgtgtacaagcacatcgggagcatggcgtcggtggggaggtacaaggcgctggtggacctgagggagaacaaggacgccaggggggtgtccatggccgggttcgtcagctggctcatgtggcggtcggcgtacctgacgagggtggtgagctggaggaacaggttctacgtggcggtcaactgggccaccacgctcgtgttcggcagggacaacaccaggatcggctgaatttttttgtcgggatttggctggaacgtgtgttcagttctctgaataatccacacgttctggaagagagggattggaagattcttttttttttactacttgttttcttaattaaatttcatctatgtaagtgatgatttattaattgttttatacggttgaatagtaagcgtccatggaaaatattggatgcttcaccagtccactgcactcactcctccaccaagtatcaacatataatcatcgtctacacgactcgaaatgttaatggccgtgatataaccctttctacagggtaagataataagaacttctcgagcataactatgtggtgcgtcacaggaagagattccccttgatctatttgggtcgatctgtttggatcaaggcacactttgcagtcctcgggcgtccatagtctttgtccccaacctgccatgacctggttcttgggtggtggctttggtcccatgtatgtgataacatacaggacgtgtggccatctccgaacaatctaggggcacacttcatctctgaacagttctaggacacacttcgactcaagccggttgatccaaacagagtttcgagcattcaactttttttaaaaaagtttggatcgagccaagagctctagactagggaggtgttagcccacaaccaatacagtctgacatcttgacttttttcccactgtccaacccccaacccggaatattaatccgtatgtgcaatgtcgtgtttaagcctgccagtgggctagattttattgggcgaaatggattggatgttgatttggatggtggtggttggattcaaatgggctgatattaattttggattggagcgggttggcctgtgaagaattgcggtttgggctggagtggatgcgggttggcctgtgaagactatccatggattcagcccatgggttagcctccaaaacaaaccgaactatccccactccactccaaaccctacactccccgcacgcgcctgtgcgcagtgcgccgccgcgcactgccgccgccgccgccacaaccgcgcgccgtcaccgccgcgtgccgtcaccgccgttcgctgccaccgccgagcgccgtcaccgccgttcgccgccacagtcgccggactcactcaagaaggtgactcatctttcatgtttcttgaagtggcgttctctctctgcttggtcgagctccgctgatatatgttcttgctgtgggcagggaggtggcagatctgcggttgcgtgacctccatcttggatctcggtgagctggggggactgttcttggaagtggttcctgggagcatcctggtatggtaccttggctatttttgtgctttttctttgtttcgatttttagataatgtgggttggttcgattggagatgctgaagagtggtgggtttctgttgggtttaatgccgcagctggtgtcccatcttagttgtctcatgtgatacatactctgctggattgtagtatgtgtgccatcagacatcaggattagtcacaataattaggtcttaactcttgaaaggtaaagacttatgaagctattgccaaattagcagtaccaatgtctcatctaaccttgagaagtcatctagatctctggtatactgcaatgctactgaaaaagaaaaaaaaaagatgttggagatttgaacaaattggaattacacaaattgattgctagcaatgttctgttattcgcaattaattctgtcagatggttgtttataatatatcagtgcaattgcaccctttcccaagtcccaacctctaagtcatgtttattaagcatgcagcttttttgctgcttaatggtgactgttgagcgcatctagaaaatccagcacttaaacttttaagctgttggtcaaaggataaaacattttgaatgtcagttcattcagtcccatataactactaatctgttgatttaggtggctgtctttcactgtataacaggttgctgttgggtatgcttatcatttcactagtttttagcacaagtagtaaatgtaaatattaattctgcacaagtagcaaatgtagatattaattttctattcttgtcaaacacaggtttattaaacatgtctatgcaaaattctgaaagttcatctgccaatagttctagtcatgagctgccttcacaaacacgtaagagagcaaaagtgtgggaacattttgagcaggagcttgtcatgatagatggtcttccaaaagcacaatgcaaatattgtggcttaatgttgtcagcgactagaaaatcaggaactagccatctcataaaccatatttgcgaatcttgtccactagttgatggtgaagttagaaataggtttatatcaacagttaggaaacaacccgtggaaaattttgtgtttgatcctaaaaagactgaagagttgatgataaaatatttcatccatgctgagataccattccataaaattgaggatccctacttggatgattggatggcatccatgcagccaacttttaaacttgtgggtcgtcaatcaatccgcgacaagatttacaactattacaataggctgaaacaagaattgcatgctgaattagagaatcttgattcgcgtgtatgcctaacatcggacatgtggacctcaaatcaaaacctaggatacatggttgtcacagcccactatgttgatgctgaattcaaaatgaaaaagaaaattataagtttgaagcctgtgaagtatccacacactagctttgcaattgaagaagccatgatgaggtgtttgactgagtggggcttgagtagcaaactgttcaccttaactttagacaatgctagtaacaacaccgctgcttgtcaagaattagtgaaaactctcaaggatgagttgctttgagtgatcctgattggcaaaccagcgatcttttaaaacgattggctgctcctatgcacaccaagtttgcaaaatattgggatgaaaaattggcaaacaacttcaatttggcacttgtcattaccactgtgttagatccaagaaggaaaagagactatttggatttcttttatgagaaggtgtctccccatggttctaatgttgaaagtaaagtggactctattatagaggagatgaaatcatactttcatgtatatgaaggaattgcaagaagaaggggtgtatcctacatgtcacagtctagtgagagagttagtgttgtaggctcacctgttttgggaaaaagaaagctagagcatgaattcaccctcttcaagtcaaaccggaaggttgcacgtactcagaagtcagagattgatacatatttagaagaagtatgtgaggatgatagtgaggattttgatgttttggcatggtggaagaaaaattccaaaaagtttcctgtgttggcaattatggctcgagactttcttgcaattccacttagcaccgtgccctcagagtccgctttcagcagtggaggaaggattcttggagacacaagaagctcattgacaccagagatgctcgaggcacttgtttgtgcaaaagattggctacatagagccaaaaaacaaggggattaaaggtataatatctcacgccttgtatttcgtctcagactttgtggtctgtgccatataaatagtaattgtagatgtgttttcattttatattgtttgattagtcacaaaatctagattaatttgtctgagtgcccaccagtattactaatatttgtgccaaattttctttgatctaggttcgtactgagtactgaccatatgatgttttgtgaagaaggtttggtatgatggctgttttttttttacaatggtggggtccctgtgctcagtaacttaatgttgttttttgttcatcagttggtgaaatgttaggcggaatttgtaacaccttgcaatgccttttatatctattagttgtatccttacttgtatatattcttatttgagcagctagagcatgttcaggagatagatgagagcattgtgtatgtgaaggataagcaaggaaggtggcctctctcttctcccagaggggcaaaaaaggccccaaccaggactctgtcatcctctgccaggtaacatcttcagctctaactctctgtctctgaatcttttctttctgtttgatgtgctcagctcagatcaatccgctcaatttctcctcttgatgaggctgctcaggccaaatgttttgttttgtactcaaaagggttcagattagttcagggcttcagggtgttctctagtccatgatttgagcttccatgagctaattaggtcagcagttagtagagtacttttttttcaggaagagttagtagagtacttggtagaaatagagaaaaatcttttctttctcttgcaaaattgtttgatatgatatgttgtatcctactatgttgattctggctgcagaattttggggctctcaaccttgttttcttcctctcttttttttttccatttcttgaaagtccttgtggttgtatatagtagtatagatatttagttgaatagtggggatggatggattcattcttcattcttactagtgtgtccactaactcatgctagtcatatcttatagaaataataatattcaacttgtaatctttcaatgttatttctgaaatataaatttctgatggcttctttctcttccagattatctacaactgcatatggatcaaggcatagatgatgttttggtagtttttgttgaagatataaaccttattatggcccttattattgctgtagtagtgagcaattgacttaattgtaattatatgacatcattagtcttctggtattcatttcagtgctggatcagctaacaaacaatgcgatgcgtatcattctgagtattttttttgcccaattttcagtgtttcagcaagcaatgatgttcttttaatatttctgttttgaattaattgtttgcacgtgtgtctacactgctgctctctatactgtagctgagatccatggctaaagaagtaacgaggcctcctggctccaagctctctgtagtgtagctgggatcatggattgaatccattccagtgaagtgggctgaacccattttagtgtaatggtttggggtgggttggattgaaatctgatgcggggtgggttggtttggattttggaggagaggaaatggggtgggttggtttggcatgccattccatgaggaggtgggctggggtggattcaaattggatctcagcccactggcaggcttagtcgtgttccaatgtggtcgcaggcatgcggtagagaattaggaattatgccggccaacctatcggcaacaaacattgtgcgcaatctcagtttcagctaccgacgagtgatcccgcggcgatcgtgcagccttgcaaccaccatatcgaacaagagataggggaggccaacttgggctgggacttgatacggatgaactcaccaacaatttgggccggaacgggattaccgtgtatgggaataggtccacttgccatcccttaacttcacattgagtttaattgacatcctttattcccagtaccaaaaatttttacctttaaactatacaaaaccgtgtaggaagagtcccatggcagtatcaacagctggtttagctgacgtgacgtcctagttagaaaaaaaaatggtgggattcacatgtcagcatctactcgccaatgaggtttgcctcggcgcctcgcttgtgttccaactccaaccttttattcctgttcgcccgcggaccaacctgatgaggccaaccaagaacacaaatccccacatcaccaatccacacaacttacacaagctcgcagcttgcgcgggatgggagagagaaaactcttctgagattttctcctctcctctctgcttttgtttcttggattggtccacggttcttggggcggcggcgccgtcgatctggtattgtgaggagaataagaatcagaggcaagtttcttgatctgatgatggcaagcatgacgtcgatgacgaccgctacctctgccgcgaagacgtaggtggggttggctgcgtcttcaaccgcggcgggagacgtgtgtacgagggtcaccccagtgacatggtgcagtgcggctggcaacacgtgcatagggcgtggttcggcgtgggaaaatgaaaagagaaaaagagagtgggcgatgggccccaccatattttttttattttcttttttttactatgttagctaaaccaagtgctaatactaccatgggatgatgggactcttgttgcacggttttttacaatttaggtgtgaagatttttggtattaggataagaggtactatctccgtcccaaaataaataagtgtagttttacactgtttatgtcgaacgttcatccatccgtcttatttgaaatttttttatggttagtatttttgttattattagatgataaaacatgaatagtactttatgtgtgactattttttttccatatttttttttcaaatacgtaaacccacagctacttatttttggacggatgtattatcaattaaactttgatgtagagttaagagacaacaagtaaacttattccccatggacgagtcaccaacaaatagcatttgattgcctatctgatttgtttcctgtacatataacaaagagaattctttcatgggctgaatcattcattggtgtcgatttatacttttttagcccagacgaaaacgaaaatgttctacgctagtaacaccagctgtaaagcctgtaacaagtaacaactgcacattctctatattgatgaatcaagaggacaggtcatacaacgtcactgtaacctactaacaatttgaaattgtagtcagcaaacagggaaaacatatatgttcgtttataccacaatctatccattccatcagagatatgagtcggaccaataatcttttctgataattaaaaagctgcccgcatagcacccctagttgcatcacgcttcatctcagcagcttttccacttcctcggaagtacatgtacacttgctgcattcacaaatgtcaaaacggctcagatagactacttgagaatttatttcataaaaacatactttctccgttttatattataagactttctagacacatatgtctagatttattaacatctatatgaatatgggcaatgctagaaagtcttataatatgaaacggagggagtatttgttattcgcaggactgacctggataacccagatgctgagcaatgattcgacgcagaacaatccaaatccaacaaagtagaagatctgcaaagaaaaattacaccaattacttgaccgacaagatcagaaagagttttttcggtaggcatctgaaaggtaagttgattatcttcatgaatcaaaaactgcatatctaaccatagttacttagcatctaacaataatgcgatgcacacttacccccaccaaagcattcttgctgatgagatcaattgctggtaaaatccccctgcgggagtataaaataagcattagttcatgcaagttcaactctcacagacactagagaatccttaggcccaccctcctcgctacactagctaagaagaaatccatccaatcatattttttttagtatttatgtatgtgttaaacagaggagcttcagatcccacatattgaagtgcctattttttgttgtttctattgaaaagatgaatatactaccacttcatgaatcataacttaagctcaactaaggaaactccaacatccagggaagttaaatcaaatagtacaatgttcttatgcgtcaatattatattgctggaaagcaggtgcatcaaaacttgcatagacaagcagaccacttcactgataaaaaaagccatttgtacaacatgcaagtaggtcacccttttagtttcagtttccatattcccattgacagaatatgaacaagcagggaacttacgccaatgatttcccctcgaagacaacaggaggagccacagcagaaaatacacagaaaagaatatggaactgcaaagacaggaaattcaagaattatgttcccacacattcaaaatcaccgaatatcttactaacatataacaaggactcctcacttaccaggtaaaccaagaagaacaatccaaacttcaaggcactatcagtcctacaaaacaagtgtccaataaatgttacttactcatatacacaagaaaagcacggagaagttcgcagaaacaatacctcatagcattatacagaggtcgataccataaaacatatgcaccaggaaccccagagatgaagtagatgattgccagcaaccatatcttcacgcctgaaaatggacatagcattattaaaggattacagccttaaagaactggtcaatatgtacaagcaacgccagaagtgtcatgagtataccttcccccttgacccaagctgaagtaactgctatgacgttccagaagagacagcaagccaatcctactcgacaccaaaaaaagttgtcttaattttgcatataacagaatggaatgttgaaataattcataagacagccttttatttctaactagaaaaataaatggcagaacttgaatataattaagaaaatctcaaaagctcatccctattgttttagaattcttattaacttgacttgcaatgcagacagtcacaaaatctcactaacgaaattctaatgataaaacatgtgactaagatcgtaggagactggaaaatttgcctttccagttttacagttgaaggtgcagaatttctgaaagaagggtgaaaatgcaaactttgtagaagactaaaatgcttgtccattatgcagttaaaacgttaccgaagtgcaagagcatcaagattttgggaatctgacaatcagaagcataccaagaaatgatgcaaatgcaacatattgcattctttgaaggtgactcggtatctcattggtgatatcatgatggatgagtggcagaaatggaggccagtttttctcctcaatgacaataccagctgcaaaagtgttataccaataaagtggcataagtttaatagcccgtgagaaatgtttaatgcataagttatattagtctgaacaccttgttattctaaaatgaactacaaggatctacagctctatcatgaaagctacacggtatacggataacatttttgaaaaaaatagtaagatacacttgttttgagattcccttttatctgtcacttatccaggccggggtgtggcctttctaacctgtgctacactgtaagctggtttcccccagcgctgccactttggctttcagtaaaagctgggtcctttggacctttcgtctaaaaaaatacttggtttgagaaactctcgctaatgacgttaccaatacaacattgcagttgcatttcacacaatcgcaattcacatgtaacagattaagagtcacatatcattgccacattacctcatagtttgtactatgtaatatcttaaatggcatagttctaatataaggaatccttatgatcacatgagtcaacagagaatattacaaagcaacattgtttctatgaattagtgagtaaagaaaatgagcttttacctcgcgctgcagcctcctccctcctttttagctcctggtcaacaaatgaagataataatgtataaatgtaacaatcacaaactaacaaaccatcatggatcaaactaattatgtctaagtaaagcatagaattccttgtgcaggtagtaagctgatttttagagaggaaaagaacactgcattacgaatttatgattctgaatacttcaggctaaggactgatgtctgctgtgtttcgcacaaaaaattaagaccaagaagcatcagattacaacaaactcttttgttgacctatcgtaatggacacaactaatgggtgatacaactgcatatgttcatggtgtaccttctccctcttgttcaattccgcttccctagcttgcagctccttttccctattcttcaggtcctgagtatccatacatcacacattagtaaaaagcgacattaggtactattccatgaaagatcctctactgtactgcagtctagctgcagttcaactgagacggataaactacacattcatacaaaccttggaagagtcaagagggatatccaccgtagccccaaaagctgcgggctcagggggaagaggcgaaagccgcgaattcgacgacacagaaggcacattccgtggattctgcattgcagtacagattaaacagttggtaggtaacaaaccaataattgcgaattcaagtattcaacccccaccgaggcaccgacaaaatggtccaactgagaagaacagaacaccgaacagcttaccggcatgtagaacgcgccgccgccatagctgggctgccctccagccttaccacgcgcttgttcctacagagaaacaaacgaaaacaaattcatccgtgcccgcacaaacgagggtttaggcaccaatgcaatcatcgcaacaccccccaaataaaaaaaaatccccctaaatttagcgtcggtgatactacaatgcgagaaaaaaaaaacaataaaaacggccaccgattcacccacggcacacggttagatctgcggccgccaaccagatccaaccacgaacgaagaacacacacgccactcctcagaacgcgcacggaggagaagggcaaggaaacacgaaaccagatccgctgcgcccggcgggaacgtggagaaagggagggagggagaggatgggttcctcaccgagaaagggttcacgtcgtcctcctcgaaggggttgctgtcgtagcgccccgccatctcggccccgtcttccccttccctcgggggtcggcttgggcttgggctctcgctcgcgccgacaatgatggcggtggagaggagtagtggggtggggttttctcgggggagagggagacgacgagacgaggagtcctgccaaatacagcggccgcgcacgcacgcacgcaccgccgcccccaccgaggcagatacggacgagtgaccgcgacgactctcggtgaagaaggggagggggaggcgggtggacgcgcacacacgcggaacggaatggcctctgcacttctgcagcttgtaaccgctcgcggggccaaccctctctgtgttttttattattttcttgctcccaatcttattggtcccacggtttatggaaatattgggtccactcacattatgtgggcagttttgaaactggcgcctcgtcgccatggaacagccaaaagagcccaaaccgtgtgaattatcacaggctcgcagtgccctacacttttgtctcttttttttaaaaaaaaaaacacgttacaaatgtagacgcttacaacacatacgtacttaggccctgtttaatttccagaaagttttttctaaaaacatcacatcgaatctttgaacacatacatgaagcattaaatatagataaatataaaacctaattgcacagttaggggggaaattgcgagacgaatcttttgtgcctaattagtccatgattagctataagtgctacagtaacccacatgtgctaatgacggattaattaggctcaaaagattcgtctcgcggtttccatgtgagttataaaattagttttttttcattcgtgtccgaaaaccccttccgacatccgatcaaacgtccgatgtaacacccaaaaattttcatttcgcgaactaaacggggccttaccatatccttaagaacatctccgaaatattaggttaacatatcttaagattaacgaagtcaccatgggtctatgtctactactgaaagaataattatttgtaaacacgtctactagtaaaagaataattaaccatacatacaagtacacaagtctggatttaaactcgaatagtctggttccaccatagggatcctaaccaattgggctacgatcacttcacactttttggctcatgtttgctctcgtctcaaacgttcttatctcaaattagggtaaaacatagttctactaaatttcggtctaaaaatctacagctctccccaaacggtctcagatcttgtaaggactaaacgtttttttatttacgatctcagtaaaaagagggctaatccatactccttccgtactcataaaggaagtcgttttggacagcgacacggtctccaaaacacaactttgacttcttttttctataaaaatatttattgaaaagtgatatatgtatacttttatgaaagtatttttcaagacaaatctattcatataatttttacattttcaaactcaacaacttgagagttattcatgatttatattatcaatatttgacttaaacattgtcctaaacgagtatggagggagtacataagttacatcaagaaatactcttttcacaatttccagctaacccaactacccaagttcgttcatccagcaaccaagacaccaagtgcttggcatgaggcagaaaactatcgtcctagaccaccgtttcgtgagtcatgtgagttcatgactcgtgggaaatggattctgctttctcttcacatgcttgaaatgtgcttagcaaaacagagttcgcttactggtgaaggtcgccatctccaccgcactccaccaatttcgctttcaaacgcttctattggccgtcatacgcttgagctttcccagattactcattattactatctttgtttatttgtcatggtgttactaccagtaccagttagaattaagctagcaagcatgagattagttgggttagcttctgtttatttgtcatggtgttactactagtaccagttagaattaagctggcaagtatgagatcagtcggagttaacttcagatgaacgggggcacatctataatcgacctctgtcggtctctggtgttctgtttgtctattttctagttatgcaatgcactaacgcatgatgactaaacaagcaccaatgcactagttgtggatgattcctgttcacaagccaactgagacctgtacgaataagcaataatgcagctttaatcagtggcaactaactagtgacttgacaaggtacaacgcccagtatcacacaaaggggcacatcacttttttcagctaccacttagcaatactcagaattctagtaacttcacacccagcaccagcagggcacaatgatatcaactactccttccgtcccaaaatataaatatttttagctatgaatattgacaattgtatagctatgaatattgacaattgtatgtctagattcatagctaaaaattattatattttaggatagaggtagtagttcagaaaatattacatgtaatctactacctccgtcccaaaataaatgcagccatgagtttccacgtctaactttgatcatccgtcttatttgaaatttttttataattagcatttttgtttttataagatgataaaacatgaataatactttactcatgacttatgtttttaattttttttaaaaaaaattaaataagacgaatgatcaaagttagacgtggaaaaccatggccacacttattttgggacggagggagctgtgaacaaacgagcaaaggaattctgcaacaatcgcagaaacagatatgacaacaatgatgacacaacttttattgaatgcaccaacctagatgctctaccaagagtaatctagtattgccgtataacaacacgcctcgagtacaatatcctgaacaatgtatacatagcactagccaatgctattccctcgcctcaatcctctacttgtgtatagaagcatagttccagtccccgcatagataaataataatacatagaacgaaagtggcaaggaaaaatttcatgcgcaacatgcaaagctaattttcttgcgtacttagaacacctgcaaaaaccttaagcttgtcaatttacagcctaccgagctcagatgtgtgcctttaagggcgttaagcttctttctgacgctccatgtttgcacaaaaatgctaatactgaatatactccaacaagagaagatatatgcaacggaaggaggtacaatcacaactcagggcatgagtggggtaagttgtttgctgaaaaggtcaccaagggcaccacgaacatccatctgcggcataaccacaatattagtactccactactactaacgcctttaatgtgaaaacatacatctatgatggaaaaacatatacctgatcacagcagataagttttgtaattaatggatagaactctctgatgtgcttcttgaatatctgagcgtccatgatacacattccattcaaaacctgaaattaaaacagttgagaatgtgggaatataacattatacgcaaggatgagatttcgcaaaaggccctatacactactattagaagtttagaaccatatgcactataccttgacaataactggtgctcttaggtccagtacacggtgtatgtctgcacttgcagcttccccagtgcttggctggagatcagaagcatcttcaagatctgcccacaaaacgaaacaagcttcccttctgcgaggctcttgagcttttcatgttcatcagattctatgacgtgcccatttgtatcctcacttgggtcattcccatcatgttccacagttgatttctgaagaatctccaaatagatagcagtt

SEQ ID NO: 70674 - DNA, 71116 bp, Oryza sativa
ctaccccatacacgcggagcgaaaacccacgaggggtcagggcgcctcggccctcgggcccgaggggggtgcagcccgaccccctcggggggactaagaggagggcgaacacatcaccctcgggcccgacgtcccccgagggtgccaggccacgtgggcgattgtgtctgcctcaaacctctagtcatgatactcccgatcccatgtcaccgacagtagcccccggcgttatgccagggcgatcgccctccttaagggaagcggtcgggcgtgacgccactcctaaggcctggtgacaggtgggaccggtctccacaattgggcagaaaaccaaacggtcacaaatcacgcacatcggcagtggtaattcggctgtcaacaatgagcggtctcttcaagactgccacattactcgagtagcacacgaatctggacatggcgattcgtttcatctgaagatatggtaacgtcgcttcggttggcgagcgtaattaacgcgcgcacgatatgatctacctcgaccgccacaaccgcatatccacctcatgcgccgcaagcgggcgaatgggattagtggaagcgtgggcgcgagaaacgagggggcgaaatagtgggcgcgagaaacgaggagccgggcatagcgttggcaagggtataaaggcactgaggaagggacttgtttccttcctttcgccattattccccttgtctttgctgcttgcgccctaactcctcctttcctgcgccctaccctcgccacacgcgctcgctcttaatcttctcttcctccggcgccatggcacggggctccgctctgctcgatggtagcgtgctgccgccctcccgcatcgtgagcgagaggcaggctgggctgccgcgccgcttcatgccggaatcggccaccggccgggagatagtcacgctgggcgagggacgcccggcgccagactgtcacgtcctgataaattcatcccgaattaaaaatcattcgctaaaaggaataatagaattaattaaaattcgaaaagaaattggcaaacactaaaatacgtacaagaaaaattcaaatgtggcccggagaatttttgttaaattctccttggtctaaaaagagccctcaaattttagtggaattttcagagcacaaataataattattaagaaataaacaaagttaaaaaggtttataaaaagaaaaaccctaaaagaagtcttcttcccccccttcctctcttgggccggctcggcccacctcgctctttccctctctctcctccccgcggcccactcggcccctcccccgcgcgcgcgccgctgacaggcgggcccgcccgccaccctcgctgacgggtggggcccacctgtcatcgccttcctcgcgccgctcccgccgcccgcccgtgccctagcgccgccgccgccgcggattccgccgcatcccgccatccccgcgcgcattaaagagggggaaatcactccccgtgattccctctccgtttccccccgcttttccctctctctctccctcggattcgctcggaatctttcccctaaacctcgccggcatcaatggcgcccgagatcgccgcggccgtttccttcccctccggcctctctctctccctcccggcgctatataattgttccccgtgcctctctcctccgtttccgccgctcgccgctcgctctccccgtcggattcgtgctcgcgccgtcctcctctctctccgccgtcgccgccgagctccggttcgccgccgtcgtcgccccggacttcctcccgtctcggcgtcacctccatcggcttcgccgcgtcgtcgtcgacctcgtccgctcctccgtttcgcccgccgaccgccggagcaccgtcgtcctcgccgtcccgaaccgcgccggcgctttcctccactccggtcgtcgtttccgccgtcctcgtcgtcccggggtgagccgtggaccgcccctttcgcttccctctcttctccgatctctcgggcgccgctccgccgcgccggtggtcgccggcggtgaccatcggggcgcgggcgcgccgtctcccgtcggccgtgccggcgaggccgccttcgggcgcgccccgcggctgccaggtggggcccggccgtcagccgcccgcgcccgcgggtgcggctgacgcgtgggacccacggcgccggccgccgtcagccgcgtgcacccggtccaccgtggaccgagaggctgacgcgtgggccccactcccgtggacccggtccgcgcgccctctctcccggctgacgcaataaatgagtttttaattaaaatttaaatgaagaaattcgtaaatatccatttaaagagcatataaacttcaaatggctatatcttggccatttgaactcggaattggaccgttcaagtctctaatttttccttaagaagtcaagaacccatttttgtgctttgtttctgctgttatgtggagtttattagagtaaaagccgtttcttttccgttggtcgtgtagacgctgcagcttcggaagatccgctcttcgtggaagttgaagccggtgtttgggaaagcgagcaaggcaagtcacatcatccttgagcatattgaatcccagtttataaaattattttgatttaaattattgcattaccgctttatttaaattcccgcgttatcactgttttatttagccatgcctatttatcgttgttaagacattattattgctattgttattattaccttgttcaccctaggaaaataaaaccccaactagtgggtactctatttatggttccactagtatgaacttaggtagatgcttcgctggttaattaggcaacattaggtgattttataactttagactttgggaattctcatatcatttggacactttggaattgttggtttatggtggaattggacatacacctctcttcccctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcgtggcagagggttggtgccctgctgcttggggctcagtcctgcctgcctgtcccgggggttccggccgtaggcaggattgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacggccttgattaataatactgtgtagctctaggatcgtctttataaaatggctttgggcaactaagtgacttttaaatgccgtttactgcaaaacttaacccctatcttattatccccttgtactcctttgcattaattgtgcatctccggtgtggcctgctgagtactgtggttgtactcattcttgctcaatcttttccccccttcagtaagagaagctttggagaagaagtcttaggtggagtcctggcttataccccagttgagcgcctgtgaagatggagccgtaggcccgctagtccgctgctgtttatttttgtttgtcaggcctgaagtacctttgtaataatgtaaatattatcgatataataaagatgtgtcttttataccatgtttgtgtggtgtacccggcttttcctgggacggggattaatacactggtgttcgggaaaaggcaattttcccggtcgcgacaagatggtatcagagccatctcgactgtaggataagccaagtggataaaacctaaggacatattttataaataaaactatttgcgaaagttccttttttttctccttcccctaatgctatttgcaaaaggtttactcccttcttccttcttcggatttccactagtactagatggttagtttgcgaagaagaagatgtcgccaattgttcgccgaagctccggaagactgcaggatccgctagcgaagtggaggaagcagtgaagccagctgtgaagcagtgaagatcttggagaacccgtcgcagaacctaagccaccctgtagggtagtgttgttagtcgtgtgttccttgcttgtgtgtgtagcgcgtggtttgcatcggggggttgtgatgtaaccatgctaggttgtttgcttaatcaacttgcagaataagtgaaacaaacaacacatcaacaaagagagttagttcctttaaggtcctgtccctagttctggtctattctttcctagcttgtttcctctctcacctcaatccctgtaacagatgtttaacagagaaaaaggaaagaatgtcagagggtatgcctccagtaactcaagttttcaactcaatccaccactggcctcaagagagttaaccagggcacacccttggtccattccaagcatgccgcttagttcacagctaccattggttggaagtcaagaccaaaatcagtatgtgtttgatcgagcatttgccacccaggtcaatgagcttccaatgccagaagaggatgtccccttttgtcacgattgtagagaacaaggacactatgccctgaattgtccatgggtatatgccaaagaagccccttcctttggtttaacagggcagacatcgctaaaccagcctcctcgcaccaagtcaagcttgcagcctagtgtgcaaagtagagagcccaatggagagaatccattgaatcccgggaattgctttcctcctagcccttcgtaccacgtggggtcacgtactaagcaagccaaaggcaagaagagtaagaatcagaagagaaaagcgccgatgcgaactgaagaagaagtacgtaagatggctattagcagcaccgaatggcctcccgcagggataactattcctagacgtcaaagaggaaataccttccgaggtgcacgacagttgacccagcaccttctaagccatggtggcagagtatctgatagtgaagggtcagatcaagtctcctcggatgatgaagatgagtctccccgacatctcggtgaggaagagatggaatcaaaagcatgtatccgttgtggagaaattggacacattgctagcatgtgtctcacactctgcgcttattgtgaagaagaccatccaccaggggagtgtcccacccgcaaggtcacatgctttctgtgcgaaggtacaaatcatgtgcccaaggattgccaactcagtgtgttgttgaccaagaccgcagaaatccaacgaacgaccctacgattgtctcgtcagctagtcagctccaacagcaacatcgacgatatcatccacaacaccaatgctcctcctgctccacctaactctgcaataaatcatagcaataatatctttagcaccaaccattctctgcaccgacagcctcagcaaagagttgtcgtcgatggaagaagttgtgtctctccccgacctactccaggccaagcaaagggcaatcaacctcaggagggcgataccaagcagaaaaccgtcatccgcttcaaccagcaatcagaaggaagcttctcctgcgaatgatagcattatgcagtcctatcacatcatcacagaaccaatcaaggatgatgcagtcactagaacaatgccagctatatctctccggaatcaaaatgagcagccatgtttgtggttttcagtttgctacttatcattgtgtaatcgaaagtatgcagcaatcatgtaataaacaaatatattcatgattttaaacaatgagcttgctatgtttagggatgattcatgttgaggatacaatgtaccaatgataagcaccttccctttttgtttaaggcagtgccttgtattcgtgtaataagggagaaatgggtaatacagacaagttctaagaggattcttgtggaagatgcggatatgtgatcatatgtataattgtttactgacaaggagacctagggtctcgtgtcagaagaactatattataaactcgagttaataaccaacctgttgatggaaaagaaaaccaattaaactgtgttgggttaaaaagccaatgagacagtagttggggataggagtttggatacgccttttacagatcaagataaggattgttggatgaaacccataagggtacccgccatgcctctacattgataagttcggatatacctgcaaacagttaagaagatccaggagacatcaatatttgagaacatagtagtcgatggttggtaattagtctatcaggtatcagaaaagggtcaaaggtgatatggcagaagaacaatttggatgctccccatctcgaggaagcactaaagatgatcatcggcaattaaaccctagtggcatagatacagatagcaagcaacgtatttccttgaaggtagtcagtgcagctttttgacgaaccacatcaaggtttcacggaaaggcagcaagccaaaggacctcatcgtccccagaagcgtccgcaatccacattaaagaataccacctgttagagataagccgaaagatgattgataaaagagattggcaaagacgttctccagcatgaaagaagtaggccgaaaggtgattgataaacagaaacatgctctgcatcgctcaaggaagacccctgatagtaattgccccgcaacagtcaccttgtcattaagtaagcaagatgacctaggtaaaagtgtttctatgaaggcaaagagtgaaatcttcaactcggtatcagatgctgcacggagtgaaaagtgcaagcaccggttaccaggcaacaccatgtcttgggagattgtcacgcccagaaattcacgaaccagaatttctaagctgaatgtgcattaaacccctgtccaggaccggccagggtacacaaacgacaattgttgacatacagatccacgtcttacaaaaatataaaagattacaaatgcagcggaaaaagagaaaagcgagctaagcctgaagacttgactcctgcagcgggcgactccattccacaggcatccttgacggcagcgacgaaaccaacctcttcgagacatcttcaactgagaaggacttcaactctggtgtgggggaaaagagagcaagactgagtactacccactgtactcagcaagtcacaccggaagaggaggtatgatgcaagatatatccaagggaggctaaaggttcttttgcataaagccggcatttcaaagcagtagttgaaagcagtaaaacagttgtagtaattaatccatattaaccaatcactgtccaacgttacaccacgttgcaacaggcccaaaccaccacctgacctaaccagttccaaaagctaactagggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggcagccgatcaaccggacaccccggccgacccaactccatcacgcccaccctcgcctggatacgtcggctagagaaaagctacactacaagcccagccgttgcccacgctggcttgtggtaagtacgataaattcttccagggcatcccgcgaaccggtccttaatcgccatgggcacgtctagcaaaaccatgcacccacagcccaccatgtagtgtattttaattagccaacaccattgcggtggcactaatccaaagctattgccaataatcaagtctatgctttaatgtggtccccttttgtgcactagttgaactaagcatggctaagcatctcctaaaccaacatctagtcattttaatacccaagttatcattggcataagggaaacaacatatagctgagtaataggacccatcccacatgatattgtaaaacaatgcaatatttaatagaaatgcgggacatttgtaaattaggtacaatatgatcaattgcaatgtatgacttgccttgctctcgcactgatggaaccacagcaacgtcttcgagaaactgcggatcgacgaaacgggcgaaatctacgcgacaaacaaagcacacaagcaaaacatgctataagactactgaaacaggaaacaaaaccatttttaatggattctacacatttttcttgatttactgagacttgaatggacttaaacggagctcggatgaattagttatgaattttagaagattcactgtgtttttactaataaagaaaaagtccttaattaattattgcgcaatatattccagggctgacgtcagcacggggtggcgcggcgccgacaagcggggcccaccggtcagcggcacggggagagagaggggaagggcgctggtacacgggcccactcggcagcggctcaaggggggggcacggctggcaagcgggccccacggctccggctccacgagccgatgtaccggccaggcccggcatcaagccggccgggcggccatggcaaggcggcggcgcgggcatgcgaccgccagcgacggcgagcggcggcgcgggcggcgggcggcggcgcgagcggcggcgcgggcggcgggcggcggcgcgagcggcgacgaccgaaagcgacggcgagggcgcgaagagggcggcggcgcacggggaaaaaaaaagaaggaaaggaaggggagggagacctcaccggaggggcggcaatggccggcggagaaaaacgagggaggcggcgaagaccggtgatgccgaggtgcggacgagcgacggcgacacctagggaaagagaggagaggaattagggcggaggaaaacccccacagcgaccatccacgccggccggagtcggaggggagagagaactcaccgacgacgcgagggaaatggggtttcggtggtattccggtgacgcagagcagcggccgggaagggtcttgcggcggcgaagctagtggtggcggtggcttagtgcggcggcggctctagcgacggcggcacacggccggagtgcggcgacgggcggcggcgtaagtggcggcggtgcgagctcggtagggggcacgggatggagcggtgagagcgaaaaacgagagaggagggcatggggagcattttataggcggagggggaggcggacgtggccgggaggcgctccgatttcgccggcgacgtgggggaggagagagagaaggtggggggagattcaaaatcgaatcccgcccctctcgtgcgctggcgcggccgggagacgcggggagagggcggcgacgtggcgtgggcgcggcgacgtggcgtgggcgcggggaaagcggaggaagtgggtgcggcggcagcggtttcggcgggacggcgcgagcgggagaggcgggaggtgggagacgggtccgacaggtgggccccacctgtcggcgaccccgggagggagggaggcgggcggccggctgggcctcggcctgcggccggcccagcagggaggagggggaggaaaggaggagatgggccagcggcccatccgaaagaaaggaggaaaaagagaaaaaaaaagaaaaagaaaaaagaaaaaggatttttttttcctggaattaaaattgcactttggtgatttttaattggttaaaattatttctagggctctgaaaattccactaaaaatcctgttagcatattttgacatgtagaatccaagaaaaattccacatgccgattccgattattatttgcatttattactttagggtttctctctaggttaaattaaacaatttcttcggacgatttattttatgaatttagagcaagggaggggaacttcagggcgtgacaaacctaccccccttaaacagaatctcgaccccgagattcggaagagctggcgaagaggtgcggatgggcggccttcaattcatcttctctttcccaggtggcttcttcttccgagtggtggctccactgaactttgcaaaacttgatcaccttgtttctggtccttctctcactggtctcgaggatacaaatcggcttctccacataagtcagatcttcctggatgtcaatgtgctctgagctagcttgttcctcaggtaccctcaaacacttcttcagttgagacacatgaaacacatcgtggataccaaccatattagatgggagctcaagctggtaagcgacttcacctctgcgttccaagatcctgtatggtcccacaaagcgtggtgccaacttgcctttggtttggaagcggtgtactccccgaagcggagtgacacgaaggtacacataatcccctgcttcgaaagtaagctctcttcggcggttgtcagcataactcttctgtcgagattgcgcaattcttagcctttctctgacagtcctaactttctcctctgcttcggttaacacttctgtcccaaacagttggcgctcacctgtttgatcccagaaaagtggtgtgcggcactttcgtccgtacaatgcttcaaacggtgccatttgcaaactggactgataactattgttgtaagagaattccgcataaggcagacttttatcccaggctccgccaaagtcaagcgcacaggctctcaacatatcttccaagatttgatttactcgctcggtctgaccatctgtttgcggatgataagccgtgctgaaattcaaacgagtccccaattcttcttgcagtttctgccagaactttgaagtgaactgactccctcgatcagatactatcttcttaggtaccccatgcagacacatgattctcgagaggtagagctccgccaaccttttgcccgtataggtagtgtgtactggaataaaatgagcaactttggtgagtcgatccacgaccacccagattgaatcgtgccccgacgacgttctgggcaaacctgttatgaaatccattccgatttcttcccatttccattccgggatctgaaggggttgtagcagtcctgcgggcctctgatgctctgctttgactcgctgacaaacatcgcagagtgcgacgaattcggctatttctcttctcatgctggcccaccagaatttctctttgaggtcctggtacattttagtactgccgggatgaattgaatactgagtttgatgagcttctgtgagtatgagatccttcagttctttgtcgtcaggcacacacaatctttctcccaaccagattgtgccattctcatcctcatggaaatctcgagcttttccaaccctcatattctttttcagctcagctatttcaggatcatttacttgagctgctctgacttgatccacgagcgtaggccgggcctctagggcagctacgtacccgtgttctacgatgcccaaatttaggtgctcaagatcttgctgcaatttgtcacacatgacttcggtatatactgcattgcaatagctctttctgctcagagcatctgctaccacatttgctttgcctggatgatagtgtatccccatgtcataatctttaatcaactccagccatcttcgttgccggagatttaagtcgggctgggtgaagatgtacttcaggctcttatgatcagtgtaaacttcacagcggttgccaataagatagtgccgccagattttcagagcatgaaccactgctgccaactcaaggtcatgagtgggataattggtctcgtgtgggcgcaactgtcgcgaagcatatgcgaccactctgccttcttgcatcaacacacatcccaatccttggcgagatgcatcacagtagacctggaagtctttcgtctgatctggcagaattagaactggtgcggagactaacttcttcttgagttcttcaaaactttggttgcactcagctgaccatttgaatttttcatctttctttagcaactgtgtcatgggcctggcaatcttagagaaattttcgatgaaccgacggtaatagcccgcaagtccaagaaaactccggatctgagaaactgtctttggtggggtccactttgtaactgactccacatttgatggatccactgccacgccttgagcagaaatgatgtgacccagaaatttgacctccgataaccagaagtcacacttgctaaacttggcatatagttggtgctccttcaatatctcgagtaccaggcggagatgctgctcatgttcctcttctgattttgaataaataagtatgtcgtcaatgaataccacgacaaacttgtcaagaaactccataaacactttgttcatcaagttcatgaagaaagccggtgcattggtgagtccaaaggacataaccgtgcactcaaacaacccataccgagtggtgaaggctgtcttgggaatatcctcttcccgaattctcaactgatgatagcctgatcgtaggtctatcttggaaaacaccttagctccttttagctgatcaaacaggtcatcaattcttggcaacggatatttgttcttgattgtgacctcattaagggcgcgataatccacgcacatcctcttggtcttgtctttcttctccacaaagataaccggagcaccccaaggtgaagtactcggtcggatgtaccctttctgcagctgttcgtcaacctgcttcttgacctctgctagctcattagctgccattctgtacggcctcttgtaaattggagcagtcccgggtgccaaatcgatccggaactcgatttctctcttcggtggcattgtagtgaggtcttctgggaacacctcaggatactcttgtactataggaatatcctccaacttcctgggacttttctccactgtttctgtctgaccctcaatagcagcctgattcagactcgctacggacttctgcgacgctggggaacggaaggtgatcttcccccctttgtcgttggttagggtgatggtgcggcttgcgcagtcaatcactcccttgtttctggtcaaccaatccattccaagaatgacatccaggtctttagattcgagaaggatgaggttggatagaaacggtgatcttttgatctctatagtcaccgaggggcagtagtgtgctgtcctcatatcatttccaggggtatgaacctgcatcggtattttaagttccactaccgataatccatgtgtcccagcaaatcttttggaaatgaaagaatgcgaggcacctgaatcaaagagaactgttgctggatatgagttcactggaaacgtgcccaacacgacctctggtgctgcctgtgcttcctctgcagacacatgattggcgcgggcctggatgaacctgggtccagtgcgattcagcttcggacacttgccagcaaagtggccgtgcttgccacagttgaagcagggtcctggctttcctacagcccccttcttgggttgttctgactgaactgacacagttggcggatctgactgagctggtgccattagtgggggtggagtcgagttgtggttgcgctgcttactgttgttgtgactgccaccgttgtaatcgttgtcgaagttactcgggtgatagggacggtgctgacagacgatcagggtggaaggcccacctagctgtcccgtcatgaagcgaggcttctgattgttcccctgaggaaagctgatctgagctgcctttctttttcggtccattttgttgcgttgctcttcctgacgaatagccttgtccacaagcttctcaaagtcctcataaactccggagattagctggttggtcaattcatcgtcgagcccaaacaaaaacttctcctgcttctcagcatcggtgcgcacgtcctcaggggcgtagcgcgcaaggcggttgaactcatgcaagtactctgtaactgacatggttccttgctggagcgcacggaactctctcttctgttgtgccataatcccttcaggaatctgtgccttcctgaagctttgacaaaactctgcccaagtaacctccgttgcatctagacgggtcgccacgtagttatcccaccaggcagaagcgggaccttgcaactggtgtgtagcaaaagcaactttctcttggtcgttgcattgcagtaggttcagcttcttctcaatagcacggagccagtcgttggcctccattgggttggtggtgcttgagaaagtgggtggctggatacgaagaaagtctaacagtttggacacgtgtgatggtggaggaccaaactgctggttctgttgcgcctgctgcaacatctgatggtaatgttgctgcatctgttgcatcatcattgtcatcatttgagtgactgttgggttttcgggcggtggagatgatctgctgccagatgcaccactgacatgagctccatcggtctgctcttcgctgcccctggcgtcgctggagtcacggggatcattccttgtcttcaccatctggaggggataggtagaaataagagaaaggaagaaaacggatggctcggaaactaatttttcttatgaaattaagtgccattatcttaatctggattaaaacactgaaaaagaggcacacaattcctaattaaggctgtcataccactcacacatgatatcgaccgccgactaacccacaagcaacaaacctaagcacggaaactagcaagcaaacaaaactaagaagacgataaagctaagggcggcgactctgaagcttggagcggcgcttgcgatcgaagaacaggtctgacatctaaagagtacagagggataggaaccaacacatgctcaaaaccaaattaaataaagcaacaaatgactaagtaactcgccgagcatgatgatttttatgcatagaacatttttcatgaacccggataaagacactaatgcgactgactaaaccatagcttaatgcataaacttgttgcatggaaaatgatgcgcataaaattgccccatcgaacatagacacgacctaatgcatatcacccgataaattcccaactgactgtcaaataaactccaaataaacttttaccaaaccctagactgtccctagtcgagaaatccaattaaataagcgaccaagatttttcccacaaactcagaagaacaaaaccccaaaatttttcccgaaacaaatccaagtgcaaaaagcatatgcagatgaagaggggttcagagggctcttaggtttccagttggcttgtcctacggtcaaggtcggctctgataccaacttgtcacgcccagaaattcacgaaccagaatttctaagctgaatgtgcattaaacccctgtccaggaccggccagggtacacaaacgacaattgttgacatacagatccacgtcttacaaaaatataaaagattacaaatgcagcggaaaaagagaaaagcgagctaagcctgaagacttgactcctgcagcgggcgactccattccacaggcatccttgacggcagcgacgaaaccaacctcttcgagacatcttcaactgagaaggacttcaactctggtgtgggggaaaagagagcaagactgagtactacccactgtactcagcaagtcacaccggaagaggaggtatgatgcaagatatatccaagggaggctaaaggttcttttgcataaagccggcatttcaaagcagtagttgaaagcagtaaaacagttgtagtaattaatccatattaaccaatcactgtccaacgttacaccacgttgcaacaggcccaaaccaccacctgacctaaccagttccaaaagctaactagggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggcagccgatcaaccggacaccccggccgacccaactccatcacgcccaccctcgcctgggtacgtcggctagagaaaagctacactacaagcccagccgttgcccacgctggcttgtggtaagtacgataaattcttccagggcatcccgcgaaccggtccttaatcgccatgggcacgtctagcaaaaccatgcacccacagcccaccatgtagtgtattttaattagccaacaccattgcggtggcactaatccaaagctattgccaataatcaagtctatgctttaatgtggtccccttttgtgcactagttgaactaagcatggctaagcatctcctaaaccaacatctagtcattttaatacccaagttatcattggcataagggaaacaacatatagctgagtaataggacccatcccacatgatattgtaaaacaatgcaatatttaatagaaatgcgggacatttgtaaattaggtacaatatgatcaattgcaatgtatgacttgccttgctctcgcactgatggaaccacagcaacgtcttcgagaaactgcggatcgacgaaacgggcgaaatctacgcgacaaacaaagcacacaagcaaaacatgctataagactactgaaacaggaaacaaaaccatttttaatggattctacacatttttcttgatttactgagacttgaatggacttaaacggagctcggatgaattagttatgaattttagaagattcactgtgtttttactaataaagaaaaagtccttaattaattattgcgcaatatattccagggctgacgtcagcacggggtggcgcggcgccgacaagcggggcccaccggtcagcggcacggggagagagaggggaagggcgctggtacacgggcccactcggcagcggctcaagggggggggcacggctggcaagcgggccccacggctccggctccacgagccgatgtaccggccaggcccggcatcaagccggccgggcggccatggcaaggcggcggcgcgggcatgcgaccgccagcgacggcgagcggcggcgcgggcggcgggcggcggcgcgagcggcggcgcgggcggcgggcggcggcgcgagcggcgacgaccgaaagcgacggcgagggcgcgaagagggcggcggcgcacggggaaaaaaaaagaaggaaaggaaggggagggagacctcaccggaggggcggcaatggccggcggagaaaaacgagggaggcggcgaagaccggtgatgccgaggtgcggacgagcgacggcgacacctagggaaagagaggagaggaattagggcggaggaaaacccccacagcgaccatccacgccggccggagtcggaggggagagagaactcaccgacgacgcgagggaaatggggtttcggtggtattccggtgacgcagagcagcggccgggaagggtcttgcggcggcgaagctagtggtggcggtggcttagtgcggcggcggctctagcgacggcggcacacggccggagtgcggcgacgggcggcggcgtaagtggcggcggtgcgagctcggtagggggcacgggatggagcggtgagagcgaaaaacgagagaggagggcatggggagcattttataggcggagggggaggcggacgtggccgggaggcgctccgatttcgccggcgacgtgggggaggagagagagaaggtggggggagattcaaaatcgaatcccgcccctctcgtgcgctggcgcggccgggagacgcggggagagggcggcgacgtggcgtgggcgcggcgacgtggcgtgggcgcggggaaagcggaggaagtgggtgcggcggcagcggtttcggcgggacggcgcgagcgggagaggcgggaggtgggagacgggtccgacaggtgggccccacctgtcggcgaccccgggagggagggaggcgggcggccggctgggcctcggcctgcggccggcccagcagggaggagggggaggaaaggaggagatgggccggcggcccatccgaaagaaaggaggaaaaagagaaaaaaaaagaaaaagaaaaaagaaaaaggatttttttttcctggaattaaaattgcactttggtgatttttaattggttaaaattatttctagggctctgaaaattccactaaaaatcctgttagcatattttgacatgtagaatccaagaaaaattccacatgccgattccgattattatttgcatttattactttagggtttctctctaggttaaattaaacaatttcttcggacgatttattttatgaatttagagcaagggaggggaacttcagggcgtgacagagatgatccaatgggaaagaacacatcaaggctgaaggtgcacaggaatacgttgaatgctaaatgatgacaacatgaagagaatagcggaaagtaaactgaacataaagaaagtgaatctgagttgcttgttcgtgggagctattcccagttatgaaacaagtgatatgttcgaagatagtctacagaggtcagagtaaaatcacatctaacaacgaagcttcaaatttggccggataacgaccagacaataagaagtccagcagtaaagccatttgggaagacgtcaaagcatgtccagtgggataagttggttctcttgggaagcataattcaaaggcaaagttatcgacccttgcatcaaatagcagaagtagctatcacccggagaccaggaaagctaatatgaggcagttggtggcgagttagaagcaaatgacaagcatggtatcttagtaatgacgagctgatctcgacgcatgacatgaagtgggtaacttgtatgaggttgactccaaagatatgaactatgcaaagttctggaactgaagccccatcttcaagtgccacaatccagtcgaagtcagctagaggtgcaaccagggaaaagtcaggtgaagagaagactccatctgcaacaggagattgagccaagcagtccagagtggagaagttttgttaggcaagttcgttataaaagatgcgacggaagaagtcggacaagaagagaagaccgcccaacctatcttcttgctagcctcctcgaatctcggggacgagattcttataaggggggtggatttgtcacgtcctgataaattcatcccgaattaaaaatcattcgctaaaaggaataatagaattaattaaaattcgaaaagaaattggcaaacactaaaatacgtacaagaaaaattcaaatgtggcccggagaatttttgttaaattctccttggtctaaaaagagccctcaaattttagtggaattttcagagcacaaataataattattaagaaataaacaaagttaaaaaggtttataaaaagaaaaaccctaaaagaagtcttctttcccccccttcctctcttgggccggctcggcccacctcgctctttccctctctctcctccccgcggcccactcggcccctcccccgcgcgcacgccgctgacaggcgggcccgcccgccaccctcgctgacgggtggggcccacctgtcatcgccttcctcgcgccgctcccgccgcccgcccgtgccctagcgccgccgccgccgcggattccgccgcatcccgccatccccgcgcgcattaaagagggggaaatcactccccgtgattccctctccgtttccccccgcttttccctctctctctccctcggattcgctcggaatctttcccctaaacctcgccggcatcaatggcgcccgagatcgccgcggccgtttccttcccctccggcctctctctctccctcccggcgctatataattgttccccgtgcctctctcctccgtttccgccgctcgccgctcgctctccccgtcggattcgtgctcgcgccgtcctcctctctctccgccgtcgccgccgagctccggttcgccgccgtcgtcgccccggacttcctcccgtctcggcgtcacctccatcggcttcgccgcgtcgtcgtcgacctcgtccgctcctccgtttcgcccgccgaccgccggagcaccgtcgtcctcgccgtcccgaaccgcgccgccgctttcctccactccggtcgtcgtttccgccgtcctcgtcgtcccggggtgagccgtggaccgcccctttcgcttccctctcttctccgctctctcgggcgccgctccgccgcgccggtggtcgccggcggtgaccatcggggcgcgggcgcgccgtctcccgtcggccgtgccggcgaggccgccttcgggcgcgccccgcggctgccaggtggggcccggccgtcagccgcccgcgcccgcgggtgcggctgacgcgtgggacccacggcgccggccgccgtcagccgcgtgcacccggtccaccgtggaccgagaggctgacgcgtgggccccactcccgtggacccggtccgcgcgccctctctcccggctgacgcaataaatgagtttttaattaaaatttaaatgaagaaattcgtaaatatccatttaaagagcatataaacttcaaatggctatatcttggccatttgaactcggaattggaccgttcaagtctctaatttttccttaagaagtcaagaacccatttttgtgctttgtttctgctgttatgtggagtttattagagtaaaagccgtttcttttccgttggtcgtgtagacgctgcagcttcggaagatccgctcttcgtggaagttgaagccggtgtttgggaaagcgagcaaggcaagtcacatcatccttgagcatattgaatcccagtttataaaattattttgatttaaattattgcattaccgctttatttaaattcccgcgttatcactgttttatttagccatgcctatttatcgttgttaagacattattattgctattgttattattaccttgttcaccctaggaaaataaaaccccaactagtgggtactctatttatggttccactagtatgaacttaggtagatgcttcgctggttaattaggcaacattaggtgattttataactttagactttgggaattctcatatcatttggacactttggaattgttggtttatggtggaattggacatacacctctcttcccctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcgtggcagagggttggtgccctgctgcttggggctcagtcctgcctgcctgtcccgggggttccggccgtaggcaggattgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacggccttgattaataatactgtgtagctctaggatcgtctttataaaatggctttgggcaactaagtgacttttaaatgccgtttactgcaaaacttaacccctatcttattatccccttgtactcctttgcattaattgtgcatctccggtgtggcctgctgagtactgtggttgtactcattcttgctcaatcttttccccccttcagtaagagaagctttggagaagaagtcttaggtggagtcctggcttataccccagttgagcgcctgtgaagatggagccgtaggcccgctagtccgctgctgtttatttttgtttgtcaggcctgaagtgcctttgtaataatgtaaatattatcgatataataaagatgtgtcttttataccatgtttgtgtggtgtaccccggcttttcctgggacggggattaatacactggcgttcgggaaaaggcaattttcccggtcgcgacacagactacccggggcggtccgtcttctttctcccttttgcaatggcagggctggttccgctattttcttctttcttcatggatgttctggagttctacgatctccagatggcgcacctcacccccaacgcggtgatgacattggccatcttcgcgcatctgtgcgagatgttcattggggtgcgcccatctcttcggctgttccggtggttctttaccgtgcagtcggtgtcgccgccatcggtagtcggtggctgctacttccagccacgggggccggcgctgaaccgctacatcccctgcgccctccgcaagaagtgggacgactggaagagcgattggttctacactcccctcgccgacgaagcgcgcctccgacttccgagccagcccccggcgcaggcctccagttggcgggcgccggtagatctgggggatggctatgacgctgtcctcgaccgcctggcgggcctgcgatcccaggggctcacaggggccatggtgtatggcgactacctccgtcgtcggattgcgccgctccagcggcgcgctcggggcgcctgggagtacaccgggtccgaagactacatgaggacccaccagggagtgagatgggactgggctcctgaggacttcaagatattggtccaacgggtgctgaatctcaactccgtggaggcggccctcattccccaaggaatcctccccctctgcagcgatccagaccgcgcctccatcttgaccattatgacggcagtcggggcctcagaggagggagctccaaagggccacgacggcgcaggcgggagccgcaagggggatcaatctaccccaggagggggtcgtgcttctgggccccgcgtcaggggctcggggagcaaccgccctatcgacgaccgggggaagaggaagctgggacgaacacctcccccatctcctccccgagggggcggggcagtgcgtgccagcagcaggcgcccggagggggccgcgccaacatcacagcccgagggggagcgcaagaagaaacggctccgcaagatgggggagacagaaccatctcggggaaacctcatctcccctccaaagtggtcgttcaaccgaccccctcgcaggttcatctctcactcatcgtggctgtatccattctcttcaacgcgagttttcactcacccgtctttgttcgtcttctggtcttttcttctgttttagcgagatcccgtcgcgtccctcccgtcattccaagtctggccaatctgaggccgaggatccggcggccacagaggcacggaggcgagaatctgaccggcgagaggccgcagatcgcctacgggaagctgaagaggccgcccgggaggccgcccgggctcgccaggctgaggataccgctcgggaggaggccgcccgagcccaccaggccgaggaagccgctcgggagaaagccggatttcgccaggacgaggcaatggtttcttccgaggcagctcgcgacgaggtcgcgggcgcatcgcttgggcccactccctcgggcgacgctcaggcgacaacttccggggcagctggcgacgaggctgcgggcgcgtcgcctgggcccactccttcgggcgacgcccaggaccaaacaggtccggggaacatccccgagtccggcacgtccattggcgggccgagccgcgcgacatcttctccaaggcagctcttccccacgccttccgtcgccccgctgagcgcagagccccttctgcaggccttagccgccgcaaacaccgcggtgttggatgggttaagtgcccaggtggaggccctgcaggcggagcgtgcggagctcgacgccgcatgggcgcgtgtcgaggaggggcggcgatcggtggaggccatggtggaagcgggccgcaaggcacaccgccggcacgtctcagatcttgaagcccgtaagacggcgctggcggagatcgctcaagaggtggaggaggagcggggggctgccctcatcgccaccaccgtgatgaacgaggcgcaggacaccctccgccttcaatacgggagctgggaggcggagctaaagaaaaagctcgacgccgcccagggggtccttgatgccgccgctgcccgagagcagcgagcaacggagaccgaaacggcgctccggcggcgtgaagaggcccttgaggcgcgtgccatggcgctggaagagcgcgcctgcgtcgtggagaaggacctggcggaccgcgaggccgccgtcgccatccgggaggcaacgctggcggcgcacgagtctgcctgcgccgaagaggagtctgcactccgcctccgcgaggacgcgcttaccgagcgggagcgagctctcgaagaggccgaggccgcggcgcaacggttgacggacagcctgtccctccgtgaggcagcgctggcggagcaggcacgccgcaatctagaatgtgtccgcgccgagagggccgcactggaccagcgggccgctgacctcgaggcgcgggagaaggagctggactcgagggcacgcagcggcggggcggctgcgggcgaaagtgacttagccacccgcctcgcagctaccgaactcaccatcgccgacatgcagcgcgcgctagactcatccgccggggaagccgaggccctccgcttggcgggcgagatagggcccggcatgctttgggatgcagtctcccatctggatcgcgccggtcggcaggcgggcctctggaaaggccagacaatgaagtactccaccaaccagggaggcctcgctcagcacctctcgaagatggccggggctctccagcagctccccgaggagctcgagaagaccgtcaagtcatcctcgagggacctcgcccaaggagcggtggagctcgtcctggcgagctaccaggccagggaccccaacttctctccgtggatggcgctggatgagttccctcctgggactgaagacagcgcgcgcgcgcaggtccgggatgccgccgaccacatcgtccacagcttcgagggctcggcccctcggctcgcgttcgcccccaactccgacgaggagggcgacgccagcggtgcagacgacagtgacgacgaggccggcgacccgggcgcatcggattgagcccccaggcccccgctaatctctagttttttctttttctttcttctaaggccttcaggcctcttttttgtatagatcaacttaatctgcaatcaaaaatgatgaaaatttttgtgttaattttactttgctatacaaatgagatgaggatgatctgtgccgtggtccttttgtgtcttagcttgatttaaggactcgtgcccaagtcccagtcctcgaaaggcgcgggtcggggctagtgcctggggagatccacatgtcgaggctggccaggccgggaacgtggtgaccgagggttatgggtgacccgattgtgggtttttgccgattcccccccccggagttcaccacgccccagggcacggctcggttctgggccccgtttggcgattttagctgaccgaaccgagcccccgagggcaaggttgagcacgagtgatcttatttcaagtcaaaattcttcaaaaaggaaaaaacggcacagatacagcccttaggaaattgaaactgcttttattgaaatactgaaataagagaaaagagaatgtgcatgtgtggtagcccccggccaaccatgcacacccgagggggggggtacggggttggcccgagcccgaaacctgacacccgacccccccctcaggggtagaagcgacgaaggtgctcgatgttccatgggttaggcaactcagtgccgtcgcccatggccagccgtatggagcccggccgggggacgccgatcactcgatacggaccctcccacattggtgagagcttgctcaatctagcacgcgtttggacgcggcgtaagacgaggtcgtcgacgcagagtgatcgggcccggacgtggcgctgatggtagcgccgcaggctctgctggtagcgtgcggctcggagggccgcacgccgccttcgttcttccaagtagtcgaggtcatctctacaaagctgatcttgatcagcctcgcagtacatggtggcccgaggagacctcagggtgagctcggatgggagaaccgcttctgcgccgtagacgaggaagaaaggcgtttccccggttgctcggcttggtgtggttcggttcgcctagagcaccgctggcaactcctcgatccatgaatcgccgtgtttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagtccccagacagcaaatggccacgaaagtggtatggtctgcagggcctgggccggctgatggatttgcttggcgtggaattgacacgctctacatcggtggaccaggtcgaccgcatcattgagagctgtcggccaatagaaaccttggcgaaaagctttaccaaccaaggtgcgcgaggcggagtgtgctccgcattcgccttcatggatatcggcaagaagcacaacgccttgttcccgaggagtgcacttcaggaggattccattagccgcgcgccgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagctgggagcactcccctcgggtcccgaggcctggactccgacgggcctcgggggccggttaggcgcatccgtctcccctaaggggtcgggtcgcgccgacggctgggcaagcctttcttcaaaggcgcccggtggggtctgggctcgcgaggacgcgagccgtgagagctcgtcggccatcatgttatcccgtctgggaacgtgccgaagctcaatcccgtcaaaatggcgctccatacgccgtacttggcgcacgtaggcgtccatctgcgagtcagagcaccggtactccttacagacttggttaacgaccagctgggaatcgcctaacaccaggaggcggcggatccccagtccagctgccactctgagtccggcaaggagtccctcgtactctgccatattattggtcgctcgaaagtcgaggcggaccaagtatttgaggacgtctccactcggagaggtcaacgtgacccccgcaccggcgccctgaagagacagggagccgtcgaactgcatcacccagtgggcggtgtgaggcagctgcgagggacccgagccggtttcggggaccgagacgagctcgggagccggggtccattctgccacaaagtcggcgagggcctggctcttgatagcgtggcgtggttcaaagtgcaaatcaaactcagaaagttcgattgcccatttcaccacccgtccagtaccctctcgattatgcaagatttgaccgagggggtaagacgtaaccacagtgacccgatgcgcctggaaataatggcgcagtttcctcgaggccatcagaacagcgtaaagcattttctgggcctgagggtatcgggtcttggcatcccggagggcctcactaacaaagtagacgggccgctgcacctttcggtggggccgatccttttcgctaggggccgcatccctggggcgctcttcacccgagcggcctcgcggggcgcactcgtcttctgtgccgacgacctcggggtcggaggacgacgggggcggccttcccacagtggcttcggggccgtcctgggggtcgggggcccctggcgtcgtcggacaagcgggcagagggccatctccggtcgtcgggagccttgggccaccgttctgctcgggggcctctcctccctgctctctcccgggccaaatcggcacagggttagcctcggggtcagagggcgataggtgcggccttcccgcagtggcctcggggccttcctgggggtcgggggctcctagcaccgtctgacaagcgggcagagggccatctccggtcgtcgggggccttgggccaccgttcggctcgggggcctctcctccctgctctctcccgggccaagtcggcacaaggtgggggtgcgcggaatgaggattgtcctcatcgcgttccacgaccaacgccgcactaaccacttgcggggtcgccgctaagtagagtagcaagggttcatttggctctggggcgaccagaactgggggagagctgagatacaccttcaactgagtgagggcacgttcagcctcctccgtccaagtaaacggcccggagcgtttgaggagcttaaataagggtaacgccttctctcccagcctcgatatgaaccgacttagggcgaccatgcaaccggtgacgcattgcacatccctaagcttgctgggggggcgcatccgctctatagctcgtatcttctcggggttggcctcgatgcctcgggcagagaccaagaacccgagaagcttgcccgtaggtacaccgaacacgcacttatcggggttcagttttatgcgggcggagcggaggctctcaaaagtttccgctagatctgaaagtaacgtttcctggttgcgcgtctttacaaccaagtcatcgacataagcctcaacattacgtcctaattggctacccaaagaaattcgagtagtacgttgaaaagtaggacctgcattctttaacccgaagggcattgtcgtataacaataagttcctatgggggtaatgaacgcagttttttcctcatcctccctagccatgcgaatttgatgataaccagagtatgcatctagaaaacacaaaaggtcgcaccccgctgtggagtcgacaatctgatctatgcgaggcagggggtaaggatccttaggacatgccttgttaaggtcggtgtagtcgatgcacattcgaagcttgccgttcgccttgggaacgaccaccgggttcgccagccactccggatggatgacctcgcggatgaatccggcctccagaagtcacgccacctcctcgcggatgaaggcttgacgttccggggcctggcgccgcactttctgccggaccggccttgcgcccggccgtacggcgagacggtgctcaatcacctccctggggaccccgggcatatccgccggtctccatgcgaagacgtcagcgtttgcccgcaggaaagagacgagcgcgtcttcctatttgccatccaagagaccaccgatccgtgtggtcttggacgggccgtcgcccaggacaacctccttgactgggacctcatcgcacgtgactatccgctgcctcggggcggcgggggcggatgtgccaagcctctcgtcgccaccctcgggcttggacacgacggcgaggcggtccgcgcgctgctccatacaagcgagcgcgactttgaggtcgccatggacagagatggggccatcggggcccggcatcttcatctggaggtaggcgtagtggaccgccgccatgaacttcaccaacgcgggcctccccaggaccgcgttgtagggcagactgaggtccgccacatcgaagttcactcgctccgtgcggaaattggcgggtccaccgaaggtgaccgggaggtcgatatgacctagcggccaagtgtgccccggcgtcacaccgatgattggctgggacggccggagcatcatccccggggccttgatggcatcaaaggctgcgggggaaaggatgttgagggctgctcctccatcaatgaggacacgccccaacttcacgttgcaaacggtgggagaaaccaccatcgcaatctgccctccccgggcaacgcacggtgggtggtcggtctggtcgaaagttagggcaacctccgaccaccgcgcccggcgcgtcgcctcatgagtaggggccgcggccagaagctctcgcttcatggccttgaggctccggcgagaaatgtgagcacacgctcctccatcgacagtggcaatggtggccccaggctcttggaaacctaggtcatcatcgccgtcgtcgatgtcctcggcgggggccttcttcttggcctcacttcgccgattgccggaaggaaccgccggggacttgccctctcggcgctcctgcctcctctcttcctcccacttcctcgtccgctcagccaaacttttgactgcacggcagtccgcgaggtcgtgaagggaagtgttgtggacggtgcaccacttgccggctgggcgctccctgctgggagcgccggcctttttctttttgtcgctcgctggcctccccttttgggtggcccgcgaagcgccctcgacggcgaggacatgaccctcgtcgtcggaatggactgacctcttcttcctcctcctgtcacgccgccctgtctgagcggcggatccgggggcggccgaagctgccactccggaaccggaggggttccaggtccatgcctcctccttacgagccactcggtccgcgagctgaaaaagctccgcggtagtctggggctctttggaggcgatcttttcgagcatgcggttgtgccgcacgccccccctgaacgcgtagattaccgcgtgtgcagggatgcatggtatggtattgcggacttgacagaaccgctgaatgtacgatcgaagtgactcatcgtcccttcgctgtactgcgtgcaagtccgcttcctcaccggggcgcggatatgtgccttggaagttcatggtgaactgttggcacaaatcctcccaagagtggacagatgcaggtggcaagttcattagccaaccccgcgcctgccccttcagggccatgggaaagaaattcgccatgaccctgtcgtcacccccggcggcctcaatcccggtcgtgtagacctggagaaactcggcggggttgatgctgccgtcatatttttcggcgatggtgggccggaaccttgggggccaacggacattccgaagactcgccacaaaggctctacagccgacaccaccaaccgggggcacggagggctgattcccacgtccgtgtcgaggtgacactctggacgaggaagcgccctccgttgcgtgggcagcacttcggtcattacgccggcgctcgatgctggtgcgggcgtcctgctccccacgcagatcttcccgggtcgaaggagtcgacgaaggagtgacggccgaacggcgaacagcggctgccgctcgtcgtgccctccgtcttgacgacgcggagccggtggtagcagcaccagaggccttggtggcggaggaccgcccaccagcatctaggcgctgccgcgccgtcatgaccaatttggccacgtcgtccagccatcgttgggctggagactccgggtcagggacgacaggcgggtggcgtaagagcgcgcccgtagcttggagcgcgccctggggcgtgctgccgtcgccgtagacgaggaggcgacgctccccatctcgccgttcttttccatcgcccgcgatcggtgaagtcgcggatctttcgaccctctcgagcgcctccccccgcttaggactttggcgtggagggggcggtggagtacgagctcgacggcgtgggttcggctccccgtcgtcgccactcacactcggagagaggtcgtgcgcctttgcttgctcagccatgaggctgaacaggaaaagcttggtgcacacgaaagagcgcaagagctcagaagatcactcgcagagtcccctacctggcgcgccagatgacggagcgtggggctcctcaccgggagaccgcgctggcccccctttgccggttcggccggggaccctgggtgagactctaagctcccaatctgtatgtggaaggttcgcgagaccggaagcacagaagacaccggcgatgtatacaggttcgggccgctgagaagcgtaataccctactcctgtgttttggtggatctgtgtatgaagcagctacaaagtgtgagccaacctctcccttgttctaggttccgaatctggaaaaaatcaatccaagaaaaagctcccccttctctcagtggtcaaggtcctccttttatatcttaaggggataccacatgcaccatttccctcttttttctgtggggatttcccccaccttctcagaaatagacggagatttgcatggttgccgttcgagtcaccttctgatggaacggcccgcacctacctccactttcgccgggagcaggcgcgacgtagaatcatggctgtctgctggcgacatgaccggtgtcagaatggtcacaaatcggtcattcttgtccaccacgcgtcagcttagctatctgcacgttggctctccttcacactacattttgcctgtaatggttaggatgaagcctggcatatatctgatcagggctaacgtgccatctctgggaggtaacacgctagctccagctggggacgagcgcctagaagccctcgacctgacgggatggggcgaggcgtgcgtcagaccgcctgccgccacctaacccgcgatctgaccggtctgtgactggtcacagaccggataaacgagtgcactgcactgcgctacatgcggtgtgacacgctcagccaaaccgcaattaatgtggttaggtgagccccactgtgctcacctaacccatacacgcggagcgaaaacccacgaggggtcggggcgcctcggccctcggggccgaggggggtgcagcccgaccccatcggggggactaagaggagggcgaacacatcaccctcgggcccgacgtcccccgagggtgccaggccacgtgggcgattgtgtctgcctcaaacctctagtcatgatactcccgatcccatgtcaccgacaacctgatttaagtatacatcgacataagaattatatatcgttaatatctacagccgatcaagtagatttagtttttccttactcattcacgattgccgatcgatacacagatgacatcggctcggatataaatgatatgtcatcggcatctggccgatcggctatcatttatagatttaaccacggttcttttgtctttatttcttgttgattgcaggatcaaatcaactgacacgctcacacatccgaaggcgagttttggacctgcactggagttaagtagatctcccaggcctcgtgttttctgtcaacagccaccccttctccccaccgaccaccgccctcctccacgctgtccgtcggccgttgcgcctggagggaggagaagagagaggagagagatacaatgaagagagggagatggggagagaggtggaagaagaggattgtgagaatgacatgtggggctcacgtgggccccaccggtcttaattatttttttctaactaacatgtaggctaacagtttttattattttccaaattaaattgccacgtaaatgccacgacaatgccacgttatccaaaaacctaattaaattagccacgtaggtgccacgtcagcgaaaaatgagaacaatgttggtgatggatcttgtttgcactggttttgtaagttgagggacccatcatacctagtttttccagtacaaggacgaaaatcagattcaaattaagggactttaaatgaacttattctaaatttgctatgggccaccttgtttacgggttagagagcccataacaataatggttaattggatccagccatgcatcgagcctttttatagatcgcaagtggtctcaaaggtgtggtttttaaaatgggattggtgctggagcactcattggtgccgcatccctagtgtcggttgagaaaaccgataccttaagaggtttttcacatgttctgtggtagtgaaagggtccgtatcataaagagattaccataccgtaacacacaacaatgacttatttcacaagacaagaggactaacaatttcacaagagaatttttatgtccaaaactccaaattgacggagcaaccatcaattcagtgcggtagaatccccagggccttgccgtactcgacgaggtcgccgaatatctcgtccagatccgtccacttgaactcgaacccttccctcgtcagcttctccgacgaatagcacactctcggcttctcagggaacccttcgaaactacgagcaaacaaagattatcgctggctcatcaggttctctcaagaaatgcatgtgtcgatcgatcagtcacttgaaagttgaaactgaaagtgccagttcgtgtatatgtaccagtcggtttggacgttgtactgagggtattttgctgccgcgaaacgtgcgagcgccatcacggtggtgctgaggctgctgcagatgtacctccccgacgccgactccttctccgcgaggaatatctcggcgcggcagacgtcgtccacgtgaaccaccggaatggagccggtggccgccaggcctttcagggtttttagctgcgcctcatcacctgaaaaagaaacaacgtcaatcgtaacacataatggaagtacatactctcttaattctaaaataaacaaatcaaatataaaatgtgatatatcttgaatctgaacaaataaaagagtagcttcttaaatttgacgtatgtttctcaggctctcaccagacagcaaggagagcgtagttgggatgcttgttgtggtcaacggcgtcggcgccgcgcccaaggtgaacaccgggagcacggtgatgaggctgatgtcgttctcctccgcgaatttgcacgccgccttctccaaaagcaccttcgagacaccatacgcctgcaaaacgcaaacgcaaaaacaatggggtgtgctagcatcagccagccgtcattttcatcagcccggtaaaaaatgtatatgaatgatttgatggaggaccaaaaaagaaaggagtagaatgtgacccaagatggtggcttctctctcgtcaggtagtcgacgtcggaccaggacgactcgtccaggacatggccgacgccgccttgcagcggacggagggcgacggcggccgccgacgatgtcagaatcacgcgcttcaccgtgccggctctcaggcacgatctcatcacgttcagggttccttggacgccggcttcaatcatctctttctgccatcaaacgttggcaggaaacccagcttaatttgtcatcgtagaagttaagagcaaattaatttcagtactagagactaaagagcatgcttatcatcagatgacacaagacaactgtcaactgtgacgtcgattagagaaaaccggattaattagctaagctagctgttcacctcaggattctctgactggagattcaccggagcggcgacgaggaaggcgtaatcgcagccgttgacggcttcatcgaagctgccatcttcgtcaaggtcggcacggaagaccttcaaggtgcctagtgcctccaaccccttgagatgggaattcttcctcatgtcatctgaatacacaagagtaggatcgtcagatgtgaaactgaactctgaaaattcgtagcgttgtcttgagaattgagatcataaagatttgcatccatcgtttccagcatatgtcactatatcagttggaacatataaagattttctatatggtgcagatagaagaactttttctattgttcatgacgacagttcagcaaataaactacctctgaccaaaagatttttgaatctgaatgggagaaagactgtggccctgtttagatttcatttttcttctttaaactttcaactttttcgtcacatcgaactttcctacatacataaatttctaactttttcattacatcgttctaatttcattgaacttctaattttggcatgaaactaatcacagcctgtaactgaaatcatgaacaacaaaaaagggggaagaatctcaccagggtttctgactgtcgtgttgacagcatatcccttctgaagcagcatcttgatgagcgccgaagcgatatacccgttcccgccggtcacgcacgccgtcttcatcccaaccgctgacatcgccgtgccgccggctacttcgtcccctccaggctccactacgtcctcctgagagaaatagcttactggaatgaagacggcggttgtaagagtacaagagtacagtcactgtcactgacgttcatctgataggatatgcttgtcagttgtcaccaataagaaatctttgttatttagatgcaaaggtatgtttgtattcagggagtaaactttattccatgtcacattggatatttggatgctaatttagagtattaaacatagaataattacaagactaattgcataaatgagagttaattcacgagacattttttaagcctaatcaattcataattagcacatgtttactatagcatcacatagactaatcatggattaattaggctcaatagattcatctcacgaattagtccagggttatgtaatgagttttgtcattagtctacgtttaatctatctattaatctaaagccagtggttatgccagcttttgattgggccacgtggcgcccctagcttatcaaataaatcatgaattttgtctaaggaaaaaaatacagaagatcaagcaaaatagaaaactacagtgttatgtgataattctaaaagcaagtagtaccttagcagtttcttttaagaaaaagttgtaccttaacaacacagcatccagaacatctagctgttcccacccggtaaaaaaaaaaatcagcttccagaagcttctaactgtacatcacttcgcaataaacatagagactttctagaaccactcaaatataaatcataatttaagataagtctagttaaagtatctagatccatagacttatacatctagattatagtcctttgcaacaacatcactcctagaggcattcaaatatccgatagaagaaaactcagaattattaaaaaaaaaaagggaaatccaataaaaaatatgagcaacagggtcctcagctatcgtatcaccgtgtagcaccaagtcaattgaccatttcaattcctccttttttcagtttccagttaccatcgtatcttatgaaccaagtgtacttcctccactaatataaaatattcccaatctttttcttagagagataagtatggagtgaaaaaactataatgccatttattaaataaaatatagttgaaaaatgacagaatggttagaagtaagacatgaagaaaattaaatcaagaggtgagtgatacgacacgcagtgctcaatttggcaggaccttccagcttttctgtagctaaagctcaacaaagttttttctgctctataaaaaagagagtggagcagactatagtgacctagaaaaatgaggggtggagtgaacacaaagaccgtcaataggccactacttaacttcaaattctacttctagcatttaggagttggatccttccacctaatatttgtggacatcaagagtattatggattattgagagcaagctttgtaagtttacgattttctgtaacttttttttattacaatcactcctttttttaaaaaaatattaatcttctaatatttttttcagagaaccttctattatttaactccacctactttctactttcttaatactttatagtatttaattatatcaaaaatttgttagaaactcaacatctataattaatcgtccaccagaaacatagagaacacacaatcccaaattaacattacaggagattatgctcagaacgatatgcaagagaatacaatatttaatggaacatagaagttgaacgaaatgctaaaaatatcttacaaaattttcatgtttcaaacacacgctaaacaatgtatcgggctataaagaaagtgtgccaaccggcacactaatgttctggtacttctaattagtgtccaaacatccgatgtgacatggcttaaagttttagtccctgatccaaacatttcaaattattttaggacgaggatgcaacactatgtgcggggttggaccatctatggaaagaaggatggaccatttacggaactgtccttacagaactgttcagttgatatgaaagtgggtggttgtttggttgatatctgattgaggagtactcctttcgtctcataaaaaatcaaccaagtatcgaatgtgacacatgctagttgttgacgagtactacaaataaaaaccaaatctatgaccggatgtatagatggccatccgggcggcacggcccaggcacggtcgtgtttaatgaaatatatttaatgtagtgtttaatgaaataaattttgtgttgtaaatgttgctaattttttctataaacttagtcaaaccttttactgaaaatgtttgacaaaaaaagttcaaaatgatttataatatgaaatggatgtagtattaactactataaatatgccaaatggttttattagattttttaaagaaacttaaaaacatgtccataatatacatcttttaacagtttatgaagcggctaaaaaaacaagtggcatccctaacagaccaacgaacggagccttaggtccctcaaaatggacatcccctaatttcttacgtatcaaccaaatgattcttgttaaatttttttataaaaaatatataaatgacatgcaagaacgaaggatatgctctaagggtattaaacttcattgccattatccactgtgtattaggctcatcttaaaacactgtactatttttttttctttaaaaacactgatcacttatttcgcaagcgcatactccagttcggtcctcgtgacagctaggttgaaggtagagcagcatcagctattcgttcaatgtggtagaattcccagggccctgccgtactctacaaggtcatcgagtatgtcgcccatattcgtgtacttgaactcgaacccttccctgatcagcttctccgacgaacagcagactctcggtttctcaggcatcccgtcgaagctgcaaagatacagagacgatcactcgctcgtcagatcgaacacaacaatatttatctattttggatttccaagttggtcaacaattcgatcgtaccggtcggttttgacgttgtactgcgggtaccttccggccatgaaacgggcaagcgccaagacggtggtgttgaagctgcagcagatgtacctcgccgacgactctgccgacgacaatgacgatgactccttctcggcgaggaatatctcggcgcggcagaggtcgtcgacgtgaacgatcgacacggagccggtgacccactgcaggggcttcaggacttcgagatgcgtctcatcacctgagaagtagtagtaaaaaaacagcagccaacttaaactgtgtaacacgcgttgcaaagagtgttgagacttggggtctgtttggagttttaagattacaatctggaaaaattgtgtttcccagcttcattttttggattttacaattatatcttcttataatctaaatcaaaagctgaactgtttagagcaacttctaattctagaatatactgcagcagctagaagctccccccaaacaggccctttgtgggagctagcttgttgatttgattgctgttgctggtgcttctagctcaccggatagcaaggagaggatgccggggacgctcgtcctcgccaccggcgccggcgctgcgcccaaggtgaacaccgggaacacggtgacgaggctcatgttgttctcctccgcgaacttgcatgcggccttctccaaaagcaccttggacacactgtacgcctgcaaacgcaaatgccattgccaattgggtgcaagcttattttcgttggtaaatttaaagaacttttcggtccaatatactgagtattttaagaatttttatcaaattaaaaatggtattttagtaattttcattctagtttgcaacagcgcagtgtctcatggtggtgaaaataatgcctatctctactccctctgtccttaaataactcaacctcttatgacacatcctactattctagtaaaacgaatctagacactctaggatgttacgagatttttttttaacggagggagtatttcgctataagttgtgagtttacataattaccctcatccaatagtatggaaagacaattttaccccctttaattttatactataatatattaaagcacaaggaaatattcataaaaatctttgaattgtttgtactggcagcacatactagtagtagcatatattagtatatattgtacggtaaaagttttcttgaatttatggataagatggagatgtgaaaatgtcaagagagaggaacgtcacccaggctggcggcttctctgttctcaggtagtcgacgtcagaccaggactcctcgtccagcacatacccgtcgccttgcagcggccttctggagatcgctgcgtccgacgatgttatgatcacgcgcttcaccgtccctactttcgcgcacgatctcatcgcgttgagcgttccattgacggcggcttcaaccagatctttctgccaccaccatcaacatcgcaaaaaaaaaaaaaaaaaaaggaaatcaagattagtagagcacatcagttacagagtatcagagtcaatagtgatgttaattagctgttcacctcaggattctctgaattgaagttcatcggagcggcgacgaggaaggcgtagtcgcagccggcgatggcatcgtcgaagcttccttcttcgtccatgtcggcgcggaagaccttcaaggggccaagtgcctgcaagtccttgaggtgggagttcttcgccatgtcatctgaatacaaaccgcagcaattagtggaatcttcagagatgaaactgaaactctgaaaattcacaccatcgtattgataaagtcgcatcatattttgatccatcatatgtcacgatatatatatgtaactatcggttggaagttggaaaaggataagatttgacaacttctccctttcgaaagatatgatattgtccacatgtgcggctaagcctgccatttgctaatgagtggttaagcgaaaacactcgctaattagctcatatggtactagcaggccgaggatatgatcatatgaatggaagaaacactgcaaaaaaagtaaaaaacacgaactagagagtgaaaaaaggaggagaatcttaccggggtttctgaccgtcgtgttgacagcatatcccttctccaacagcatcttgatgagcgcagaagcgatgtacccgttgccgccggtgacgcacgccgtcttcctctcgaccgccgacatcgtcgtcgtcgatcggtcgctacaacaacccaccagcccagatgagacgaagaggacgaggaatttatgtttgttgctgtactttgggaagagttcaatttgtctagtgaggtggtctggcgtgcttatcagtaagattttttttaagtactaccgaaaagaaacatgctgacatcatgcactatatccagaatatcaccttattgtaaaataaaaccggtgcggtgcgagttgggtggttgattgagacatgtatagagaattagctaagagttattttaaaaactactaatttttaagaaaaaaatagccatccaataaaatagtctcaagttgtttagatccaagggttattttaagagctatttaatctttaatgcactttctcatggagagagataaagagaaaagacattttttagtgggccccacctgaaatagccctaattagtattcttaagggggatagtttttttggatgtgttattttcaaatagccctgaaatagctcacctatttataacttttagattatttgcagctatttgaaagaggactgaaaagtaacccatgaatctaaacaggtcctgagtcggagcgtcgattacgcacgtcagctgggttaaagtgtcaatatggagtggacaacaagatcgtcatatcacgctctcagcaatggtatgcgtagctggtagagtcaaaggagcatgcgtgcgtctggaccgatggattcatggccgtccatcggcatccaactgacgttaatacggccgtgcgtcatacacgttgtccataagccgatcgagagatgggacggacggtaggtacagtgctactgcaatcgcgccgtgtcgtgtgactatccctgtgcaccgtgttcattggggctgatgccgagcaggcaggggcagcccatcgcgcgcgctagaaagctagcaggccgaggtgggccgcgagcccgcgagggaggagaaaattgcatatgtactactcattaaaaactggcttcgctataatatcattctcaagatgggatttgcccaaacgccactcataatatatgggtattcgctgaaatgccacttcaggttttcttccatttcgaaaatatttttcatcaatttcaatttttctcagactattatgcccctgagactctttcttctcctcggttcaatctagcgagcgtgagaaggtgagaagagaatcggcagcgacaccggcgccgcccaccaccactgcgccaccgctacctcagctccagccgccgcgccgaggtcctccccagctgtgccgctcgtcctagtccgcgcaattgtgccgcctcctcggtgacatacaccatgagtccatgacatacaacctcaattcatgagttcatatatataacttgcaagcggtttaattttcatttaatttcgcatcaagcagagctgccgacttgtttaattttgtatgagcaagttcgttcgctttggttaacccaaacgaactttaaaaagaagttgcaaaatgtttttcgaacatacaagaagatactactagaatagaagtcgctttgtgcttgaaaattatacacagttgttgatttcagaatgtaaaatcggcacatcattgacacaaaatgtgaacaaaaatatttaccaggcaccagaggaaattacacaggaggcaaaaaaaccactatgaattcagagaagagaagaaaaaaaaatgaaagctaagctcaggggtcctcagtgatgcacgagaggtgcggctgccacggcgaggcatggctcccggtgctcatgcgccgccggtgttggtggtggtgttgcttctgcaccctcatcatccttgtcgtctccggcgacgcgctgcactggctgcccaaccaatcggcgacggcggcgttgccctccgacttgctgcggacgtggtgcccgtggccggcggcgccgccggtgctcgtccttctcttggcgtcggggacggaggcggccgggatgaggaagtagatctcgccgcactccagcttcgactccggcgacacgatgtgtatccggcccatcgccccctgctgcgacgagcactgccggctaagcacgtggttggggtgcgccgccagcacctcaccggcggacacagcacggccgtacgcgtcgatgcggccggctcggtgcctagggtttcgctgaggataggcggcggctggggaggagactcaccggggagaggcggcggcgcagctgttggggggcgggaccggtgaggcacgccgcggcggcgatgcagtggtggtgggcggcgccggtgtcgctgccgcttctcttctcgacttctcgcgttcggtcgctagattgaaacgaagagaagaaagagtccgactgaatcagttgactcaggggcataatagtccaagaaaaattgaaattgatgaaaagtattttcgaaatggaaaaaagcccgaaagtggcattccagcgaatacccacgtgttaagagtggcgtttgggcgaatcctatcttgagaatggcattatagcgaagccagtttttacgagtggtacatatgcaattttctcgcgagggaggggatcgggaatgggcgaccatgcgccgagagcctgggagtgaacgggaaggaaagcttacgcggcgccctcatgcgcttttttttggctatttttttgcgaattttttattttagaaattgaatctttcatcttcaatttcatttggaagttttgaatttgagttgaaagttttaaattttgaaatgaaagtttcaattctgagttgaaattttcaaatatagatttattttttttcaaatcatggttaaaagttatcgaatttgatttgaaagttttaaatcttgagttaaaagttaaaaatccttatttgaaaatttttaaatctgacttgaaattttaaatattaatgcgaaaattttcaaatcttcacatgcaagcttttaaatctgagttaaaagtttttaacaagaaaggaaattggataaagtgttgcactacgtactttgctagcgcatatacactaaataaggaacccccgaggctgcatagcacgtttctttttgggcaaagtggatggccactatccggataagctcttttgggctgagtttggatgtggtgctagaaatttaggatttttcacaaatgctaaatgagactaaattattagtgtcaggttaattgaatactttctccattttcatagtattgttgttttgaattttttttctattctacctttttaaatttaatcaagtttataaaaaatatagcaatattttaaaacaaaacaaacacattattaaaatatctttaatgtagtatttaatgaaattaattttttttacatgttgctagtttttttttataaacttagtcaaaccctttacttaaaaggtttaactagatgatttataatatgaaacggagggagtattaattactataaatatgacaaatggttttattagattttttttaaagaagctttaaaacttttcataatatacatcatttaacagtttgggaagcggctaaaaaaacaagtggcatccctaacagaccaaatgaacggagccttggtccctcaaaatggacatctccttatttcttacgtatcatccaaatgaatcttgttaatttttttaaaaatatatataactatttaaatgacatgcaagaccaaaggataccctataaggtattaattttttttgccattatctactgtgtattaggctcatcttaaaacactgtatttttttttctttgagatgtttaaaggcacagaccacttatttcacaagcgcatatatagtttggtcctcgtgacatctaccccctctatcccataaaaaccatcctaaaccatcctagtactgaatgtgacatatcttagtattacaaatctggatatacacctgtccagattcgttgtactagaatatgtcacatccagtcttagtttcgtttttttggacgaaaggatatgtcacatccagtcttagtttcgtttttttgacgaagggagtaggttgaaagtagagcagcatgagctgttcgttcaatgtggtagaattcccagggccctgccttactccacaaggtcatcaagtatgtcgcccaaattcgtgtacttgaactcgaacggtcgaacccttccctgatcagcttctccgacgaacagcagactctcggtttctcaggcatcccgtcgaagctgcaaagataacagagatcatcactcgctcgtcagatcgaacacagcatgcatgtatatctatgttggatttcgaagttggccaacaattcgatcgtaccggtcggttttgacgttgtactgcgggtaccttccggccatgaaacgggcaagcgccaagacggtggtgttgaagctgcagcagatgtacctcgccgacgactctgccgacgacaatgacgatgactccttctcggcgaggaatatctcggcgcggcagaggtcgtcgacgtgaacgatcgacacgtagccggtgaacgattgcaggggcttcaggacttcgagatgcgtctcatcacctgagaagtaataaacagaagccaacttaggtgtgtttatattcagagacgcggtaaagttttggcgtgtaacatcggatattatatagggtgtcgtaagagttgttggggcattaataaaaaactaattacagcatcgctaataaaccgcgagatgaatttattaagcctaattaatttatcattagcgaatgtttactgtaataccagattcgtctcacaaattagtcgtaatcttgtaattagttattttctagcctatatttaatattttatatagctgttcaaatattcgatgtgacggggtgtaaatttttaaggtgggatctaagaaccacctgcaagtgttgagactttggtgggagctagcttgttgatttgatcgctggtgctggtgcttctaactcaccggatagcagggagaggatgccggggacgctcgtcctcgccaccggcgccggcgctgcgcccaaggtgaacaccgggaatacggtgacgaggctcatgttgttctcctccgcgaacttgcatgctgccttctccaaaagcaccttggagacacagtacgcctgcaaacgcaaacgccattttcaaccatacaatatttatttttggtaaacttataaaaaaagtctatgtttagtttattgctaaatttagtcaatatataagaaatcctgccaaaattttgataatattagcatcttgccaaaattttaacattgccaaaacttggtaaggtttatttttgttacaatctaaacaggccctaaatttagagaacttttctatacaatatactgagtattttaagaatttttattaaattaacaatggtattttaataattttcatccattgtgctagtttgcagcggcgcggcacctcatggtggtgaaaataatgcctatctctactccctccgtcctaaaaaaaacacaacctcgtactctctccgtattttaatttatgacgcggttgactttttgactaacatttgaccattcatcttattaaaaaaatgtatttatcatttattttattgtgacttgatttatcatctaatgttctttaagcatgacatagatatttttgtatttgcacaaaaattttgaataaaacgaatggttaaacgttgataaaaaagttaacggcgtcacacattaaaatactgagggagtgctagaatgtgacatatggttttttagacggtgggagtatttcactataaattatgagtttacagaattaccctccaccaatagtataaaaagacaattttatcccctttaattttatactatattatattgaagcaggaggaaaaaataatatttttttcgattatttgtactgtcagtataatactgtaaaagttttcttaaatttatggataagatggagatgtgaaaatgtcaagagaggaacgtcacccaggctagcggcttctccgttctcaggtagtcaacgtcagaccaggattcctcgtccagcacatgcccgtcgccttgcagcggccttctggagatcgctgcgtccgacgatgttatgatcacgcgcttcaccgtccccgccttcgcgcacgatctcatcgcgttgagcgttccattgacggcggcttcaaccaaatctttctgccaccatcaacgtcggaaaaaaaaacgaaatggagagcagtagagcacatcaaagttggatgaacatggattggaaacggacgaaaactagctatctcgtagtcagtagggatcttaattagtggtgccaagtactaccttgtaaaaaaaaataaattcctatatacaatcttagatagacacatgttttcaggtttgtaggtaatattagttttttttttttttaagacgaagggtgtaagcttttcacctcaggattctctgaattgaagttcatcggagcagcgacgaggaaggcgtagtcgcagccggcgacggcatcgtccaagctgccttcttcgccgatgtcagcacggaacaccttcaaggggtcaagtgcctgcaagtccttgagatgggagttcttcgccatgtcatctgaatacaaatcgcagcaattagtagaatctttgagaggtgaaactgaactctgaaaattcacaccatctttttgagatcatataaagtctcataataattcgatccatcatatgtcacgatatgtatatatgtaactatcagttggaagttggaaaaggataagattttgtcctcatgtgcggctaagcctgccatttgctaattggttaagcgaaaacactcgctaaaaagctcatatggtactagctggcctatgatttcacacctgaactgaatggaagaaacactgcaaaaaacatgaacttagagagtgaaaaaatgaggaggagaacctcaccggggtttctgaccgtcgtcttgacagcatatcccttctccaacagcatatcttgatgagcgcagatgcgatgtagccgttgccgccggtgacgcacgccgtcttcctctcaaccgccgacatcgtcgtcgtcggtcgctacaacctctccagcccagatgacgaagaggacgatgaatttatttttgttgctgttctttggaaagagttcaatttgtgtagtgagccagtgaggtggtctggcgtgcttatcagtaagtattcctaaaagaaacattctgacgagcactatatccagaatatcacctttattataaaataaaaccggtgcggtgcgagttgggtggttgattgaagtgtcaatatggagtggacaaatagatcgtcatatcacgctgctctcagcaatggtaagcatagctggtagagtactacacaatactacggtggtgtttgaatattgaagatgaagatggagattaaggggctgtttggttcagatactaacattgactaggtttaccatgctttcttaaccaaacttgccaaagatgaggccatcaaaatccaagccacactctagccaacaaaatgaaaccatgccacactttttagagacacttacatgtgggacctagattacaaaagaggaatcttgccacacttgtggaagccaaccaaacaatcatctaacatggtcaaacttgtctaaccttaagtatggcaaagtgtagtaacttatggccatcaactaaacagcccctaagtttttatgcaaaacaatatgctattaacgtatgattgattgagttttaattcttacaaacttgaaaaatagattaatatgatattttagtgcaacttttatataaaaagtttttgtacgaaacacatcatttatcatttaacagtttgaaaagcgtgtcacgaaaatcttaatatttatctaagtcttgtggaagaaaagaactggacctgagtcatgcattcgtgcgtctggactgacatgtagattcatggccgaccatcgacttacaactgacgttaatccgggcgtgcgtcatacgcattgtccgtaagccgatcgagagaggggacggtaggtaaagtacaatcgcgccgtgtgtcgtgtcgtgcaccgtgttaattgggggaaaaagtacacccaaggtccctcaacttgtcagcgagataaaaaaacatacttaaaccataaaaccatatatatatatagtcccttaactaaacaaaaccgatcacccgagatccttcggtggttttgaccccgatttcggtctatgtggcggctgagtcagcatgggaccaacgtgggtcccatatatcaggatgccatgtcagccggtcctcggttcctcctctctgttgagcgcgagcgcgaggcttgcaggcgagcagatggttgaggactctgcgagctcggaccggtgcacgacgcggaaggggtccgggtgaccggcgagggcgcggtcgacggctgcaacgcccacggcctcggcggcggagaggaggagatcggcgaccagcgccgccgccgccgcgcttcctccacgcgctagccaccaccgcctccacggggacctcgccgtgggcggcggccatcgtcgacctcgccgcccctagggccctccacgccggcgcacaaggggcttgccgcggaggatgagcggcgtggagctccagacgcgccgccagcgggaggcgagcgcggcggtgcgagtcgcgcccttgaagggaggcgggcgacgaggaggtcgtcggggagcgcgctgacgcggtcctcgccgtcgtatccctcggcggcggaaagcatggcgccgttgtcggaggcgggatggccggggaaccaccggaggcggacttggacgtggcgctgtcgtcgtcgtcgtcctcggcgtcggggaagaaggtgggcgcggcggcggcggaggctagggggttgccgcggctagtgtggatggaaagctgaacattgcttcttcagctccaatatattgtaattcacgagcctttttattttgatggttgcttcttcagttcgaaagatgtctctgtttttattcttgttcaagccattggcaagtctgaagaacctagactgaattctatactgtagtacagttctaccatcgtcagtacagtataaagaagcaatcttttgaatccttttcaagtaggagtatagtatgagattattatagcctgtcaacttgctgtttgtaactagccaatgctaatcttttcagctcgattatgatatatatcacgtcgtcagatttgtgcaaaattggtatagagacattctgaccgggttatggtcgatgacactgtccatcatctgagagtttgcaagtctctgaactctgaacattgcccagaatctcttacaggaatctttttgttggtcttctcatacagtatatatcattggccccttgcaagcagaggacaaattctctttgcattcgtatgcattttaattctgcgaaacctgtagcttgtcctgtgtataaacaacgagaatatcatctgtttatcattccaatttccaagtatcaacttctacctcgaccaggagtaatacagattctgaagtttataaacacatctctgcctgaacaagatggacacctactgttttcagttcaccatttgatctttaccagataaacctgaagttcaaaccgtgcagcactgcagccatgtttcccaagatagaatgacgcgtacacaagcttccagcgtgtcgagggcgaggtcgacggcggcgccgcaccgcgtgtgccagcaaccccaggcgccgcaccccgggagcggcccgctattgggagccgccaccgacgcctgcctgctgtacagaaactgcagcacgagcacgagcaccagcaccttgtaccgcaccagccgcggcaaccccctagcctccgccgccgcgcccaccttcttcctcgacgccgaggacgacgacgacgacagtgccacgacctcctcctcctcggcaccggcgccgcccacctctgccgcgtgccccacgcagcaccaccctccccggtggcgccgccgcgccactatgttcgttgccggccggcttccaacaggagaaaagagtgagagagagagagagagaggaggaagggaggatgctgacggcggcgttgcctccgccggcgcgacgccggctgccggaccttctcctctcccctccccccggcggcctcctcccccacagcgccgcccgtcgccggctgagaaaagtgagagagagaaagggagaagaggggaaataagagggaagagatgaggtggcgtgggttccacgtgggtcccatgctgactcatccgctataaaccgccgaggaatctcgtatgatcggttttgtatagttaaggaatcccgcatatctggttttgcggttcgaggatgattttgtatctcgctgacaagttgagggaccttcggtgcactttttccgaattttttttatttttaattttttttattaaaagttttacaaaaataatttttcattttgaaaattgacagaagtggtcgcctaccgccctctgggagggcgatttttaaaaatcgccatcccagagggcggcgaaaatgacgtggcagacggccgttcgctctcgggcgacggccgtcaacgaaatttgcatgcggcccccttgccgccctccgctagggcgattttgtactgtgcggggggccgcctgcaaatgggcggcgagggggcatggaattttgcaggcggcccccttgctgccctgggggagggcgattttatactgtgctatatttttttttataaatatcaatagttatcaaatctttttatattgaaaactatacaagattaaaatctccaagactggtaaaatacaattttattattttttagggcatagttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattatgtattaccaatgaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtacgcgctactggatctgacactaccatgaagcgccgaaagtgcgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaactcgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccccagtaccgaagatcccggctgcaaatcctgctggacaaggactatcagtttcatacaggtatttaatagtattaataaaaagtaaagtaccgtgtgggcgagggatcgacgctccgtgagaggaagagctggcgaacgcgcccgaagaggtggcgaacgcccctgcggagctcgcggaagtgccggtcgtgcctgcgaacgcgctcgaaggcagacgaggtcctgcgatgaggaaacgtgcagttaaaacatggtgacatattcgtgcaaaagctgaaacaaaaatgaactaatatctgggctgaactgtaccgtgcgaaaccggtgctgtaggtcgcactgctccgaagctaggggcgctcgaaggcaaacgaggtcctgcgaggatggaacatcaagttacgacggggtgatgttttcgtacaaaaacagaaacaaaacttaagaaacctctgggctgagcagtaccgtgcgaaacaggtgccgtaggtcgaggtcctgctccgacggtaggcacgcgaggccgtggttgcaccggaccagctggaggtacgacgtccatggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaagtaatacaaattcgacgtacccccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacatgtgaagagaggtacattatatggctcgatgatcgcttaattatcataaaaatttagaaatgaacaatccgaactcacgagtggtcggcaaggaggacggtcggctgcacgttgcccggaaacacctgcctaagtccgaactgtctcatcacatgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggcaggagacggtcaaactcgaacacgaagtccgggtaacctcgtctcacctggacgtgagcgtaacgacgctgcaataaacatgatcggaattagacatgttatgtgaagaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgtggcacgtcctgtggctgagcatccgcgatgaaccgtgcgtagtggaccagccggaagtccacagcgtgcccgtgggtgctagtgaacatcacccacccgaacaacaacaacaggtacgcctcaagggagcgtcggaccgagtaatcatcagcgtcagggtgcagaaggtccgcctacaattaagaatgaaatgttagtacaaaacactctgttgatcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaaaaacacagtccacgggaccaactggtgctcccgccagcggtagcccgagcaggtacgacacgtcctgcagtgtcggagccatctccccacagggaaggtggaacgtgtgcgtctcaggtctccagcggtctaccagagcggcaaggagtgaccggtctgcatcccaccgcttcgctgggtcacggtcgtccgccgccgcctcaacaagcctacaaagtggtggaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaacagattgatcagaaacatataaataattagttcaacataagtaataaatgttcataagcgaattactaacacattcctgcacaagagtacaaacaaacaaaagtgtcaccatacggaatatttctgattacaacaataactgcagttacacgatatgagtacttagtccgaatactcatcacgataacattatgatacaacaccgaatagttcgcaatactactagtacaacaatagtcggaggtactcattacaacaacattcaattgaaattacacgatagaaatatttagtccgaacactcattacagcacaacagcattttatttcctaaatcgatagcattgttacaccatggaatcgcctgctgcgcgacgacgccttggccttgcgcgcctgcttgttgttccttcaccaggtggtcgcctaccctcacttgcctgtccagatggactagcatctgcgccgcttggaacttctgcattctttgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtacgcttgcgtgccgtgaaggatgaattcaacaatagcaaccaatggaagtacccgaactcctcgcattacccagttgtacacctctgctaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccaataccagctttcagtgttctcactctctacaaatgcaaaagccataggtagaacctggttgttcccatcacacccaattgctgtcaatatctgacctcggtatttacctgtcataaaagttccatctatgcatagaacaagtcgacaatgcacaaaagcattgatgcaagcacccaacgagaaaaaggctctttgcagcacactctttgttcgatcatcaactgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaaagccaatgttaccaacaacactgctgtacatctcacttgccacaaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcactttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctaaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatatactcaaacataacatattagtacaaatgtaaaagatgtatgggagcatacctgtgatgaagtgagcgaaccagcagggcttcgccgctccccttctgctgccctcccctctctctctttcgttttttttggatttttagtgaatataatgaaatttcagagaggagggactgggctttataggggggaggcaaaaatcgccctcccccagggcggcaagggggccgcctgcaaaattccatgccccctcgccgcccatttgcaggcggccccccgcacagtacaaaatcgccctagcggagggcggcaagggggccgcctacaaatttcgttgacggccgtcgcccgagagcgaacggccgtctgccacgtcatttttgccgccctctgggatggcgatttttaaaaatcgccctcccagagggcggtaggcgactacttccgtcaattttcaaaatgaaaaattatttttgtaaaacttttaataaaaaaattaaaaataaaaaaaaatccactttttcctaattggggctgatgccgagcaggcaggggcagcccatcgcgcgcgctagaaagctagcaggccgcggtgggccgcgagcccgcgagggaggggatcgggaatgcgcgaccacgcgccgggagtgagcgggaggtcgcatgcgcgatccgttgactgatttctctgcactaatttccaccgttcgccttgtcccacgtagggatggcaatcgggcgcgacgggcacgggtagtgcctacctatacccatgcccgtgagattatttgtgctcgtgggtatacccattactacatgacgggtaaggatggttacctatgcccattgcccgcgggcgtgcccgtttacccgccacaacaaaagcagtggaacaaaaagtctacaagctactaagttcgaatcgaacttaaaacatcaaatattctccacctcggtgtcgtgtctctcctctggcggcgatagagtaagaggagagaaataataagggaaataaaagggaaaccgaagaaatcaaagaactgggcttatgtattctagtggattttgctcctagcctacatataagttagatttcgtgggtaaacgggcaaagcgggcatgggtagtgattacccatacccatgcccatttactcatcgggcatagcttttgacccaataagatacccatgggtataaaatggagaacaaacccaaccctaatagggtttttacccgcgggtaaacgggcaaacgggcacaattgccatccctagtcccacgttgacgaccggcggaggttgatgccaaggatattgtcgttgccggcttgccgcgcatccatcgccccggtgcctggttacgtgcccgtcgcgctcaaaaatctcgtccacgcactgcacaaaagatcaggccggccaccgtgcccaggtgaaacacgaggtggccagtacgtgacagagccaggcagcgtgtgacgtctgtggtttttgcatgctcgcattgcccgcatccgcatgccgtcgtgtagcgtgagcaattgaccgatcgatttgtggccttggccttctcaacctgctcggctgcacctgacagcagcagcagtgtcgcagcaggtagaaacgctgttcagagagttttttttttttcaacgcgtgccagaccacaacattcccattacggattcacatggatccatagtaaagagggcccacatgttagtgactcaaagtcatgtggcttagtccgtgtttagattttttttttttgctaaaaaggtcacatcgaatgtttggacacgtgcatggagtattatttgtggaaaaaaaccaattacacagtttgcatgtaaattatgagacgaattttttgagtctaattacgccatgatttaacaatgtgatgctacagtaaatatttactaatgatggacacattaggcttaataaattcgtctcgcagtttatatgtggaatctgtaatttgttttgttattagtctacgtttaatacttcaaatgtatatccgtatactaaaaaaaatttggccaagaaactaaacacaaccttttttttgtggcagaagtttttacccggttctccgggaaaccgggaaagtacgttggtattgcaaaaactattagaggatttcagctaatcctttccggagaattagacagcttaccccctaagaggatctcaaattctcaatcctcctcttacatgaacagaacgaagtacagccaaaccgccaaatgtattggaacttggtactagtactactagcaatgtagcaatagaatgctagacacaatagtatttttgaaagcaacacacgtttggtcgtaatcgccaaagcagtggaattacgccgcccatcatcaccatcagttggggatcaaccccagggccttgccgtacgcgacgaggtcgtcgtacatctcgtccaggttcttgtacttgaactcgaacccttcgccgatgagcttcgccgacgagagcgagatggtcggcttctcggggtgatgctcttcgatgctgcgtacatagcaacgcatgatcagattcagataaccaaatgcacgaatgcataaagcttaatttcttaattaccaatcgcatctgacgttgtactgggggtacttggccgccaggaagccggcgatctcggtgaccgtggtgttgaggctgccgcagatgtacctccccgacgccgactcctcctcggcgacgaagatctcggcgcggcacacgtcctcgatgtggaccatcggcatcgaccacccggacgccttctcgatgcccttgaggatgttcatcatctcctcgtcgcctgaaaaaaaaaattcacagatcatcgatgcagcgacccaaaaacgttcagaagtcgagttcttggattgcttcttgtttcattcattcggtgatcgctagatagttcctcaccggttatcaacgagaggcaggccgggacgctggtatcgaccctcaccgccggcgatgctccgacggcgacgaccgggcagagggtcaccaggctgagaccgttctcctccgcgaacttggtcgcctccttctccgaaagaaccttggagatcgagtacgcctgcagtgcatgcagcaacaatggcgccgaactcatgttctacgagacattgctgtggttcagtgacatggaacagctcgtgtgtatatatgtgtacctgcgtcggcgacagcttctccatggatctgaggtactcgatgtcggaccaggacgactcgtcgaggacatggccggcgccttccagcggccgcaggctggagacggcggccgtcgacgacgtcaggatcacgcgcttcaccgtgccggctctcgcgcacgacctcatcacgttcagtgtgccctcgacgccgccttggactatctctttctgccatggccaagttcagaattcagtaactaactaactgactacagatactaatcgagcttgcaggttgcagcagtggtcacctcgagatcgtcggacttgtggctcttgtcgtacaccggagcggcgacgaggaaggcgtagtggcagccggcgacggcctcgtcgaagctgccttcatcctccaagttggcgcgaaagaccttcagggggccgagtttttccatgtccttgaaatgggagaccttctccgggttatctgaaattcagagttacaaaagcagtttcagaggccaaaccaaaattgtactgacacaatcaatcccaaaactgaacgtgcaaatactcctctgaaacaaattatgaactgatgacatgttcttcgattttcagttaaaactgaacactggaaaaacatgtaacaagaaagaaagggagtagaatctcactgggatctctgacgcttgtctgaacagcgtatcctttctccaggagcatcttgacgagcaatgaagcaacgtacccgttgccgccggtgacgcacaccgtcttcctctcaacctccgacgacatcgtctctctctctctctccggtcagttaatacctctcctgtgacagagaaggtgacttgggtttactcccaggtagaatccgagcagcacactgatgatgaggtttcttttgctgattgcgctgttgtggcacttgccaggacaaatcccggagagcaggaacataatacatttgacttagccaacactattttacaagcgacgacgccagtcgccagacagagaggcagaacaagaaatgcttttcgtgatgcatgcaccatacctgctcttctgattgattttccttccttagataatgacctgcactgatcgattatgtcgatcgatgaacatctcacgcttcacatttttaatgcggtcgatcgtgttttcaaaaggtaaagcttttgctccaagaaaaaaggatcatcttatcttcccagatgacgtgtgtacaggttcattcttagaattgaacttttttttttaggatagaggtagtacatctgacgctgaagcctgtgacgatttaacatcgttgaaaatgataggatccgtttctttctctatgcaaacaaaagcgagagaggaacagcacacgcgccattgaaaagtaacccaacgctgcatgcctgcgaattggacttctcgtttgtgtgtgtgattaatcataccaaaaagtaattcctgcgatgcccgcaaagttgagctgagagagctagcataaaaaaaaaagctagcaagttagttcatgttattagtactccctatgtttacaccattgactttttagcacatacttgatcattcatcttattcaaagaaatttgtgaaatatgtaaaactatatttatacatgaaagtatatttaacaatgaattaaatgatagaaaaaaaataataattacatattttttttgaataagacgaatgatcaaacatgtttaaaaaaatcaaacggcgtcaaatatttagaaaaggaggaagaagttgtcttcgcatctctgtaataactttcccacactaaggttgtgtttagttcacatcaaaattagaagtttggttgaaattgaaatgatgtgatggaaaaattagaagtttgtgtgtgtagaaaagttttgatgtgatggaaaagttgaaagtttgaagaattattttggaactaaacacggcctaacacgacctgatcttcagatgctgaactggggaccttgaaagaccttgtgaggcttcgttgttccaccagaatattttctttgctacttaatgaaatgacagatctcttgcttgtttcaaaaaagaaaatcatagagccacaattaggttgtgttctttagtgagggttgtgaatcctttcctcccgacacataaaacggagtgacggattagcgcatgattaattaaatactatttaactgaaaaacttgaaaaatgaattgatatggttttttaaaacaacttttctatacttttatcttgtaaaaaacatattgtttaatcgtttggtaattgtgcatgtgaaaattgaggggtagaaattgagaaaatgttgaaaggagcacaattttattgaacagtttgacgtgtcaataggcacgtttttcataaaagcggatgggaacaaattcactgctgttttacacatacttatttttgcaagagccgtttggttgcgaagctgggtagtaacagcattgtcgtcggcgtcagtagtgcagaatcccgagtgccatgccgtactccacgaaggcatcatcgtacatctcatccaccgtcttgtacatgaactcgaacccttcactggtcagcttctccgacgagaggaggatcgtcggcttctcagggaggccgccgccgagtctgcatgttccgccgccaccgtcggagtcagctcgcagtggacacgcataatctttgagaccagttcatgattttgtcttacgcatcgatgtcaacgttgtggtgcgggtatttggcggccagggaacgggcgatctgccgcatggtggtgttgagggcgcagcagatgtacctccccgacggcgacggcgacgctttctcggcgaggaatatctcggcgcggcagaggtcgtcgacgtgaaccagcttcagcccgccggagtactggtcaatcattctcagggtgttgatctcctcgttgcctgaaatcgaatcggacacgtgagtccgaaccagatactccctccataccatgaaaactctcgttatactaaattatattacattctaatactaggttgggtttttggaagaaggagtttattctagcacacttaggtcgtgtttgctactgagggttctcaatcttctctctcgtttttctcgcgcatgcttttcaaattgctaaacaatatgtttttgcagcaactttctatatgaaagttgcttaaaaaaattaaattaatctatttttttaaaaaagttaactaatacttaattaatcatgtgttaatgaactgttccgttttccgtgcggagggaaagagtttccatccatgatctccaaacaatactgccggtgcttacgtactcaccggacagcaaggagaggacgttggcgacgctctcgttggccaccggcgccggcgacgcgccgacggtggcgaccgggcacaccgccactaagctgatgccgttctcctccgccagcttgctcgcttccttctccgagagaaccttggcgatcgcgtaagcctgcagcgcaaacaccaccgctgtgctctcacgcaagcgactgtactatcaactctgactgaacatgtaaaattttgtaagtttgtgtgtacctgagcaggagatatcccgttggttgatctgaggtagtcgaggtcggaccaggacgactcgtccaggacatggctgctgccgttgccgtctccttgcagcggctggccggagacggcggccgccgacgatgtgaggatcacgcgcttaaccgtgccggctttcacgcacgacctcagaacgttcagagtgccttggacgccggcttccaacagttctttctgccattaccaaataatactctagatcgttatttcagctggttattatggagaggatttactagacaaaccaagtaaattaatcgtgacgatacaagtaaaagtactctcccgtttcaaaataaaacaacatagtattggattggacacgtacataataaagttgtttattattattattattattattattattattattattattattattattattattattattattatttcagagacaagatttttatgggaggaaatattattccttccgtcctataataaattcagttttagacttttctatttatcccaaaataaatttatttttaaagtaatcattacatcatgtgaaagtatgataagcctctcccatttatcccaaaataaatttatttttaactaatcattacattagagttcttgaaaatatgatagtatatatgtattgagaataaataaaaatagaaataattatattgggatttaataaagtgagtatattataggcttgtaggtaaatattggtttgtgtgagataggtaaaaaacaaacttattttggaggaaggaatagtaattaatgtgacataattgatatctaatcaacagtggcctggcagcgatcagagacttgacaagtggcaattactacctaggacaagtggacaacatcgagtggcacttggccccacaatggcactgagtttggtgggagatgtgctacgtgtctgcatgcatttacctcaggattctgagacttgaggttcatcggagcggcgacgaggaaggcgtaatcgcagccggcaactgcctcgtcgaaactgccttcctcttccaagtcggcgcggaagatcttcaaggggcctagtgcttgcaactccttgaaatgagagttcttctccatatcatctggaactcaaaatcacaatgcgctgcagtttcagaggccaaaccaatggtgttcttgtgaattcccgaaatagttttcttcggtcatatcaacttgaaacaaatcaaacatcagcatttatcttctaccaaacagaacaccgcaaaatcttctatgcacacagcatgctgttactgcccggatctatcgtcaccgcatacacacaaaatcaatgaactgaagacgatctacagaccattgttggggtgagaagtaagaagaatctcaccggggtttctgactgtcgtcttgacagcgtatcccttctgcagcagcatcttgatgagcgccgaagcgatatacccgctgccgccggtcacgcacgccgtcttcctctcaaccgccgacatcgccgcggttagttggctacttcgcctctcctagtagacgaagaaagagtgagaattgcttcacgcaccaaataggagcagctaggaccccaagcactgagcagagcgtactgaggttgcttttggtcggggtcattgttggtgttgtcatgtctcgtggtcatagatcatcatattgggaggtacaactactttgagaaaagagtactccctccataaaaaaaaagacaaacaaaccctgatttccgtgcctaacatttgaccgtccatcttatttgaaaaaattataaaaaaaagtaaaaagacaacttacgcataaaatattaatcatattttatcatctaacaacaataaaaatacgaattataaaaaaatttcatataagacggacagtcaaagttgaacacggaaatccagggtttgccttttttttggatagagggagtatgtgtattagaatatatcacatcatatactaagtgcatttatattatgcattaagtgtatttatattgggaccaaaggagtaggaatatatacatagcatgctcaatgcttacaccctctgtcctataaaaaaacaatttagcactggatgtgacatatctataactataatctggagatacctttgttcatgtttagattcgtatacatccattactagatttatttttttcggaacggagggagaacgtgtcttgtgtgggtctttgattagtagcaaacgtaggtaccctgatttatcctagactgagatcctttgatttaaatcaagtgattttaggatcactaacatgtggatacatactctattcgttccaaaatataaatatttttaaacttcgacacagttttcgagatgctattttgatcaataatatatatatatataatgttttaaataaaaaagagttgcatattatgatagtttgtttaatgataaatttagtaacatcaattttacatgattgatcttttttctactaatagttaaagttaaaaaaaataacttgacactattctaaaaatgtttatattttggaagtaagaaggatctatatgttggtgactcaaagtactccagtagaaaaaggaggtcgagagtattcgttcaacgtgtctttttttttaaaaaaaaaatccgggaacagcaattaagccatctaaccaacatcgttgctcctctccccacccaccctatagacttaggggctgcttgaataggaggcacttatatttctgtgaaatcagtctctcccattcaaatagggcattatgttctaacgagccatttggttctgatcaaggttttgaatatcagttttaaagagcacctaaaaatcagtttaaaaaattattgtatgaagtagtatatatgcatctcatacaattaatttttgaacttgaaactgttctcgctgttgctgctaccggtggtaatgtacgctaagatttgcatcttttcgttgtgatcactgttagatagatctctctccccttgagcccaacggctcaagggggccttgaccgcgccctgatcgggggcgcccagcccaatggctggtgggcccccgtcacactgcgccatataaaagaggggtggaggccggcacggcacatggtacgagattcaccgccgccgccaactccaccccacaaaaccctaatccgatcgagagggggcgcagccagtgacgggaaacgccaccgccgcgccacgcctcatcgccgggacgtctacgaccaccactgccgcagccgtcatcaccgtcgacctcaccggcgccgcatccacgtcaagccgcgacgacaacgacgatgtccggcgcctcttcctccacgaactcctcaaccggtcggtatctaaaccctctccctttcatctacaatgtcgttcatcaaacccaaatagaaccacccgactagatctaacctaggtgatcctagagcaaagtctaacaatggtatcagagcaaccctagtgtttagatcgtttcggggaaagaaatccaaagaaagaaaagcacaagatccgcacggatcaaaagaaccaaaaaccctaaccctaattcttacctcgtcgccggccgtcgttgacgccggcaacggagggggggaggggcaaagaggcgccgcctaggagccactcgacggccgcgcgcgcacctgcacgcgcgtgccggcgagggggcccgcggcggcgccgccatctccgtcgtcgccatctctctctcacacggtgggggttagagacggtggggggagcggagaagagaaaagaaaggagcgccggccatggcgcggcggcgcgaaggtcgccggcgatggcgacgccgtccacgcggtcgcgtgagagagagaagagaagagaagctagggttttcggcggccggccgggagaggggggtttttgatcctccgatctcggcgcccggccgtccgatcgaaaccctagctgatcggacggccggcggcggccggaccgaaatcggcccaagtggggagcgcgcggcggcggctttcccggcccaggcccaggttgcggcctgggggaggggagggggcgcttgcccgcgcgcaaagtggccataggccgaccggcaaaggccggaaaagttcaatttaggtccctcggggccgaaaatgaataaaagagaacagtagcaatttttccattttattttgtcgatttttcatgcaaatttcaatagaattttgaatagatttttgcatgttttacctctgtttaaatttgaaccaacgggagaattttcacagagagagaatta

SEQ ID NO: 70675 - DNA, 10524 bp, Oryza sativa
ttttctttttataaaacccttttaactttgtttatttcttttcacttattatttgtgctctgaaaattccactaaaatttatttacacattttaggcttttaggaaatatacaaaaatcctccaagcctcatttgacttttatctttgcacattttaattgttggaggctttcacatgaattttaattattctttgcacaatttcgaggatgagttttagagtcgttttgggacgcgacagtacggttctttctttcgggcaccccatttgattggggtgaatagggaggcgtcatctcatgaataattccaaactcttcgcaaaaagatgcaaactcattggaaaaatactccccacctctatcagacctcaaccgtttgattttcctttcaagttggttttctacctcagctttatagattttgaagtaatgcaatgcctcatcctttgttttcaatagatacacatagcaaaatctagtgcaatcatctatcagtgtcatgaaatatttctttccccctttagtcaacacgccgttcatttcgcacaaatcggaatgaacaagttctagaggtgccaaattcctcgcctcagatgccttgtgaggcttgcgaggttgtttcgattgaacacaagtatggcacttggaacctttgaccaaagtgaattttggaattaaactcatgttagctaagcgcgtcatacaaccgaaattcacatgacagagtcgcgaatgccacacattagactcatcattctcgctaatatggttcacagcattatgattattacacatgtcattcaaagaaaagcggaacaagcctccgctgtcataaccttttccaacaaaagtcccatatttagatacgacacatttattggactcaaacacaagtctaaaaccttctctacacaatagagagccgctaactagattcttctttattgaagggacatgctgcacgttcttcagctgcacggtctttcccgaagtaaacttcagatcgaccgtaccaacaccatgaacagccgcaagcgacccgtttcccatcaacaaggaggaacctctcccgacctgataagaagaaaacagagaaatgtcagcacatacatgaatattagcaccagtatccacccaccaatcaggtgaatgaaaaacagagagaactgtaggtaatattttaccgtaccccgatgttcctccgccctcgctaatgatcatgttggcagacttcctgtctttgcgctcaggacagtccttggcccaatgcccagacttgccacacacaaagcagtctccttttgcctttcccttgcctttcttcttaaaattggttgcagctttgggtttgacatcaggcttgactttcttgttgttgtgggatgcatgagggttcttcttctgtaccatattggcactagaacctccctcaacctttttgccccgcacgtcctttgccctcgccttctcctcaacacccaaagagccaatgagatcaggaacactgaactcttgtctcttgtgctttagagaagtggcaaagtccgaccaagaaggtggcagtttggcaataatgccacccgccacaaacttgtctggcaactcacagttgttgttctcaagttccttagccagcatctgaatctcatgagcttgttctactacagaacggtcatcgaccatcttatagtcatagaactgctccatgacatacagctcactgccagcgtcagaaactccgaacttagcctcaagtgcatcccacatgtccttcccagaaggcatgtgcatgtacacgtccactatgttgtcagcgagtacactgatcaatgctccacggaacaggcaatccgaagcctcgaacttagcctcttcctcaggagagagaggtggttcacttcgtttgccccgtgaaacatagaagcactgcatcgctgtcaaccataatagtgcacgtgctttccatctcttatagtttgaaccatcaaaagcatgtggtttcagtgcagcagcaaagccaactaccgaaaatgacctatcaggtttttggattgttggaaatatagtcattattcggcatattttaatccaagaaattgaaacaatgatcatggcataagcagtgtagggtgatcttaacataaccagtagcatactatgcgcatcatgaatgtcagaaacaggaacataccagtaatgcgataacatgctagaggcatcatgtagaacaggaacaagaacatagctcacacagtatagcgctaacaacagtagtaggaggagaagattataccccgagaatggccctccgctggatggtgaggcagaattgcctccgttgttgtagtcgttcacggcacctcctcctggcgcaccagctccggatccagctcctgtcggcggcggcgcaccagctccggatccagctcctgtcggcggcggcgcaccacctccgccagcaactccagacatggcgatgagcagtcgtgcaggaggcactccccaaaaacctgatcacccgcctacccggtgcagatctcaggcgaaggtgtggtttcggaggcactgcttcttccaatctctcgtgcgcgcaagagatcagaagcggggaagggagagagcaactcaggcacaggggagaaactaacaccggggaagcagctaagaaatcggatcagactcgcggcctccttttctatcaggagaaagaacgtggacgcgctgttgcggagggaatcgtgggaacgtgggttagtggctgcaaaagagcgacgtgacgcacgcccgccgccagccagccagccagccacgccacgcctcgcccacgcccacgcccacgccccggcccggcgcgcgcgcgcgcgcgtgtggcattccgacccccacctcaactggtcaacagggagcctctaataactccctatttaggttgagatatttctcgcttaaatcctgaggtggtattattatccttaacatttattatgggcctttgagatttaatagaataaattgggcctagcccaattattctaacaacctcgacccgcgcgccgctctccatcagcggcgacgggaaagagaggcggtgacgacgggcggtggcgagagagatgaccccgccgacgccgcttgccatcgagcattgcaagagagagagagaggcagtgacgagagagagagagagggcgtggggagagtggatccggcaccgacgaggtagaaggcgacgagaagaggaggaaacggagcagcggcggagagagggagaaaaatcagcgcaggaaatggtgggcggaagagacgagaagaggagaggaagagataggagcagcgtcggtcaggttttcccaaaccgcaagggccggggttaccgcgccccagcggtaagcacggttaccgcgcggtaaccgtgaaaaatcgtgcaaaatttatcaaaaatttaaattattttttaaattcatttgaatttaaggaggttaccatggtttttctattaccgtactccctcggtaaggctggtaaccgcgataaccgtgcggttaccgacggtaatgtaaaccttggcgttggtgggctgatgggcagtggggaggggtattttctcacttgaggctaccttgggccgggataccctttgtgggctagagtatctttatcaaatggcctcagattttgaagaacccatcagaggtattcttcattggaagatgagttctctaagtatggctttggttgtacttccttcattcccaaataagtgcagctttgctatattcatcttcaacgtttgactactcgtcttatttgaaaaatttttataattaatatttttgttgtcatttgataataaaatatgaatagtattttatgtgtgactatttttttaaactttttcataaatttttaatatgaatagtacatgccgtactgtactcgtcatgcattgacagtattgaaggagaagctactccaactagtactagtagtaggagtaggagtaacacacatcacggggccgtagtacgctttagcccctgtcatgaatatcctgtctcaaaccagaggccagcaatgacaacaccacaaccggaccaatggtacccagctactcctactgcaagtcactgctgcctggtgccaaaaggccaatgctacagtgaccggagcacaggtgaaattgctgccgccctctttgggtcagctctgctcagctctcagcgactgagactgagctgagctgactcgcgaccgctcgccggcgggaaggaacagtggtcagtgcgctcggacatcgccggcagagtgaggccacggttgtcgatctcatctcactggaatctgtccctgcagggtggggacaccgccccatgccggtgggcccccaccgttggaggatccgatgcgtacgttatgctggagggtggggcccttcccccgtgatgtggggccaaaaggtggtcagctctgatcagtggtggcccagctatggttgtttgttctttcggagttggcgccatctggaagcgatgggggcgggtcagcctcatgtcaggtcactgatggtggggcccaggttgggcacgggtgggccccagcgagtttgctctcgtttcgtgcaactcgtgttggtagtggtggcagtggtgtcatttcgctggctctgcagtactcactccgtcaaaaaaaaaaaaaaagtaaaatctgatttttcgtgtccaactttatctgtccttcttatataaaatttttttataattcgcattttcattgttgttagatgataaaacatgattaatattttatgcgtgacttgtctttttaattttttttataattttttcaaataagacggacggtcaaatgttggacacggaaatcagggtttgtcctttttttttttctttttgatgacggagagagtaggaaaaatgatggaacagtagagtcagcctcggccagtagctgtgctgcttctttaccattaccggtggagttgtgaaggatttgggggttgattgacactgtggacaatgaatgcagctgtgaatctgtggcgtcatgtcagtactcaagtactcctaccaaactagtacggattattacttgctggattggattggttgctcccgttgtttggtcggatccagtccagtgtccgtcaaaactctccgatgcttggggattttgtgggtggtggttgggcgaagcgggcgtcccggcgttttgccgcgcggagcacacgcggggaggagcgcggacgggacgtaacgtaccacgttgtagtacgcgctcgcgcgggaatcgatcgcggctgccgccgtatcgatcggtgaagaggcggcggcgatgaccggaccgcgcggcgcgcgcacgtcgtgggcgcgaggcgacggcgaagaggtctcttgcggggcgcggtcgacgggcggtggtggcaggtggagtggaagcggatcgtcggcggcgtcgactcggctaaagctctcgctatgctccgcgcggttgcagcagctggtgtctgtccgtctctcgcgcgcgttggtcgatcggattacagacgcggcgcggcctttttgtagtagcggcgctggcgcaaggttgcgtgatctcggcgttccaggtgtgcggtgaaccgggggtaaagtagtctaggctatattctttttttttattagttttagttagcatgcgagagtgtttgaaaatgttaaaggatacattccgtgctaaaattttctatagaagttgctttaaaatatcaaatatatatattttaagtttataataattaaaactcactaatcaggcactaatgatttttttttcgggccctaacttcatcttcagtcttttagtaaaaaaatgaacaccaactctggccatctagaaatcacctactccctctccatccgtctcaaaatacaattatttctaaaatttctcataaacaataagtaaggaactagaaaaactaaaatcgagatgattgtaatagattgagatgtagaagtatgtatacaagttgttatattttaggataagttttaaatgatactaccttcgtttcagattataagacttcctagtattgcccacattaatatagatgttaatgaatctatttgtgtctagattaattaacatttatatgaatgtggaaagtcttgtaatctgaaatggaggaagtagaaacaaaggttacaaatgcattagaagcactctaaataaattttgtcggaacaacttgtaatgcatcgtcaccttcttcccaaaatatttattgattgtaacttagattgaaagaaaaaaaaatgtccgtcaaacactacaatgtctaaagatggttacaccaaacgatatcccattgtcttaaaaacagttagaccaaaggatcacttatataatccactgtaataccaagcaaaagcttggtgtaccgatttcggtccgttgagcgtcagtgatgacggcaatagccggcaacctcacatccacgaggggaaaaaattggaaagtaacaacccaaattgtttacaatgactaacttatctactcaacttgtttgccattagtcgccgtatgaaaaacaagagcctgaccaaatgggtcatatgggcaggtaaacgactcgggcaacgaaaaagatacaccttctacaacacatgctacggataattagatctacgtcaacattagtaaacagaatcagcatttgcaggggaatcggtaacttgcagggaacagcttcgcttgttacgtcaatgacagagagagcattctaaacaaaggcgaaacaacaaactttgtcctcctccatcaaaaagacaatttgcatgtttgatagggaccacaatgtttgtgtatgtggatgtgtgtgcatccataggattttctctagagtaggatagaatccattgccaatgctgatgagtgctggaaagctcatggagcaaaagctacttgtggtaggcattcaaaaaatccggcaaggcaaattaatgacatgtcaccaactgggatcaatggatctaagacaagggcttcaggatgatatgagaacacacagccccacaatctctctgaaatttagtgaaggtggcaacaccgatgcttgtgccaagaaagtgaagccccctggtgttatacttttcagcctgcacgttgaatggtgttcagtccagacacgtgtgctcagctagagctttaaaatgcgatatccatcaagatagtactagtagaagattgtccatccacagaagttaacaaatgcaagcaaccacacctcactttcggattagcattgcagagactgatgacataatagaccaggaattttcaaccttgatttttcttttcatcagttcatttctcacttctctttcaaagctaattacaacacaacacaaccgaaaaggcaggtcatgccatgccatgccacccccctccaacccaatcaaatcatggctcatctatgggataatatgtttcttctcccaattgctaaaacaatccaagcagagaatggtgaggaatatagagggaaagaggaacaccaccacatcacaaaagttaccttgtcctgcattctaattaaattttgcttcagttaagagaacaacaaaaagaacaaagctaaagcagttgggagagggagaaagagaccagcttttgacatccatgcataaaactgctaaaaagagattctatgcacctccagctttccatcatgagaggataacctactacacaaaagtatcactcccatcaaccattccaaatacttcagttagcaaatgatccagcaaaggaatgggcgcgccgtcctcttcgattaacagccagcaaacaggctcttgcgcctgtggctgttgctgcgatctgcttcttctggggtccaagaggcgtagctccgttcgcgcatattcagaattagcagttagctcgcaagtccagagtagcgtcctgaagtccgagcatcgacatcttacttgcctgataagacggatgtttcaattaggaaaaagaattcacagcaggcttgtttcatgggagaaacatttgagcttatacagggaagaaatagaagatgtggagaaaagagcaagtccattaccagcagcaggcttctgatcacttgatggttttacagacattgacattggggccccaaaagtcaattgtgccgctgacatatgagagtgaggcacaccgctcggagactgagatgctgcggcaagatgcataaaactgccagcgggaggatgatgagtcttcatgttattgctggctgcagctgcaagaacattcactggatcagttagcattgcagttgtggaaatagacatggaagtagagcatagggagagcatagtagacgaacccgacatggcgctctgctgatggggctgctgctgctgctgcgtcttgtcagctgagcgcttctggtaaaggccaagagcaacacctccagcagctccaggggcttgtggtgtgtatgcattggagatgaagaaatgacctccttgtggaaatggctgctgtttcatcatgtgcgactgctgcttactgcctgaattagaaccaggcggcacatttggctgttgaccaaggatcgatggcataggcatactactatagtgatttgtgggagctgacttggctccagacgtcgatgctggattcttggctgattgttgttgaggtgacggcaattggacagctggtggaacaccctttgcacttccagaagccggtgggctgccaccagtacttttggagactgaattggatggtgaaccagaagcaacgggagcatttgaagatcttgacaaatcccctcctccagtagacatattagtgacaggacccatctttgatgaactctggggttggtggtttgaggtagagagagactgcataggagccttagcttgttgctgatggagaccactcttcatcacaatcaaattagagggtgaagcaccaggggaagccacaccagcaggtgcacctgttgctctggctgacgaaggcttcaattgaggagattgactaggaacacccacttgggcagcacttgatgggtacatcataccctgaaaacttggcatgttcaagcggtctgaatatccacctgtattgcttggtgcagcagatctggggcgagagttcatatggtgatgctgaatcaattgttgctgctgcttatgaagttgaaggaaatgttgttgctgctgctgctgctgctgctgctgaggaatgctggatggggatggtgctgccgctgatgtagctgccggggccgatgtatttgctgatttgcctcctagactgaaggcatttgaaggttctgacccaataaggctcaaggtgcgggatgagctatcattagtgcttccactaaggaaaggaggcacataagacttgttatcttgcctggagaaggaaagtgaatgctgctgtgaatcacctggatactttgcagctgctgatttctttctctcactgtcaacagtgttatgcgttgaagaatcaccagccacagattttgtttctccactgacctgacgctggggcttgtgttgaccagcttgaacagattgcgctgtggcaaaattgagctgaggataaccatgcctgcctgcttcttgatggctctggaatagttgatggttcggccccaatgaagaaaagtcaaggccacctggggcagatccaggagcacccacagaaccaaaaggaaccacaaaagagggagaggaagcaagatcaattctcacaccctgccctcgactcgccggtggtagctgatgcgggtggtgatcacttaacttcttgtcactctgaccaccaccaccagcagcggaagtagggggcatcaatgcaaaatttggaagatgaactggaacggcataattatgatcataacctcctttctgagggtgagatgacttgtcatcacccgatggaccatcttgcacagttttctcactgtcctggcggtgagcaaggccaggcagcagcactggacgctggttgccactggaatagctctgggaattactggcagctgcagcagcattagcatttggtgcatatcccagtaacccttgagattgttgtggctgatgcttctgagatgaagcggacatgtttgacatggggttcttctgaagattttgtggtgacgccccttgctgctgtgatgggtgcaacatgtgagaagggtaaacatgcccattgaagaacggaacagcaggtcctggtggtgccatgcctcgataggcagcaggaggtcctccagcatgagcagcaacctggaacgggtagccgccattctgtaagatggcaaaaagctgagcatcagctggtggcaagttggcaaagctcaggttcatggccgctgcgccagggtttgctgaagaattgtgggcagcagcagatggtggcattgtattactgcccacagaaggctttgcatcacccactcggctggcagcatttgcagcagcagccacaa

SEQ ID NO: 70676 - DNA, 32525 bp, Oryza sativa
  unsure (1)..(32525): unsure at all n locations
cgtttcacaatgtaaatcattctagcatttcccatatttatattgatgttaataaatctagatagatctatctatcatcaatatgaatgtgggaaatgctagaataacttacattgtgaaacggaggaagttctgaacattcgtagactagatcatggaagacagaaaaactgtgacatgcaaaaagtccttttagaagcacagttaaattttaccctttcctactgcaactgctatttccatatgcaaacaggaaacggtacttcgccggcctcttgagcctcaagtacggagcagtacaagatcaaagcagccaccgtcactaactctgacaagcttgagttgtggcgcatgcagaagctgctttacaacttcccaaaataacagtgcaaacttagacccgttctgtccgggggcttcggacaacgctgtcaacgcacaagatgagtccttcctcagttaatcttagatcatgcgcactgaccacacgatcgacagagaggaataatggtcaaaacgtcaagcagacggcccgcacgcacgcaccgacgcacgcaccggcgcgccgcgagggggtgtccagacaaaccggcgtctgtcacctacagagaaatcctgcggggatcgagctaggcgcggacgtatgcagtgcagggcagcgagagacaggtaagtatacagtaggatgcacggatggatggatggatcggtggcgccggtgccgtcgccggcggcgtcgtcgtcgtcagagtctcagagatggacgctgaccggggcggcgcacgcgtgcacggggccgggggggcagaccggcagaaggcgtcaatgctctgtatctagcacgagataaacgcgcggtacgtagcagttcgtggtattcgactaatactctgctctcgctagcgcgcacgcgccaaacaggagaacagctcgagcagtggatgtagcgggtgaaaacggtcacagaaattcctatcgactgagcgccgtttctgcataaggggtattgtttataaccgtaccattttctgctatttttaaattttattttttaaatttttttctatcgtattaatatcgatacagggtagtttgaatgataaatatggtttaccgattccgaccgttcaccccggtagctgcctcagccctgccttggcggtgaaacgcacggacatgcatgcggaagagatgacgcggcggatagggcgtcgaacgggatttggttaagtggaatctgatccgggattctcgaccgcgactcggtcgtatatattcgtacgacggtacgaggaatcagcgatcgaggagccgaggaatgttattctccaatccgtttttttttcctttttacagtttttgttggtcttggcccgagaattgatattgatttgttcgtagcgacgaattctgtgcttgtttcaacgttatatcgttgtcgctctgtcagcagcaacaagctaggtcgggaggaaggggaagacgtcgcgttccacggtgagttggagatcgatcggtgcacgtcgcgtggaccgcgacaaggccgcagggacagcgccgtgcgtgacctcctgtcgcttcgcgtagggtcatgcattgctgtgcctgtgccagtatgcgacaccaacctttgccaatatagcgtcaaggccgccccgcgcgtgatcgacaactggtgccactttgctctcagtttcaggcggccatatacagtcgcaaaccgtgacggcttcattaattacgtgcttccattttccattgctagtctcggaatgccatttatatttagtaaactttagccacttctacttcaataaactaaaaaaatattataaaaaacatactatcttatcaaagttatcaccgtcgttcgtatggaggttgcagtttcaaagtggaaacattaagaaactaggtggctgatatttttagccatgtaccgttgccttttcgaccaagagattattgtttctactttttttttaatcttcgatcatcgtcactcatgtggaagttagaatttcagagtgaaagcattaagaaataaagtagctgagtgtttttaatttgtaccctattatttcagatcactgtcacttatgtggaaattgtaattttcaaagtaaaaaaatcaaaaaataattaggtgactgagtttttccttatctatgcgtcattgcctttccgattaatgtttacctatcctttttttcatctctaaccgtcatcactcatgtggaattaccgttttcgaagtgaaaacataaagaaatttaggtgggtaacttcttacttttttcttatctacatgatatgccattgccttgtcaaccaacatattaactaggtgataccccgcgctttgctgcgagatttatggataagtatatattaaatattgtcgaaatgatgaaagttgaaatgttgaaaaaataatgtgagtaagatgatttgacacatgcttgttgatgatgtgttatacttacatgagatttaaaataggctagaatagtactttctagtgagtgaagatgttgcatgcttgtataggattttaaatgggctagaatagtaattgctagtgggtgatgatgtggcatacttgcatgttgagttttaacttttaataattgttagtgggtaccgactatatagaagactatatagaaagtatcgatgtgtagcagcactcactcatgctttgccaggtgaaagagaaaaaaagttattccaacttaaaacaaagtattgtaatttggcaaatatctacaagctagtatagatataaaaaagctaatgtgcaaaggcattcataaaaattaaaatacatttaggtgaatccgtacatgtaaaaatccacactaaacttaaatcaggttgcaataaaaaactatcaaattaatttgaaatacaagcttatgcatgcatgttacttatatgcactacaaattaaacaggagtgtttttctgaagataacttccatatgatgcatgcgactgttagtatagggtatatagcccattctttgactgccaagtgcaaacggaaatgttggaatagtgtcaaccattcagggcatgcgtggactattccaaatctaatacaggccattcaacagtctttgcacggttattctaaaattaaagcacctagagggtgaccatagttatgcatcgaacaaaatctaatcttataactagggcaagaattctccagtgaaattcaaagcattggtcttaattccatggtctaaagaatgtatggatttaaaaatgtgaaacatttgtgtggagattatgggtaccccatacccacacgacatggttatccgactagtcttaggggatagcttatatctatggaatatgtaacagatcatgacttgggtattacgtttccctgtatattatggaacggcctaaagtcctggtttgataagattgtaaagtagatttaggaaaccgataccatgttggttaaggtttctatcttgtaatcctgccctccaccctatataaggtgggcaggaggccctctagggggcatgagacaacctgatcgtcagatcaatacacactcggcggattcaaatccccaaacaggagtagggtattacctctcattgagagggcctgaacctgtctaaatcctttgtctccgcatccatccacttttaggtctcgtgcgctacccccttttattattgccgaattcatgtttcgacagttggcgcgccaggtaggggttgcgtcgagttatctatcaagaagcgcgatggaatcaactttacgagtcgccggcttcgtcttcacttcgggagctgcaacttcctcgccgccgacgaattccctaagcttttcttctccaactcagatccaatctagccgggaagattaatctcggcgatggatccaatcaccgtcgccgccgagtcttttctttgatcggcaagaccggacgtcagtcaccgagttttgttcttgatcagcaaaagatttgaagccaacagctattatgagcctccataagtagttgttcctgtcaattctattttatgcaatgagatcaaatctgtcgccatgtgctgtcaagcaacagatcaagcatcagcagaaaacatgcatgcaaagctctgaagcatcggcgtctttcctcgtcgacatcaaaatttgttggcgagattcaatttcggaatcgatatggactccaacccagctgattggagcaattgtcgcacaagggcatcgatcaagccacttctgtccaagccatacatgcaggtgcatgatctacctagacagatacatgcacgcagcgacctttttgctggagtctctgattcaatcaagcaagccatacaccgctgatgacatacatgcattaaaaatcttggattacaagccaggtttatcgttttaaattctttcgcaaattagattaattcacagattactaattattgtttgatctgttattgtttatgcatgtatgtcggctgctgtcgtcgccgctggctggcttctttgcgtacatggctggtgtactctgccaccattgctggtggcgacattgtcttcaccaaccggctgcctccgtcgccgctgactggtgtcctcgcctatatggttggtcggtcacaccaccgttcatgggcgtcaacgtcttcatcgaccggctagccttcgccgccgccgactggtgtttccgcctgcacggctggcctattatgccgccgctgttgggcgtctacgacttcaccgccggcctacctccgtcgccgccgagtggtgcctccgcctacacggttggcctattatgccgccgctgttgggcgtccacgtcttcaccgccggcctgcctccgtcgccgccgagtggtgcctccgcctatacggttggttggtcacaccaccgttcatgggcgtccacgtcttcaccgccggcctgcctccgtcgccgccgattggtgcctctgcctacacagctggcctattatgccgctgctgttgggcgtctacgacttcaccgccggcctgcctccgtcgccgccgactggtgtcctcgcctatacggttggttggtcacaccaccgttcatgggcgtccacgtcttcgccgaccggctggccttcgccgccgccgactggtgtttttgcctatacggttggcagacttcgccgccgttaatgggcttcatcatctacaccactggcttggttccactggcgccgactggtgtttttgtcaccatcgatggactgcttcgttcccacatcggctacttttgctgtcaccgagggaatattacaaagctaagtcatcatttattttattctttatatgatattttgtcttttcctttgcctcactacatcaactggttcgccgttgactagtgagtcgggggctatagatgttatatcgtattttttaaacaattttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcagaataaatcaaaagcatagagatgagataaatttattttctgctcttaataattgcaaaagtacccgagtagtaaattctgattcgtgaaactttgttccattaatggcgaactcatgtcactcatatgcatgtctgggaagtgcctaggccgactcccggtgcttgggggctatgactagtcggacagagcgtttaaacgtaatgaatcatctgctcggggaaatcaaaattgacaagaggagaaatacacatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccgccgccgactggtgtttccgcctgcacggctggcctattatgccgccgttgttgggcgtctacgtcttcaccgaccggcttgccttcgccgccgccgactggtgtttccgcctgcacggctggcctattatgccaccgttgttgggcgtctacgtcttcaccgaccggcttgccttcgccgctgccgactggtgtttccgcctgtacggctggcctttatgccgccgttgttgggcgtctacgtcttcaccgaccggccgcctcgtccgccgccgactggtgcttccgcctgcacggctggcctattatgccgccgttgttgggcgtctacgtcttcaccgaccagcttgccttcgccgccgccgactggtgcttccgcctgcacggctgacttattatgccgtcattgttgggcgtctacgtcttcaccgaccggccgcctcgaccgccgtcgactggtgtttccgcctgcacggctggcctattatgctgccgttgttgggcgtctacgtcttcaccgaccggccgccgcatccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggccttaccatcttcatcgccggtcgtctcgtctgctgctgactagtgcccttacctctacgtctggtttatacagctaccactactgatggacatcatcatcttccgtcgccgactgattatgccgcctccgactggtgcttttatcttcacaactgcgcgtcttcactaccggtttgcttctgttgccgccgatttgtgttcacttcattacggcaatacaactttgtcatcatggtggagcgacttcatctttattatcttcggcaccggcaaactctattgttgctacttcgcaagttttactacatcaccaaccatgacgttgttgtgaatctcgacatctcggcatgcgatgccgtgttattttactacaacaagtggctctccaacattcatgatttctacttggacatcttcaacacatatcttcaatcaagcaataactattcgacgacaagatgctacagttctcgactctatgttcagttgtttcccaactaatcaaagagtcgggggctacacaaatacaaggctcaaaatttgacaaattttatgtcaagctgaagaaatcaattcatcaaccaacgagtcaactccaggagtcattatcttcatctttgatttggagcagacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcttcaacatagcctactctgctgccgttgatgggaaacttcgtcatcatagtcggctatctctgttgccgctaatcatcattaccgtcggatgcgtttgtcgccgccgattattttcttcatcttcatgattggtggatttcgccatcaccgttgatgcgcgtctacgtcttcatcgtcggtttgcttttgtcaccaccgactgttctttcgttgttgttgggcgcctacatcttcactgctagctgacctgactgttgccgactggtttcttcgcctccatggttatgcaacttcattacctttgattggtgtcactgtttttactaccactgacatcttccgttacttctgatgagcaatttcgtcttcatgttggtcatttcatctccatgccgactgcgtcagctattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcacttttcgcttaggccaaagtgcgcgtgatcaagtgcccaataccttaaaatccttttataccgcagttactcgactttttaggagttggtacaatgcatcttaaaaggtgtcaaacagtaaagctttatatagctgccccgctgacttttttatatagtcaaggtgctgtttgggtttatcaagcaattgattggatacaatatcattgctttttgccacgtaagtgtgcatttttattgaccaatattatggcttaggctgattatatattatggtcatttttcaggcggttggtaaatcctttatgagtttacttactcggatgttataccacatgtgccatatatttccaggtgtggtgaaacaatgtgtcttttatggacttaagcacatctgttaaagcagtgtgcgcatggcgtatgcccaatactttgaaaatttctttattcacagcattcaagcttctttatagttgttttgctatgtgaactttcaaagatgttgtcaactttaggttgtacgcatcatattttgccaagcagtcggtatatcacttggatcatattattcggggattcacaccgcatatgctatacattgatatcaagtcacttggttgattacaattatcaaaaccactcggttggttagattatttattccttgactatatgtttggttggttcaattaaccacatagtcgggggctacacctattaggtgcatctattcgatgcacctgactatatttttcagccctccacagtcttcagatttggtaaaagtactcgggagaccatggcgaagataattgaagcactcggctttggagtaatctagttcgagagaaggttatcttttcggctgtgaaggtctcaggggctactgtggagattatgggtaccccatacccacacgacatggttatccgactagtcttaggggatagcttatatctatggaatatgtaacagatcatgacttgggtattacgtttccctgtatattatggaacggcctaaagtcctggtttgataagattgtaaagtagatttaggaaaccgataccgtgttggttaaggtttctatcttgtaatcctgccctccaccctatataaggtgggcaggaggccctctagggggcatgagacaacctgatcgtcagatcaatacacactcggcggattcaaatccccaaacaggagtagggtattacctctcattgagagggcctgaacctgtctaaatcctttgtctctgcatccatccacttttaggtctcgtgcgctacccccttttattattgccgaattcatgtttcgacaatttgttttcttctaaattaagatccaaattagaggtattatgaaaccatgtgcagtgtggtatagcgtggagtggaaacaagagggggccgggtcaattcttttccattgtatctatgccgtccttttccctcttacacgatccatctctcctcaactttacatttaattacacaagtaactaattaattaagggagagagaaaagacaccatgagtgcatgaccatgaggggtgccctttgtggaggggtaaggtatttacgtagttaaaggcagctttggaacatttagatttaaaaatactccattcatcccaaattataagacatatttttttacatagtctccaatgatatactttgatcattaatttattccatactatattccaataaatatgaaattagcatcacacgaaaataatttaaattataaaactagtgatataacatgcataatacttagcatatactatatgattagtatgattagcagttaaaagttaccgagtttaatttttattataaaaaaagggtgccctataatttgggacggaaggaataataggtattagtgttcaattacagatcaatgtaaaactagagatattttaccgtctttaagggagtattatatatagtttttaacatttaccccaaggtatgtactcccttcgtttaaaaaaaaagacaacctagtattagaatgtgacatattctaatacaacgaatctagacatagagtatgtccagattcattgtactaggatgtgtcacgtcgtaggacgaggttgagtcttttgggacggatggagtatacatgtactcctacaagacatgattcatgcacgcgtctaatttaagcagcattatatctaaagtaagtttcttttatctagtactttatatacaaatcttgagtactactgccatatctttaagtaaattcaactccatcgatctgttcctagctaaaagaaagtcattttaggttattttgcatagattaatgtttgagaagagaatagacttagcgctccttttttttttttgaaaacatagtgcttcttattaaatgatgttttatggggagtgggaaggtggagaggtagaatgtagagaaatttgaacttaagggtgtgtttagttcacgctaaaattagaagtttggttaaaattgaaacgatgtgatggaaaagttggaagtttatgtgtgtagaaaagttttgatgtgatagaaaagttagaagtttgaagaaatagtttggaactaaactcggcctaaggtgattgacatgataagtactactctatagtgattatatagtaactttacttttgatccagaaacataaccaaaagttgatatatttttgggtagagaggaattattctttttagggtggagcttaggtacactagtttttttccccttgcagaaatgatatggaaatgcatgcatcgtacgttaattgctactgatggtggagatgaattttttagaagtactcaacggcttaataggactcataccggtgaattgatctggtattaccgccttatgttttttagtgaaagtggaatatattgatgtaattctccttgcaaataaaggagagaaataatgtactaccggccagtggataaacagcattaattaattagttaatacggtaaaacctggtcaagtagctagcagaagttgcatagaagaaacattaatgcgtggttaaattctcaggatatcaccttgtgctacttgacttaataactgaacttaattatattccgtacagagttgagagcatgcacgcgtgtataagaattttcaagagctttgcatattttctcatatacgtagatagaattaatccgacacaaattaaataagtacgaatacttttgaaattttgactatcgataatttctttgaaaatatttaaaaacgtttgagcattttatatttttttaagaaaaaaactatatcataatatcatatatacttattttcccaaaatatattagattttataaatttaatttaatataaaattgatcaaagttaacttaaaaaattaaaccagaattgtcttgaatactatttatgagtggaacgagtatattactaagtatggttctaacaaaagatatgaagctaggggcctgttcggcaagctgggctgctgcagcccctgctatcttgtggcttgccggactgttcaggtcctcggctgccgaacatgccctagagcaatggctgcaatgcagtagaggctgtaggttaacctaattaacgctgctgaaagtattgctacgtgcaggaatttatttttgaacgaaacgtgcaggaaaatcaaactgaagaaattgaaatgtgaacactaatactagttcaaaacgaccatatccatgcatgaacgcttgaataaataccagtagacaaaaaacaacgacgacattaataaaggcgggagacagaagtttgaatccagtcctgccatgcaaagagtggcagactgttaaaaaagcactgtatttttaatttattggtgtaatcatgtaaatacatatacacatatgcacataattatttgcaaaaccctattctcatgcacatatcggcatggactgcctagctagctagtcactcagtgctgcatgcattgcttatttttacgtatagtaccaattcaatcctgcagattaatttatttacccaaaaaataactaactagaaaaaaaatgaatgaatccatcccaagttaaatgttatttgttaaattgcccccggtttttcttagtctcgtcctctgaattgtacatggtgaagccgcgatgaaccattcaaattacagcctggacatgatcatatgtcttccttgcgtgacctcatgcttgtctatgttctccaaaactgcggtagccgccgatgttacgagctctgcaagatctctgtagaggcagatcaccattacaaatgcgtcagttgcgatcaaacgagaagctaaccgagcttagctactaagtatgagaatataatggcgccaaatggctgcagcattttaaacctaccctgtggctgtgtcgtaggtgaggccgactgtgttcttgacctcgcgtagcgcgaatttgaagcgttcaatgtcgcggggatggtgagcgacggactcgacgacggcctgcgggaggacgagatccgagggtttgatgttgtaaaacaccgggatgatctttttccgtgactcgacgaggagggcgagctcgcggaggcaatactcggagtcgcagtagtgcggcgagaagatggccaccgcgacgccgcactggctgatggcctcgctgatccgctcgtcgaggcgatcgccggggcgcattgactggttgtccaggaaggcgcggacgcccgcggcgacgaggcggtcgtagaaaagccgcgccaccgtcctcttggtgtccacgcccctgtggttgatgaaaacgtcgtagcgcgcctccccccgcgcatcctcctcgtcgtagtactccacccgtctcgccaccgccgccttctgcttctcccccctgctgctgctggtggccgcaaccgccgcctcagccgacgcgtttagccgcgacgcgatggtgcaccggcggccgcgggaaagcccggtggacgacatgatcaaacgaccgatatatagctagtgatatcgatcaagaaatgtctcctagaatactgcgagagcgcggagaaatccaagagtccaagacgttctctagttagctgatcgagctgccgcgatcccgatcaagttgatcttgatcgatcgaaacgtctctgaacaatttgagtggaagcagcaaaaactccaacaaaatagagatcgatcgctacgagttagtttgtgaattgtgatgcctgatatgtggatgaggggatgggccggcatgcatgcgtttataaaggattgggttcggggtggtcatggtcgcatcgcgcgcgcatgggaacattttaattatgacatgaaagtactgagtaagttatccgcgcacagtccccgggcggggaaatttgttattttaatagtcagatttcgctttgagtagtattatcaatccaaagatcagaccgtcgtcagtccaccgtcaatccaccccgtggcttatgctaagacggactatataattattatgttttctggtcccctatatatagtacaacaaacagatattctgcatgaattcagaccaaatattatacaatccaaagagcgattcgctacttttcaagctctcctctccaagcaaaagcatatacattactggattttcttcgctcgagcgtttcaaaagtttgaattttcctcgctcgagcgtgcacacacgcgttgcgttagacctgcagatctttgcagtattttggcgagactctgcgcagcgtgcagccaaaggcaaaaaacactccgtgcagaagattgaatagaaattttgtggaggtgagaaccattcaaatacttgaacgacggggctacgctgaactgcagcaatcaatgggacaggaatactactgcaacgatgtttggggtcgggaggaggatcggaggaggggggagccgtacgatcgccgggtgacgtgcgagagtgatgacgtcacacgttggactgtccccctctcatctcacgtgtctgccccacggtttgacttattgatgcgttcaaaagttccacgggctgctgggctggctgcgccaccggtacggtcgctgtaataaaatacggaattgctaaactacagtcaatagaaaagctacctctaaatcttataaattttggttcactagatatgcttcgcgattcgtgctccaactgcttcttcttcaaccccaacaaactcctcttcttccccgacgccggcgataacccaaactccggcgaagggccgacgaattaggttcccggggtagggtggggttcgaggggtgggaagggaggaagaagggggagttcgccgggcttagagggatggtcgtgggcggcggcggcccggaggtgggcggcgggtcgggtgggcggcgaggcgccggcggcgctgccggagccgcagggctggaggagggcggtgggccagcgtcggtggtgggggcatctcgccgccgacagctcgaggaggaaggaggggaggagggaggagaaggagggggaggaggatggtaggggggagggagtctcgccggcgccgttgacgccctccagccagccggcgaggcgggcggcgacgcggtggggtggtggcggcgggggatcgggtggagctgcggaggagctcgcgagcgtgatgggagggaacgggaggaggagttgtagggttaatgtatcttcatgaatcataaagcacatccaatggttcaaaaattgaaagatgggaggtgggattttctgtcaacagatgtatagatagtcccaatataataataataataataataataataataataataataataataataataataataataataataataataataataataataataataataataaagaaaaggtgaactttaaccgcaccatcgtcgagttgaaatgaagtccacgaagattaatttttgggggtttcgggtgtacttctaatttcgataatcgtttccttttgaatgtgaaattaatttgatatatagtcgaaggcacgcaatctgcttgataatgacttgtttggccagaaattaatatgaggaagagacaaagtgtaattaaagacttaggagtacgtgtgttcctagaaagtagacatatgtgtacgagtgtacaccatgtctattgatgtagttcaaaaaagccgacgttgaatactttatttgttcatgcaaatacattgttattgatatgttttaagggaatacttcaaaaatgtttgaatctcaatagccttttagtcgtattgaagatacttgaaattggtaaattgatggattatgtggtatttgtgatagctgtttgaggatataaacgattgaattaaatagcataaagttgaaaagttaggaaacatgcaaacgaaaatcccaaatccagaataagaaaagaacgtggctttaaaactagcattggattcatgagaaacttatttgtgtatttgtttagaaaataatattgttatattaccaagttaataaaataattatgttacggtaattccttcgttccaaaatttgactcagtcacgtaaccattttttaattttaagttcgaccaaatttatagaaaaagcataaaaacatttaggggttgtttatattgcagccaaaataaaccttaccaaattttggtaatgccaaaattttggtaatttggctattatgtatttactaaagtttgataataaactaaatgaacgcatatatttggcaactctatcaacaaatgttatgatttaaaatggcatcaatctgaacaagcccttaagcccttagaacatcaaacagattatatacatatatttagcggtggatttaataaaaccaacttggtattgtatatgttgctatattttctaaacttaaagatgtttgacttagcacaaaaccaaaacatgttatattttaaaaaggaaggagcagaaattagttgttaaaattatattttcaagactgtattgatacccaaaagacacatttctaaggatagatggagtaatacactaggtttacatataattagaataaccactaacacagtaagtttatatgtaattagaatatcaattaattaaatgagaacatgcactggcccaaaattctgtattagacttggactataatttaatatgacgtatattaatttacataaatatgattttccatctctgtataaattaagttggttattcattggttatataagttggttgtaaggatagtggtagagccgagctcttatcccagtccctgttcttaaacaaatactcctaggtaccatcagtccttaaaaaaacgttatcatcattaataggtaccatcagtttgtacctacatgacgactagtatatgaactgatcacatcctaactagctcataatcatcacctagaagtgcaggttttggcataacttcgttaacaaatatttcatctcgatattatcatcacttggattttctactatgttcttacttgtttcaactaccgagatttatatcaattcatagcttttataacacgtttctttactatcttcggtgttccttatttactgtactcttactttcaataggatttaatttacatactccctccgtactagtaaaggaagtcgtttaaaacagcgacacggtcttcaaaacataactttgactttgtgtttctataaaaatatttattgaaaagtgatatatgtatatttttatgaaattatttttcaagacaaatctattcatataatttttacattttcaaactcaataattttagaggtattcacgatttatatttccaagatttgatttaaacattgtcctaaacgacttcttttacgagtacggagggagtataaccgctacaatttgtaagttctaataatgccctggctttcacttttaacataaataaatccacttccaacttaagactgtgttgttcagtgtttattgggtacctactacctcatttttcgtaagcacatatttcaaaatgctaatgctcaactcaactaatcctatgctaataggtcttattgttttgtgtgctgtgaaaaagcctaaccattaagccatatgaaatgaatcatgattaagtggttatagttcttgttgagcagtgcaaatagtcattcctatatttttttatagaagatctattccctcttaaaaagtcaaatcctaaaaataaatttggatatataagattcatctcgaggattaaggttttttttacagagggagtatgttatacatctctactattataaaaattgaagatgttttgccagtattttggtacgttattcgtgtatgagtcggttttaagtttgtttgcttttggaaatacatatccgtatttcagttggtttttaagatagttcacttttggtaatacaaaaggaatcatataaaaaatctgtttaaaaaactcacatgttaacttgagacaatcggactcctatctgtagctcatgattttctaaaagaatatatatgcacgcaaacttccacagtaaatttcatcttaaataaaccatataacaataataagattaaaatagacttcacccgttacaacgcacgtgcattttttttctagtaccataaaaattctcagtcatccgagtaaacatatctaatttttactactactaaattggttgtactagatggttgaacgtcggggattttattggcttgaattcctgcacgcatacatttcctaagtttccgataattagttgacaacccattttccaggcaaacgttaaatcactagtgctggaatctgaggatacatttttggagaagtcaagggacatgtttgctacacgcgctgagtcaccgaccaatgggacccacccctagcccggcacgtcggaaggccactaccgcagtgtgcgccccaaaatcgccgccgtcccccgtctcactccccgccgttctcctcctcctccgccgccgccgccgtcccgcccgcccgccgccaccgcccacatgtgggagcgcggcaggctaccccgcaagccgcgaccgtcccctatcctcgtgccgccgccgccggcgtccccgccgcccccgccccgcctcctcgccttcctcctccctagatccctcctctcgctcgccgcccgcgccatgccgtcgcgccgcccgtctcccctgctcctcctcctcctcgcgctcgcgctcgccttcctcttcctcctcctctccccatccgcgccctccgccttccacctttccagctccctcgcctccgccgccgccgccgtttccactcccgcgtcctcccctcccgcccccgtcaagatctacatgtacgacctccccgccaagttcacctacggcgtcgtccgcagctacatggcggcgcgcgcccgggcgggggcggcgggcgcggcatcggcgattcccgacgacgagctgcggtacccggggcaccagcactcggcggagtggtggctcttcaaggacctcaggcgccgcgggccactcgaccgccccgtcgcccgcgtcgacgacccggccgacgccgacctcttctacgtgccgttcttctcctccctcagcctcgtcgtcaacccgatccgcccatcggcggccgccgccaatgcgtccgacgcggcggagcccgcgtacagcgacgagtccacgcaggaggagctgctggtgtggctggagcggcagccgtactggcgacggcaccaggggagggatcacgtgttcatctgccaggatccgaacgcgctctacagggtggtggatcggatcagcaatgctgtgctcctgatctccgacttcgggcggttgcgtagtgagcaggcatctctcgtcaaggatgttatcctgccctacgcgcaccgaatcaactccttccaaggcgatgtgggagtcgaaagccggccttcattgctattcttcatgggcaaccggtatcgaaaggaggtgaaattcttaaatcttgggagaaatgtgatggcttgatcaattaatttgcattgtacctatcatagagcatctgcattttcagaagggatattgtatgctatagagtagagagtgaatttttttgccatatcctagataacattagcattgaattttattggtggttatatgattttccagagcactccaaaatcatgttaactttatgtcttaagttgatggttctgtctgagaatttttaggcaatcagaaaaaaaatgaagcttaatatgccattagctcattatatattttttgttaccatgtgcctttgatttagcttgtttagatgagttttcttacatatattataaataggaaactatcacaaatgtatcatgtgcaaacacattaattgatatgagatgattattaaaaaaggtgtgattgatttttcagtttttacatgcctccttctctagcgaacttttggttctggatatatctgttgactggtcaacaacctttcttttagaattcaagtcaaattgcatgatagcttccacattttgcaagccatattcacttagaaagttctagcctttcatgcacgttcttgctgattgattatttttggtgttctgttttggagagatcaactctcaacatgaactcgtccattcctatatttttctacttgtcctcataattttccttctttcacacatgcaaaactaagttggaaggcatgtctcatactattaatgactgaagatttctgcacatgccctggagcctgggcatatttattgattggtcaacacatttctttcataattcaaatatgattgtatgataggtttccacagctttgcaaaccataatatttagaacattctagcctttggtgcactttcttagctggcccatccattagtttttcttttaaaaatcaagtacgattccatgatatacttctacagttttgcgagccataatcttttagaaagttctagccttccgtgcacattcttgctgattgatccattagtcttctgttttggagagatgaactctgccaacatgaactcttttgttcctatttttgtatacctggtcctgataatcattcgtcttctgcacatgtaaaactttaatgtttgaaggcatgactcgcagcatcccattgctaaagctttctacatgtgtacctaattgtataaactatttgtctctctctgttccaatatagttgtttggaatgagtgcactcaatcttggtttggaacaacagagaagttaagaacagtatcatctgaagcagtaagctttggaaatgaccaattatggaaatgtaaaaatgtttgattcatttgcataattgttcatctttgtttccttgtgagttttaagattgttaggccctgtttaagattatacatatgattcatattcatccttccctttatttttgctgtattatttagagcactgctacatgcactaaaattttcttacaaagctcttactaacaaatttctcaaccatttgatttaactagatggaagttacaaaaaatctagatttacttacagcttgccacatcagagtttgtaagcattttgtaagaaaattttagtacgtatagacttttcctattatttatgttattgcctacagagtttactgtcagtctgtcattttcttttcttcctttcacactttgtttatgaaataacatcttatactaaggttgttaaccttctgataatttagggtgggaaggtgcgtgatacgctgtttcaagttcttgaaaatgaggcagatgtaatcataaaacatggagcccagtcaagggagagtaggcgtatggctacacgaggaatgcactcatccaaattctgcctccatcctgctggagatactccctcggcatgcagattgtttgatgcgcttgtcagtttatgtgttcctgttatagtcagcgattacattgaattaccatttgaagatgttatagattacagaaacatatcaatatttgttgagacaagcaaggctgtacagcctggatttttaacatcaacacttcgaggaatcagttcacagaggattctagagtaccagagagaaataaaaaaggttaatttcatctctctctcatagttgatgctgccatgtgcatattacattcagaattagcttcgtgggttacattgccaggaaaagagagtgagaaatacataaatatttagtatctgcaccttcagttaattttgtgagcacatgattcaggtttaactgcttggtacatttttccaggaagataaccatttttctcctggcatttagtacgaaacattggcaatatcttgaatcacctagttgttttcagttattttgcaattttggcatgttatacatatgatattttggcacgttatagttttataggcatgttatacatatgatattttggcacgtttgtcttaactagtaaaacctgaaattttgtttcaggtaaaacattattttgagtatgaagatccaaacggaccagtgaatcagatatggcaccaagtttcttcaaaggcaccattgatcaagctgttgattaaccgcgataaacgcctagttgaaagaggtaccaatggaacagattgctcgtgcatctgttcgaccacgaaggaacttctacgtaaataagatggttctcatctcctggacgaacccaagttttgtggacgacccttctgattgagtacagtacctgaattttggctgacgctgagctctgtaactatgtgcagcgaggatcctaacaatttgttttgattgctaagcgcccatttcctgctgatttttcttcaattttcagtagatattagaatgttgtgaacaatataacaccactggtgcccctggctaaagcagaagtatatcattgttttcttttgtacgtgtgacttatatacatcctacattcctttttctcccaaggatgttaccctcaagtttacatgcctctgtgttacccaatcgaattgtgcaaggtacttgtatacatagaagcaacagagacagagggcctcatggaggctggagtgtgacggagagccacaaagccccatgagcagctgacactgctcggtgtgcttcggcgtgcgagaagccgtcgagcaccgagaactactccgaatgtgtgaagagaaattatggaaaagattaatatgattttttttaaaacaacttttctatagaaacattttagcatcgtttagcaggttagggagggtgaacgtggaaatcgaatactttctcttctgtcattcaaatgaacgcactcttagttattcataaaatatatgaataagataatttagttaacaccattcaataataattgtcagactaaaaacatgtaataattacaattttacaacttttagcacagagaaaatttagaaaaaaagcaagagttcaaataaaaatacaatttaaaagaactgcaatttgaaataaagaataaaataagaatacatctaatccaacataagattaactaaaattcagaataaaaaataaaataaattctgaacttagttttttcaacatgaatctatccaaaaatcagaatcaaaaggatcattaaaacttgaaacaaaaatatataataaaaataaactagtaaagacaacttaccaagaaatacaattctataaatatccaaaagtaagattaaatacaatttggaataaaaataaataaattccaaaactggatcagataaaaagaaaaataagagttcaattagaaatataatttgtatacaaatgcataagttatagatcatgcatgctcaaagtaattttagtgataaaacaacttaaagaaatgataattacataatttttttaataagtcgaatggcaaaacttatgtccaaaattaacagtgttatttattaaaaaaatggagatattatttaagagttttcccacctagaaactagcgacaattttttttagcaatttccttcgtgtaaactagccacctccgtggtagaacggtcacgtacgtaatgaaatgcgtgatgagccttggcgtgtggtgtattgtaccgtgtacatgtccgtcgcctcgttttttaaaagatatatatatatatacgatttaaatcttacaatttttggcgttccttccggtacgtcctccgcgccttgttattacaggctctgcctgtacatacgtacgtgttggtatggacatggccgcagccgctgccgtctggttctccgccatagccgccgtccttctggcggccagcaccatcgccgtggtggtggtggcgaagatgacggggaagagaaacggcggtgcggctgcagcggcggcggcggcggcggaggcggagctgccactcccgccggtggtgagcggcgtttccctgataattccggtgatcaccaggggccccatggctgtggccgacgagctgtacgtgaagctggggagcgtcttcacggtgagcttcctcggggtggtgaaggcgaccttcctcgtcgggccggaggtgcagggcggcttctactcgcggccggagtcggaggtccaccagggcggcacgtacaggatgacggtgcccatgtttgggagaggggtcatgtacgacgtcgacgtggccacgaggtcggagcagatcgccgtctgcttcgaggcgcttaggccgaccaagctcaggagcagcacggtgaccatggttcgtgaaaccgaggtgtgtacgtatacagtacctccgtttttcatttgatgatatcgttaacttttaggtatgtttgactattcgttttatttgaaaaaaatatgtaattattatttattttgctatgagttattttatcactaaaagtattttaagcactttttatgtcatacatttgcataaaattttaaataaaacaaatggtcaaatatgtatctaaatgtcaatgcgtcatctattaaaaatagagggattatgctttgccgctcctcttcgtatgacttttttgtgactttttgatgctggttattagaggggttagaccaaggttttaaatctctgtttataactatcgatatttcttcgatgataactgtttgagtaggatatagttatttgctcttatttatctcaccattagtcgtttgaaaggtcgagtgctcaatatcttaacccttttaccttttttgaaaaacactaggctagatagatgccatatcggattgaggggttattattggagatttggaggggcattttttttagttattttttttctaaattttttggatggtgaggctatatgaggtgctcttgaagatgctctccctttatgtccgagtgattgaattgtataatttgcaacacacaagcttgcttttacagaactcatggacttctttacttatatcgtataattcgcaggaatatttcgcgaaatggggagagcaaggcacggtggatctgaaacgcgagctcgacctcctcatcctgacgatcgcgagccgcgtcctcctcggcaaggaggttagggagaccatgttcgccgacgtcgtggcatccttccacgagctcatggacaacagcatgcacctcatcagcctctgcttccccaacctcccgatcccgcggcaccgccggcgcgacacggcgtccgctaggctcaaggagctcttctcccgtgccatccagcttcgccgcggctccggccgcgccgaggacgacgtgctccagcggttcttggagtccaggtacagggacggccgcgccatgtccgacaacgagatcaccggcatgctcatcgccctggtcgtcgccggccagcacatgagctccagcgcgagcacctggaccggggcgttcctcctccgcgaccccaagcacctggccgccgccgtcgacgagcagcggcggctcatcggtgacgaccgcgtcgactacgacgcgctgacgacggggatgagcacgctccaccgctgcatcaaggaggcgctccggatgcacccgccggcgccggcgctcgtccgcaccgtgcgcaggggcttcgccgtgtggaccagggaagggaaggagtacaggatgccggcagggcacagcgtcgtgtcgtatgccgcgttcaaccaccgcctcggctacgtgtaccgcgaccccgacgagtacgacccggagcggttcggcccggagaggaaggaggacagggtcgccggcaagttctccttcacggcgttcgggggcgggaggcacgcgtgcctcggcgagcactacgcgttcctgaagatgaaggtaatatggagctatttgctgaggaattttgagcttgagctggtctcgcctttccccgaggttgaactcaacaacataatgctagggccgcgaggggaagtgatggttagatacaagagacggaagctgacaagcacctagtgcattaagtcgtaattacagtcaaaattatttgagagcagacgtactctttactactacctccgtctcaaataagtgcagccatggtattcgtatttaatatttgatcgttcgttttatctaaataaataaataaataaatataaaaaaatagtcacgcataaaatacaattcatgttttatcatctaagagtaacaacaataaaaatactaatcataaatattttaaaaataagacgaatagtcaaacgttgaatatgaacaacataaaactacatttattttgaacaacataaaactatatttattttggaacggagtgagtactttcagtcataaatactgtaactgagagtctcttccatgatggaacgtgttttgcagtgtgttttgcgtgcatatgtagtgtgatgtataagtaaatctttgagatagcaaataaaagaacaagcaagttctcacgacgaatttagtcagaacttcagagatggacagtgctgcacctcaatcagcaaaattgggatatatgcacctcggtggaggagtggtggtacctatactctcgcacaaactgccaaaccaaacaaaggccctagaatccttgataatcctcatctcttgggagctttggtgcgagcgcaatgtaagaatcagtagtaggccccagcagcagtgactgcaaagataaaataagaaataaccgcttgggtccatgtaggggtgtctagtctgcaagtgtttaccgttctaggagaagtcccataatatgctctcttttacggtcttcgtgttgcaaaggtcctatacatatttatttttcatatatcttctgctctattaatatataagagccaaaatttttgctctctttttttttttaaaggaacaagcgagaaaacatcgttactgtagttgcacagcgcgtgcgatttctccacaggaaggtgaccttcttggttggacctgaagaatcgagccatttcttcacagggttggattcagagatcagccaggacgaggtttcccggttcatcattccaacctttggctcatgagtggccttcgatgcgagcaggaccagccctaggggggtcaggccgtgcggccgcccgaggcccctaaaatctagggcccctatacacatatagtatatatatactatgtattgtataattttaattcatagaccataggcttatattaagttagacagctgaataacccaattcagaaaatgaattttagtctatcgccaggcatgtttcagcgaagccgaagcgatattcatctgactcccgtcgcttcgcctcgatcacatcacgccagtcgcgtcgcgccgccttgatcacatcacgctactcgctgctattgcgctcgcggcaacttctcggtcgcgtaaatggaaacggcaagtggacacagcaaatcgtagctcgccagtagccacactcatgtcaataaggacctccatataagtttttgccctgggccccaaaaccccaggaccagccctggatgcgggttatgccacgcagtaagagcagttccggttctttggtgatacaatgaagccgaccaagctgaggagttatgtaagtcacatggtttacgaagtggaggtatgcaaaaaaaaaaaaatcctactccgtttatcttaaaacgcagcaagttttagtctttgacacaggtattaaggagagggtcgagtaaaaaacatggttaccttctcggggtaggtaattagttgtggatataataaagccaaggaatagtaacagtagataaaaagagttacatattatgatagtttgtgaaataataaatctagtaacatcaattttacatgattgatctttttaattttttttgctattaatagttaaatttgaaaatagttgacttagcattattcaaagatacttttattttaggacgaaggacgaagggtttacgtcgtttctaaagttgtgaggagtacctttttatagttagtggaaagtcatatggctcaattatcaatcttgtttttttttttgaagaaggaaaatcgggcccgaaagccatacagctgcatggttaattgcaggaaaaccggttaaaacccaccgctacataactaataacgacggcggagcccaattgcaggttgtcgccaccaaactaaacacaaaagcaacacaacagcccccacatcgcagaagatgtgttatcgttgccgagttagccgcccaagcgacctagcagcaccgactccacaaccgcagcgatactgaagccacgaaagtcgccacagcgaaaagtagctccgacatccaataatggacatcagccaagctaccgaggagcaacttccttcacacggccaacaccagaactccttggaagagactgcaacatgtcatcgttgccgagcgttgccgcaccccatcagcgagtagcttcgacttcatcagtagaaacaaccgaagagcatgtcgcccaccacaagaaagaagcggacccaagaagacgaaggcctcgccgaacactaaggtatgaaagcttttgaaccgaaaaagaccatcgacagtcgtcgatgcgttggagcttcggacaatgcgtgcgacgcccccaaggagaacatgacgatcaatcttgcttgatcttatataacttatcataagtgtttaaataggctctagaaaatttatgaatcctgcgaaacaaatgcaacgtctatattcaggggcggatgcaggcctatgacagttatgatttgagccctagacttgtctccaaaagtaagcttatatttctcaaatcagcatgtaaattttaaaagagaatcttaacagtccattggttagaccagagcttagtcccaagtctttagtagtttctagctccgtcactatgtgcaggagcatgnnccgacagggaccngggggggggggcgggtccgacgcacggacggtcccatctccaaacccctcctgcacatagcagtgatgatagtcgtaacgctcatcgccactaggtgcctgttcggcgaggtccggtcgaagatgctcggcgaggtcccgacgctcctccgcgagctcaatgacagcatgcgtctcatcaccatcgtgttcccgtacctcccgatcccggcgcaccgccggcgagacagtgcgcgcgccaggctcggcgagatcttcgtcgagatcgtgaggtcccgcaggagcagccccggcggtggcggagccggccacgacgacatgctgcagtgcctcatcgacgccaggtacaaggacggccgcgccacgacggagggcaggcggaggtcgccgggatgctcgtatcggcgctcttcgcggggcagtacacgagctccagcaccagcacgtggaccggcgcgcgcgcctcctcacccaccccgagcacctccgcgccgccgtgcgggagcaggaggagctcgtactcgtgcggcaccggcacggcggcgacgtcgtcgaccacgatgccctgcagcggatgggccacctccaccgctgcgtcaaggagaccctgcgtctccacccgccgtcgctgatgctgctccgccacgcgcgccggagcttcgtcgtgagggccagggggagcggcgatgccgagtacgaggtcccagcagggcacacggtggcgagcccgatggtgatccacaacgcgctgccacacgtgtatgaggacgccgggtcgttcgacccgggcaggttcggccccgcgagggaagagtacagggcgtacgccgccgaccacgcgtacacggtatttggcggcggccggcacgcctgcgtcggcgaggcgttatcaaggtgatctggagccatctgctgaggaacttcgagttggagctcatgttgccgttcccggagacggactggaacgacgtcatgccagggcccaagggaaaggtgatggtactccctccgtcacataataagataataagcgtaatcgtgggttttagtgtccaactttgatcattcgtcttatttaaaatatttttataattaacatttttattgttattagatgattaaatatgaatagtactttgtgcgtgacttaacttttaaaatttttataaatttttcaaataagacggatggtcaaacgttaggcacggaaacttatagctgcacttataatgggacggacggagagtaagctacaagagaaggaagttgcagacaaaagaacgaacatttcatagaagctactacaccttatcattcaaaacatttgatataattgcctgtgcttgcctaagtgttcaaatcgttgggatatatagttaacccttcccttaggatgtcccgaacaaacaaatgctcgttcggtaatgaatatgccgagttagagagtacgataactacaaatggcacacaggtggaatcaactggttaaacatctcaatttccaaatgcctctagttcttgagttgagtgtttccagtaagcaaatctgctgtcaaaaagtgacaatgggtagtcaggtcaacacaattgtacatgcctgtagcaccaacactgcagccctgttgaaaagaatatatatctacaatgccaccattttatccccccaactaatttttgggcaaaattcaacaatatactactagccatattgtcgcccattaaactcatgaatttcttctgtatatgtattctaacccaaaatgaagctcttcgtcagaacttcaacccgctacaaactataaaacatcaaggcaatgaagacagtaacggttaaggattctctcaacaagagagttgggttcaggaaccagcgaagaagtaatgctgttccagaggtggaaagtagtagagtcatttacaatcctagaaaacagagcatcatgttgggctctttcatccgtgctatctgcttctgagaagtacctgcagtacatggatatcataatgagagtgcatattgcaaatttgtagccacacatctaaagagtcaacaattacttgaacaacaaaaatatgtgaaaggttgacttttaagttacttgaacaacaaatatatgtaataggttgagttttaagagggctggggtgcatctggtttatctctagtactgtaaaagcggtgtagttgtcctccccaacaatcgcacctcccccacataaaaaaaaccaccccacccaaaaaactagtgttcccatgcgaaaattgacccatcagaaaaaccggatacaaaaaaccgaacccggtaaaaccattcagccatcttcctgagttccttcagatcaatggcatgacactaataggttgaacttggctagtgaatagagttcagtttttcttttaaaaatgctcatgcgctacgtcaacaatgtcgcaaaaggagcagagcatccagtgcagccactacggcttgatgtgggaagggagagcttgacccaccaacacaagcttcaaggctgcctgtgttgacctatgtacacaggaaatcaagttgcagttcattaaattgaattgacaatttgaacattctatgactattacagtttaattttggttagttcaaatcaatggttacattcaactcagttcaaggactgttgtaatgcaggtgaacgatcatagctctaggtaacactaactggcaaccagaacaagtgtcaaagcaaaacttccctggaattgagaggcactataatctggtgagaggtggctgtaatagaggtgtttgatggccacctcatagagtttggaaatggttgaagggggaaaaacagcatgttacaggcaagagctaatagcaatgacaagaggattagaaacaggtccaggtttggtttgtgcatctctcagtaaaactagttaacatgtgatagcatggtgacaaagtgcaaggggcttgcactgaatatcactgcaacaatgacaagctcgtgagccttgacctcccctctctgtgtctgcctcatagtgattttcttttagttatcttaaaatgaaacattgcagtcggaagagttcaccttgcggcttgggaagttgagatggaactttgatgtaccaacaaacaatcttaaaatttaatactgaatatcaatttcaaatagttaaattgaagcaaacaaattcagcataccttgtaatatctgttgagcttatgggataaaatgcaacagaaggttcaaactttatgtcaagatgcccactgttgtcatctgctttgtcggacatatttctgattactcttgtcataagttcagcaccattccactgcaagagttcatcatcatatgttgaatgaaattccttcaggcactccgctaagaaagggctgcaattaacataagttaggtgaaaaatacatgattgctatgattagttatgcataagcatatatatacgcctgcaaagttataatcaacaaaaagaaaccaagatgagatataaaccttgtgtacttgagacctagttatttatacccattatattttgtgatacttctagaatactgttcatgatccatatactaattcatagtacaactgtaacaaaagaaacaaaccaaaataatagcagcaacatgtttttttcccttttttttcctaaaattaaataaaacactaaaagatagtaatggactttatctgtctgttgg

SEQ ID NO: 70677 - DNA, 11251 bp, Oryza sativa
attagaagatcaggacctattgcctcatcagagtcagtctcaacgactacatatgccattaggaataccaaatgatgacaattaattgcaacaactgctgccaactaagctatgattattttgacgaaaggaaaagctatgtcaactttgtgtcgatggttgaaacacttcaagctacagttgatgaaatagttcatcgtaccttgttcgatcaatctggagttttgacggatatattgcaaaattcgatcaaaaggatagttgatgagttaattgtccaaagacgccagctcgggtggcagattgaagaacaacaacaatatcggctcggggggaaaacatatcagtatcagcatgatgaggcatatcaacaatatcggccagaaggaattcaaagacatcagtgtggaggacatttggccaatagaattgcaaagataatagaggagtagtttggattcaagcctaaagaacatacttcagtgtatcagctaccatatcctgagtggtttgatagggttccatttccacaccgatacaaggttctagacttgtccaagttttcaaggcaagacgatatatctacaatggaacatgtcagccgattcttagcacaatgtgaggaggcatcggctgaagaaactctgaaagttagatttttccgattatccttgactagatcggccttcacatggttttcttctttaccatcaaattctatcaaaggttgggccgatctagaaaagcaatttcatacatacttcttcgctcgcatcgatgagatgaaactttcagatttgatatcagttcagcagcaggaaggagaatcggttatggaatatattcacagatttcgtaatgtccgcaaccgatgttatagtttaagtctaagcgatgagcagctagcagatcttgcgttccaagggctatcaacacctatcagagaaagattcttttgccatgagtttgacagcttagcttatctaatgcagacagtatcggctcatgaaagccgattggaagaagcaaaggaagatcaattttggaggtaccaagatcggacagaagataattttgaagcatgagacctcatactcaaaaattggggggcatgtgttaacgccaaaatttggtaagcccgaagtcaccatcggcctagagtcagtgtcggcttcagagtcctgggatcggccgatgagagttatcaaatcgcccgttgtcggattcttactatattcggttaaggaaattaatctactaaaggaagcttatccagaagtgatcgaattcaaggaggatgcggcatggcgagttatctattaattaggaatagtttgttagtttccttttatccttaggaaagtgtgtttagtgtcctataaggactttatgtttttatttttttaggaaagtttctttcttgtcctacaaggactagtatcttaccatgggtataaatatgtacacccggggtcattgtacaaatatctctcgatcaatacaactactctcggcccatcgccaccctcttttttgaggttttttcttattcaaccggcggaatttggcacctgacgcggggctatatcggttcagttcgatctccggcgaaggggtaagtcctacgttccgccggccctggcgaatctatcggctgcgttggtgttgttcaaggctgcatcgctttgatctcctggatcgctctggtttggttgatatatttgcctacctgatatctcaattctatctctaattgcattgtgtttagagacgcatcagtttagttgggactgtctcagttaggtccgatcttctgtcttagccgatatatctctacaatcacaatgttgttctaaatagatttgttttatccatcacattagacagatctatcggctcatcgagtattagattatcgtatataatctcgtgctgtatcggttaggttcgacctactatattgttgttgataatataaatcttgttgaactgataggttcatgctttatcggggtgctagccgataagttatctggatgttgcatcggcttataaggattacatataagttgggtttagccaatcgcaacaaatgttacactgtttaatctaatcttgtggattttacgacatcggacctgcagccgatgtatgctttaaccgtcggatcagtgcttattctatcatgtcaatgtcagccgattggtttatactggattaaattgttgctttcttgcattatcatcagccgattgcctttatgtcaatatctacattggacatatagccgattgctcaaaatcctatcgctatcggctggtatcggcatcggttggaattaatacatcggcttgtcagccgatcggcacattgatctgctatttgtatatcttatcagttgtagggtcaaactgactggtatgcccacatctcaccaacatttggtcctgcactggagctatgcagatctccctggccagtgtgtgttttttcgcgtcaacacattttttatcaaatgcttactgctgcaataggtcattggcccccatacagcaagctgaatatgccctcactctaacatcgattgtcacattgctttgattagatatacaaattaaattgtaccaaagtacccctaataacaaaagggttggctaaatcggtcctatattacaccatacattacattagaagagaagatatgaaattacctctccatcatatattataaccatagtcaaatagcaaggagatgggggtcgacaagacagagcagtgggcagctacaaacagcaatgggtggagatctctgcagccagtcggcctccctttgcaccccagctgcgggccgcccttcactagagagccaagtcgcacataggcctccctctgtccaaccccaccccttccttcctctgttcctgcgatcggacgagctccgaatgcgctcacgcccgcaccagccaacttccctctgagctcgtgcgcactgagctccatccatgcccgcaccggctgagctccctccgccctgtgcccacacctggcagagctccgtccgccttcgcgaccgtgcacctagcatagctccatgccggcgaccgcacactgcatcttgctccgcgccgcgacctccctcccggccacacgctgagccaccaacacttcgctcaccttctgctcgcctactgcccaaagcctagcttcgtcaagtctaatatgggatgacggaagcagtggcgaatctatgatgaaaatgtaggtggggttttatttatcatcgtaatataaaataatcatatatctttgatctatatcaacaatatttgaaaatcctacacggatagaaaaaaatacagtggattaaagaatgaagggaactgaagagtgaaaaagattaaaagatatatatagggatgggctacacactgacagctactaaaacacgaaagtaaaagtaatccacatcgtttctttcaccctgaacatctccagccaaatatagtcatcatcggttggctgtttgctgtaattaattttgttggcactatgaactcactagtcactacacatagacatagatatctgggatcaatccctgtcagccagagctggggctggagcctcaaccagccccaacagtggattcgccacaaccagccccaacattggattcgccactggacggaagggggaggaattagaatccacccactcctatgttatttcctaggagcatttcagtctttcatcctgaaaatgacatacacccctaaagcttggtttggaaagggtcagtcggcaggtttggtattttaaaccggggttaaataaccaaagtttaaaagcagggctaaactcatagttaggttttaaaataggtacaatggtgccattgcccctactaattatgaaattaaggattacgtgaccaaggaaatctaaaattaccatgacttaactttgtctttaaataatattgttcatatgtccttaaatgttttccatctatctatctataagtttactaatttgactctgaataagctcctaagttaatcataaatatcttacgatcaattagtttgatcgaatgatcatggccttagatagtcaaattcgtataaaataaaaatatataccttcaaagataacaccaattgaaaacctatgcatacggtttaatttgaattgaaaacctgtccagaccgaaaaatcatgtataactttgtcaaggttggccaaactaggtatacgtagtcataagccaattaattgctatagaactagatctttgtctgaatcaatatcaactatatcaactattcctaattaatcttagtgataggtatgaaagattaatctatctgctttttatttagaatgacttgaccgaattcatttgtgttaactaaatataccactgaaaatttcaaactattcagattttttatatatgccgatacaattaagaaaaacaactaatatttttactaaatggttaaatttttaatatattataacattcacaataatagtccatgtaatacttagtctggctactaatataaataatgtatctatacaaatagcccgtgtaaatacatgggtttctgatgcttctactttggtagtacactcacaatattcttgaatagatgttactctaggatatgtgtaggcagaaattgaaatgtttaataaatattgtacaggaaaatattaaggtttgagacatagatatgtaaaatagatatttatatatttataaatatagctactcacttctagaaatcggcaataagaaaaaggggtggcatacgaaatctaaaagtggataagtaaatggaataatgatttagacatgcttaaaccttgtcgacaagaagtaatactctactcctgattggggattgtatccgtcgagtgtgtattgatttgacaatcgagtacgttgtgaatatgctctttgagggctccctgtccaccttatataggatcgagggcatggttacaaagaggaaagcttagccgaacatgagattggtttccatgccgtgggaaagaagggaacataattctcatgtcttaaagaaattacgtaatacatggatccagctcacctcctatctctctttttagtagtcttttttaatgttgatttgagaaaaaataatgatggaaaagatgcatgtcactactacagaaaatctcataggttgggaatgggctataggtgccagtttcccaaccggcacagattggtcggtacctattctcgaaattattggtgcgggttgtagagccggcacctatgaggcatatggaaaaaaaaaagagaaagaaacgccaccagtctccgccaccctgccgcccgccatgcgtctcgccttccgccaccgccgctgtaggccatgtgtgcggccacttcactaccttctcaaccaccaccatcccatccaatatcacatcatccccatccaaaaatcaacagcaaactactaaacaagatggacatggaggaggagaaagcaatggagaactcaagaagtcaccacctcaccgaacgccacatcgctcgtgccagcctccaccgccgccgttgccaccgccgtcgcgggatccggcggttgccgccggccaccgcctcgctgccttgccacctctccacgcgtgcgccggccgccaccacccgggcctgcctccgcgtcctccgtcggccgccgcaaccacctcgccacgcctgcgccggcctccgcgtcagccgccacccgggcctgctgccgctcctccatcgaccgccaccactcctccgtcagctgccgcgccgttcgataggtaaggggagaggaggggcgaaggaggagaaataagaggcggaagatgtggataagagaaacgataaggtcgttgtggataagaaggagctgcgaggttgcattatatgctccggtttttttaataggtgccggtttttcaacagagccgacacctatgcttatattatatgtgccagttttctttagaaccgacacctataatataagagtaggtgtcggttctattaaaaaaccactacctacagtattggtgctggtttttctctagaatcaacacctatattaattaaaggtgtcggttctatatttttttcatcgtgtggaggtgggaaaaggctcataggtgccggttttaaatgaaccggcacgtataaggccggttcctattagggtttttgtagcagtgtgtattgattagtgcttgtaatacttctactcgatccctctatgacggaaaaagtctagtacagaagatggatgtaagttcagattcatctatggaattgaatactctctccattttaaaacgtttgacaccgttgacttttagtacgtgtttgaccattcgtcttattcaaaaatttaagtaattatttattcttttcatatcatttgattcattgttaaatatacttcatgtacacatatagttttacatatttcacaaatttttttaataagatgaacggtcaaacatgtgctaaaaagtcaacggtgtcaaatattttgaaacggagggagtatttttttacgtagggaagtacatggagtctccttactgaacatatggaactcaattcctgattgaacggtactggcatgaacggtagaacgggacagtagggataaggatcaggaagttcggcagagatgtttccacgagtttagtacggtagtattgttgatccacatcactaggcaccggaatttctgcccggtcattctcctccacacaagagcatacaatttctccggaaaggacccggaccagtagagattgagttggcgtgtagctcttgcctctcaaactctcccaatcgttgtacttagctcaggtacaggcactgtatttgtgtctctcatactctcacaatcatcgtattaattagcacaggtacaggcatactgtacgttcttgttctggaagacacgtgctttaggtttatcatgcacttgccagctggttcggtagagcagtagccaacggcaacttccttcttatcacgagcacgtctcctgtatgtttttcgaaaataacaattatgaagaagttcttttcaaataccaaatgaactattttttaaaaattttactagttaatacttagttagtttgcctcgtttcatatatcaccgacttatcaaatcctactgctctatcgaactaagggcatcagcaatgtatcgtttaccaactaccactactacaaaactgcatacagaggtcggcgctaaagttgctagaagtgttaaaacctgcacttataggtcttctcccactttcgcggccttagaaaacagaaaacaacacctttaaatgattataggtgccggttttgtttaaaaaccgacactatactacatgtgctatgttttattaagaaaaccggcacccccataaaatcgaggcgagccgaactccacacattgcgcgtaccctctcctccttatctccgagccggccttatcctcaacctctctcaccctctctcttcctcctcctcctcctcaacctcgctctctctctccccctcccccctctctctctctgtctcgcgggagaggacacaagagccagtaggcgatggcccagcaatggtggtggccccctcccctccgctagatccggtgagaggggaggcaccggcagcccgacgggaagggaggcgatggttgccaagaagggaggaagagaggcgcattcaccgagcggtctccccgtacgcctccgactcgttctgtcggtgctctgtctccctctctcagctctctctctctctctctctccctctccctctctctctcggtccctttcaactgtctcccgctttcagcctctctccagcagcccggcggtgttgctgtctcttccgctagatccggcgggaggtgaggtggtggcgacggttcggcggtggcctggcattggcgccctcccctcctggcggcggggctctgcgggacaacgtcggcagcatccgcagcgacggagcatcggcggcggggcctcccactgcggatccgacgttatcagtagttaatttaatcatttgtgttcatcttgtgcatggtgtcaatccgtgttcatttgttcatatattaatctgtgttcatttgttcaccttgtccatggtgtcgaagtatcgactcgagccgggttccttttttgtagctcgtggattccactttggtgccggtttttaaatgggattggtgccggtgcactcatcactgccgcctctatggtgccggtcggcacctatgtgggtttaccaaccagcacctttgatgttttgtgttgtagtttactatctcagtttcatattataactcattttgacttttttagtataatttcttttaaacttgataagctttagaaaaatgtaacaatattttaagcacaaaacaaatatattatcaaaatatatttaatatttctttcaattaaactaatttggtattgtagatgttgctaaatttttctataaacttagtccaaattaaaaaaaattaaaaagaagtcaaggcgacttataatatgaaaataaggtgggttctaacaaaaaataggaaattgtttttcaaaatctcacaatgtgtaggggaaaatatggtcacaccgaaaagtgtgttacaatctaacagtgtgtaataacatattaagaaagaatcaacacacatagctaagagaattcattctttgttatttcttgccagtaggttgtagtgctatttcatgatattcgttcataatgtttattatttggtataaaaaatgtatttaacacttattgcaccctcgttataaaagtgtttattttttacatattccacgtactagaacaaaaccaaaaacaaccataatactcttactttttcaaatcccaatgcaattattccttgctaaggaagtaaatgtttttttgttccttgttaggaggttgtagtgctattgcctgataaatgttgcttagtacctccacaatgtttgtcgcttactacaccctcgtctgaatgcaatatactatctcctaaacagtgcttgtcaatggcaaaatttggcaatttccattagtcaaggccaaatcaaaggtagagttctaagctgaggaagtcatgttagaattggactcagttagtttctttttgctacatattagctgattagagtttgagttggagttgtataagtagtttcttgtttaggatagagtgctaagtcgatccgatcttagtataaccagacttagttttgcctatgggtataatatgtacacacatagggtttttgtaagataacaacagttcaaaacatatttttcggtgcatcgccaaccctattattagttttgacgagttcttgtttttaacatggtagagagctcttacataagggacttatttggcgaatagttgatggaaattcagttgatgtaatcaaggataactgggacaagaggaacagccttctcaaaccacttggttttatcaatgctttactattcatcattctatagttaaaattttacagttttctttaaaaaaataaactgcactaaagcttttattgagatggatggtcaactattatttcaaaactcaacaacttttcgcacatggaaggagtactacataattatgttgcaaataaaggggatacacagctacatatgcatagattaatcttaaaaacactcaataaaatcataatatatatatatatatatatatatagactgcgtgtccttgttcaaaacactaaggcctcctttaatggttgagctagtgcactagcaaaaagtctacctttttaatagattgtctcatagcacattgttcaaaatgctttgggttccacaatccctctcacatttttttaggagcttagctcttgaagaagagatagtgcattctctctccttatcttctctctcttccacatcatacaaaaactgatgtggagatttatgagctagctgactcacccttgttggaggaggcctaagtactaccaacctggagggagtaccgtgtttttttttaaaaaaaaactgcactaaaccatttagtaaaacaaatggccaactattattgcaaagctcaacaactttgtacatatggaggagtacataactttcaaaacggagggagtgggtacgcaatttctccctctaggtagataatacttaccattttggataaaactgatatcaaactttaaaatctttaactaagaataatttctaaaatatttcacttataagtattgagaccatatgtatagatttgtcttaaaaagcacttcaataaattcatatattcgttgatattactatatatatcataatataaaatagttgtcatagttattttttgaacatcatgcgtatccttatccaaaaggataagtactccaatctagaaggagtactgtgttctggttcatctatatattagaggcatggtgctatgcattcgcattcataaatatcaagccaatcggcaatcgctgagatttactagtacttactgtacctgcataaatacataaacacataccatattatggcctcgagtgatactcctacccatgaggaggcactcagttttgagccctcgatatggggcgacttctttatcaactacgaaccacaaccattgcaggcatcaccactactcattcctatgtgtacatctgcccttctaattttaattaatgccatgctaactagctaatagctagctaattcgatggatctatgctataatttcatgcagagatcagagaggtggatgcaggagagggctgagaagctgagagggcaaatccagacactatttgggacctgccacgacatgtcggcgaggatgaacttagtggattccgtccaacatctcggaattgatcacctcttccaagaggagatagaagatgctctaacaagcatccatggcagtgaattcagaagctctagtctctatgagattgctcttcggtttcgcttgcttagggaacatgggttttgggtgtctccaggtatccaaatgcatccatccacctaatatatagataaatagtttattattccgagattaggaatttttgtcttcgagatttgctgaagcttacttttgttcgtttgcgacattatagaaattttttagtctaaaaccatacgacacatgcaa

SEQ ID NO: 70678 - DNA, 9280 bp, Oryza sativa
ccccctaagtcactgagcatgcatgggcaggtgactgaattttagtactagtagatgaatggagtacgtcctaaaataagcgaaatactagtactcgcatgttttctgatgggtactccttggaaatgctgggacctttgacctgcttcctacttgtgtcgtcctcgagcccgcccaagattgcacttgtccacgccgtgcatcgagccagcaacccgagtgatcgaccagtcaaggacgcatcacacatggcgtgtctctctgccttgcggaagcaacaagtgtcagtaggagaaccttgctctgatcatcatcctggaaaaaaataaagcttagctaaacataattaggagatgattcaaaactaagattttcgaacacaaaaaattgataatactcttacttccatacagttgcaagagatggaaaaatttcggcgttggcacttggctttaaagcgttctttgaagcgttgaataaaagctttggaaccacacgtccgacgcacgcccgagccgggggcagtatgggaaggcggaaaccgcaccgagccgcttctcgcgagaggagaacgccacgcgcgccccgtcacggtggaaatgcccgttctacccctgctcctcgtgtgtgtactagcgcccccccgggccccgtctctcgtcacgctgcagacaaggacctactagtcgcgcgtaggccgtgtgacggcgtgacaccaccactgaccaccccctcctctcctcccagttcgtctcctccactcctcctgcatcacctccactcgtcggcggcggcggcggcggcgcggcgcagtgcggtgcctgcgttggaggagagggcgggccgccgagaggtcggcaatggcggccggtgggttggcgtgaggcaggtgggatcggtggtggtggggagggaggagaggtgggaggtgcgggcatggagcgcgggccggcgatggctccggcggcggggacggggtcggggccggggacggtggtggtggggtcggcagcggcgctggcggcgcaggaggagatgcggtggcggcagctggacagcggcgtcagcgcggtgtcgttcgggttcgtggccaccgccatcctcgtctccatgttcctcgccatggccatcctcgagcacttcctccgctccccggcccaccgcggccacgctgggatggggccgccgcccccgcacccgccgccgccgggagggatcctctctcgcctccgcctactcctccaccgccgcggcgccggcgaggccgccttccctggcggctcggatctcgaggcggccaggaagctcgacggcggcgcgtcccccgaggtatggccgcaccggcgcactgctcccgcacgctctcccccccttcccatccatcgctttaatgattccgtcatctcgcccttttcgcagctttcgcttttcgcatcgcatcgtattgccttttcacgcattgtgtctgctcatttgatgacccggttgcgaaacttgtcccgccaccttccttccacatcttccactctctcactaggaagaagcagaagcagggagtgagaagtcaaaccctgacatttttagatttcttgacttgaatatcggttgtgaattcgtagtctctaaactcttttgacgattaggatgatcttgaaagatttgacgattcctcacatataaaagcgaggtgcagcatttgagagcttaagttagatctttccaattccgttcataggtgtacggtcattctgaagaaataggtgttgcagcattgttccaagacaactcattaattagtttggacggcgtgtctgatcacaacaagccatatccatatgtcatgtacgatgagcccgaccagctgcatatgggattcgtcccaatgttactgtagtacattagtatcgatttgtcatctaagatcctgtctggaagcttgggatttggatcctaatccttaggattgcttccaggcgggtctgaagtgttttgctgctttcaataggctatgttggtttgttgtgttgtgaaaagaacgggttaaaagcgttattgttcaagagaggctagattatcaatatcatgcgtaatggacctgagaggggaatatgggagacagcagcaagcagacaagggcccatccctgtctgcagccaccccaaggtctgaatcatcctctggcttgcaatgttagctgtccacagccagaggtctcattcattgctgtttgagaattattagcatttgtggaacatcttgttaagatagatcagcagcagaatttgattgagttataatggtccacatcatagggatcaaaagcactcagtaacttcaattagatgtgaaatgtgcattgtatacttcatataattttgtagacttgtagtgattgctttccttctcttagggacgttaaactttgttgttcaactgctggcatcaactttgctagtttgaagttcattccttgcttgtgcagaatccacacttatgaattccttgctggtgcagaatccacacttatgaactagtactagtgattaggactatgctctattctgtatgctaagttacttcattgtgttgtctacattgagctgatctttttcctatcataggaaactataataatggcttccttctggcatatgcttctgtttttggtagtctagtggtagaaagagcaataggtataatgaaattggtgcactcatagttggcaatcactcccctgaagtggattgccctgctgcatgttgttttctactctattcacaattttttttgtttcctgcttattaagatgctagtgcaaatttgaaatgtttaaatttggactgtgttagaagagggctggcttgtattgtagtgatagaacactagactgaattgcaaaagtccatggtttcgaatccccatacttattcaaaatatagatgtgtattactccctccatttttaatagataacgtcgttcacttttgatcattcaccttagtcaaaaaatttgtatgtgtcatttattttgttgtgacttgttttatcattaggtaaactttaagcatgattcatattttttgtgtatttatatttaataagacgaatggccaaacattatgccaaaagtcaatatcgtcatttattacaaaatggaggtagtacttcctgtgtgctctgttataacaaaggattgccatggaagagataaggtttactatacaattgaatgggcatcaccaatgttaaaaattcactattgccatttaatctgttagcctaccaataaatcattcttgtcactgtattattaaaaaaattacccgagcaactgttacccaatctattccacaaaaagattacctgatctagctgtttagtgtaactgcagtaggagccaccacatacttgaaggatcacctgctaaaaatcatctctctcactacggtgtgaagctagtggaggaaataggaatactgacaatcttttaccattgatttttatttgtgtgcatgcatatgtggtgggtttttttgggtgcggggtgggaggggtaaaaaccagccacttaccactggactactttaattatgcatctgtttcgccttaagtggaaagtatgtggtcatgtgatcgagatttttgatcggttagatctttggggggtgtactagaaaacttgcttactaacccggtcgagaaatatttagatcagcttcatagttgtggatcacaacaaggcttcactagcaacgttccctgttaaatgacatcatgcagctattaaatattctttttcttgatgccaaatctttcacgatagctttaaacatggacaactgattcaagctttcatacaaactagaattctttttagcagcttctgtagtgtggctccaaaattcactcagaactgtgacatggaaatattttataggaaaatgtaggctcccatcggatggcctattcagccaaagaaaaagccaaaatttgaattttcaaacttaattttgacattgattttgaaatattttcaacgtagtttctttttcagcgttggcttttaagtcaccgagaacacatatataaaagttttacctacaaattcatttttattctttaataagccgttttggcttattatgttggcttattacgttttggcttataagatttataaggctattatgttctttagtggtgtatgcttgtggtacttacactgcagactacttcctccgtttcacaatgtaagactttctagcattgctcacattcacttagatgttaatgaatctagacactagattcattaacatctatatgtatgtgggcaatgctagaaagtcttacattatgaaacggagggagtacttactatacagattaaaactctctgcactttgttttttagatttaactatagtgaatctttcacccaattaaaaaatagttgcatgatagaaccgtcatctgctaggcctggcatcttgggagttgggagtccctgcactgatcattccaaagttacggactactaaaacccatctgtgtaactataggagttcctgcattcataggagccatctgtggaacttcttccagcttaaagatctccagtgtagccctggaggtttttctttacctttatagggaatatgcagaaagctttgcatgtcattcccattagatagaaaagagagtttacagcactaaacagtaagcaactgaggactaaagagactcaacagcggcacacagccctgaaaatcaagtttaaatcctgcaaacggatctgaaactttgatgaccctatgtcactccaatccctgagttcttagatggtctgaaaatgaaaagtttttcttcatgtgcatcagttttgctgttgggttttggtaatttcaacttgactggttcctggggaagttccggtatggaatacatgtttgttactcgtttctattactagtatataaaaatgtaaatcgattccattaccaatgctctgtattttgaagttccattaccagtttgtgcatacattgatcatgaaagtgggacatcctcattgactactttgctcacgtgtttcgcagatacctgtttacgccaaaggtgtctcagttttaatgccaggacacgatgtaccaacattcatcgctcatcctgccccagcaccctgccctccagaaagggtccagtggccctcacaccagcccactccttttgctggttcctcatcaaatccgagctagtagcattcaaatgctaaatgccatctgcatcacagcgatccgcaaagtaattcttctgttcttctctggctgtatttcctgcctctccagcagaattcaggcaggttctctccacatatgtacaggtcttgtatctttgttctaaagcaagttctgctgcccctgccgtattgtggcgggcgagcagccggcggatcgatggagttggctaccgatcccacttgctctgctagtgttagatgcctttgttttcgctgtcgatcctacacctttctttgctagatccccaatggagggaaggatggactatacacatcttgtagaaactctgtcggggaatgtgaagctagctgttaaagccattcttgttctgcctggttgttcccatgtgcctgcctcttcctgcttgccagtgacctttgatgctgagaaaaaaaacaggctaatcaaagcatttattttccaaaattttttttccaaaaaacatcacatcgaatttttagacatatgtatagagcattaaatatagataaaaagaaaaactaattacacagtttgcatggaaatcacgagatgaatcttttgagtctaattagtccatgattacccatgagtgctacagtaacccacgtgtgctaatgatagattaattatgcttaataaatttgtctcgcggtttccatacgagttatgaaattagttttttcattcatgtcggaaaaccatttccaacatccagttaaacatccaatgtgacacctacaaaattcttcttttcgcgaactaaacacacccgcttttctcctgaagaattcgcttggatggcctcgtttctccctttcggcaagacggcgattgtagtaacttatctgaaaccggtcaagatcgcgatgtggaccgcacaggctgcagcagtgcaatgcaactgatgaaaagccgttaagcttgccttgtcaggcagtcgccgtccggtggacggtgacagctagccttggtggcaacccggtgtcctcgcgcgcagacaacaaagcggcgctgtcacgatggtgagatggccaccaccaccaccaccacgacacccccccatgcatgcaacgcaaaatccactcgagaaaacttgtgcgattcatccgatgatgagttttttttctcctttttgtggtggctacggcgtcaacatcatgctgagccggcggcgtgtgtgtcattagctgccggatcagcggcggaatctggacgccggcggcgacggcgacaggaggaatccggcagctgttccgttcccaacctgtccgttctcgtgggcctctctctctttgctgcgtttcatgtgccctcatttactcggctcgtattgcacacgtacgctcttgtcgatcaggcgtttcatactttcatttgccttgcttttggacagttaatttattattagtaccactagtagatcaacttggatgatttcttttgctggtgtaccaccaagatgttcagttagtaacagtaccaaattaggcattcatgcacgtgaggacatcgtcgttgtcgatttattttatcagtttcgacatgcgttgctgaggctcagctcgaggtagattggtggcgacactggctgacacggcggcagctacaacggctacttaggcccctatttagtgctcctactaattgtttactcctttcaaaaggggcaccacgttacagtagccgttatcggttagtgctgttgattacttgattagtcaattagtgttgcgtttaacagttgcttaatggaataatggttggtgctcagtgtccagtgtgccgccagaaactgagaaaagcttcggcctttaggctctgttcgttctgaggagataataggggagattgattctcgttttccgcgtgcacgctttttaaactactaaacggtacgttttttgcaaaaaatttctataggaaagttgctttaaaaaatcataataatccatttttgaaatttaaaatagttaatactcaattaatcatgagttaatggctcacctcgttttacgtatctccccaatctcctcgatccccttctcctcgaacacacccttagtcatggaaacgggaggattgtgtgagccttcagcttgctggcatgccaatctcctgcaatgcaagtaggagaaaaaatggataataaattgcgtattgtccttctgttagtgtacaagtacagattactgaggcgacacgaggcagcgtatctgatgcgatgcctattgtagacgcagaaattttgggctctagatcctgggatgacatgatcggaatcataactctaggactaccaaagttcacccctttttttcatgattttatccatacgatgggctaaaaggatgggacaaattctacagcaaaaggcattccttggattccgccgtgaaacaggaataggagggatggagcagtcttgtaccagacgactcctcaacatcattttagtctccaatccatggtcatcagcgtcccaaaaatcaaagggttcatcattcttatacccatggtggtatctcagtaaattgagatgcttctttttttacacagattctatcatgataaatcgcaattcttgtcatttaaagcccaatcacaaaacagatctacagagtaattatgcaaagcgcatagtagtaacaaaaccaaattcaccaattctaaatttatctgtgactatgtctttttttgagggggagtggacatgcctttgcaaggcgcactcatgtttcattgtttcacatggacaaggttgtaaggttaaagggtgtaaaagaaaaagaaaaacaaagctatctgtaaccacgtctttagcaaaagccatggatgtatagtcacactttcattgcctcattcttgttagacagttattttataagttgttagactgtttgtaccatgaacttcacacagatcctaaatctaggcccccctttataacatgagagttcacttgtttttttttttttggaaatcaaataaaccactcaaaaaatgaaaaaaaacatgtgaaatttcttctctgtttttaaaaagaaaatcagagagctacgaagtgaccataacttgttaattccttttggtagaatctactcacttaggttcaagatctaaacttaacatgcgtgattatatatacgtctaattattttttcatcgatagacgatgtatctatcgacacgatatccatggtgactttgtaaatcaaagtgtatattcgcaaacgtcgacaacgagacgttcatagtcacttcgtcaatctcatagagtgtagtgttacgagtgcttacatagattatttttctttcgtttagagcaagtttaatagtatagcccactattggctccaattcgtctatagccgatctaatagccatttcatataatagttgcttactattctattaatatatggtcccacttgtcatacacatattacgtcttggagtccgtgctgcagctggctacagatctgtagcccactacttttttctctcatcttttatctcattaaaatatgtttacagctggctaatagtctgctactgtacctgctcttataccgtattaaaaaaaaaatcagagagctactactatcacaatcttttttgaaaaaaaaaatggtgctgtcacaatcattgctcattcttagcgctggctaagcaggtttaaaagcggctgctttgctgcacttgtctttttccccttccaccccatctccgcctacgcgcacacaagcgtaacagacgctctctcacactctcctcctcactcgccgctcgcttatctccccaatccaatcccctgccgcgcgacggctctgcgagattgcaaggctagtgtagatctgtctctttcctccctcccctttctcccgtcgtctccgttgttctccaccgagcagagcagcaaaatccttagcggccaaggcttccgggctcggtgagaagttttaaacgcattattacgaggggggggggggggggggggg

SEQ ID NO: 70679 - DNA, 7466 bp, Oryza sativa
actatagggcgaattcgagctcggtacccatatttataaaaaatatttataagaaatatttatatcatgactaaaaagttaatttaaagcatgtataagcttttcaagaacaatttcaagattttcgtgcaagataactcaatccttatggccttgaaattgttttatccattagtcctaaaatatagcaattttgtctagatgactagattcatagctcaaatgattaattttaaaacatgggaaatataatatataatagtacaactactccctccgtactcataaaggaagtcgttttggacagcgacacggtctctaaaacataactttgacttcttgtttctataaaaatatttattctaaagtaatatacgtatacttttatgaaagtatttttcaagacaaatctattcatataatttttacattttcaaactcaacaatttgagagttttccatgatttatattcccaaggtttgacttaaacattgtcctaaacgacttcttttatgagtatggagggagtactcactaaataagtcaggggagaaatcaaaatttgcacacatggatcgctacctatattgccatccacatgagtagatctagagaattttgtggtccacactcttgttatgtggattgttatttatgtaaccaaaagcctgagctacctcatatgccatgacaatgatatacatactccatgtcttggaaaagaaaaaaatagcttatctttgtcgacatgttttcagtccattcactaacgccctaatcggttggtccaacctaataacatatcatttgggtaggggtgatgacctttgcactctatcacaggtagaggcctaacagcgaaaaaaaattgattataggcaagctaattaagccatacaatagtctattcagtactccttaattatttgaccacatggcctaagcaatgaccaaagatgatgatggcttgtattgtgtgctctagatggtttgtcccttctcaaatcagtcactagctagcctgcctgttttgttgtgattgtctgtggtgggccattttccttttcaatttctttattagaagctcaagcagccaagctaggagtagtatagatcatatagcatgcccaacttgagtttacaaaattacaactgacaaattatgtgtacattgttggagaaaatatctcccataattacacactgttgaagtagtatagattacaaaattacaattgacaaattgtgtgtaccctgttggagaaaatatctcccataatcacacattgttgaagtactatagattaattgtccatacttgtttatcatttttttaaaaaaaattaaatatgtatatcaatatgataaccgtagcaggggtctcaatttcgaattctggttgatgcaattaaataagcatgcttctgttttacatttctgagattgaaaagcgttcatgggatagagggcacattagcataaataaataaataacttaattttcttgtcagtctaaatatattagatgaactgaagattttgagaagtagctgttgagagagcatggactgtttgggacatcagctgaggattgtatgtacgagacttgcagctgttaaaagtttcctgaatatggcttaataaacctttaaaacaacattttaaaaagtactgatttgatactctaaaatattcattttgaaagtgccataaataaaaatagccgggtgtccgttgcataatactccatcttgtacgtattctagaaccgtctttgtctgtctcagcaacagtaattactacttcagtcaatataagatgctagggtggtgattatttaattattggatcgatggggatgtattagttaataatttccttgtacgattactaggtaaaggtcacgtacgcgcctgattctctatcttaatccttattatactgcctcgccgtttgtttattggaaccctaatggtacaatgattcccctaaaatattcataccaattccactaagcctctactctctttgtttggcctcttctatttgttccaaaataagggtcctttaatttatttattatatgattgataaaaggttttcatagaatttaaatttctatgaaaatttccctctatgtccctttaattcataagaaaagaaataaattttcccatagaattgtatttcttcatatttcatagaaaaaataccgagaggtatgagctatttataatactccatccgtttcatattataagtcgtttgacctttttatagccaaactttgttgagtttgaccaagttgacagaaaaatctagcaacatttaaaatataaaattagtttcattaactctaacatttcatatattttgatactatatttgttttgtattcaaaattattggtgatatggacccgagggtatcatgtctagagggaggagacggcccccaaacccacgtggcacttccccgaggggggttgggcccggggtggagtggcggctgctccctcccagttggaggctaggccaccctaaccccctccacgcacttaccagcatgcgcgggttaggtgggcgcacccaacgcccaactaaccgtatttaaggcgggtgttgcggccgtgccacgccgtatttaatgcggcgtgcaggtgtggctgacaggctgggtgacgctgaattgaccgacgtagcagggtgagtgcgtttgctaaaaaaatgactaggaaaataagtcaaactatttatataaaatgaaatggagggagtattttctttgtttttcccgtagcactattgaaagttctcatcttcttctttcctatgttttttattccttcagaattggagaattcttctattttttttctattcctatgtttttcctatcctagaatcaaagggggcctaaatatcttttttagcaattattatatcaatgtttataaagtgctacattcgtcccaaaataagtgcaacccatggatatccgtgtccaacgtttgaccgtccgtcttatttgaaaattttatgattttttttaaaaaattagtcacatataaaatactatttatgttttatattctaataacaaaaaaaatactaatcataaaaaatttaaataagataaacggtcaaacattggacgtaaatagtgcaaaacattacttattttaggacagatggaatacgtggtaaatgtattaggagtggataaaaagagaaataattttattggaatatgataaattaggggtattctagtttttttttgtgtatatgtacgtgcaagatgagtgaaaaataaatatgacggagggagtagtttcaatgcatggcttgaaagttatagatgctatcctgtatattgcccgacccagatatgtcggccggttgataaagtgtcaacgttcccaattgtaaaaaaaaaaaaaaggaaaaaatattccatttcagctttgttggcctattttgcattgattattcaatttagatcaggtagtggcactcgcattacaagaaacgatggcacatttacgctttcaaacatgagatgcagtggatgcaaaatccagatctgaatactgcatcatcaggtactaccggaatagctttcagttgttaatttattactatctggcagagattataaaatgttgacctgggcatggagattgattcataccgctttgatattcgttgccagctgctactacctttcaaaaaatagattaatttccagttaagtgcatattttattcccaaataggactacatccatcccattataagtgcagtcgtggttttccgcgtccaattttgaccgtccgtcttatttgaaaattttttaaaaaagtttaaaaacataaatcacgagtaaagtactattcatgttttatcatctcataacaacgaaaatactaattataaaatttttttaaataagacgaacgatcaaagttggacgcggaaacttatggttgcacttataatgggacggagggagtaccacttactaagttcccttgtttgtatcctcgctaatgttattcgatctcataactcttagacaaactttagtctctgttagcaagtgaatgctaaaaaaaaatagattgtttgggtataaagagttatgaaaaccacgatgagaaaatggattagatttcatgtttaaaaaacatttttggcatggttggatagttaaaaagagagtaaaatgttcggtttcatagttgatggttcatcctacactcaatgatagttatggtgtgtttgatactttccttttccatcgcctgttctctcatttttttttcgtgagcatgtttttcaacagttaaacgatgtattttttcgtaaaaaagaaaaatatataggaaagttgtttatttttagctaatatttattaatcatgtgttaatgagttattttgttttacgtgtgtgagggagaagtactctttatttagagtatgcaataagccaatatcgttattattagaaagaggatagcatatcagaaagcatagttcctccttatttgccatctagtaggtgtctcatagacatatatgtgacaaataagaaaagaaataaaataatttccacccgtgtataattgatccccatataaacagatcagcctaggggcctaaatttggaaccatagttactgacaaaaaaaaatgagaacacaatacattgcattcaactagctagtcttgcactattaaatattacatttttattgaccaacatcttactactacaatagtagggttagagaactgaaataccacgtgaaacaaatgtagaaagtgggagtagtacgtgcatttgttctttctttttttcaggtaattgcaaaagtatttctgtaaacacaaaagtaacctgctgtaaaacacgcagctcatcgtgcaaaagaggagcacagataatgcaaaacaaatggatgtccacgagatgactaatagagtaatgatggtgatgatgcttgttacttcgaacatgggaaatgaaattggggaaattagtcttcatgattatctaacagaatctacttttaaaagctggaccagcctaattgtctctcctctactaccactttactccaatttaaaatgcctgtttctggatgcaaattcaacccatgatcttctgcatccaagatatagctcatctttagtcaacactgtatttctaaaacaccactacttagggttagtgtctaagcttgaacaagtttgggtataactaaatttatagtcccattatttcgccaatagctatccgtgccctaaatatgaaatacccaatacatgtatactaacttcggtggagtccaccatataccaagttttatacgaaatcaagccttaaacatatgggaaaagtcctggatagacaatataaacttatgtaagttgatgtggtttatgataatttaaatttaaataataatgattcaaatgtaaaagttgttgtggttttatgtaaaagtttggatcatagattaatcatctaagggctaaaacaattgaggtgatatgacttaataagagaagaaattaagggagataatttgaaccatgaataatcatctaaggacaaaaataattgatgtgatatggattaatgagagaagagagagagagagagcacattaacttagttaggagttaggatgaactatataagtatataaaatattataaaaaataatgatacatattgaaatattatgtgaattatgtgagatgataatttaacatgcttacatttgaaaagctataaaaattaataaattataaaattatagataatataacatgcttacatgtttaaatgtaataattgttattggatgatgatgtgatatctttgtatgttaagtttttcgatttagtaggctctaactttataataaaagagaaaatgtccatatattgcaatgggttagtaccaatggtaatgagctgggtgtgaacctaacctaaaccatgtgaatttttaaccaacctttggtttatgtttttatccaaaggattttttattttttatttttatgtgtgagagcgtgttgtgcacgagggaaagggtggacgaacgtcactgcaaaattatgttgtttcgagacggccggataaatattacaaaaaaatcagtaggatagtatttgaacaaagtgctctttctttttaacttaaaataattttgacattacaaactttttaattgtgtaatgaacaaaagtagccctaaatgaacgtagctcaactggctatgtttcttatagtataacttgttcatttgagtttaagttttggacttaacgacagaagacatgtgctcacctttactgctaattatttttttcaatagtttaaaggtcggtttcttttcttcttttttgaataaacttttgcagagcaggttgccggttgtataagtcaaattaactcccagaaattattcgtagttggatgcgttccctggaaagcagagccaagttgttgatatttggtcaataaacactgcaaaatcatgtgtgtttaatttcccataacacactttccctatttttggcctattttatgcccacctagcccctaatcattttaattaatcacaaaaaatatgtttcgttaatgcattttttataacaaggcggctagtatatactacctccgttttttaatagatgacgccgttgactatttctcacatgtttgaccattcgtctgattcaaaaaatttacgtaattataatttattttgttatgagttgttttatcactcatagtactttaagtgtgatttatatcttacacatttgcacaaaatttttgaataagacgaatagtcaaacatgtgagaaaaagttaacagcgtcatctatttaaaaaatggaggtagtagtattaattttgagatctattgctgctacatcctactcctatagggcaagtgagttaagggactctaaagggactgaaaggctgaaattacgataatgaggtctaacaaaagagatgcccaatacttgaaagcctctttcttgtccagttttaattctttatattttatactgagctacttgcttaattaaactaatgccgtgggagacaactcgaggtaagttggttctaatctttttgtgttctttgtgtttactttattggccccaagataatattatatctgggatcatgtttctaggtttaaatttcttaagcctattaaaaaaaacatgggacatggacaagcaaccaggccaatgccgccatccactcgagagattgatcacacaagcttggtgacgcataatttttttattttactattgcaatattttaactttgcatgatgcatgatattattattatgtttaccactagatacaatattggtggtgaggccaattatttatctagggcaagtgcatggcttgtg

SEQ ID NO: 70680 - DNA, 47025 bp, Oryza sativa
ccaagaagagctgcagcaactcaacaggtatgtacatctgacatttattgctcttttttatttcctatgtaaaccaacaaacttgcagataatttcgttacaattttttgctgcagctgggtgaaagagagcaggttggatcagctgcattcgcacggcagaagttggactacttctatttctctgctgctgctaccattttcactcctgaactgtcagatgttcgcattttgtgggccaaaaatggcgtgctgacaacggtcgtcgacgacttcttcgacgttggaggatcaaaagaagaactggaaaacctcgtcgcattagttgagaagtaaaactaatccttaaaacaaattaatgtcttaaccaattctagttcctcaggctaacaaaaatttcagccctgataacgcttgtgatattcatatctaggtgggacaagaatgacaaaactgagtactactctgaacaagtagagattgtgttctctgcaatttatacttcaactaaccagcttggatcaatggcctctgtagtacaaggccgtgatgtcaccaaacaccttgtagaaatagtaagcatcatctctgacatactttggaattattttttttcagaagtgagaactgacaagctaaatatagtggcctctgttaatctgtgtatagtggcaagaattgctgaggtctatgatgacagaggtagagtggaggcagagccggtatgtgccaacagcagaggaatacatggaaaatgcagttgtgacatttgcactgggacccgttgtgctcccagcattgtatcttgttggaccaaagatccctgattctgtcataagaagccaagaatgcagcgagttgttccggctaatgagcaaatgtggccgtctcctgaatgatgtccaatcctacgaggtacagactacagaactactagctgttctgtcgagtttctaagccactgccaaattttaaattttaaattttaactttgtagtttattttaaaggtttttctccgaagcttgttttttcagcattgatttttaaacaatgaaaacagtgtctttctgaagagttgtgcactttctgaagtttgtactagaacttctgaacttgtgcgtcaattcgatctttctgaattctgaagttcccacgatgaatttgagtgtttcacactgtctcatgctgcagagagagggcagccagggcaagctgaacagcgtctctctgcttgccctccacagtggaggctctgtctccatggaagaggctgtgaagcagattcagagacccatcgagaaatgcaggagagagttgctgaagctggtcgtcagcagaggaggcgccgttccaaggccatgcagggagctgttctggagcatgtgcaaggtctgccacttcttctactccggcggcgacgggttcagctcgccgacggcgaaggccggcgcgttggacgcggtgatccacgagccgctgaatctgtcttgttctgtgtgactaactaacgacagaggctggaaatgcagtcaaacttctgtaatcctaaaaggaaagaattgatcttgacatcaaagataatgtcaagttagcatatattatgtagagattcgttgtgttggcgtgaatatcaagttagcatattatgtctcaaataattgggcaaagagagcttgaaaaagctaaagaggaaaaaggcgagagaggagtgactagtgctagtataatactccacatgtgaaggaatcacctttttgcacaagtattagtcgtgtaataatgatcaaaatcatgctaaacagctagttacaaaatctgcagtgctatgtggcctagaggcaaatggaatgactgcccaacaaacttgcaaagaatgtttgcacatcgatctgcatgcacatgcaatgcagcctgttctgctgcatctctgcagtgcaactccttcatagtaggtcgaattggcacttttcatagcctgcagagttcatcaaaaacagcataagagagagaaaatgacttcttagttgcaacaaaaactcagcaagtaggtagtttcaaaaactgaaatttagccaggacagtggacagagcatctgaatgcagagcacctgattcagtgcaatatgttcagtggcaagtgtccttttcttctctgttctagctagcagattgcactaactaaagcagtaaacactataaagtactatacaaaagatttaataaaaaaacattttgtttttgcaaaaaaaaatcatcaacacataacattcctaaataacacaaatccaactacatcaatttcccgtcataaaaaaatataccctaatattttgggttgtgaagaaagaatacgttgagaaggagatggtaataataaatgttattagtccccaaaaatctcttttttttcgttttgcaaaaagattcatcagcccatactactcctttcatcccaaaatatacaacatagtatcggataaagtattagaatatatttcatcttatactagattcctatatgtttcgtggaatgcgatgagaagaagaaaaatgaggaagagagggtaaatccccaaaaatcttttttattttttttgcaaaaataatcatcagcacgtactactcacttcatcccaaaatatgcagcgtagtgttggatggagtaaaatatgttttatcttattctaatcctagattgttatattttgggccgagaagaaggagaaggagaaggagaaggagagggtaaataataaaaaaatggtgttgttattatttacttgggtcacgggtgacgatggtggcggtgccgccgaagtcgcaggtgccaccggcggccttggtcatctgccagtagctgttgaaggcgtaggaggcgtgggcgagcacggtgtcgggcgtgtagcacgccccgctcggctggatcgacccgcactccgcccccgacccgcacgcgtagtccatcgcctcctgcattatcgggtccggcaccgtcggcttcgccacgcaccacagcgcctcccccgcccccggcgccgccggcggcgccagcggcggcgggtacactatcggcggcaagaaccctccccctcctcccccgccgccgctgttcccgcctcctccgctgctcccgcctccaccattgctcccgcctccaccgctactgccgccaccgccaccaccctcgccgccactgccgccgccgccaggcccaccacctacaccaccaccgccaccgccctcgcctccactgccgccacctacaccgccgccgccctcgccgccgctgccgccacctaaaccgccgccgccgggtccggtctcgggagggctgggcacgacgaagatcgggctcggtggggcagacccaggcgtgctcggggtgaagccaggcgtggacgacgcaggcgggctcggctcgaacgacggtggcgtgaagccgccgatggggggcagcggcgggggctggtcgtccggggcgaacggcgtcgaggcgaagggaggtgtcggcgtcggtgtcgttgtcggggtggaggacgacgggggcgcgttcggagggttgacgcagtacggcgagctcgagccgtcgccggtggcgtcggcgaggctcgccgcgtcgccgtccggcttcgccggagaaggagacgaagaaggcagctgcatcggctccaccgtcctgatgaagttgagcttgtacagcgcgttcagcagcgtgttcctcctgcttcgcctcatcagagctctcgcctctgctccatcaacaacaacaacaaccacacaatcaaatgcacatcaaaaaccaaactaatcactgacattacaacctagctatgaacctaccacactgatatgatccggacagtagcaagaacaccatcatcaaccacactgctactctcccatctctgttcttgcgagccatgtctagctagctgcagctgcactggggccagtagccactgatgcaggaggaggaggaggaagaggaggttgttatagcagaggccgcgacgacgacgacgaagggaaagaacaacaacaagtgtggattggccatgatctcaaaggcacaggggggggggggggggggcgggagaaaaggtcggcggcagcagcagaaagaggaaaaggtgagctcgatcagtgaagtggcagtggagtggagtggaggtgatgatcttgttcttctctcgcgcggccgatcgatcgatcccccttcgctttgtgcagaaaacgtcgtcgcgcggtttctagtagcttttcagtaccagtactagtgattatctccatcactctctcacttcacttggagagattaattagttggagtgtgtgctgtgctatcagtgtgtctttctttgtgtttctttttggtttggacgttttgcctttaatttcttgttgtttaattttggtatctatgctttcttgccactagagcaaaactgagagagagatagagggatatagatgggagaatgtgtggacgacgacgtgtttgtactttggttagcttctgggttagtagcttgctttaagctcaaggaaagcatgcatgaacaacagatcgatgcagtggtgtggcgacgatcgatgctgtgtcgtgttgtagcatctgcatgctgagatggaaggtcgattaggataacatgagatgcgagctaattaagctagcttagctctgtgaaaagttggtgatggcaacgtgtgtgatcgatcatgccaggggtcagggtggttttcttgtttactgattggcttatcagagacgtagggttcatctgagcttaggttgaccaatgttttggatggatggcttggccacctttgccttttcgtttgtgcattttaatgagacacttgccgtggggtttcaggcttgatcagtattccaatcccctacagtctacagacgctttctgagttttttttttttgagggttgggggggggggatgataagcttaggcattcgtgatcatcctgtgtctgctggttaatttgtcaatagcaattgtaaatcaatcacctgttaaaggcgtacagtttgattaagatgtacctaataggctactgaggaggaaagatcaaccgctgtcagaactacaagcatgtccttacataaaaaaaactccagtttgattaagatgtacctagtagcaaaataaattcttttttgctactagctgctatattatcgcaaacacgtttctcaaggtgtgtgttttttttaaaaaaatagtttgcacacacaagtttttttaagaaaaatcaaacaaatttattttttaagtttataatagttaaaaattaattaattgtgatataattgagcattttgtcgggtagggaaacaagaaacgttctccatgggctgtcgccggagtcccgcttcagtgcaaaaggccgtgcagaacgccgcctgcggcctgctgtgacaacccacaccggccgcgtctacttgggccggcgccatcgccatgcgtccgtacaaaacggccgcggatttcgctcgggacgccactaaatcggcccaaaggccgttgattatgctcgggaccccggtaatccacggcccgtgtgggtcgcgtttcaccgaccggtttttgtgtgcgcgcttgctttgcagtgcagtggctgctgttacatcagcgagcggagataactgaactgaacagtaattgcactgcacggaggctgcctgcctgtctggctactgtagacggaaaaaaatatgtagccaaaatttttactcatgagtaatagacttgctagtaaaaattttactcgtgataatatgaacaaatttcagacgtctatttcttaacccaacgttttcaaatttcgaatacatacgtagttttgaccgtatattttgctaggggcatctcgatcgagtggccatccgtcgcatcgggactactactactactagaaaacagatttttacaaatgaccaaaacagatttttctttttttcagacgcccatccatcacgcctgcactttttgttccgatccatcgccggtcttcgctgactaattaacttacgcgctagctatcacaccttaattggtacaggcatatgttaattaatatgcacgctacacgtacaccacgtacagacaacagccgttcgatactttggataagaccatatcgtttcatgcatgaacagtgtccatgtacgtatggctgcttggtgcctgggcaatgcactggcggagttagccatgggacatgggtacgtaagtagagtgggctgaccccatagcttaattttatacattcaccttagaggtctttaaaatttctatatgaatctattcagattcaccttagaagtctttagtgtactaaaatataaagtaagaataatccaccttatgccaagttagttggtatttaacttctgagaatatagaggaactaggtttgtcagcttctagagtttctagtttatttcttaaaatcaaattcaaaatctgaattgctcggggaagatgaagtttttgggagaaactacagctgtacaagatctaatatataggaggcggcagccacaggaggcatacgttacgttgcatgtctcgatcgatcggccggtttaattcgtcagcgaccaaacattcttggcgacgatattatggactattgggccataaagcgcatacgcatgcacgtcgtttccttgctagccaggaggatgaaagccgcaagcgcgcgtaccagtttatcatgcatggactgatcgcttgcaacttgatcaacggatgaccgtttggtatatctatctaatcatcaatagcatattatttgtatgtagaagttatatatgtcgcatatgcatgcatttcatgtcatgtatcttcgttttttaatatatgatagtaccgttgactttttaatcaatatttaaccattcattttatttaaaattttaaataagacgaatgaccaaattaacgtataaaaagataatagcgtcatatattaaaaaataggggagtaattattgaaaagattagcataaatatgtaaaattataataaaattatatgttaagattatagtttatttgataataaaacaagtcacaataaaataaataatatttatatatttttttaataagatgaatgatcaaaacatcatgtgatgtcaaaagttgacagcatcacacattaaaaaataatagaggtagtgtagtactccctctgtcccataatagaagggatattatggattttgtagggatgtaacacatatcctagtactatgaatttggataaagagtctatcaaaattcatagcactagaatatgtcacgttccttcaaaatctcttatacttcgggacggacggagtattagttttgctccagcgtttgccgctgctcacagccaaacacactcgtgcgatcaggtaaaaggaagaaaagagctttgctctttttgactataagactcaagggaacctgttttttacccctcgaggggatgttccctcgttatttgcatgtcactcaaatgattataaaaaaatttaaaaattctgagaagatgtattaacatgcatgtgatatatcactccacaaacatgcaagttcaatgcgatatggagctggtgctgtggtgcatatactcacatgcatgggcggtgtaagtgtaacgctccgcttctcgtgagacgttaaaaaactattttggcaaaatcctattcgcgaaaattttcgttctttgtgtgtgagtctaagttgtgccaaggatctcaattcaatcccattgttccctctcatcgaaatcaaaatcctctgcctcaaatttcctcttccaattcaagtctccaaaatctaattccgaaagtcaatcccttcctttgaatcctcgccaaatacatttccgaatcccaaaatatccaaactcccgttttgtttccttccttgactccttgaacccttgtgtacaaagtatcaaatttagattcaaaacccaaactccaaatctctccaaatcaaaatctttcagcaaaagtctattttgcctcccttgtcgatgggctgattcctctctctcacggcccatcccctcctctcggcccagctctctcgagcgtgcgtcgcacgtgttcgggagcgagagacagcgccgtctcctttctctctctctcggcgtcgcttcccgccgacgccgccccaaaattccggccgcgtcaccgtttcccgcgtgctcgcgcatggtcgaccggcaaggacgccgctcccaccgccttcgcccttcccgcgcgggttcgcgtgtggccaacgccccggtcgccgctgcgacaaaccctggcgccgccagcgtcgtgccctgccgcgctgccgctccgccgctccacgccgctagcttccaaggccgagagaggcagcccctgtctcactcccctctccctcctccttttcccgtttcggcaagggtcaaaccctcctttccctcttcctttcccctttttcccgaccaccgccgatgtcatccatggtcctagccgctcgctccggttcgccgccgctcgccggaacgcctcgcgcgtcgtcggccgtccgatcccgggcgcctcctcctcctcctcctcctcccctttcgcccctgcccacatggccgaccacgtggcagccacctcagccccgggcccgcttgaccgggtcaagtcgcgcccagtcagcatcctccctccgtcttccctcccgtgcacgcggtccacggcaagccgtgcggctgcacgtgggcccgccgccatccgtccacccggcgcgccgcgcccgaaccacgcgcacctgaaaccctagcacccgcccccgcgtgcgccctccccaccgtgaacccgaccaccgccatgtgggtcccgcgcggtggaccgcgtccacccgcgtcggcctctctctccccgcgccccctctcctgggccgcccctcccgcgcccgcgccggcccattaggtccggcccagccgcataaacccctcgggctgcacctaagccgccctaggaagtctatatggcatccctcccttctttttcaagggatttaataaaccctttttcccctattccataaatcaattccttattcccaaaattccataaatcatttccttggtcccgcacgtcagtgacggtcaataatatttttgagaatattatttctataaatttcataaatcaatttctccttgttccacaaatatcttcctttgcccagaaattccaattaaacttccaaaattcatatctctcaatccgtagctctgattgactccgttcaacttccagtatttccataaaattgagatctatttaatggcactactaattagtctaaataggatctttcttttggtcttttgtttaggttttcgattgtttgcgtatagttgcggttaccggattttcgtcgatcgcgggttttctcgaagattcgtgaagcttcgtgcagaccttgagcaaggcaagtcaccctctgaccaattgctcctataattggaaaatcattattattttgtttgcaacttgcattattagaatcacacactcaacttgcttggcctcggtatgcgtgccaaaccgacggacctacccagtagtcgcactaattcatgtaggttgtgctaccctgatttccttgtcgctccacctttgtggtacctcagtatccgtgctatctgagcgcgtataccaaatatcccacatacaccgttgtttgtcgaaaacttgggaaatgggttcgagaagccttgaaaacccgacatgtggtgtcggcgtgtttgaaaataaaatggattgtgaaaactcgcgatgcgggggttgtgcctgtgtggcactgtcccgtattcgcatataaggaccgattcctgtggaaaattcatccgagcatataacaagtgcgaccacacgggtgcaatgggacgcccctggctgagtaattagctaatcgggggagccatgatgccaagagacatgtagattcaacggggtggtgttggggagaaccctcgggcttcctggcacagtatggtctgggacctaatctggtgttagtctgggacccctctcgttggcatatggtgaacctgtgtcggctttcgaaatgccttgtcatgaaagccttaaggtctcccgacgtggctgatctcacgggctgggtgatccgggttagtaatgtcgtgtgggtaaagtgtaccccctctgcagaggttaactaattgttcgaacagccgtgcccgcggtcatgggcggatgtgaggtgtttcctgtagcgtagatttgttttcctgtgctttgtgaaaagttgttgtggtgtgggaatcgttaccagaatcagcctatgtggcagatggatgacctgagtggtcaagaaacgaatctgtgtgattcgggatgtctacgggcatcatagaataggcttcccgagtggaagcggattgttgtgctgctgggcagctggactctgggagtccgagaaaatgaaaaaggctctgggagccgattaatcaagtggaatggctctgggagccgagaagtaatgatctgacccgggaggtcggtacattaccaattgagctgttgaaaaacatctcttaaagtcgaatcgagacgcaagtctcttttcggcccaaacttagaaagaaataaatcacttagtgatttcaaaatgatttcaaaacaaaagatttgcaaaaacaaccttgccgctcttccaagcttgcattaaacacctaagttcccgtgacttgctgagtacgaaagtactcatccttgctctatataaatatatataaatatatatatatatatatatatatatatatatatatatatatatagttcctccgccctgaagctgaagtgaagtgaagattagggtttcgtcctggttcccagctgtcgcctatggtgatgggtgttagttcgttggttccgctgctgctgctgctggtgtttcttcgtccgtgtcgtcggttgcattctcaggctgttctgagctgcaacctaagttaaggtaaataagtcctctatttattataaggattgcaatgattcatatttgtcaccgtgggtaccagcgctatgtcctaggactggtactgagatcgcggtttcgtaggaagcggttcgcgccgtttttcctacgacacactcctgtcaggtgccgttgtacggcggtgccagattggggtgtgacagtaagtgggtcagccgcgaacccacttataggtcaaaataaataggttcgctgcttattttaacctataagtgggtttcgcgggctagccacttacacccctacgaatggccgccgagatgagactttttggttgaatttcagcagcaacgccgactcgatcgatgccagccacaatctatcttcgccacggcgatcgacgtgacacgccaagctctagctagctccatcagtgacggcctctcgccaccatcgatcgatcggtggcctataaatccacacccccacctcgtctccttcccagctcgcatcagctagccaagcccaaagacatcaagagagctctcgatctctcgccatggccgccgccaagaacggccgcattgccctcctcctcgccgcgctcgccctgtccgctcagctcgcgccggccgccgcgacgtggtgcggctccaactgcccgacgacgaagccgcctccgccaccgtgccagccgccaccgccgacgccgacgcccgcgaccccaacgacgccgccgactccgtggactccgccgcctgcaacgccgacgccgccgacgccgactccgtggactccgacgcctgcgacgccgccgccaacgccggcgacgcccgcgactccgacgacgccgccgacgccggcgccggcgccgtcgacgccgacggggaagtgcccggtggacacgctgaagctgctggcgtgcgtggacgcgctgaacgggctggtgcacgcggtggtcggcgccaccgccggcgacacctgctgcccgctgctgtccggcgtcgccgacctcgacgccgcgctctgcctctgcaccgccatcaaggccaaggcgctcggcctcagcctcgtcctccccgtcgccatctccgtgctcgtcaatgactgcggcaagtacgtgccctccgacttccagtgcccatccactgatccaccgtacatataaatcatctcaaataattaatcacacacaccatctctgcatgcatgcgtgcatggatggattaattaattaattaagctattaatacctgcatgagtatagtttatcgcctggctatactatatacatgcataaattatataaaatacatatagtaacgtatgtagcatatatacatgagctctgatcgacttgtgtcatggagacatggaggcatgcatatggagccttggattgtgcattaattgatgtataataatatttgtgtgacatatatatatatatatatatatatatatatatatatatatatatatatatatatatatatatatatacatgtggagtttgtggtatttgcaggtttgttgtggtttgggagatttataatgaaataaagagtgtgtgatatgtatgctatgaaatacaaagtttgatgtgtatgtaccatgtatatgtgtatggttgacaaagcctgtcaactttcctatatataaaacgtacttaaaagaatatgtttcctatttccatgtgttttttcatccattgttcaaaaggagtgcataatattaaaaagcagatctggtttctttcaagttcaaggctacgatggaatggaagaattttacgacaatttcatgaaaattaaactaattcaagtgaatttcctgtaaacttcacgggttccagcttccaaattaaaggagcatgcactaagttgtatatgtacaaagtggatatttccttcgcaaaagaaaggtggatatttcaatcttgatcgaagggatcagactaattaacagagatactctgcaactcaattttgatagttgccacatgcagagttaataaagaaaaaaaatacaagaggccgcacaactcaaggcctgagatggtctttaacatccccattatttcgcttatgtttaagcttataatcaaattttaaattttaaaactaaattttggagttaattttgtggatttttcattcagatcatgtgtgttcagccggtcaggtaagctatgaacaatttttagcttttcttttttaaaaaaagagagagttataagtgggtttgttataatatccttgcaaaaatgaaaagtcaaaattaaatctactcaatggtaaaataacatgtagaatccacatgtgtaccacgttgactaattaagttatcatcttagctaaaaccaagagcaatattgacttgggtaccagtcaatgtatgtagtatgatagcttggcacttaccggcggagcctaggtaataaggtgtagggtcgactgattcataacttttttacattcatattgattcaccttagaagtctttaaattttctatataaatccctttgaatttatagaggaagcaatagtcgtgtagtggtggagtcgtgggtgtataatgtggaaaatctaatatgttgtattctaatgttttctaatatattggatcgaccctctcatggggtatatatatgagtacataggggatagagacttggagtacaatacaagtaagagtaaatttatctctaggattctatctataggactctatcttatctctaggattctatctctaggatatatcttatctctatatttgtatttgactcttatctctaactaacatattatacttctaacattccccctcagtcgtaacgggagcgaagctaacgattgcaactggatttaaaatcttctatttcttcatcttctttaactcaccatcatcaattgcatctctgatggacggtcctccacctggtgcctgcgtccccttctgtgtcgtcccttgactctcctctattccctcccgcagtcatagcgggagtgtcatagacgatagcgatgacacggacgctttgactagagtttccgtcaatgatttttgttgtagacgttcgtcgatgtagctgatcatgtagtagttgtagtcatggtggtcatggtagttgatgtagccgcaaatagccgaaggcgaaaaaaaatatttacgccatggtgtgaagacgaaactgtaattgttagcatcttgcaccttgtagatgtcagatgatgccattggagacgtcttgcatatgtcagaggacgccgttggcgatgaggccaccacttcggttggtccttccgcaccatgtagcggtcatcacaatggtgatgccggattgatgcagtctttgtcgtcatagatgacgtgatcgatgccgtcgtcggtgtcgcggtcgttgccgtcgtagaggacgcggtcgatgtcgtcgataaagcgtcttgcagattaatctgtcagaggacgcgagatgtccatcttcgtggacgagtcggcggcggcatgttaccatgttgatgaagaccataggagtcgatgtagtcgtacaactgatgatgagtattgtccgttgtagatccgaagacatgtgttgttgccgcggagggagtcgatctcggcggccaccggtcgccggccgccacaaattcatgcatgtgaattctcctcgggctcggtgcaccgtactgctgcttgcctgctactgatgtgtgcacgcactagatgcctctctgattcttgctgctcgatatgacgcttgaattggctatacagcttgatggacaatggttgcttccgctcaggaggatcgcttttatgtggctaatgaagaaactaatctaatctaatgctaattaatggaattggcggctgattaggcacttgcttcttcggctaatgattgaagaggctagctaatggcgttgccccagggagataccatttgaaaaatctaatatgttgtattctaatgttttctgatatattggatcgaccctctcatagggtatatataggagtacatagaggatagagacttggagtacaatacaagtaagagtagatttatctctaggattctatctctaggactctatcttatctctaagattctatctctaggatatattttatctctatatttgtatttgactcttatcgctaactaacatctaactaacatcttggcgacgatatcatggactattgggctataagcgcatacgcatgcacgtcgttcccttgctagccaggccaggggatcggatgcattgcgcgcgtaccagttcatcagtaattaatcatgcatgtactgatcgatcgcttgcaagttgactaacggatggtttggtatatccatctgtctaatcatcggaagcatattatttgtatatatgtcgcatgatgtagagctagcctaggaatacttttattagtatatttcgtaaaactatatataatttgattaaactaatacgaaactacatatatatatttaaaggtctatatattataaaattatagatttatcattaaatttatcacgaaacggtagacttaaagcatagtagcacaaaactatagatttattattataattctcaacatagctactccctttgtcccaaaatacttgttattaattctaattaaatgatgtatgatgtatggttagaagtaaaatggttgtttgagggtacaaaatttgaatgggagaagctagatggatagaaaaccaactattttgggatggaggtggtaggacttgttttcgtgtttagttccttgcactaatattcttccggaattactaaacttatatttttatggtaactagtgctagagctgaaattttgtgatattgtaccttctctatatattttcatgataattgtgatgcatgctacatatgtagatatattctattaaatatatagttttgtgatagtttagtcaaagtatctattttgttttgttgtaaaatttactctattaaggcccggcgaaaaatttactctattaagagtgcaaaggctaggatttttttatacggttattaagaaaaaaaatataaaaagcaccatggtgtggaattgatatgataataccgtactagctgtgagaatatatactccctgtgcatacgtctcctgtacggggttctccagtaaattaccaaaatttggatgttctgtagtaaaattcatcttaattaaaaaaagatgattaaaggtaagatagaaaaaattaatatgaattgatcaatgggataaatagtactttaaaaatacttatattagttataaatatttagtgtgctctagctgactactccctctatctacttttgatcggtatatttttaaatctgaaaaatttatttttgataggcatatttcaatccaaccacctatcattttaatgattttttcggatttaatgagcgactctctattcttcaacacaagattgactacatgggcatcaagaaatgtaaatattaatgaatcgtttgtttacgaggaataactagtagcatgtttaaatggatgataagtaaaattatttattcttgatctgtgtgacaagatgaaatatgactagtatcaaaagtagatgtagggagtaattagtaattaacttcttctccaatcaatcaaattaagaccggtacgtacgtacatgcattgatcggaaagtagattcccatgcattatacagtatgtgtacttgtacaggtgctcgtacatgcatgatgaactgatcatgtactacttatgccccacacgtacgtacgtacaggagaatccctcccggcaatacaaacctgcatggtccacacattttggaatgcacgactaataatatggttcttttcctattaattccgcgtgtacgcggaagacttttgcgccaatctattaaagagtacttcttcagtttttaaaaaaatcaatctagaaggagctcataagataacgaatataaaaaatgtagtacatattcattgtcttagaaggggatgcttctaggttgagtttttgtttttatggagaggaagtagaagataattaaacgtacaatattatttttaatgaggaagcacggggtcacgccacaataaaattatgggtgcacacgtcttcatatatacatgactcacctatccatcaagcaattaaattttggtgtccataaacattacacatatatacggatgtgttttcagtagctaggattttggtgaaataatcgagttaccactggcatccgtgtctctcttctcttttcaaggggcaccctagctcgcggcgtgcaaaaaaatatcgttcataactgcacgaatatgtatcgtgctatatatagtaccgttcgtaggtataaatatatctggtttaattcttcgttcgcccatgcgaataatcgcctctatttctttcacgctactatatgtacaattggtacatgacatggaaattcatggggccggggcaagctatctctatttgttccagaattccaggaattccaggtcaaatgtctcagggctgaaactatagtggtgtgtttataagtggttaattaatctactactctcttcgtttcagcttataagacgttttgagttgtcaaagtcaaactgctttaagtttagccaagtttatagaaaaaagtattaacattttcaacccaatagaaatttattatgaaaatatatttaattattgatttgatgaaactaatttagtattataaatattactatatttatctataaatttaattaaacttaaaaccatttgagtttaaccaaagtcaaaacgtcttataacctgaaacagaccgagtattatgggcctgtttggttatttacttcaacttaccaagccacaagtatggccatgccacaagtgtggcggacgatttgagcgccacacattcaacaaagaaatatgcggcagagtagttcacattcaacaaagaaatatgcggcagagtagttcactgctgttgaattttgtgcggcagcctcaggtgcggtaagcaaacaaacagtgaactaactatgtgtggtacgcctaacttgaagtgcggcaaaaggaggcaaccatccaaacaggtgtctgtacgactgatggtcaatgggctcgcatatatgcatctgagctccaaaacttggacagagctagattccaccgtatctatgttttagaaaacatgcatgcatgttaattcctgccaatttcggtacttgtttcaccggccgatcgattgctggcatgatttgtttgatcaatcatggaaaaacaacagcttaacggtgctctctctcatatacgtgttgcaaaaataaactgtcttggaaaaattaaaatggctagatctgtagtttgtagctagtattcgataactaaacgatattttaatttagataattttaccatctttaaaaaagtaataccacgaagtatcacattttttatgtaaaatttgatatctctagatgctactagataactgaggtatcaaagtttctagtgtaaaattataatgccccaccttttaccagatgttgaaaactaaattaataaaagcctatatgtgaaaatttcattctttgagtgagagtttaaatcgtgtcatggatcccgatttaaatatacccttgttccctctcctagaatcaaccatcaacacctcgaaaatccccgttccaaatcgagtccgcaaaaatcaagttcgaaatttgaccttttgaacccttgccaaaaacttctcccggtttcaaaaatatcaaattcccttccttgactgctccttgaacccttgagttcaaatatccaattttaattcaaatcaatctcccaattccctcaaatcagttcctgcaaaaagatcaagtcgtttccttctctatttgggccatctcccttcctctcctcccggcccagtccttcttctctccatcccacctggcctgtccctcccttccccctcctaccagcccatcttcgctagtgggcctcgcgctacggcccagtggcgaaagccaccaggctgctggcctgctgcaggacacgcacgcgctccgcacgtgctgcgctttacctcgctgggccgcgccgctcctccggcccagtggaccaaataccatttattcctcaatttcttttccagaaattcccgcaaatacattccctttgtatagcattgacgcattgtatatacactaaatatatgtgtatgcttactgaccattggtcaaagtctgtaaagtttgaccttttttcaatataaaaatattccttataaaaagttcgaaatcaaaataccccttataaaagtgaacggaggaaatactaaatttcacaaaactaccacatacttcaacaaaacaacaaatttaattagtcatcgtactatatctccgccccagaaaaactacagttttacattgtttgtgaccaatgtttgactgtccgtcttatttgaaaaaaaattatgaatagtattcttattgttattagatgataaaacatgaatagtattttatgtgtgactatttttttaattttttcataaatttttaaataaaacgaacaattaaaatacagaaacccataactatacttaaaattgggacggatgtagtaatttgtagtggttctagctttctaggcttagctagggcaacaggactacctagtttactttctactagcagtaaattactagagatgtatagccatacataaagatatatgtcaatgttgaaagcaacaactacagctaaagaacgtaaccgatgaatgcaacccggatcatcaatcaaaagtacttcaactcttcaagacagtaaaaaggaaaagaccaatggcctgtgtcacacgactggtacccaacaaaatcaactcaacaagacaccacatgagcagtagttttaattttcttgtggcatccaacgtagacacgctggaagcaggaaaagcacgcagggcaagaaacaaaaccctaattaagagagagatggatgatgaatgaattaagaggtagcaatgcaaggcaaggatagatagatgcaagttgagctggggatggatggatgcgtggatgtcggcacgggaaggcgccaaacaggggacgcgccttactcgccatttgcttccaaaatctccttaattttttctatcgcttgatgtgcccattccttggaggagactgagaccgtcgctctctcgtcctagctcggctcatccgtcagcgtaaacgcgcgtacttagcagaaaatatgtctacatgagactacgtagatatattttctgcttagtagcccgaccgcacgggattaaagattatcccgtgcggttggaccacccgcacatgaaagtgttgattttcgcagacacctgaatgcagacggacgggatctctgcatgaaaaaatccattttgaccgcacggaaaaatccaatctgtagtagtgtacaagttatatatgcccgtacacgaatcaaaacaaagctttatcgtagtccaaacaactgatctagctaggatccagttgtgtagatgtgtgtgcacacccctggtcacacgccacagctagctcagctctgatcgatctcctttttctgttttgttgtgttgtgtctggaggaggaagaagaagaagaagattggattgatctcagcctctagattttggtagtgaaaataaaatgtgattatattgaataattgaaaggagttgaagctcactggccacctatcctagctctagctaggcctctaaatatctggggacagtgccaatggagtaagggcccataggcatgcatatatgccatgcaatgtatgctgagtaatgatggtttcatactttcatttgccttcatgcatggcaagatcagagatgatttaacagctaacccgctgtcagtactcggtgacacgttcattagctagcaaaggtaagactgttctggattccaacaataagggcatgtacaatggttgtcaatagtggtctcttagcgttactaattaggaatacttattgacatggaagaaagagaaagagaagagacaaaacgtcgttgttatacatgacaacggcttaacaacgactcttaatcactataatatgaaaatatggttgcacgagggtaaaaaaagggaaagaatattaacaaatggaatattttttgagttaatgattagagtctttgtcgtctcaactattgtaaagacagggtctctaaataatcttgtattgtttaagagatcatactcgtctctaccattgaacgtgccctaatagtgaattattttgcatgcggaccatgctgtgtcgatcgattaactcacctaccatgcagtaatttggaggttgcatgggcaccatggaatatccgaataaatagaatagacataaattaaaggtcctctttcaaaagaaatttagtgatatcaagaatttatcattaatttctactatatctttcgacgtaaaagttacgattctttcttgggtgtgatatgcacggaaaatattttctacatctagtacttgaatagggaacctttttaagataacagaagaattttatcaatctgagtcaattatattaaaatgatacaactgcattaagaatagtctcgacctgttgactgttttaaggttaaaaaaaaaaaagctttgctcttttgactgttgactccccaatcagtcggttttgttttaaccgcgacatgcaatatgcaggggccccgcatttgctcacaggctcacatgcctgcgcgagtaatccaaagcacgagtcatccaaattaagtccaaaccgagatgacttggttgaatttcagcagcagcaaccaccgactcgatgcatgccagccacaatcctcgccaccgcgcgcgacgtgacacgccaagctctacctagctagcgtgctccatgtccatcactagctagcttcagtgacggcctctcgcctccaccaatggcctataaatccaggctcccagctcgtcttcttccctcgcacaccagctagctatagctaagccccccaagagacatcgagagcgagatcgccatggccgccgccgccgccaagaacggccgcattgccgtcgccgcgctcctcctggcggcgctggccctgtccgcgcagctcgcgccggccgcggcgtgctcctactgcccgacgccgaagccgcctccgccgccgccgccggcgccgtccggcgtcccgtgcccgccgccgccgtacacccccaccccggcgacgccgacggggaagtgcccggtgaacacgctgaagctgctggcgtgcgtggacgcgctgaacgggctggtgcacgcggtggtcggcgccaaggccagcgacacctgctgcccgctgctgtccggcgtcgccgacctcgacgccgcgctctgcctctgcaccgccatcaaggccaaggcgctcggcgtcagcctcgtcctccccgttgccatctccgtgctcgtcaacgagtgcggcaagcacgtcccctccagcttccagtgcccatcataaatcacctcaattatgtatgatcactaattaattaataatcacctactgcatctgatctctgcatgcatgcatggattaattaattaagctatcaaattacatattacctgcataattaataagtatagtttatcacctggctatgctatatacatataaatatatatagtgacatatgtagcatatatacatgagctctgacttgtgtcatggagatgtggaggcatgcatggagccttggattgtgcatttaattgatgtataataatatttgtgtaacatatattttgctgtgtcatgcatatatgcatgtggagttgtggtatttggtttgtagtggtttgggagatttattatgaaataaagagtgtgtgatatgtatgctatgaaatacaaagtttgatgtgtatgtatcatatgtatatgtgtggctgataaagcctgtcattctgtcaactttcatatatagtataaaacgtgctatgttgtgcttaaatgaatatgttttcctatttctcatgtgtttgtttcatccattcttcaaaatgcgttcataattgaaagcagctctggtttctttcaagttcaaagcctctcttatggaacgaaagaattttacagagaaatttatttttaaaaaattaaactaattcatgtgaatttcctgcaaaaactcctgcgttacagcttccgaaggagtactaagttgtatatgtacacccctccccacaaaacaagttgtatatgtacaagtggatatttcaatcttgatcggagggcatcttacattggctcatttctctggtcaaaatattgatcccttctagtccagaaaaacggaatgctttgaattttggcgcaagcagtttcctttaagggagatattactgtaaacagggccggccctgactttttggtggcccggtgcgaaaaaaaatgtaggcccccattcaccataaaaatataagataatatttaaaaactcattgtcattaacgaatttcacgctaataagcttaaaatacaatcaggcaatcacgatatgctcgatcgtcgattggttttctgtctttcctctaagcctatcaggcctgataccatagtacatatattttggaggcctctaatttttggagacctaatacggttgcaccgtccgcactgcccaggccggccctgactgtaaatcagcaattaacacagcaagatgatagattgttacacatgttctaagctcagactgtgtagtagtaagtgcaaagatctgcatgcgacatacgctgatatgcattgcactaccagagatactctctgctactcaattttgacagttgccacacggcagagctcagaaagagaatacaaggcacaaggcagcccaactcaagcatccctatcatttcacttacgcttataaccaaaatttaaattttaaaagtaaaacttgaatttatagttgattttgtggatttttatcaagatcaagcgtgttcagataagccaagaataatttttggttttctaaaaaaaaaattatagattattatgttatatatccctacaaacatacaagttcaaattaaatatactcagagaaaataacaagaaatttaggaataactttgaacggggacattgtgcaattttgtatttccatgcgtggatcaaaaagacacgatcatatataggttattcaatgttctagaaacttcttatagctgtttaaaccacatgcaagaaacaggagcatgcaagcaaagatggcgctacataacgtcaggttccacgcgaggaccacactttctagcacaagaaaatctgcgaggtgcagcacggcgcacaaacgaatacaaagaatcgagcgatgtaacaacaatccagcagaatataacaaaatgtcgatgctgaccacaaacgtcaccattcaagattctacattatatttgtttatacagcaggggttcagagtacaagattggccgggtagtatatcaccatttgagcaaaacagactgagcaaatgcaacataattttcgctgtgttaaggcactcaaaatggaacatgggggatcaattgtgttatctgcaatctggcaagcgttttccgcggacgtgttcaagcgacggcttggagagctctctcgaagttatcttctgctgatacggcacgctttactagcacatgatcggggtgtgatagtttcagctggctgcagatggaaaagaaaggttagaagtgtggtaagcatttttgggttcactaaaagtaaagcattgtgaaaatcacgggatagtttccaaacactgaagcaaagcatgaaagatgttctacggtttaacccgcacagatggtaaattccaccgaaccattctactggtaattatatgttaaaaaaaatgaattgtgaagtcatcaatcttcagtgttgatattcttctcaacagttcacatcagtttcataaactattactaactgactcgtttagtaaagttttggatgtccctaactgataggcattttatgaagaatctatacttatatatattattatatactattaaaagacattagtggtggtagtgagcctgccaccaccaccaccaccaccaccatcactgacacatgggccctgatatagtacaacacatgtcaatgctctgcttgctctttggacttgttaggctgtaggctgtagtctataggagaagaggacattgggatttgggtgattacttaatttgtaggctggagctcttaaattttctaagcatgtaatttttcttttgttctttaagatgatagatcttctttcaaccaatgaaaaaataattaatttccacaaggacttaattttgctattttcaatatccgttgcaaagcatgggtatttggctagtgaagacaaaagatacatagaggatcctaacatgatagtctgataccctgccgcttcttttcatactggaccagtaatatctaaaacaaagtagagaagttctgtggaatctgggtggaacaattggaatgttgaacacagccaattggaatgtcagtttcaagttgctgggcagaccttgtcttgatatatcagatcaggaactagtggctataacaaatttgcttggatacacaaaatcagatcatagccaaaaaaaaaaaacagctgtctttcgcaaaacttgaacatataaattcaatcgccgaaataagagaaaatgattcactagttcaaagaggaaaagtatctcatgacattttgccagtggtcctactcgtgacacgtctttcaccatcccagatcaaccaatgctatagttcatgtttctttaatagctgcggggaccagtcatacgattgccaagatttgactagacttattgagtggctattgttttaaataggctgaatagtgagacacaaatacaaatatttctcttgggtagcagcttttgcaccatgccatgagatatttacatcagtctggtaatttctgatacattattgcattttcattttaactttttaactactaatcttgaaggtctctgtagcataaaataattaggtggagatataaattttaagaatgtccccttatcttgctagcaatttaactttaaaatattgtttggtagtaattgtccctctggatacatatttaatagtttgtatatgcaagccacatgatttatcaacatgtaattcttctagtttggcatgcatcttccaaataataagatagaataatataatgaaatcctgcttgacacagcatgacagtgttgccttccatgcaaataactaaacagagcaaacagttgaattgtacagttgtgttacagtttgtacctgaggtatcttgatgacggtttgccaaggtggagattacacacaataagattagcaagagtttcaggatcttttgcatcctacaagagtagaaacagggtttgagtaccttgtgtcgaacatgccaacgtggcatccttatgtgagtcaaataaaaaaaattaaatgtcataagtttttttttccaactttaattcaaacttagttgcgaggtgtgtcatcaagctaaccttgttcaatgcttcgagtaaaagagtctcagcctcatcaaagctccccatgtgcatacagcaaactgccttgccatttagaaccattcctgtcatcgggtatttttcagcaaagtcttggaatatgaggtaagcttcacggatcttagagccaccctgcacgataacttgattgttaataagctcgatagattaaatgttgaataagcacatttgtccagcagttgtcaatgcaatgctgaattttcggtactccacaaagttggactgtcaaagtacttacaacagcaatgtccagccatgcgtttgcaagttgtgtcagtgtatggtcctcatcaatctgttgcatgatctttaattgcttctcggcatagtctgaacggtgcatcttaatgaagatctggacattcaatgcatgcctgtaaccgaaaagcaacagatagtaaacaagatcatcaacaaacagtattccacaaatgaagggggcaccaaacagaagattctgaccaccaaggtttgcagttaactaaatgatcagcaacatcaaatcgaaatcagcaaagatcagcaattaccagtgttgaacaatagaaaatattaccatgctaaagatcatgaagccagaaagcacatttaagatgtatcatgcagtaatgcattttcaccaactctcaaaacgtcacattttcaacaagataaacataagtgcatttgcatgtgcatagttagcacttagcagcatataagaaagaaaagtgcgttgaactacaatgtccgagtgataataaacgtgcacaacactgagcatttgaacataccttttcggaaacaagatttttgacttatcttactggataccaataaacttgaccattattgtaaggtgatcaaaattcacaaacaaaattttctattgttctgcacctatgttttctaaaaataaatctacacctggaaggatgaaccatataaagttcagaggacaaatgaaactcacaggtccagagttccaccagagtgtgtgtgcttgagagcttcagtgtagtcttgctcatgcataaatataattccagcaatcaatcgtagaacaggattgcttccaaccgccgaatcactcaaccattccttcagactgacaatcgcactttccttcaaaagttgtacaaaagaataatacatagcatttcagtgtatggacaaaccagagggaagagaagacaatatgatggaaaaacaaaacaaaaaactatttttctaggcttagctgtactggactactggttaaatactcataaagtgcatgacatgaaccaaaataagaccataaaaactctgaaatgcaccagaaaacaatcgtattattggaccataatgtatgcggtagggttaaagtgaaaacatgcatacacaagttgagttcatggggcctcatagcaatttggggaaaacatataccaatgatccatctatgtttgaggaggtggtatccctgaattgcctgtgattgccaagttgaccatacattccccagcagactaccaaccaacattatcactgatgaatgccggtagtcctagtctcctagatgcatggtaggcagtatgtatgttttcccccaatttatctgaactgaacaccctgagatcaagtttacgttatactggttccgttttgttttcttcttttgggttttaacagtgaggaggaagtagctctaatggcatatctttgtgtatgcaagtgtgtctatgctcttttttttttactttaaactttaaaggaactgtggtttcaacctatggtaactgaagtttgaaacgaaaggtcctaatatgcattgcgcaattgagctgaagaacttaacagcttcagcctctgaacaccatcagagtctattcatccaattgaaatgaaaaataggaaatcaatgatcaagtatcaacgaactaatcaagccctgagcctctggcaatgcatacgatccactagatctaactccagatcacataactcaatatagatctagcccttcgatcacaacaaagcacaccagatccagactcagacatcacgttacagaggcgatgggatcagatccagcgtgctaaccttgtctccggagaggtacagcgcgagcagcttcacggcctgcagcgacgtcgccgcggacgagtcgatctcgctgatcaccaactgcaacagccacatggggggaggggacacgcaccgatcagagccgccaacccgttgtagagcgagcgagcgaccgagggggaagggaagggagctgagctcacctggtaggagccgagcgcgacgtaggagcggaagacgatggcgtcgcgctcggcggcggcgtcggcgtcgaggcccgggacgtcgctgttgttgatggcggcctggtaggcgccgaggtagaagaggttgcgcaggttgaagaggaggtccggggacgccatggggtggctgctccggtgctctgccgccggcgacgacgaggaggaggcggctcgtcggcgacgaggagtaggagatctcgcgagcggtggcgctgctgctgctcctctctccttggcccgtttggtctctgtgtgggttggtaaagactgaggcgtatttataactgggctcgattgggccaaaaacttctggcccgttgctaggtgggcccgtcggaaatctgcagagaggtgggcccattgtttgggccttagttctatagtgggccaaaatatatccggcgctagcaaattctagtacagtacatttttgctatatatatttttgtcgatatttttttctaatataatggtaatgtacattataacttacatggtaactataatataactttcatataattttaatcgttatatttatttcaacattcatgcaagttagaaagaaaaaaatccgagcgcatatgtgtgacgattcggtcccacaatcttcgttttataaaaatagcatgtaactaacaaatttttgaaagttacaagttacaatataattacatcatgattgcactataatttatatgtataggcagtctcagtataatttggtcgtgctgtcgtggtacaaatccaactccgacttggtaacaaattatcttctagattctaatcgataaatttcaacgaaaatttgacgagccttttggccaactcgagagtgacgtcagcgcgcacggcgtgctcggcccatcgtcttataggctcttagctcaagacactggcggagtcataaacagcgctgtaaaacgagcagcgcgcgcacgccgatcagcaagccgccactggctacttaaagccgtagcctgtagctcagctccaccgcgcataaacctagccagctagcaaccgacaagccaaggcgacggcaatggcgccgacgacgacggccacggcggcggcggagcaggcgccgccgccgcagcatacgaggaaggcggtggggctcgccgcgcacgacgactccggccacctcacacccatccgcatctcgcgcaggtatgaacagccaaccgtataccgctccatgctaagaggatctttgtcgtgctcgatgattgctcgatgattctcccgcgccatggcgccattgatgggagattgggagacatatggagcttttttttttctctccagagtttaagatgatctatcgtgtttgaatttgactgttactctcgtagcaacaatagtttacaggatgtccacatcgaattagtgaaaatcgccgtttggttcatggagttaatagaatctgaagctctcatgagccagcgtcacttgagctttcgatttttgttttccccttccatttccagtcatttccagccttctcatcggatttgtagattgtagttttgcatttgatttccctgcgagcaacggtgctcagcatttgcacatcgaatttcggtcatccatgtgcaaaggaagcaaaattcaccactttttgaaactgttcttttttaaaaatcttttagagaagtgtatttattacctggcctcgttcaaccggatatatgcagccatttaaattggttctgaaactgttcttgatcaaatggagtatctcaaccaagccctttcgtgccaaatcaacaaacaacagcaaaatctttccccagacgtctacagtacaaaaaccctgaccatccagcaccagccagcgctggctcactgacctgcagcaaccagctttaaaaaccatgcgcatttgcagcacgtattctgtaccaggaatacgggatccgtcagatctcaactgcaaggcaccctttcttcaattgtttttggtggtgagttaatactgttcaacagtgaccatactgggcatgcctcagctgcaagaatttatggtgctcgatcgctactacgtcatccatcttcttttcatgtgcgaccattctggctgtgattggctggctgctgctgtcaaagtaacaggagtgatttactttcacagtctggttgtatggtacataattcagttatccttctggaatctgaactcctcctggcttagtcatagcagtaaaaatgttcattcaagaaacaggctttcaagcagtaggcggcttgctgcacatggcttgtttttgttaccagtttttttgtcgagcctatgtgaattttcacaagtttacagccatctgtgtgatggtaaattgaggatcttgctgtatgccaattcacttgctagtgttgtaagcatgcatcttctttcagcttcagcagttcaaggctgttgatttgatggtactgaattagttccctgaaatacttcagataaagtaaaagggaaagcaaaataaaagaaaaatttcagttctaccagttcatggcttagttaaaatcttgggaggtgaagcatggtgtttaggctctctcttcttgtgtacttgagagtctgaactctcaatgctgaagtaataaccactgcagttctgctaaaaggttattggctcagtagagaaatagtatatgtttctgacttgtgttctatatattgccatttttcaggaaaactggagatgacgacgtcgctataaaggtgctgtactgtgggatttgtcactctgacctgcacaccatcaagaatgagtggagaaacgctgtctacccagttgttgcagggtacatccttcttattgcatcaccaatttatcaatcaatcgtttttcttttcttcttggttctgtgcgcatccagatggaaaggctggatgcaatttcattgcttagtgaaatatccattatcagttcatactttcttccggcaaagctgaattatcatactgtaaactgcaaatcttgtcagttttttttcacgataatgaaattcattttgtttttacttcaaagaagctacaaccaaccactaccgccgtttcaggttataagacgttttaactttagtcaaagtcaaactgcttcaagtttgactaagtttgtagaaaaaataataataacattttcaacccaagacaaatttattatgaaaatatattcagttattaatttaataaaactaatttggtattacaaatattactatatttgtttataaacttagtcagactttatcaaagtcaaaacatcctgtaacctaaaacggagggagtattactctaaagtgctttcaacttacttggaaaaaagaaatgcaaactttggctgcatggtttgattgatgcaggcacgagatcaccggggtggtgaccgaggtggggaagaacgtggcgaggttcaaggccggcgacgaggtcggcgtcgggtgcatggtgaacacctgcggcggctgcgagagctgccgggacggctgcgagaactactgctccggcggggtcgtcttcacctacaactccgtcgaccgggacggcacgcgcacctacggcggctactccgacgcggtggtcgtcagccagcgcttcgtcgtgcgcttcccctcctccgccggcggcggcgccggcgccgcgctgccgctggacagcggcgcgccgctgctgtgcgccggggtgacggtgtacgcgccgatgaggcagcatgggctgtgcgaggccgggaagcacgtcggcgtggtggggctcggcgggctcggccacgtcgccgtcaagttcgccagggcgttcgggatgagggtgacggtgatcagcacgtcgccggtgaagaggcaggaggccctggagaggctcggcgccgacggcttcatcgtcagcaccaacgccagtgagatgaaggtaattttaaagctagtttgatcaagtcaagagattattaaatgaactttaagaacggattacacgatagtaattacaatctacaactcctgtacaagtagtaaattaataggaccactttggactgagttaagaagagatcaatgaactattcagttctacattaatcgtgtagtcatatggaaggacatcctactgatgcagatgcagtaatatggcacatcacaaacatacaatttcaaatttgacttttacaagttgcgtttgatatgttatttttgttacaaattatagaagtcgaatttgaatttgcatgtttgtggagtgttatattagtagatgtcaatctattttttcaattttttttaatatttttataatcgtttaattaacatgcaataaacgggttaacatccactcaagtggttataatccatctccatcaatttattgatgtgctgcagtgcaactttgcaaggctatgcaagccgaagaaatctttgaatacaactgatgcacctcattgccgacagagcatcttaagattgtttggtcaagtatctgaatttgcattttggacttgtgtttttgcaggctgcgatgggcaccatgcatggcatcatcaacacggcctctgcaagcacatccatgcactcttacctggcactcttgaagcccaagggcaagatgatcttggttggcctgcctgagaagcctctccagatcccaaccttcgctttggttggaggtaatttactagtttgtctgacgctgcatcgtctgattccttctcaaattcatggcaaaatttgacagtttgttttgtgacaaatctttgcaaatcaacagggggcaagatactagctgggagctgcatggggagcatcagtgaaacgcaggagatgatcgacttcgccgccgagcacggggtggccgccgacatcgagctgatcggcgccgacgaggtgaacacggccatggagcgcctcgccaagggcgacgtcaggtaccgcttcgtcgtcgacatcggcaacaccctcaggtcggattgactagggagctcactgtcactggtctcagctctgtagcataccggacctgcaatcctgcaaagtagtgcaatcttcttgctacaagacatacatatcacctctacttggtgtcaataaatgtagcaaaagtggtacattgttgtactaatctgtgtttaatatagcgttgcaacacacatgtatattgtgtaatggaatggaatgggtcactgactcctatccaagaacgagccatttgcattttgcaataaagcattactgtacttgtacacagggacaagggtaacgttctcactctgatggttggacaaaaaagttatactagtatacaatatgccaatatggattctgcttgaatgaagctaaaacgacgtactacagagatagacatcatcaccttgacatactaagggacctggggatagagagcgatcggacctccggcgccgaacttgggaacatcacgttgagcctgtgcatcaggacgtcagccttggatggtatctcgttgagcaggaactgctgcacgatcggcttcttgaaccactcgagcaccgagtcacctggcgcccgcagcaccaccttgctcacctcaaagggggactccagcgacgccagcacctgcgccaccaccatcttgagcgttggtccagtcactagcttgatgcggcgcggcaccaccccatagtagagcatacgcttcctgaaccggtgcagcgtgtgcacggttgccactagcgctgcgccaacggagaggtttctgacgtccagtgaccaggcgatgtgctggtcgaagacgatcgccttggcaaacagcttattctcgtaggcgaccttccagatacagcgggcacggttcatctgccccatgagaactaaatagttgagaagcacattcacgaagtaccttgccgcactctcctcattgtcgtagtcgatgccctggaagaactcccggacgaacgagagcactggcttcttgcgctgctcaggcccggtgaacagcccgcacatgaagtcatgtgccttgtgcttgcttacactcaggatgtccatgattgcccgctcgcgtccctcatcctggcaccgcaccaaatgtgcaaggatcgaagtgtagagtatcaagtccacctttgctgcccccgcgacatatgtctcgagcaatggccgtgctgagtcatacagccccgtcttcatacatgactcgaatagctgccttatgatgaaattgttggtccttatgccagcggagcccatgaaccgaagccaccggagtgcaagctccgtcgacccttccttgatgtaaatcatcaggaggtcgctggcggtcacctctatcgggaaccctgatgccttcatctccagcaatacctttgcagccaaatccagcatcctcttattcgccaacatcatcagcaatgctgtaaatgtgctaagccccggccgttgtccagcatttgccatcgagtggtacaaccgcatagcagcatccacctgccctgcagaagcatgcatctcaaccagacaagcgtatgtcgctggcgtagggaagaagccggacttctccatatcaccaaacaactgtgtggcaacatccaacctcccggaccgtgcattcgcctcgacaaccatggtgtacagaccaaagcttggacggagccctcccctcctcatctcctcccagagctccatccctgcatccaacttcccagccctcaccagcccctccaccacggctgtgctcaccgccgggcttgcacggtgccccaccgccaccatctccctgtacatccccatagcagcatcgagcctccctgcttttgccagcacgtccaccagcacgccgtacatcccagccgacgcccgcccaatcccctccctcttcctcatttcatcaaacatcttgcgtgcggcatctatcctcccggcgcgcgcaagggctggcaccacgagctcgtaggttccctcgtcgagcgcgcaccccgacgatgacatttcgtcgagcacctcaaaggccttgaaggcgaggcccctggtgagcagcagcgagaggagggcattgtaggcgtgcgtctccaggaccctgaaacccgcgtcgcggaggcgcttgaagcagaagaaggcgggctcgaggaggccatgggtggcgagcgcggagagaacggcgttgagggtcttggggaaggcggcggggtcggggagggcgagggtatcgtcgaagagggagaggagttcggaggagtgggtggccggggcgaggcgggcggcgaggagggaggagaggtcgtcggaggggacgaaccatggctggacgcgcgcccaggcgacgagggcgaggagcggggtggggtcggaggcggggagggaggacgcggcgaggaggaggagagccggatcgggctgggacggcagcgcggagagcgcggcggagagggatggccccgagcggaagcggagcgcgagcgccgccagccgcgccgccgccgcggggcgcgggagcgggtgggccgaggagccggacaggatggtcgcgtcggcgcccggcaccgcggcgcgcgcccccggcgccgacgagaggacctcccccgactcgtccaggtagtccaccgtgtcggtccactccgccgccggcggaggcggcggcggcgaaggccccgtcgagagccgccgcccccgcgcggcgatcgagaggggcagcgccgccgtcgtgaggcggcggcgcgagaggccgacgcggagtagcatcgcgatgacgctgccgccgccgtggggctctctgcgactgcaagtaggggacttcgctagggtgccctttgggccgtgctcggcccatccaattacatgttgttgggccgtggcccattacaaggcccatcgcacaccgttgccgagtcgtcttcttcctcttcttcccctcttcttctgctctgctctactcgcgaagccaaagcctccgccgcgatcccctccgccgctcccacgagcttcgccgcccgcttccgtcgcgcgtcggcgattcgcgctctccccgactccagcgccttcgtcttcttcgacctcctcctccgaaggccccgccgatcgatccccggtgtccgcgccttctagttcgccttttcgagctctttttcgccggagacgacgggcgtgggcgattcggctggattcctctccggtacgtgcgatctcgctccagctctgctgatttatctaccctagctttgtggttgcggaacagccctgagtagcacccatgttttgagatgtttcgactgtatcgacttgctgtgcgcgcgtccctgttaggtctagcttccactgggtgttgtttactgctcaatctatactttaccactgtagcttctgccaccaatcggttggtcatgtgtatgcctgtgtgaattccactgggtgtgtgtgcacatgtatgaatgtgtgatgcaaaccaatatggtagatccagtggatgcttatactattaactgcttaagtaagatgtatatgccatagttttgcgcaatgtttgggtgtagttcattccatgttgttttccctgcagctggttgtataattcatggtgcatattttgtcttgcctctgtttcagcattcctgttaggacttaggagaagtaatgtcaggagtattagcaaaattcgctattgcatctgcggtgatgtggacagctccagttgccatcgtgtatggattttactaccagatgattccaggtttgactattgtatctaatttacattgtttttcatcgctacttttaaaactgggacacatgatattcataaggagacttcatttgctccctgatcaggtgtgagtcaactgtcatcctcgacgcaaactctagcaagtggattccttgctgttatatcgattaatctggtaatcggcttttatatatgcatggcgatgaaggagactccccaccaagagccacaacctgatccaaccttcttggcaaatgctaaagcaagcattgatcaaccaactccgtctcaagtgaatgatgattcccatggaaagggaaaggtggagtaggtcatatcacaacatgtgcatgtttcacatgttatccagaaacagttcttctcgataccctgccttctaattcaatattatcttctgtaaatcttgagaattatggaaccaatatgagttttaccttttgtactgttattatcgagatactgtgttagaattatttttgtttggctgcagagaactactttggctggctgtatttaagtcaatttcgtttttcttcaatgtggtcagagatctcctttagcatacatttaataagataaatattatatctatttagttatccattcgcaatgtggcactgtttttttaaaaaaaatttctggttaggagaacaaacctggagaaagttgtgttccaaacttatgcaaatgtttgcccattggaagtagatgatttcatggagtaagcctattatgctttagggagataataatttattagtgcccatgccactcactcttatggatgctcgacgctagaatggtactgatctgaccaaatgggaagctcagaatctactttacccttagtcattcacatggcttagcagctaagaacaagttaagtcatcatgtattatcatatcataaagtacaaagagatcacctgagataagctttggttttagaaaatctaggatggatacaataaatactccaccaagagtatgttattttgcgaagatagaaaactcatagattaatacaaatcaagcctatctgggaaataagatcctctgttattctgaagatctatgcccatatggcaagcattgacatcagtccagcacctaggaaaagtgcaaggtatgccatgagctgaagctttgtattaatctgtagcttcgggttattgaaatctgttgctagaaggtcaactagggacatgtagatcaaaattcctgctgaggctgagttgaagactccttcaacgacgaaggcagttgagctatgcacattgtagctcgatgaaattgcaattcctagcacgatgcccacaggtgcagtcagggagaaaaatattgccataatgacggttgcccttaccttaaaattagcctgcagtaagaagaatgaatcaaacatattagctttttgttgctgtaagacatgatatgttatatgcatagttgtctctttcttctttgtgtccaattatttgatttctcgataaatctattattattcttacctaactagtgaacctatgttctctatatgaaacagttatatttctttatttttcttttgcagcctgttactttgttctcggcttcttttttttgtggtctgttacttcgttcttgaagaaaatggctaataacttttcatgcttgcaatgtgtcttgttgctattgtgcctttttttttccaactttgtatgtctctgccttatttctttttttctctccccttctgcggaagggcccttccactggcctacgagcatgttgatgttaagccttttcgagcaagcattttgctatcttttgtcaaaagtcgaaacaacaagttagatatttgtcatcaggtgtctactatctaggttacagtacttggacatacctgaacaatgcaaccacccaaacctacaccttcaaagaactggtggaagctgagggcaccaactagtggcctgatagtagatggcctcacagatgcacctaaggatactccaatgataactgaatgcaccaagattcccagctcaagaacctgcatggccaaaaattcatgtggttattgcaagagggcctatctggttttgtgaagcattcatttagttggcaatcaatgtgcaaatggagttaattctgagtttagtgggaaaagtttcccctgaagtgcagattatcagacatatccattgaataggtatcttctcttccccatatatgttttctatgtgttttatggaaataagtaaaaagagatattagataatcaacatcatcctgcactattgtagtttcaagattacaatagactaaacttattctcattactgttgccaggaaggcctatgagcttcaagtgactgctgttacctgagatactaccttatgtcgaattgattcagctactgaaccctcctctggtgagccacagaccactatatcaccatgtgaatgtgtatgtcctccatgtgtgtgcgcatttatgtgttgtgcatgttcagccctctcgtctccagcatgcttgtgtacgttgatgttgtcaactgggcgtgccttcctgaattgagaccggtgatagtatccagcagccaatgagtccaccaccattgtggacactgcagcagacattgaaacaaggcccgcaaaggggaagggattcctatccccaccaccccttttgaggcatggagatgtgagcgcatcaaacgccgctggaagaatgtgcaccatgccagtggcaaggatgacgccggctgcaaatgccttgacagcaaagaagatgtcaccatcagggcgcagcgcagccatggagcggccaatcactggcaccaagacaccagccgccccagctgcaaggatggatgcaatggcaatgagctttagcttcattgcaccctgtctgtctgccccgtctgtggtgttagcacagtcgcaggcactggctgcagtgtgctgcgcaaagagcagtagccatggaagcacttgcaaggtatgcttcttggctcccattgttgctgattatgttgattatttccctgtgatacgatgtatgtatattgctatgagtcagagatgaaggtagtactgggttctttatataggaggggatgagatgatagggattgatgtcatcctttgaccagaagatggaggcaatgatgggttttttcttcttctttttttatttaagtagaagggaataagatgatgagaagagatgtcattctttggccagaagatggatgcaatactgggtcatttatataggaggggatgagatcatagggagatatgtcatcctttgtctaggtgggatgagctatgcccatgtgtcaaaaactgtagactaaagcactttggacaaagttgacccaaaaatgtggaaggaccaaactctctccataaatatgtaaaccgtaatttaacgctatcactctatcatgatgttaattgacaggtgtatcatggggcatggtaaagccataaaggtagatcaagcctgggctcatgtggaacttgtttgcatccatggtaatcagttgtggggtgaatgtgaaaaatcttcatgttcagtgttaacgtccgcatgccatgttgacccatctcctgattaccaatgaatatggctgaagcagatttcacctgattatattcaccttgagtaaagctggggatatagcattcagatagatttttttttgccttctattgccacccttcttcatctcttaagacttctaattaacattattgttcttatccggttggaagatgtacaggtgcaaatctgatggttcgaacacaatagttttgcattgagctgtcaatctgaatcaagcaaatcagctaccagcctgccagtgagtcctgaatgtgcaatctgaattgattagatggctcatgatgaacttatcgtcggacatgttggatcggtatgttcatcacatttgctccctttaattagctttaggcacaattgtgctgcatcattggtggcttatcgattgatatgtacatgcaagtaagaagtgacttggaaagtatttgttgcctatacggatgggtctcaagatctacactcgtgggttctactgttgacaagaactaatgcactgtttacaagaatattagcaggattctgcatatttccttcaccaatcactactacccgtatcaacctaagactatcatgttttcctttttccttgcacctgtttctgatagttagaagtgacatttttaagtgcttgttgatacagaccattcgtttatattcattttcataaaaaaaagaattcagttatatccaagttttcaaattttcaagcaggggtatccttgttcctcgctgacctcgggctcggctaatggtcgaacggatgcaccagggagaaaagaaggcgacacaacacaccacaaggacagcatagtgggtaggcagaccagctatgttcttgtacacgaacaggagaagcaccactgagccggccggccggccagccaaccgcagcggagtggaggtgagccaataatgctatcctagctcgcaggatttaagtggtatcgtgcacttgacttgaccccataacagttcacccttttgctttttgcctcgtgaatttcttcaggaaaaaaaatctgaccaatcaaggttgtgcagaatgttaacactgcatagataaagttcctcttgatttcgagggctggagtatgtccattgatgattcaagggacaattaaaacccttcctgtgctgatgcagttttgcatgatgctgaagcggtagatcggccgatctgtgacttgctgggtggtaaggacagctaaaaaaatctcagagggatatgaagtgaatcagtggctcaaagttgccatcgtctgggcttgtgcagcacctggtatctcgcattgccgtaagagcgacctaacatgaaatactgcacacagtcatctcatttgcaggacagcgacacagtgtaatgctcttcactgcacacactcagctcatctgcaggaggacagtggcacagtgtactgctctttcgcctcccactcagcaagtcatgcaacagcgccatgtgcttgcgatgaaagcccatcgctgcccactaatggccgaggtgatcgtcgcgtttctacatccgcatcattggttgctcggacggaggccatggggcgcctggagccaaagctgcgtagcccatgttctccttgactccttggatttcgtttgcaagcaggaaaggtattgtttgcactttgcagctctgcactgtgttattcgtttccttatcttctttcttttcacgagtagaattctgctttggaataaatctattttgcctctctcctaattgaatcgcctcacaaaatcacaaaatcggatataacgttttcctcatcttcgaaagctggtgaaaactgtcatccttcctgcctctaatgctgctggaagatgagataggaggaaaatggaagagaggattgatagaggggaaaagataaggagaaagttgttgacatatgggtcccactcattactcaacgagtcaaccgaggttaacttgttactacgtcagtagaaaccgtttccaaaccatcgaaggagctgatttgtagttgagagaggctaaggagctgatttgttatattcggttttatagttgagagaggctactgctgggtggtaactactgtcctcctgtcatggacaagcagagggatgtgacaatcagtagctcaagttacgccatcgtctgggcttgtgctacacatatagcgttgcgcggtgtgtaacgtgtgttaggccgactagtgtagtcctcttcattgcacactcagcacatttgcaggacagcgccagtgtaatgctcttgactgcacactcagctcatctgcagaaggatagagacacagtgtactgctctttcgcttcccactcagcaagtcatgcaacagctcatgaaaatatgcagtgcaaatcacatatgcaatggaaatctggagactacgttggatccaaatatgagtgttttagatttgttcgtgtcaccaagaataaaacttttactcgtggttaaatctaagagtaaatctaggaaaaatatgtagtgcaaatcacatatacagtggaaatataaaaactatcattagactaaaatggacgcctacaatttatcaatgccaacaatagaaaaacttataggcgtccattttagtctaagatagttttcatatttccactatatatgtgatttgaactacatattttcccaaacaacaccatacttttgcgatgaagcccacctgtacccactaacggccgaggatattgtctctgttctactaccttcgtcctagaaaaagacaaaccctgagtttccgtgtccaacgtttgacagttcgtcttatatgaaattttttttataattaatatttttagtgttgttggatgataaaacatgattaatactttatgcatgacttgtctttttaattttttttcataatttttttaaataagacagacagtcaaacgttggacatggaaacccagggtttgtttttttattgggacggagggagtatattacaaatctttcaggtttatcctaagttaaaattcttttaagtgacattaatttgtaaatatttatcaacaacactaaattaatttgtaaatatttatttacaatatatttattttgtgtggaaaatatacctataatttttttataaaatttaatcaaacttaaaaaagtttgatttaggataaacccaaaacgactgtaatgtgacggagggaatagatacggccaagctgggtagctgcgagcatgagaggattggtctgcacattgcagctctgcgctgcactgtgttctccggctcgttgttcttctttcttttatctcctatttcttctccggctcgttatccggcacgacggcgtgggctagcccgtgctcgctagttgctactcgacccagtgtgtagtcgcgacatggctgtgatttgagaagaggaagcttgatgaggagaaggggaagggaggtggggaggaggaagaggtggttgctagcgcggggtggaggcggaggtggaggtggtggcgcttcaacagccggtggcgccgtggcggcgaagactgccgcggcgcttcccgatcgcattgcctcctccccgacggtggcctaggtgatggacgacaccccggcattgggcgtggagcggaaggggaaagagggggcggagcggtccacgggaaactattttaacagcgctcgtgtggacgtccacccgtttattgcatgtcatctaaatggttatgaaaaaatatgaacaagatagatcaatttgtaatatatcaatccacatatttttgttacaatttgtagaagttgaatttgaacttgcatgtatgtggagtgatatattacatattgatctatcttgtcaatttttttaaaaatttttcgtaaccatctaattgacatgcaataaacggatagacgcccacttgagctattagaatccatctccagctgtccacggctccacgccatatatggcccggccatcctgggttcaaagttgttgggctatcttacatggctgtatgccccgaccatcctgggcccaaagttgttcgtttccagcctgaaaaccagccatattcagtcaaggaataagttcactctaggtccctcaagttgtcgccctgtccgatttttcgtcctcagtctagaaaacctgatacaacgcatcccccaacttacaaaacaatacaaaacaacgtcagccaaaatcagggtcaaatactgccgaggacctcgtttgcactggttttgtaatttgttggacacgctgtatccggttttccggtttagggacgcaattcggactgggcaacatattgagggacctaaagtgaacttattccttcagtcaagtgaccgggtcccccaaggacattggtattatcaggcataccgacaaaccagatgggccaatactgaattcagcatacaacgtactccagctagcaccggtttcagtcaaatgatcgatgtagtgcattactacattggccatggatgattggatgtgattgccggttcctcaagagttaagcatgcgtgcgacgagtcgctgtcaaagttttcagaaggtatggggcagttaacaagctgacatactacaggaattatactgatgtcccatttattagtgttggaatacatgagattaatcagtcaaagccaactgccaaaagaactactgtacccctgaaaccaggaaacttcttttctgcatggttgctcgcctaattaatcagtgattgcgtgcctttcggtagttacaagtagcagcagctgtacttactttgattagttctgaatactacataattaagagtttaattgtgcttttacttgtatagatagtactagtagcaggctactactgttatcacctgagacaacagaggatagatatacgagtgagccggtctatccgccgcttttgttgcggacaaatcactgatgctcccgggacagctgctccttctcccgggatttattctcagaagttgttttctcttgacgagatttattttcagaagttgtttttctttttactgtaaactgtccaagtttctaccccgtttccaaaaccattttttctctctcgtttggtctcaaggtctcaccgacctctcttggtcttggccctggggctgatcaactacctagatttattttttatttttttactgtcaactgcacggcatgaggtagtactgtttttcttctctggaattcttgcgaatgcttgaatggatctttgtccatgttctctttttctttagcattacgtcctcatgtcctatgttgcaatttgatgcaggaagcttcttgtaattttctcctgtaattttctctctccttaacttttccacttgatctaggaagtgagccttgtttaggtcccttttgaatcgcaggattgagaaaacgtaggaataggaaaaacgtagaattttgataggaatgtaagtgtaaaacaaagaattgcaaaacgcaggaaaaatacaggaataactgtttgattgaaccacaggaaaaacacaggaattggatgagagagagactcaaaggaaagttagcaaaaggttaggccccctttgatttggaggaaaaatataggaattttagaggatttcaatcctataggaaaatttcctatgaagccctttgaaaaaaagattgaatcatatccaatcctttgaaattcctatgaaatggacaa

SEQ ID NO: 70681 - DNA, 10363 bp, Oryza sativa
ccatcttcgctgtcggagattcagatcaggttgggtgaagatgtactttagacttttgtgatctgtatatacctcacaacggttactgatgagatagtgccgccaaatctttaaagcatgaacgactgcggccaattccagatcgtgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaacttctattgcattcagcagaccagataaacttttcttccttcttcaatagctgtgtcattggcttagcaattttagagaagttctcaatgaaccggcggtaatagcccgcaagtcctaagaaactccgaacctgagtgactgtccttggtggggtccacttggtaattgactccacatttgctggatccacagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgataaaaaccacgacaaacttgtctagaaattccataaacaccttgttcatcaaattcatgaagaaggcaggtgcattagtgagtccgaaagacataactgtgcattcgaacaacccgtaccgagtgatgaatgctgtctttggaatatcctcttcgcggatcctcaactggtgatagcctgatcgcaggtctatcttagagaacacagtagctcctttcaactgatcaaacagatcatcaatccttggcaaaggatacttgttcttgatggtgacctcattgagtgcgcggtagtcaacgcacattctcttggttttgtctttcttctccacaaagataaccggagcaccccaaggcgacgtgctcgggcggatgtatcccttctgtaactgttcatcaacttgcttcttgacttccgccaactcgttggctcccattctgtaaggcctcttgtggatcggtgcagttccaggtaccaagtcaatccggaactcgatatccctttttggtggcattgttgtcagatcatccggaaaaacctctggatactctctgactatgggaatatcctccaacttcttagtggttttctccactgctacctcttgttcttcaccagcagcctggtttaaactaatccctggcttccgcggcactggagactggaaagttaccacctctccttttgcattggtcaacttgatggtgcggctggcgcaatcaatcactcctctgtgccttgtcaaccaatccattccaagtatgacgtctaggtccttggattcgagaagaatgaggttggctggaaaaatcgacccttgaatttcaactgtcacagatgggcagtagtgagttgtggtcatgccacctccaggagtatgcactcgcattggtatcttaagcttcactaaagataacccatgtgcaccagcaaaacgcttggaaatgaaggaatgggttgcaccagaatcaaacaatactactgccggtgtcgagttgacggggaatgtgcccaatataacctctggtgctgactgcgcctcctctgcagatgcatgattgacacgggcctgaacggacttgggtccagcacgtcttggcttcgagcactttccaaccgtgtgtccgggtttgttacaattgaagcagagttcgggtttttctcccaacctcttgggctgttctggcagagctggctgaactgattgagctggaatctttagtgaactcggagtagggttgagactgtgctgctcactgttgttgtgactgccactatggtggttcttgttgaagctacccgggtggtagggacggtgctgtcggataatcatggtggaaggtccaccgtgacgtcccatcgtgaaacgaggcttctgactcttcccctggggagtcctgaactgagctgccttcctcttacggtttattttgttaccgtgctcctcctgacggatagccttatccaccagcttctcaaagtcctcataatctctagagatcaactggttagtcaattcatcatcaagaccagacaaaaacttctcctgcctctcggcatcagtacgcacgtcctcaggggcgtagcgcgcgaggcggttgaactcatgcaaatactctataactgttctggttccttgttgcagggaacggaactctctcttcttttgtgccacaattccctcgggaacctgtgctttattgaaactatgacgaaactctgtccaagtaacctctgccccagctggacgggtcaccatgtagttgtcccaccaaatagaagcgggaccttgtagctggtgtgtagcaaaagcaaccttctcctgctcgttgcattgcaaaagattcagcttcttctcaatggcatgaagccagtcgtgggcctcgattgggttggtggtgcttgagaaagtgggcggcttgacacgaagaaattctaacagtttggactgaggaggtggaggaccaaactgcaggttctgctgctgctgctgtgcttgccgctgcacctgttgcaacacctgatggtactgttgttgcatctgttgcatcattattgccatcatctgagtctgattgtccaacacctgagcgatcgttgggttctcgggcggtggggacggactgctattaggtgcattgctggcacgtggtccattgatctgctcttcgctgccactggcgttgttcgagtcgcgtgaaccattccttatctccatctgaaggggataggtagaaatatgagaaaaggaagaaaaacagggggctcagaaactaatcttgcttatgaatttaagtgcaattatcttaatcttgattaaaacactgaaaaagaggcacgcaactcctaattgaggcagtcataccactgacacatgatatcgaccgccgactaacccacaagcaacaaacctaaacacgaaaactagcaagcaaacagactaagaaggcgataaagctaagggcggcgactctgaagctcggggcggcgcttgcaaacgagggataggactgacatctaaagtagacaagggataggaaccaattcatgctcaaatccaagttaaacaaagcaaaagaagactcaaataaataaccgagcatgatgatttttatgcatagaacatttttcatgaactcaaataaagacactaatgcaactaaacaataaattaatgcatagactagttgcatggaaaatgatgcgcataacattgcccccatcgaatatagacacgacctaatgcataacccccaataaattcccgactgactgtcgaataaactccaactaaaatttttctaaagccctagactgagctaattttttttaaaaaaaaatccgatccgaataaatgaccaagatttttcccgcaaaccaaagaggcaaaactccaaattttcccaaaacaaatccaagtgaaaaagggcatatgcatatgaaaaggggttcagaaggctgttaggtgttccagttggcttgtcctacggtcaaggtcggctctgataccaacttgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcgggaaagataaaagcgagctaaaccgggaagcttgacttcagcagcgagcgactccactccacaggcaaaccttgacggcagcgacgaaacaaactttggcaaaacagctccaacaaggaagatcttcagctctggtgtgggggaaaaagagagcaagactgagtactacccactgtactcagcaagtcataccggaagaggaggtatgatgcaggatataaccaaaggaggctagaggttcttttgcataaagctagcatttaaaagcagtagttgaaggcagtaaaacagttgtagtaattaatcaatattaaccaatcactgtccaacgctacaccacgttgcaacaggcccaaccaaccacctgaactacgccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacagcccaccattcagtgtattttaattaactgacacccatgcggtggcaccaatctaaagctatgctcatagtcaaagtctatgtaataatgtgatccccatttgtgtgctagttgaactaagcatggctaagcatttcctaggccaacatctagtcattttgatacccaagttatcaatggcatatggtaaacaataaatggctgagtaataggacccatcccacattacattgtaaaaggatgcaacatttaatagaaatgcgggatatttgtaaattgggtacaatatgatcaaacgtattgaatgacttgccttgctctcgcactgatgagacctcagcaacgtcttcgagaaaccgcggaacgacgaaacggccgaaacctacgcgacaaacagagcacacaagcaaacatgctataagactacagaaacaggaaacaaaaccatttttaatggattctttgcatttttcttgatttactgagacttgaatggacttaaacggagctcggatgaattacttatgaattttagaagataaactgtgtttttactaataaagaaaagtccttaatcactttattgcgcaataaagcccagggctgacgtcatccaagggggggggcggcgccgacaggtggggcccgcatgtcagcggttcaagagagaggaagggggcgccggcacgtgggccccattggcagcggcacaagggagggaggtggcggcggcatgctcggcatggctcaagccggccggccagccatggggcggcggtcgaagacgacggcgcacgcgcggagggcggcggcgctcatgggagagagaggaaaggaaggaggagaggggattcctcaccttcgagcacggcggccggcgcgaagaaagaaagcggcggcgacgaccggtgatgcggaggcacggacgggcggcggcgacaccctaggagaagatggagaggcgttagggatggagaaagcgaccgcgacgaccaaaatggccggccggagatggaaacaatggcgagcacaccggcgacgcggggaaatcggagctccggcggtgattcgcggcaacgaagcggcggccgaggtagctctcgcggcggcgaagctaacggcggtggtgggttggcgcggcggcgaccctagcggcagtgacgcgcggccgaaggcgacggcaagcggcggcgctagcaacaagcggcgcgagcgcgataggaggcacgggagagcgcggcgaatgagggaaaacgaaagagggggctcgggagagtgcttttatgggcaagggaggggaggacgtggccgggaaccctcccgatttggccggcgacgtggggaggagagagagagagaggggtgggattcgaaatcgaatcccgccctctcgagcgcgcgcgcgggccgggagatgcgggggaagaggcggcgacgtggggaggacgcgggagcggcgcggcgtgggcgcgggaagagcggaggaggcggcggcgtggcggattcggcggcggttgccgtcggaggcgggtggctggaggaaggggacgacctgacaggtgggccccacctgtcagcgtcccggagagagggggaaggagaacgggccggcccacaaggggaaggccgagcgggagagggatgggccgacggcccaacaaaggaaaaggagggaaaagaaaaaaaagaaaaaggattttcctgggattaaaattgcaccttggtgatttttaattggtaaaaattatttccaaggctctgaaaattccactaaaaatcctgttaatatattgtgacatgtggaacccaagaaaaaaatcccacaatgccaattccaattattaattgcatttattaattatggaattagctctaggttaattaagataatttcttcggacaatttatttaaccaatttttttaaagcaagaaaaaggggaaacttccgggcgtgacatcccttccccgcttctgatctcttgcgcgcacgagagattggaagaagcagtgcctccgaaaccacaccttcgcctgagatctgcaccgggtaggcgggtgatcaggtttttggggagtgcctcctgcacgactgctcatcgccatgtctggagttgctggcggaggtggtgcgccgccgccgacaggagctggatccggagctggtgcgccaggaggaggtgccgtgaacgactacaacaacggaggcaattctgcctcaccatccagcggagggccattctcggggtataatcttctcctcctactactgttgttagcgctatactgtgtgagctatgttcttgttcctgttctacatgatgcctctagcatgttatcgcattactggtatgttcctgtttctgacattcatgatgcgcatagtatgctactggttatgttaagatcaccctacactgcttatgccatgatcattgtttcaatttcttggattaaaatatgccgaataatgactatatttccaacagaggtagcggacggaaagcagtggccgtcactatcctcccttcctcgtgccgacattgccccgccgccgtcgccgaccttggttccggcgccgtcgtgcgcggctctagccccctcgcggccaaattgggatggagcgcgccggccgcgccgcatcgaggaggaggccgcaacgccgggggaggaggtcgcgcaggttgtcaccagcatcgtctcggccgctcgtctccatctccctcttgccgccgacgctcacctctctccctctcccttgtcgccgccgttctccctctctctcccgttgacggcaaccgcgagggcgatgaggagggccaacgccgccgccggagccacgccgttgccggtggccgacaacgcgtgagcgcggtggtcaacggcgagaaggggaggtggaagggacgagggtggaagaggaaaaacaggggacggagcggtgtcgttgggctactcccctacccagctcgcctcctctatcgctcccctagccgaggcgctcgtagagctgcgtccctttgctaagggacgtgcgcttctgctggggcactgagcggcgtgaaaaagggacagggatggacggcgtgagctagggacgcggcgtggagagccgcattgtacatggccttatagaactactccagctagattgattatagtatctagtaacatgtttgattattttgtaacgaaaagagtactctatctagttctatgaatgcgttcgacacaagaagttcatttcaaccagtcctaagttttcaaaactgcaaaatggggtgttttttaataaaaatatcttaaaattgtttttaaaaattatattaatttatattttaaatttgcaatagttaatactttattaatcattcgttaaatgagatatctcgttttatgtaaacaaatttcagttccctctacacccactgcccacctagcttaaatagttgtaatactccaaaaacaagtttcttattttcctattataatgggaagttcaggcttcatgtcaacataaattagtattatcttcgtccttaaataactttatttcacactcctcccacacgtaacaatataaagacaaaatgattggaattacctccattttataaaattctaatataattgtttttcactttatcaaatcctaatataattgttttccactttcacaaaccctaatgaaatggttgtttgaaacatagagttacgttggaataaataagatggtggaaaagaaatatagattcactactactccatgttgtacgaggtagcgctagcgcttgcacccggtgaggcagcgcacaatgctgatactccatgctgcacgatgtcaagcgcaggccatctcgacagccatggtcagcaatcaagcatgtgctattgtttcctggatgccgagcaaggcgccgcacggcgaggtggacgaaggggagagggtgcggcacttttaggagaaggaagagaccgcgcggtcgcgatatgacttttagttttagtttccccgttctctgtgaagaacgtttctgatgaaattttgtgagggagatctgatgaaatgggccaaatggaaccgggagaagtgaagaaccattgcaaaagcagagcacctgtgttgcgacttgcgaaaccgctgaaaacaaagagaatccaagagcaaacacttcgatcgctcctaggcacggcacgtacgccggcgcaacgaaagaaaattcaacgaaaagaaaaaaaaaacagcaatatgttaaccgcggaagcggggcgatcttcgagccggcgacgagcggaggctggccgccggaggaggagcaaatgagttccccgatcaccaccggagaggacgagaagacgaagacgaagagtgcgtcgcgggggagtagatgatcaattgcttccaatccaaaaacctgccactatttataggctcacacattttccacattctgctgtgcttctccaagcgtgggtgggccgtgggctccacgtgggcccattcatcctcggcaaccggtggtgccgcgtcaacgtcacgcctgcctgatgtgcattgctttgtggtcgtttttggtttacacgtacggacaccgtgcgggccccacctagttagccaacagtgtagtacagttcagcttcgtctccagaagttgattttttatgagacggaaggtgtagtccacacgcagatcggcacagaagatccaggccggtacgtgtggggcccaccgtccgcactgacgggcgcacagagagatgctgctaaaaccagagaacacacgggcggaccccaccaagccacggggccccaccgtccgcgtaccgacacgtcggcctgatcctggagaaggaaacgcggccgtggggcccgtggccctgtggcgataaggtttgctgggtcgtagtagtagtagcagcgccggcgcgggggccacgtcggatgccgcgcgggccccacccgggtcgcgctccggcccccacgtgcgattgcctctcgccgcctcggtggcttcaaatagaacgtcatcgtggacgccggtgcaacggtggccgtccgttcgcgcgcgcgagagagagagaccaaccaagctctcgtacgtgcggctctcgatggaccgcatgcacgatgcgggtgcgatgcctcactctggaaagcacccaatttcgttctctttggatgaagacggttgcggtccatctgaagctgtcgattcataacatattaacatgtgtattgtttgaaaccagtttaatcaaacttacaaactctgaatgcaacgtggatttagaatctagatatactctctccgtattttaatggatgacgccgttgactttttaactaacgtttgaccattcattttatttaaaatttttaagcagatataaaaatatttatatcatacttaaagagtatttgatgataaatcaagtcacaataaaataaataacaattacataaattttttgagtaagacgaatggtcaaacgctgaataaaaaaatcaacggcgtcatacattgaaatataatatagaggtagtatattttatttcgtgtgggatataagagtgtcttaccacatcgacatcagccacaaaagaacaacactccctccgtcccataatataagggatt

SEQ ID NO: 70682 - DNA, 91207 bp, Oryza sativa
gccctcccagagggcggtaggcgactatttccgtcaattttcaaaatggaaaattatttttgtaaaacttttaataaaaaaaattataaataaaaaaaattcaaacatcacctgctcagctcgtacgaaaccgattaaagagcagttttccgtgtacacacaaaagcgtgcctggatcaagcgagaccccaccacacacacacacacacactacgctagctaggttgctgtacgagagagagagatagagaagtgatcacgattcacatggcacatgcagatgcatgcatgccaagctcgtttttaaagggcgtgccatgcatgcatgcacgatgcatgaggacttgtggagtcgtctgtctagctagctgcatgcatgcatccatccatgccagcgtcctctctcgtctgaatgcaagattcacaatccatgtactccctcggtcttaaaaaaaaacgatcctaactatgtagctagacatatgttatattcaaatacatacctaggagttgctctttttgagacaaagagagtacttactgcatctcaaaatatagcgacaaatttaaattggataaatcttattatgataaatctgaatatatatccatccagatttattatgataggatatgttttatcccgtcttagatctatattttaaaacggggtagtaccttttgctcaacttaagtccatttttcatttatttcacacggttccacaaaactgaaaagattataatacctcaatttattaaattctaatacaattatttatttcccatgcattatctatccttaatatatattctttatttttacaaactacgatacaataattactaacaaatagtataatctaaaaatgattgtattcgagagagaaaccgccgggggtgagggagagtagatacaccactcacaccagtggctagctgcatctgcatgggacccctgcatgcgtacgtcgtcctgcctgcgacgacggtactgcgggcgatcgatcgatcgatcggcgatcccgtgcaagcatgcacgcgccggtatatatttaatgtataatgtcattgacttttcatttaacgtttgaccattcgtcttatttaaaaaatttatataattattattaattttattatgacttgattcatcatcaaatattctttaagtacgaatggaactcgatttgagggggtgaaaacgttgagcgttgttggacaacatgaatgaaatcgatcatattaatgcagtagtaatattagacgacgcatatttaattatgtctcttcgcttcgaaggacgttattactcccttcattctacggtcacgcgcatatgatacatctacactacaaatagtagaaattgtgttgggtttgttgctgttgtggctgcacacccgtagcaatctctcctgatcaatctcaacatactccctccgtactcgtaaagaaaatcgtttaggacagcgacacggtctccaaaacacaactttgactttttttctataaaaatatttattgaaaagtgatatatgtatacttttatgaaagtatttttcaagacaaatatattcatataatttttatattttcaaactcaacaacttgagagttattcatgatttatatttctaaagtttgacttaacattgtcctaaacgacttttttttatgagtatggagggagtaggttattttaagtcttttctaattaagtccaactcctttaagtttgattgaatttatgaaaaaattataacagcgtctaaaacacataattagtttcatcaaacccattacataatttcaattaagtgggtcatattttgatttttcttttgctttaaaaatttatgatcttctaaaaactaaacacacagacggtttattatttgaataagtgatttgctttcgattatgctcttgtattaattttcatcgaacatattttctcccataaagtacttaaagttttcaacaaacaaatgtacacctataaagaaataaactcaaatgtactacacacctataaagaaataaactatttcctggcttctcacaaagagaaaacggaagaattaatagcgaaacagtaaggggttatttggatggagctaacttcgccacatatttattttatcgtaagtgctgtagacagtacgttgtgtctcatattgacgaaatttaacttaaaaaattaaaaatatgaaatgtgagccaaacatactccgtgacacttaaaaaattatggcatacctaatcttttgtgcttaccaatcttcgaccaactaaccagacaacccctaaacttcagcagttcaagcaggcagtacaaaaacaaatggacggcaaagccgcaaatgctcatcagtgacggcaaatcggcaacacggataagctgccactgaaaatccgcgcgctgtaacgcacacgcatgcattcatttgtttttcccccctcctcgccacgctgcgggccatgcacgcacgaattatttggcgcgcacacccggccgtctccttattaatccatcatcactcccattttgtatttgcactaataattcagtttattttagtttcgtgattccttttggcgtggctgatggggacaattaattaaaaaaacgaaactggctaagaaagggctaatataaaaataaacaactccgtagacgtacatcgatcagctgaggtgagcatgatcgatcgcggttacacgagctccactaaattattgttgattaacttgcgttttcatcgagcttaattatataatccgtaattccgtatgatttacatgactttttatttatctgtatacagttgattgtaacatcgtaaccggttcgattaatttacgttaacttgtactcgtacatatgtgctcgctagtgtgattttttttagagttaatttcactttgcaccatgttttatttccaaagtaaaactttggaccactctttatctaatcttttcactttagtctaggtaattttatttttattgcacaatgaatcaccccaaaccacatctctttagcatttcaatgacttttactccctctgtcccataaaaattacatttctagctaatttaggacaaaatggtaggattagaaaatgaccacaatgaccttatttaatgaacccattgcatgcacatattccatatatacaaatgattaaaaggaagtttgagagaattaacccatataattagcatacttaaattacaagctgagagaacttaaggaaacttataatgaatcaatttgctggccccacatggatagaaatacaatttttatgggacaaagccttagagctagaaatgcaatttttttgggacggaggtagtagcaaattgttaactaacgacataccgacaaactttcatatctatatattcatgctataccttcatcgaatgagacgttaaagcggatagagataggccagcaaaaaagaaaacgaatagagttagggtgatctattatgcaacaaaagtaaaagtaaagttacctagttcaaagagaaaacgttggatataggatgatacaaagtgaaactttaataataaaacataaacaaaaagtacatttcactcattttttatactacttgggttaattatgggaacagttagtacagaacttacgtttagtaaacaaatttgtaccattaaagtataggggcacctaattacttacgtgtgctttactattactccctcctccgtcctataatggaagagattttgacattttgcttatcatatttgaccattcgtcttattaaaaaatagaattattatttattttatttgtacttactttattattgaaagtaatttaagcacaatttttcgttttttatatttgcacaatttttttaacaagacgagtgatcaaatagtacaagcaaaaatgttaaaatcacttatattatgggacggaggggtactagttagccacgatcattgatacaggcatgaagaaaaatactattatactactacaacaactactaattaataaattaattaattcagaacaaggcatgcaataaaaacatgcatgcatgtgcatgcatgcaccaactaacctatactatgggattatattggagtagtacgtcgtagcaaaagagcaaatggcgtccagccagcgtctgtgtcattggacgggccctttgcgtgcatttgtaaaattgcacgtatgtgagcccactggatatatgattacgaaatagagatgtgtagttgctatctataaataagtacgtaggacattaggactatatataggtaataatattgttgagccagaggctaccgtctctacgaggcatcatgaactcatcccacacacatatgacacgtgtgattaattaagtattagtattattttaaataatagttaatatgattttttaaaacaacttttctatagaaaaatttagaaaaaacataacgtttaatagttttaaaacgtgtatgcgaaaaatgatggagagataattaagttgacggccgaacagtctaaaattaggggcaattcgaaattcgattcatgtacaagacatacaaattaaagagaccacgcaagaggaaaataaaaaaaaagaccatattgccatttaatatcatgcatctctactctctttttagagccattgattcgcaaggaaaacaatctaaccatatcttcatcgaaataaaccatgtatgaacataagcagctcataaaagaacggaagggcaacccaacattgctacgtgcatgaaccaacgaggctaaggcacaagacggtatagcctattatatatagatctatgctaggcctatgatggtgaaaaattgtccaagcctgtaggtcgtcttttagcccaaaccctcggaccatgacccaaataagttgtccatatcactacaacaaaaaaaaactcatacagaggaactttcgtagagatgttttgtaaattgtttctaagatgagtagttttatagtgtaaatacactttatagaggcactttaaaaatgaaaaaagcacgaattacactcccgaactatcgcggtcgtccgaattacccccctaaccataaaaccggacattcttcacccccaactatataaaccggacgaataaccccccttgacccaatccgctgtggttttggtctacgtggcgtacgcgtggcagtccagtcattattctatttataaaaaatatatataggacccacatgtcctcctctctctctcactcttcccctctctctcacgggtcagcgaaggcggcggcgggggatgaggaggacaacgaggatgttgaccgggtaattcgtactttttcctttaaaaattgcctagaaaacttttactctagagatattttcaactcagtttattagattttatcttgttgagacattctttcggcattgtaaaatgagtctgatatgtaaagacattttcttgagatattttaaactatgtagagacactttttagaatgataatgtgtactaaaggactaaatataagtaactaaaggcacaaacatacaggtatgtctataaaaaaatgcctctaccatcttatagacagtttacaaaatgtatcttcgtttgtagagacaattcaccataagacactttttagacattttttaaaatgcctctacaatattgtaaaggcattggttttataagttgtagtatgtctatagaaaatgcctctaccatcttatagacattttataaaatgtctcttcgtttgtagagacaattcactataagacacttattagacattttttaaaatgcctcgcatttgaaaaatgcctctatagtactagaaaaatatctctgcaaagcatttttgttgtagtgtatgtttgcccttgtgcatgcataggcacatatagatagatctaagaaaaaaataaatttgcgttattccatctatatttgcgtgcaaaggaagctgacatatatgagatatatagctggcatcgtagcttctttcgttttataatcgcttctattactaaattgatatttagttctttttgtgtgctacaaggcaagatgacacgtgaggcaaacctccctcctaacctcctaggtggacggggtggccacctacggtgcatgtctcgtggcacatatgacgcgtgggactatcgtgccaacctcccttccatgtagactcaccgcttacgatgcatgtgtcttcctagaacaaagtgacgtgtaggactgtggggctaaccttcattccatgtggggtgcgccgcttatggtgcatgcgtcttgacatgtggaatgcgcgtccacgatccctctcagggtatgcatcaagcgtgaatgccatgtggaccatccctccatcccttcatctcacgtggacatcatgtatgctatgaatatagctggcgcctatgcaaaagaacggtgtgtgtaagatcattatcctctctcttatggatggaaacatctagctattgtgacgcatgcgcgttaccagaagctcggtgcacacttttcgatagtatgaaataaaatattttatcaatcatatataaaaaaatcaaacttaatttaggactatttacgattgtcaggattatggataccacatacttgactaaatctcggcaggacccaccacataccatgtcttatacggaaacaacctgtggatataggaggagttccggataaggaaagacaaccagagttctatatggaaacgacaaagactactcggattgtatccatattggtttccttagttctacttggacaagggaacacctatgggtataaatacaaggctccctaggaatagaggggacagaatcaacacccaccacaattaacatagacgccacaagccaatacaagccaacatacgccaagacaagacgccggatatcgacattagagatacgcctggatcgaccctatccggtacctacagaggccggccatagggatctagcgctgtctttgatctcgccgggtacggattcgaggaggaagactaccctgttgtcgactacgagtcagaccttcagaccgccatgtcgacaacagttagataggctaccccaaatattgtaatggtgtgattatggtgaataagagcaataccggcttcggccaacaggatgtagggttattacctaacaattcagaggcccgaacctatataaaaatctctgtatctgtctcttttatctcagtcttgcgtatatcctagtaccaacgatccccatactatgcaaataccggaatcgcgacatcaaacgtcgacaacgatgtcttaaatattcacattgtgagacgattcatatcacatttattagtgctacaagtttaattaccttaatttgtgccttcgcagagcccataagagcaagttcaatagtatagctaaatactagctccaaatcatctataaccaatgtaatagccaattcatacaatagttgcttactatactattaatacatggtactacctgtcatacatatagtacgtcttggagtccgtgctgcagctggctatagatctgtagcccgctgcttttctctctttaaaatatatttatagctagcttatagcttgttattgtgtctgctctcagcataagcatgcattgcatatatccttccaacgagaaaaatccacacgaagagggaaaaaaccaacgtgcgggacacacgaagggaaaaggaagggacgcaagcgcgcgcggtctcctcgccttatcgtctactcgatccggtgtttatcctgaggcgtggtgtgtgtgcgcggagactatttagcgtctaatcacaccactgttctcgcgatcaggacggcataaattaagacgcaatacaacgtacccacgcatagtacgtccgtccatcctctctagctctgtaatggctctgatctgcactacacggatgcatgacagtaattaaaaaaacgcatcagcgctacctgcatgcagctagttggtgatacagtgatttatggagtacatctcggcaacatatatcctatgcagacaggccctcacgtgtacacacgtgcacaccaactaaaaaatatcaccaaaaaatttagaaaaaatcatacacatactttcaattgtattacacctagggttaaaatcttaacgtcaaattcattatattttagccgtaacaaaaaaacaaaaaatctgacagttttaaggttgcaattttgtcagaattttatcttttttgttattctctatgtagaatgaatttgaagatgcgactttgcacgtagatgtaatactattgaaagtacatgtatgaatttttctagaattttttgtgataatttttagttagtgtacacggtgtgtatacgcgagggcctgtgtgcataggatacgctcccgtacatctctaacactaaaataacatcagtaagggccctttgaatcgcaggtagaaaaaacggaggaacaggaaaaatacagaattctgacaggaattgaagcgtaaaacagagaattgcaaaatacatgaaaaatacaggaattgtcgtttgattggagcgcaggaaaaacacaggaatcaaatgagagagatagactcaaaggaaatttttcaagaggttggagctcttgctaaatttcctccaaaatccacatgcaatgtgtcattccataggaatttcataggatttggaaagcttcaatcctttgaatcaaatggtcaaataggaaatttttctataggatttgaatcctataagggcccatttgaatcgtaggaatgaaaaaacagaggaataggaaaaacataggattctgacaggaatacaattgtaaaacataggattgcaaaacacagaaaaaacagaggaatgactgtttgattggaccacaggaaaaacacagaaatcggataagagagatagactcagaggaaatgtttcaagaggttagacctcttgctaactttcctccaaaatgtgcataggattacccattacataggaattttaaaggatttgatatgattcaatcctttgtttcaaaggcctttataggattttttccatagaattgaaatcctccaaaattcctacaaatcaaaggggccctaaaattcttatataaatcctttgattcaaaggggtcctaaataatatgtttctctagtactactactatactgttggttcggaatacgcccttccattctataaaaaccaacataatactcgatatgatatactgcctccattccaaattgatctacatataggctttttgaggttattcctaaatgatatacatatttgtgttcatttattaagtctattcgttatttgtctattggagtaaaatagacattgatgcatgcatccatgcacacaagtatttataacccacatgcaatatcttaatttgctattggctaggaaatattggggatggtgcatgtattgagtttgttgatatagtaaatatagtatgagagagttattagcttttcttggtcttggtgtacctataaaatatgtagatcaatttgaaatggagggagtagtatacaacattgtttccggaaaagttttaaccagatttattggaatacattacatctgacagatctagatataagtttgtaattagatttgtagtactattagagcaggtataatagcaggctataagccaactataaacatattttaaaaagataaaggaaaaaagagaagagcagcgggctatagatctgtagccagctgcagcacgaactccaagatgtaatgtgtgtatgacagatgggaccagatattaatagtatagtaagcaactattgtatgtatgggctattatattagctatagatagtttggagttagtggtgggttatactattaaacttgctcttaaacattatattcggtactaattaatgttttatggggcgtatattttttcttttttttttcttgtacgacggaggagccagggatgagaggagggggcggggcccaccacggcacggcgtgttccaagctgtttttacgcaggtagtagtagtacgtactattagtacgtaacgagtacagctagaacgctttgtttttcttgctgttgtagttgtacgcaacttttggcttgataatatttgttattttggataaaaatacggtctctaaaaataactttaaatattattttctattataatatatataacagtgttaacaaacataagatttaatatgttttgttaaagtactttttaaaactaatctatatatatagtcactatatttgaaagattaatatttttaaaataatttataataaagattttaaagtttaaacttattcttatctaaaacgataaatattatcgatacgagggagtagtatattatggttatatcagtagtacataccagcagtagtataattgtagcagtagttgtagtagtagtagcatacgatattttttttctctctcccggcccctttcgtgatggggaaaaccgatgacctgctgctgttgtgctggtgcggtggcgtggcgtgctacgtgcatggggctgcggctctcgccggtaggcttaccgcccgcgcgcggcgcgcacccacccaccgccccccctgcgccgcgtgaccgtaccgcgcgcccccactctccgcatgcatttcgcatgcatgcaccgcaccctataaaacgttcacggaaattccccgagaatcgttttcgtataaagtgtatcgttttttataattattgtttttagttatatataaattttgtttttctaatttatttatacatcgcattgacgttgatagcgtatagttgaaatgataaacattattaattatcgatcgatcgagtatcgtttctgaaaaggatatcgattcggatggttttggaccgttctcaaacacccacacacccacctccctcccctcgtcggcggcgagccatccgccggccgcgccgcgcaccgacgcgtgcatgcaccggccggcggtgacgagtgaccacacgtagtatagtacaacgttacgtacgcgccataatgattctgtcagtgaccgtggcggctagggacgatggacgaacgcacaggacatgtcgtgtgtgctgtgcggtgcagtgcagctgctcaccgatcaagatgttcagatgcatgcatgcatgcatggtggtgatcagtgtcgcggtctggtttggttttggattgatcgaatttttgtgtatggcggccatgcatgcagggtgggaggtgagggccgagagaggggaatcgatcgggaattcggaactcgcaacgtgcatgcagagagagcatggagccaggcatgcggcggttgactccacgccgatataaaagaatggttagtgttagattagatttagatcgaccctaattaaacacatccatcgattgatctctaattaatctctctctcgttccaagttggacagaaaaaaaagaatatgattattcgtccatcacgtagacaatcacagtacaacgatgagagattagtatataaaaatgagtagttatgagcgagattacgaataataataaaattgggtgagagagtagtagagtgtgttggggggggggggggtgtcgtgtacacgtagcaggaggaggcgctggtttgagtagtaatagtagtagtactactacaacaacaacggcaatttttttttcttttcttctgggtctcgctttaaaagcctcctcctccgtctcgcttcccctctggctctctcgtcttattccgtccgtcccccacgattcccacacaccccaaaaccccccctcctctcctctctcgccgcgcggcgccgcgcgccccggggggactcgtcgcggccggccttagggtttcgaggcccatgtcgtcgccggcgcagccgcccccgacgcggccgccggtggccgccccgcccccatccctcgcggcggcggcccccatctcggtgcagccgcccccgctccagccgaaaccgccgccgcatccgcagcagccgcctcaggcggtcgtctcggttggggttgggccgccgccgccgacgccgcagcatcagcagcagcagcagggcccccccggtcacgcgccgccgcagcagcggcccaggatctgcttcaacgcgcactgcaaggaccccaaatccgacggcccgcgccgccgcggatggcgactccgcaacggcgacttcgccgagctctgcgaccgatgctagtacgtacgggtaacccccttaatcgcctccctcccccttccccctcccgcgcgcaatcggcggcgcccccccgcgtgctcgattcgtgcggggaggccggctcttctcctcctccacgcgcgggcggattcgcctatggcgcccaccggatctacgtggagtgatcgccacgtcgttgtaatttccgcggaatacgcgggggttttctgtaaaatttttttggggttcctcgtggtggtttgactcgcgtgcgactccgagagagctctcctgatgccatgcatggtgtgttctgtttcagtcactcgttcgagcatgggggcttttgcgagactttccatttggaggttgccgggtggaggaactgcgaatcctgcgggaaggtacggtgccccatgcatgctcgtttctctaatctttcgagccttgtggtggtgttcgtgatttgtgcttcctggctgatccctcccttgtatctctgttcttatcctgcagaggctgcactgtgggtgcattgtgtcggtccatgcatttgttcacctcgacgccggaggggtcgagtgcgtcatgtgtgctcgcaagtcgcatgctgcaatggtatgtttgtggtggctgttgctactgttgcgtgaatattggctgtaacaattggattgacggtataatatgggggatagatgtcttatgtagtattgtgctcccttcatgtgtattttgatccttggttggtgattgataaaattgcatgcattgcttggcagaaacttcataagtactggatggttcgttttatcacttgtgttccacttattgtcaccttctggcatctatttttttctcattgaaatggaaatctgagaaacatccatcattaactaaattgcagtctatcttggttggcagcattaattagggaaagtctgatgtattatgtagctgatgttctgttgatatatctttcttgccatttactttgaagctgttcagtgaactatgtaaagggtgtttctcatctacttctatgcatggatttttttttttttgaattcaacagcttttgcaaccgggtttgttttctttgggagtagttcgtactttttacttatcattataccttgtagttcgtactttttaattatcattataccttgtagttcgtactttttaattatcattataccttgatcctcatgtttgtcaggcaccaagtcagatatggtcatcttccatgcatatggctcaaaatgtagctgatagaaaagacaattttgtcaagagctggagacctcctgccgggcaattttcaagccagtggcggcagaataatatgtggagtatgtccaccatgcagtctgacttgcagcagcgcctagcttttgagtttgataggcctagtggcagtgaaaaattgcttccagggcgcacttttattcatgcccatgagaagaaatttgatgacatgcatgacagatcaacaacacctgctggcatgaaccagattatgagggagaggtatgccaatgggcatactcagcacaccaccctggatccgacgtacgcttacactctctatcacagagaaggaacaaatccaaatcttcatgaccatagtcaccatgcaggagaaaatgaccatttgactgcaaggaaaggagtaacttcagatccttgttcctctgtatctactaccttcaagcttgattcacaccatccgtccattttgaaagatgatccatcagccgtaccagctgggttgtcttctaatttttcatcagcaaatggcccaaaagaccatatcagaattggaccaactcagcagcagcagcaaatggcttcctcctcattgcagaaacaattctattcccatagtgtgattgataacgattttcaagcgcaattgcgcaatggaaggcctagaatggatgcaaaggcgagatctcagttgcttccacgctattggcctagaataacagatcaagagctacagcacctatctggagagtatccaaaaaattctatgtatcttcatcagcaatttcctctagataatatagatttactagtaaatactgtcatttttttcacgtgtttttttttgtttaaactcttgcctgttcttaagtgtttccttaaccctccaacagctcaaattctgttattacccctttgtttgagaaaatgttaagtgctagtgatgctggacggattggtcgtttggtgttgccaaagaaatgtgctgaggtgagttattcagttatcgttttaaactgtcttttcttttattagattgtattactgaactgtttattatgctaggcttgccatgcatgggatctgccctcattagtgtttactaataacccatgtatgatgtatggttatataatctgtccttttacttttactaggttttgcaacttatcccgagtcatgcacagatatttgacataatctcgtgatttggttatatatatgtgaataagcttgtgatttaaaactaatctgatgtatgggaacttctatagaaatgtgggttatttagaattaccagcaactattgccttcattttagttgttttaaccaaaagtgggttgaaatcagttgatgctacattataattggatgtgcagtcattttacatactttgctgatcacctccaattttgtttattttattgcataaatactcttctaacaaaaaaaaaagtttcgaataggcgtacttccctgccatctctcaggcagaagggcttcccttaaaagttcaggatgctactggtaaggaatgggtgttccagttccgcttttggcccaataataacagcaggatgtatgtattggagggtgtcacaccttgcattcaatcgatgcagttacaagcaggcgatacaggtatatatcttctacaaaagactcagtatataagtttgctaatgtgagttaatggtatgctgcaaacctatttctaacgcatagagatttggcatgcatgtagtaaatcattaatatttttctgcacattttatattagggcacgtcttatccatttagatgcgttatgttctaatgattttattgtatttgctgttttattccagttccagttgtgctacatttcttaaaaatgctatctgtgtgattcctatatcttctttttagtatacacatgattgtgcttatctttctccatatgagaaacatttttgtttcttttaaaattggcttatgatttttttgacatcctagttcatgttgccatattttttcagtaacctttagccgaatagatccagaagggaagctggtcatgggatttcgaaaggcaacaaatctttctgcagaacaggtaagaaagttttggactttgggttcttcaatatatttgttgtactgtacctctcattagttccagctgaaacaaacatgctatttgtatatttgtctctagaagtcttactaggcgaccatatctgacatgctcactattagatgttctacttctgctgcatactatattatttctcaaattttgagatctgcttgactctaggagtttttatctactgatgaaatgagataattatggcaacacatgttgggcttcaagaacacaaaaaaatgatgtgtttttaaaaccaaatttaggtgtatcatatgttaggtatcacacaatttagagtgttttgttacttactcctggagagagtgcttattttttagcgtgttatatcatgctggttctacactagcaaactatttgcaacgaatatgagatctgtcgaactggtaactagtttgttgaagtcttcctttggttcatttgacaggaccaacctacaaagcctgccaatggtgtactaccccctccagaagcaaataataaagttgttgtcccagattctagtcctaatgctgctgtacctcgaccaattaaagtcaacacagagagcaaaagttccagccctgtggaacaagccactgcctgtaaaattgacaaaggtgcattaccacaaaaggaagggccaggaacttcaagttcctccccactacctgtcaagagaaaggcaacttctgttggtccgaagatcaaacggttccacatggacagtgaggaatccatggaattgaagataacatgggaggaagctcaagaattacttcgtcctcctcctaaggccccttcaattgttgttgttgatggccatgagtttgaggaatatgaggtatgctgtgcattttattatttcttttagcattcagatcttggctagtgggcacaggcctgcaaacttgagccctattcagctgttcaatgttatgggacaattactatctgagacatagtttggagcatgcttaagcttatttgcattcgtgacttgctttactgtgttcttggtatagaagattaaacacatatcttctatattgacgtcctataattttcaggagccaccaatacttgggaggaggacatattttgtgacagaccaatcagggtaatgctcttagctttgctatctgcatttgttatatatgtggaaaaggacccagacagaccattccagttctttctttttagtaacatttatctcaacactttttctcataatgcttaacttatctagctaccttaattttttatgtgttttttttcaatgttttggaaacttttaattgttgaaaccattaatggtctatctgaatagaattatcctattggtgcatgatgagacgacaatataaattctcttgacttccatttgtaggactcccaacagtttactttttggaaagtacagtagcatcttttttacttgcttacaaatgatcatcattttttaccagtgagaatcatcaatgggctcaatgtgaggattgctctaagtggcgtaaactgccggtggacgcccttttgccctctaagtggacctgctctgacaataaatgggattctgaaaggtgacctgctattttagaaccattcagccttttgtatgctgtatttatgattagctacaatagaaaaacgtatttacaaatgttctaggtagggatgcaagtgggctgacccgtgaacccacatataggtcaaataagtgggtaacccgtaggttcccgtgtcatggcccagcttgccacacctagggctgcaagtgggttgaccagtgaacccactgggttacccactaatttggcctataatagggttcgcgggttggtccacttgcatcctaagttcaaggatagctcttagggttatgcttatggttcttttttgttaccgaatttcaattctattaaccctatttccacccatcagttctttataaatattgcaatcacgaagtttgagctgtctgtttcttaaatctacggtggaatttagcatgtttgaacacaagaatagcttttttttttctttctgttcacgtgtggttggtaggatggtgggatagtctcaatttactttacacacgtagctaataaccaccactacttatcactaggtcttcctgtgattctgcccaagagataaatatggaggagcttggcgaaatgattcctatcaaacctggtatgtatatgttctagtgatttatctatgctgatgtagaagctccatttctgctagtagttctttttaaatagcatgccaaatatgaattccaaaaggataataaattggagaggttcactacgaacaattggctgtatagaactatgtgctactgtgctacatgccagagcctacaaaagtacatcctgaggcatgtaaggctggttgatatctatcactactgatggctggatgtcacaatgaagcatcatagtattagtacatgttatagttggcaatgggccgaactacaaaaacgacttgccatgatccagcctgaggcatgtaaggctggttgatatctatcactactgatggctggattcacaatgaagcattggcaatgggccgaactacaaaaacgacttgccatgatccagcctgaggcatgtaaggctggttgatatctatcactactgatggctggattcacaatgaagcatcatagtattagtacatgatatagttggcaatgggccgaactacaaaaacgacttgccatgatccactgtgttgagaatgccatcttgaaccaacacatccccaatgttactttggggctacatatttctatctgtggtaccagtatgaaagtagtcaatgtttgcataatgccactatattttctttgctgtgtggtaggctataactgcactaaatgatctactataattactgttctagcatttacttaaaattcatgttgttgcatttcaggtgctgcaaaaaagaccaaagggaaggtagatactgacaatattgatgtttcagatgggctggacacactcgcaaatcttgcaattcttggtgaaggtgaatctctcccttcccagccaaccacaaggcatccccgccatcgccctggctgctcatgcatagtctgcatacaaccacccagcggaaagggaccaaagcacaaacagacgtgcacttgcaacgtctgtatgacagtgcgacgccgtttcaggacgcttatgatgcggcgcgagaagcgccagcagtcagagaaggactctggggtgcctcgcaaaagagagccaggtcaatccagcgagccagttccacaatctggctctggtgctcatccaaccagtactagctctcctcaccagagagcagataccaacggcgaaggtcctgaagacatgtccattgacaacaagaggacctcctctcctgtcaagaaccagattgacctgaacagtcagcctgagcgggaagacgagcagtcaccgaaatccgatgcgacgagactcctcagggacaacccaacctagggctgcctgcccaaaagggaagtcatactggcgatggtagataaccgatgaaaaagataatgtctataccaatggagaaatgcggcgggcggatttgtagtgtagctctgtagatgttacctttctataccaaagatctagtttatcctgtggcgggagagatccagttttaatgttatcataccatagaaccaggcgtcggtgttgtagtagaacccgttgctgtttgcctagggcccgttgctttaccctgtatgtagtgatgtagcgtgagagcggcgcccttcggcagcatgtacctctgggcaaatttatttcatgtaccggatcatccatccctgtgcaaggagaggatttactatgttgcttaccggggtggtttccctttggcattatagcatgcattcatatctatagtgtgatctgacgtgataatgtttaccatcaaagtttacccgtactcaaatcacggaattctgacgtgatatgtatagtgtcggtgtattccgttcatatgatatcatctcatcctctctttcctccacgctctagactgaggattgcttctcttagctgcagtcttacagaatcatcggcttttgttggatacatcaatttattgcattttatgttggaatctattttttaaaacttattcatcggattattgaaaaaattgtttactacatacttcgaataaagatctcaaaatactttactctctgcatgttacaccagtttgtttgagatgtttgttaggtttatttttaaaatttattcctatagtcaaatcgtcaataatcaaaatgaaaccgggcctctaaacatacgctcggttctttgttacagttgtggctaaccgtaccttttatcaataccaccacatatgacatgctaaaagctcatattcttaactaattttgtcaaagttgtggttaacattttgataccgacgcttctcgtgatatgtacaaccaccttgtgtaagctactagtaaacaaccaaacaaatacattgaatatttggtgcatttgtgaagccttggcagttcaccttttatgtaagacgcacacgaaacaacatacacaccctcgagtgtaacctatagcagcacatctaagaaacaggttcatatgctacacatgaacacagaagaacagaacatgtgccatgaacaatctcagtaagcaaaggctaattaatatttaatacacaagaccccaatagaaattgggttgttcttttcttcactaatctgtcgcccctaatatgaacagtcttgtcttttgtgtactatcactatcatccttgaacaaaaccatttcttacacaactgatagttgaaggaagaaattaaaaaaaaaaagggagcccaaaagaagaaaaaaaaggccaaaactacaaaacaaaacaaaaaagcaagctcttgcttgctgctattgctgctctgcatcgtcagtagacgctgcctctgctgatcatttcgttgtagtgcttgagcgactcctgccgctgcagccgcatctccatgttgaacttgttgatgaacgcctccaccctccggttcagctcgtcctgccccagcgacggctcccgccgcactttcttccctcctcctcctcctccggcggcctcgttgaacgtctccgccttccgcatcgccgtcgccggcggtggcgcgtcctcgccacctccgctgccggactggcggcggccgggccgggtctcccaggtgtccgacttcttgagatgccgcgccagcggcggcgcccgcccctccgtgatggccttccacgtgctctccagcgtctgctccttccgcggccgcgacacccccagcgccctgctgctccctgcaaaacccaatcccgcgagctcaatcaatggcgaattggcgaaagaaccgagacgggattagaggagaattcctgatttgttgtttaccttctgggctcgccttgaccggcttccggccgaatcgagtggacaccagtggcttctccctcgagttcgtcaggtccgcgaagggggacaacgcctcatgctctgcctccgcctcggcggtgctcctccgccgtggcgtccatgccgacctcgagatcgtgaagttctcctccgcttcctccgcctccggcgccgtcttcaccacctccggcaccgtcacctccacgggaatgggctcgggagccatcgcctccggcaccggcacaacgggcacctccatcggcatcgtcaccgccggcgcgggcaccgccaccaccgggactggaaccggaaccggagccggccgcaccaacgacgcgtcggcggaggcggcctgcgggcggttaggctggaaccgcgacgacgccgcgatggacaggatgatggcgttgatgacgaggtacaggtacggcggcgtcagccacgtggccgccgccgcctgcgcccgcggcagctcgtccgccacgaaccccgccgcagccggcgccgccatcctcaccccgaacgccaccagcaccgccgccgccgccgccgtcgccgccttcaccgtccgcgcgtaccccatccctcaaccccaccaccgccgtcgccgccgcctccttctttacgtcttcgcgcggcgaaagcggaaacggcaatcggaagcggaagcgaaggcgaagcagagcaaagcgatatgcgtgcgagtcacgaggtggggtgcagcgcagcggccaacttatagcgggcacggctcgctcggggagacgcgtgagccgtcggatccgggcgcttggacggtgggagatccgtgtggcttagcgtgcaccgctttcttcttccgcaccggaacggtctagatagagccagcctgtgcggtgcggtgcggtccgtgtgagtgaccgcgcggtgtttggccggtggtggcgacatgtggacgtcacacacacgtcgtaatcaccgcgccccccgacttaatcccctaattagcaggggctaatgcactaaaaaattgtaaaaatgtaatgcggccgcttcgagatgccacgtgagatgatcggacggccaggattggaaggctgtgggggagtacgggccacgtgggggagttttacatgtgtgtgtgagaaatgatgggagaggagggggggggcatcatgcggcgtcgcaaagctcaaacggtcaaaaaaagaaccgttggatgcgaaccgcgcggcgacggtgggcccccacgtcctcctgccacgtaggccggcctcgggacgccgccgctccggcttttgtctggtgctgagctggaccgctccggggcgccacgtcagctgacatcatcaccgttgggttagctcgtctcccgcgccgcgacccgaacaaacaagaacgaaacgacacacacggaaaaaaaaaagaaagaagaaacggcaacacggtcacgtatcgatacgcatttttccccctctctttcacatcgcgacgtgtacgggaacgagaccgagagacgagcatgcatgtgaagggcacgcacagcagggtgcaggcctgcagggtgcagcgtgcacgtgtacacgaccacgtcccgcagctggtacggccgcacgtcgacacacgccgccacacgtaatgcggctccggcgacggcatacggcaaatcgacttgtagtactatgtgctgccgatagtagtattatatatctgctggtgtgcacactgcgctttggcctaattacacggcagttttgttgaactggtcgtgtgccctggccggtcaagaattaggtgagggatatctgattagtctctgtgtttttcagtagcctgtagctttggcctgcctgcctgttcatcggcaaccacacaacacgcgtagcaaatgttcgtgtgctcgcagtcgcatggtccctggtcgtcatatagctagggagatcgatcgtgagcacacactaattcgtagtgtagtaggcagcattatagcacgcaactgcacgtctctctagtagcttctatacatgcacagttgcacaccacacaaacaaaagcggtttcatggatgcatattgccggccactaccactaatctcggcatcattagttacatgactcataattaattcctagcttggtggttattggatatcggttaagtaggtggcgatgggcgacggatcactgcatatctcgatcgaggttaatatgggcgattcgacgacgggtgcacgtagcagcacaggtgttgagcgttttgactgacgtgcggtggacggcacgcgcgcgcggtgattttcatacgagggtgtgtagtgctcctacgtactaccggagtactccgtaattgttaatttccaccgtgcgcgcgtgtccatgtacgacgcactacgtggcccgatcggtcacgttctacctacgtcgcgcaatcgtgtctccgtcttaggcaaacatctcagccggtgatcgacgaactgtccccgaaatatggtaaacaactactccctgcatacgacgttgcctgtaaccatcccttcttttatcaaggcagtcagtactcagtacacaacctcagtacataagtatttttttactgtagcttaattgaacatagtgtgttaatccctcgttaacgagctatctatccacgagacgactctgtcccagatgtatatataaaatatataatatattactttctccgtcccataatataaatgatttttactttttgtttgcactgttcaaccattcgtcttattcaaaaaatttgaaattattatttattttatttgtaacttactttattatcaaaaagtatcttaagcataacttttttgtttttttatatctacacaattttttttaaataagacgagtggttaaacagtacaagtaaaaaatttaaatacattatattatggaacaaagagagtagtttctaatcagggtaagctaatcttagctgctacctagccagcggccggcccgtgtacatgttggacccggcggatcccggtgacagcgacggttcatccaaagctgccaaccccgagcccgcgaggcgcgcggctgcgacgtcgtacggcggcctcgcgagccggcgaaacgtcgccgcggcatatcatggcgcgccaccaccacgcgttgcttcgcgagacgtttccttcccgtacgcaaactcccgtgtctcccaaggcgtgggcgtgcatgtggtgcaacacggccgcacgaacgatttggagatccagagtacaagaccgtttcggccgagcgagcgcgcgcgctccgcctcgcaaatgagcctaacttttatttttttcaaccagaccgaacttttgtaagtatacttccaactcttcatgtcctctcgacgaatattattggcttagctataggctctagcttgcctacttgtcgcaacctcggtggtgtaccaaaggagaggttcaaaggttcaagtactagcagtatgtactgatccggccatctggtctaaaatgatcaacttttgcttttaaatctacatatagactatgctcagattcaaaatcagtagttgattaaataggtggcataaatgaccggagcatgtatatgtacgttgttacgagcatcaatcgtccatcaaccatataaatatctgagcatgtatgtattagagggtatgacatgtgtgtctagtgatatgtttgaatgtgtgtcttccgtgtgataaaatttgtgtatttttattatgattttagtgaggtagggatttattgatttctgtttctttatttaagtatgtacgaagtattacgaggcatactcgcatatgcaagaatataatgtggtgtacgtgtgtgtggtgattatgtgcatatgcggttacatgattaaaaaaatcccctgaaattcactagccaaaagccgtacacccagctcgatcgtacggcctctaaaaattgctgcgagagggggcggcagatcagatcctgccgcccggctaggagcaagtacgtcggccggttggcacttggcaggagggccttttttggaggcgacgtgtagacacgctgttggtgcaggttggtatccttgttcaccgccatttgtagaaaatttcgaggagcgtgcagctgtatgcgctgtgcagtgtgcgccaccacacacgcgagaatctatcgatctcccgatttcacgcggccttacctactatactcatctgcaccttgtcacttctgccatgcatgtgtgcgtccagtagtacgagtatcagcaaccggccatgggggacaaattcaactaaccatgtgaaggtgatcgagattaaagtgcaactaatagattgttggatgtatcacgatgcagattaagatatactaagattcaggggctattcaaatcacagtcaaaataaacattaccaaatttcagaaaaaaaaacattaccaaatttcagcaccgcaaaaaatttgataagttagcaatactaccaagttttggtaggattccttatatatttaccaaagtctggtaaaaaaatttaaatgtatgcacatctttaacaacttaaaaaaagtatagtttgaaataacattaatatgaacaatctcttatttttgtgtggataggacacgagaatcagttagttaagtgaatagagcaaaactgcaaggtcaatatgagtagagagtcagattaattatcagtgatgccgagaagatctatcttacgtatgaattaggtggtgttcttttctcctgaaaatgaagatgaaaattaagttttttacacaaaacgaggtggtattaacgtatgattaattgagttttaattattacaaatttgaaaaaaatatgatattttagagcaactttcatatagaaagttttcgtatgaaatacaccgtttagcaatttgaaaaacgtgacacgaaaatctgattcatccaactcttgttggagaaaagaacgggcctaacctcactagtactcacgcatttgatgcaacgggatcatcggtgcacactgcacgtagctgaaggccataggagagaggcgacggtggagacaagataaaaagaaggatagcaacacatggagtcagggtcgtccctgcaacggacgccatatatacacatctgtcatggatatattcgtgctgcaggtcaaagctaaattaatgccaggtgccgttcatgtatgttaatgttatccttctctatctgcttcacatgcatgcaaagatatatcctgcacattgaccatggaaaaagggtacataccaattgatgttacgtaagtaattaatcctgatcaatctttttatccaatgcttaattagatccttaatctcactgataatttcgtcgccctcgtacagtcgtaatgtcccctctgaggccctgacttcctggcagcctggcctcgcctcgatcgccggccggcgagccaaacgctgcccgacacctgcatattctgaagcttccggccggaggcgccggccagcccaacgaccaacccaggtaagtttctcgcgtcgtcgacgtcgcaaacgaaatttccactcatccacagctgcaaacgtagcgccgacgatcgatcgatacatctcccatccatcgccagagtgattgcatcgacagttcaatccaataatatgggcatatttgacacggttctagttttagttttatctctcttctagagccagaatccaactaattaacggcttcagcttaaaaaaaagagtgaagttagctaaaatattcttacgaaatctccacccagaaaaggaacgaggttggctaaaatgtttctataaaataaactaaacatgttgagttggttttagattgttttacagttccactcaaaacctaactactgaagttaaatttagaagttagaatcgtaccgaacaagccctgagcacgatcagttagctgttactagtagaagaatacgtgtttggtcaacaacgcttcgacacacagtagaccgtgtcaccgtgctagctgggagacatgtacatgcatatatacgacgagattttagacagcgagatcaatatacggacagtgaaacgaggtctcgttgctagctctccgtgtttgttggcttgcaccgactgtgcgcgtgttgcaatcgggcgcactgccgcacatatatgaccagtagtgcatatatatacatacgtataacgtatatatatacgctgttcgcgaaaccgcgtttctgtttcaatgtgcgtctgtgtactgtacaggggtggtatgtacaggaaaagaaccatcgtgtcaacacgcgcaaggttgcactgggtggaggatgtggggatacgtacagtatgcgtgtactcgagcaattagtgagaagagaattaatgggcacatatatatgggtcggtgacaaggaccggtccggatttggataaggtgagtgcggtttagtggcggcacctcggaccatcaaatccataccaacagtttcatgcttgatgcttaacacacaaagaacattatctaaggataggaagcaacgacgaactgaaaaagaatatagttactttccccatatttataacccagtatttttctggcaaaatttctcatcttttgttctataaacttgcagtctcttctatgactacatcggatagaagagactgcaagtttagcagttggaaccatttttcatcattggatcaaagcaatcaacggccgaaacaaatgctacagttgttttaaacagtaattgctacagtacctgctacagtcatgtatgaacagtatcaaggaaagatctaggacgttgatttataatccaatggtgtacttaggactgcttaagttgcagtggctatagccactgcatatgatcccaatcccgtacgtatagtacctgaattagttagataattttctaaaattctgcgtatgtttgttctctctctctctctcttttagaaccggttcaccgccacttgtagaaaacttgggggcaccgtgccggctgctctgttttggaaactggaaaaaacagagacaggagaatccgagaatccatctccagatttcacgcgacctacactacctacccagctatcctgcccatgaatagttttgtcacttccgggattatgaaatggccggctcgctagggacaaaacgcccatgtgaaaggttagaaactgagcagatcagcagaatcgtgagatggagcaagcagctgcatgctgatcagaaattcagcatagtataaacagtacatcactccgttccagattcattttagaaaacacgtatgaatgtttatattaattttggaatgggttagtaaatagtactactactactatattgcaagaacaattagttaagctagctaggatgatacgacgatcgatgatgacgacggtggaaaacagtggaggatccaatcacaatcacgcatcatatatatcgtacattttgattgattgatttatttttttttagaaaaaatgatagccgtattaggatttgtctggcctcaagaaaatttgggcttcgtcactagtggaaacaagcaagctttggcaagtatagctagatactatatgtacgtacacgtttcgtcgatctgtatacgtgtacgtacgtgtgtgtatatcgttcggtatttgtagctgctgcccgttttaattatcggcttgcaacttttgacgtaagaattccgatcgatccgcttgcacatggataggcatagccttcattcctagctatatatagcttgctaggcaacaataattttagaatgctgatcacatcgatcgatctcgagatatatatatatatatatatatatatatatatatatatatatatatatatatatatatatatatatatacacacacacacacacacacacacacatatacacacagagtagctttgcacgtacgtatatgacgtgcatgcggctaagctcgctcacacgtgtacacgttatacaatggtgtgatcatgcagataaaggtagtccagattcattaacccctccgtgatggctttgtagatatggtaaaggaggtctggtctagtgtacatgagggtaatactcatatggagcgatggcaggcgaagattcgccaattaagacagcattttgagaggatgggctaaacatacacgtggtatgtataaaaaagaaaaaaaaagggagattttggataggttggatttgttggataaaaagtctaaatctgttcttctaactcaggaggaaattgattttagatggttttgtaggaatagattatctactcctacgagagaagaagaaattaagtggtatcaaagggctaaaactaaggatattttggagggtgattcaaatacaaagtatttttatttggttgctaacggcaaacatacaaaaaccagaatttttcaacttcaagatggggatcaattgataaatggtgatgcaaatctaaaatcgcatattaccacttattataaaggcctctttggtcctcctgatgattctgatctccagtttgatgaaaataaatttgtggacatcccacaagtatctcaattagagaatgaagttttaatacaagaattcactgaaaaggaaattaaagaggctattttctaaatggaacataataaagctccggctcctaatggatttcctgctgagttttatcaggtcttttgggatgtcattaaggatgatatgttggatcttttcagagattttcataatggtactttgcctttattctcccttaactttggtactattattcttttgcctaagtgtgctgaggccatgaaaattcaacaatataggcctatctgcttacttaatgttagttttaagatctttaccaaagttgctacgaatagaataatgagtgttgctcaaaaggtgattagccctactcaaactgcttttatacctgggagaaatattatggaaggtgttgttattttgcatgaaactatgcatgaattacatcgcaaaaataaaagtgtgatttttaagatcgattttgaaaaagcctatgacaaggttaaatggtcttttgtacaacagacgctcagaatgaaaggtttctctcctaaatgatgtgagtggataacttcttttattcaagggggacatgttggtattagagtaaatgatcagaccggtaataattttcaaacttacaaaggtctaaggcaaggagatcctttatctccaattctttttaatatagtagcagatatgcttactgtcacgccctgaagttttcccccttttgcttgctttaaaaattggttaaataaattgcccgaagaaattatcttaattaacctagagctgaattccttaattaataaatgcaaataataatcggaatcggcatgtggaatttttcttggattctacatgtcaaaatatgctaacaggatttttagtggaattttcagagccttggaaataattttaaccaattaaaaatgagcatgtgcaatatataaatcccaggaaaatcctttttctttttttttcttttccctccttttcctttgttgggccgtcggcccatccctctcccgctcggccttccccttgtgggccggcccgttctccttccccctctctccgggacgctgacaggtggggcccacctgtcaggtcgtccccttcctccagccacccgcctccgacggcaaccgccgccgaatccgccactccgccgcctcctccgctcttcccgcgcccacgccgcgccgctcccgcgtcctccccacgtcgccgcctcttcccccgcatctcccggcccgcgcgcgcgctcgagagggcgggattcgatttcgaatcccacccctctctctctctctcctccccacgtcgccggccaaatcgggagggttcccggccacgtcctcccctccctcgcccataaaagcactctcccgagccccctctttcgttttccctcattcgccgcgctctcccgtgcctcctatcgcgcttgcgccgcttgttgctagcgccgccgcttgccgtcgccttcggccgcgtgccactgccgctagggtcgccgccgcgccaacccgccaccgccgttagcttcgccgccgcgagagctacctcggccgccgcttcgttgccgcgaatcaccgccggagctccgatttccccgcgtcgccggtgtgctcgccattgtttccatctccggccggccattttggtcgtcgcggtcgctttctccatccctaacgcctctccatcttctcctagggtgtcgccgccgcccgtccgtgcctccgcatcaccggtcgtcgccgccgctttcttccttcgcgccggccgccgtgctcgaaggtgaggaatcccctctcctccttcctttcctctctctcccatgagcaccgccgccctccgcgcgtgcgccgtcgtcttcggccgccgccgccgccttcgcgccggccgccgccgtctcccgcgccgccggtcaccgccggtgaccgcgcgtgccgccgccgccgccccatggctggccggccggcttgagccgtgccgagcatgccgccgccacctccctcccttgtgccgctgccaatggggcccacgtgccggcgcccccttcctctctcttgaaccgctgacaagcggggcccgcctgtcggcgcccgcccccccttctgctgacgtcagccctgggctttattgcgcaataaattgattaaggacttttctttattagtaaaaacacagtttatcttctaaaattcataagtaattcatccgagctccgtttaagtccattcaagtctcagtaaatcaagaaaaatgcaaagaatccattaaaaatggttttgtttcctgtttcagtagtcttatagcatgttttgcttgtgtgctttgtttgtcgcgtagatttcggccgtttcgtcgatccgcggtttctcgaagatgttgctgaggtctcgtcagtgcgagagcaaggcaagtcatgcaatacgtttgatcatattgtacccaatttacaaatatcccgcatttttattaaatgttgcatccttttgcaatgtcatgtgggatgggtcctaatactcagctatatattgtttaccatatgccgttgataacttgggtatcaaaatgactagatgttggtttaggaaatgcttagccatgcttagttcaactagcacacacacggggatcacattattacatagactttgactatgagcatagctttggtttggtgccaccgtaatggtgttaggtaattaaaatacactgaatggtgggctgtgggtgcatggttttgctggtcgcacccatggcaattaaggaccggttcacgggaaaccctgggagacttaccgtgcttaccacaagcgggagtgggtaactgcttgatctgaagtatagctcgaccctttcctaggcaccgggggcgagggtgggcgtgatggagttgggtcggccggggtgtccggttgtccagctgccgaattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgataggttaatattgattaattactacagctgttttactactttcaactactgctttgaaatgcctgctttatgcaaaagaacccctagcttcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgctcgctgctgaagtcaagcttcccggtttagctcgcttttatctttcccgctgcatttgtaatcttttctatttttgtaagacgtggatctgtatgtcaacaattgtcgtttgtgtaccctggctggtcttggacagggatttaatgcacattcagcttagaaattctggtttgagaatttctgggcgtgacacttactttattaattaagagggctaaaaatgctggttcattgaatggggtagtccctcacctagtggatgatggtttatctattttacagtatgcagatgataccatcatttttttggaacatgacttacaacaagcgaagaatcttaaattgattttatatgtgtttgaaaagttgtctgacttgaaaataaattttcataagagtgaattattttgttttggtcaggcaaaagaatattatgatgagtattctaacatctttggttataagtttggctctctccctgttaaatatcttggtataccaatgcatgttagaaaactgaataatagagattggaaaatgattgagaaaataattgagaaaaaacttagtagttggaaaggaaaacatttatctgttgggggtagactggttttgattaactatgtactttcaagtttagttatgtttatgatatctttttttgagataccaaaaggggttcttcaaaaaattgattattatagatcacggttcttttagcaaggggatgaccataaaaaaagtatagacttactagatgggatatcatttgtcaacctaaggatcagggaggtttaggggttcataacttggaaatacaaaacaagtgtctcttgagtaagtggttgtttaagttgatttaacgaggaaggtgtgtggcaaaatctattaaagagaaagtatctctacaatcagtctataacccaagttaataagaaacagggcgattcttatttttggtcaggtctcatgaaggtcaaagataccttcttagatatgggttcttagactgtaaataatgggaaacaaataaggttctgggaagataaatggctaggaaacctggcttttaaagacaaatatccatctttatactctattgtctgaaggaaaagttctactattgctaatgttatgagatctgttccactcagtgtttcctttaggagatcattagttggtcagaatcttgcatattggcatgaattgtgtgcttctattgtacatattcaattgaatcaatcccctgatagctttagatggaattatcatcagaatggaatattttctgttaggtcgatgtatctagctttaattaataatggttatattgagagaaacaagattatttggaagcttaagatgccacttaagattaagatttttgtgtggtacttgcttaaaggggttgtcctaaccaagaataatttggcaagacgaaattggaatggtagtttaagatgtttttgtatgaaaaatgagactattcatcatctttttatagagtgtcattatgcaaaatttgtttggagagcagtacagttctctcttggtttataccttcctactaccatatctaatatgtttgatggttggctcttgggggtagacaagaagaagagtaaactcatacttgtaggagcttctgccatatgttgtgctctgtggttgactaggaataatatggtttttgacaaatcactatctatctcatatatgcaggtgattttcagggcaacatattggttccgattttgggcacagttgcaaatgtgtgaagatgatcgagagcttatgaaggttgcatgtcgtaggcttgagacaacggtcatgcaactccttgcaaactatggatggagattcacaaatagacttgaataaatatgctctccttatcttagtttgatcttttattttgttgggtgtgtttaattcatttgaactacactcagtgtttgggtgttacttttataataattggctgtagctctgatgagcaaaggccgggatgttttattccattataaaaaaaaattaacccctcctacgttaagtgttttttggaacggaggtagtatgtcgtgcgtacacaagtacaaaatattaggatgtgatgtttaaatttgttgcattaaaatgcattatgttataatacaaggttagtttattttggaatagaatgagtatatcgcagcgtgccattatatcgatcatatcgaaattgtataaagacggagtcaaggataactggataaggtgcagtgctccatatcgttctattgacttagctttgttgcgggtgaaaaacaaaagggaaaaaaaaatcaacgcccatcttatatgtcagacgtgtacactgcaagttacacttatcgcattgagccattgaccgtgaaaaatatataccagcaaccgcaggtaaaatagttggttagttaggacgacaaagtgaccgtttcaacgtcagcaaaccaaaagtaaagagtgtttatccgatacaatctcaaaaagttttttcttctgaatcttatcgacagtttgactgtcactcgaattgtctcccagctgcatatgctgcttataacatcctggccggccgcctcacgtacgtcgccggccggcaagccaagcgccgcccgacacctgcatgcacgacgacctagcctctgcgtccaaccggaaatcgccgcgattcggccgccagcgacaggcacctggccatgcattagccggccgacgcaattgcgcgtcgtacgtcgtcgtcgttgcatcgcgacccaggcagagaggaaagtcaggagattcagacgttcagagctaatagcatgcagcagcagatgaatctcgacgactacctgctgagagtgttggtcggatcaagatcgagcatgcaaagtatttcaacacggcagagtggcaaacagacagttgggacgatgtaacctactgcagctagcttggaagcttctgccgacggaggatgtaatatgttcagcaattaatgggacacaatacgtactacatgtcgattctagcgtgttctcgtgatcatgtgctagcttaggttagcttgacactgctcgttaagtttggctacgattaatgccactgatgcaaatgctccctgtcgtcatatatatatatatatatatgctggtgattaatttctagccgttcaccgatcagctagccgcctagccgtcatgtcaacacggctgtgcagatgggcacggtcgtctcgcggatgtaacccatggtgtattgtacatgggagagatcgatatacatcgagctatagctagcgagaggccggccggcaggtcacacgtaaacgtcgtcggcgacaggagtgggatggacagagatatgctatatctgtcttttaatatatcttttaatatatggtttcattaactttttctaataaacttttgatcatccatcttatttaaacttttaataaaactatgaaaaccttttaagtcgtgcttaaaaaacataaatcaagttacaataaaaataaataatcattacatataattttttaattaagaaaatggttaaacgtgcctcaaacaatcaatgatatcatacaccaatacttgaggttatattcaccgggatttaatttggataggcttatctagtggcacgcgccagcgagcctggactgtcaaatcaaggaggattgcgtactaatcatgtaactaaaacgggaaaacactgccaatactcaatagggacatggccggcatgctgcccattccgaacttgatcgagcattaaactagtagcaatttagcatgacatggtactcgtctacacgtgtctggccactgtatttagtacagtattcggtcttctcttcagacactgcactttgcgaaaccgtaagcacgaacagggcacttcgttttgaagaaactgcaccgggtttgtttcgagattagtgcacaagatcaacggcagagggggtctgcttcagttgcggtttaactcacgatctgggctgatgctacggcccactttgcttttgcgtgaggcccatatatccggcccgtgggtccacgcggtgtggatttcggcccaatagcccataaccacctcccttactcctcagcccggttgtccccagatccccctcttgtcaccgaggcggcgagcggagcgaagcgccggtggccggcggcgcagcgacccgcggaggagcgaggcggacgtgcggcggcgcatcgagaggagcaggtggctgcggaggcgcgaccggcatagggagccccgctggagaggggtcagcggcgcgggtgcgtgtcatccgtcggccgcgtctccatctcggatcgccggagagggaggaggggtgggggtggtacaggtgcgttctttgattcccctgcggtgagatgagctagcctgccatggattcgctgtgctgttcctacttagctcggtgatcttcgttgtaagcgtggtcaaatttgactttacaattttacattatgtgtgctgcttctagtctcgcgccgcctctaagcacattctttttccccctttctttatacttctgacccgtcgagtagaacttttttgacatcaatcgtgcttgcattctactactagaatgttagttcttgaagagagataacagattgtgcatttgttcattccatttcttttgttttttcattccatttctttttttgacaaggaggagagagacgggcacctaggagaagcttcaccggtttctatcaagtaagcttgttgtatgagtgaggttacagaacacaatgtccagcaatagcgggggtagcgcgaaggagaaagatcctgaaaatgctccggagcttgtggcactgccgttggtccggaccctgaggcctgttcatgcagtgattgatcctgccgctgacccgagatcagcacagctgtcttggccgggccatgtagtcctcctgcctccatatgcaacatggcctcatcatgtgccgaccctgccaccagcggtgaatcctgcaaatccacaacaaaacgtggtactgcgattttatagttgcctatgtgactttcttgatctaggtgttgagggatatgttcatatatcgcctccttcttattgattgtgctgtgctgcaatttgtgattggcaggatgtggcggcggctgatgttagtcctgacgttggttgttgtgatgagaagatgttgccaaaggtagatatgctgtttgatggcgaaaaagaggcatacgatttctacaatgcgtatgcagagatggtgggcttctttgtccggagatcaacactctggacaacgtcaaagaacataatcactaggagaacttttgtctgctcgagagaaggttttcgggagaagaagaggggcaccaaagaagcaaagtgcccgcggcctgaaacaagaattgggtgccctgcgagcatgaccattagacttaataccaacggcaagtaccgtttgacagagtttgtaccaaaccataaccatcaacttgcaacagcatctacaatgcatatgctgaaggctaagaaaatcaggcttaaagcacgggctgcgagagaaaatctggttgatgatactgtgaggacgccagaatttgggagtgaagatgaggcatatgaattttacagcatgtatgctgggaaaattggtttcaatgtgagaagggcaagcatgactatgaatgctgaaaatgtcatcacaagaaggatgtttgtttgttcaaaagaaggtttccgtgagaagaaaagaggggcaaaaagagtaaagaagcctcgcccagagacccgaactggttgtccagcgtgtatggtcattagacttacatctaatggcaaatatcatgtaacagaatttgttaccttccataatcaccagcttggtgcaacagtaccttctgatcttgtggcaacatcacaaagtacagaaactggtcaagatgatggactggatttggttgatggttcagctgatgctaatatccacaggcaaaatcttataattggaaatatcatggcaacatctctagaaggtagaagtaacaaaagattcaagtgtacaaaggttcctcactatggtgatgtaggtgctactctagagtacctgcaaaagatgcaacatgataacccttcattcttctttgcagtaaaatctgatgatgatgggaacttgacaaactttctatggtcagattcaaagtctatcatggattttgtccactttggtgatgtggtatgtcttgattcaacgtatgcattgcagggctatggtaggccacttgctttatttacgggtgtgaatcatcacaagcaaactgttatctttgctgctgcattgctttatgacgaaagtgtggaggctttcagatggttgtttgatacttttaagatggcaatgaatggaactcagcccaaaacattgttaactgatagatctgatgcaataagtgaaggtgttgcagcaagttggcctgcgacagcccatcgttattgtgtctggcaaatttaccaaaacgctcttcagcagttgagtcaagcatttcatgggtcaaaaaccttagattactgcttccagaaatgcctatttgactctgaagatgagcctgagtttttgacagcatggagagaaatgttggaaaagtatgacctagaagataatcaatggctagcagatttgttctctcttaaggagaaatgggcactaccatatggccgcgaggcattttgtgctgatatgaaaagtgtccagcagaaggagagcttgggcactgagcttaagaaacacttatccctagaatttgaccttttgagtttcttcaagcagtttgaaagagtattgtgtgaccgccgatcaacagaattgcaggctgatgtggatgctagtcagagtacaaagaagccaccacctatgcgagtgttaaggcaagcttccaatatatatacacctgctgcctttaaaatgttcgagagggagtttgagttatacatggattgcatgttatacaactgtggtgagatgggcacaatttctgagtatagggtagtcattgaggacaatccaaaagatcattttgttaaatttgattcgcttaattccatggtaaactgtagctgtaaagggtttgaattcgtaggcattccatgccgccatatgctaaaggtacttgacaccaggaatatcaaggaccttcctcctcaatacttcttgaaaaggtggagaaaggatgctaaatcaggatctccaaactgtagttattcattcccacttgatggtgatcctcagttggttcaaacaaaacgttataacttgctgtgtcggatgttcagcatagcagcagctagggctgcaacctctatagaaacttttgcatatatggaaaaccaatcaagcatatttatggaccaagtagaacaagctcttcaaacaaggcccccagacatcgctgccatgattggggctcattgtgatcaaacacaaaatccaattgacaatatcgtcgcaggaggtctacacagccatactaatttcatcaatggccctgctgatggtacttattatattattcttttaccattaaaaactatattgctggcttgctgccatagatcttattaatgatcttatttgcatgcaggttccctaacctttccatttacattgggtgctggtgtgttggattaccgctagatagtgactaatttcttacaagtactagccacaaggagctgcgaattctgtacagtgatcttttcgtggaaatgcattttatatatcaccagaaaattccaggttatgtccctctgctgacccacttcctcatccaggtgattacatggtaatattgtgcatcttgctggctggcaatttgacaatgcttacacattataccgtagagctgagaatagtgatggctagcccatccattgtacatgtaattttcagataaagtttagagaatgatgaaaagtttccatcggtgtatttactgaaacaatattagaaaatccatttggtcacttattagttgttattactaactaatagtcatttcaactcaacaacaaaagtctgtagcctttaagttgtctcctgcagtcattcctgtttagaggaagttggcaatctatcttctgtcagtgtggtggaatgtcgagtgatgaatttggggttcctcaagtgagaagaattgctttggtgactgatgggctccttactagtgatacgtatggtgcagcgaagccggataggatgtaacagtttcaattttgatgtacatatgatgtcgaaccagtattttgatcacctagagtaaactgtttgattatgcttactctctctttgtgtgtgatgtcctcaaagaattttgagaaagatgtcaggatgcatggagcaaacgagcaaataatcgtgctcgtgcaggtgaaatattgtcgaagtttctctctcccttaatcagaagtttgcaacaaaagaaggctttgaaatcaaataccggtaaaaaaattatcgaaatactcctacctgcttagattctgtgagatttctacgttgtgtaaacagccccaaaattggagacctttgttctgttggatttttccaataggctttctgcacgattgtactgagttaacaatttaacatgctcgcacgggaaataattctccgtttctagcttaaagtgaatcgttcatcgtgaaattcctacattcgaaatgaaaattttaaattcgttttgagtgtgttttgattttcttttctttaaagggagggcgctttgattttcactgctgctcggtacttcgggtgtgttcttttctctcgtacccaacatccagtcacttattttccatgtgcacgtttttcaaatttataattaatatgtttttaaattatataaaatagttgcttcaaaaatcatattaatttatttttaattttttaattaatacttaattaattatgtattaatttgtagctccgtttccgagtagaaagggttctgaaaagttccaaccctctagaacacagctcagcctcatcttttcgcttctacttatatgagtaaatatatttacaagctaaaatttgaatttccaaccttaaatttggagttgattttgaagtttttcatcttagtttatttttcattctttgttttagatcactaaaaacacatatataaaagttttattcccaagttattttaagtttgcaaatatgccctggtcgttgctagcaagaacccttttgaaaacataaaaacgattttaacagtaaccctcggatcttccgtggacggcccagatcgacacgggtgggggatcgagccccccaccttgaagccctcccaactcatatttttgccaaaacctccccaaaccctagacacccgccgccgcggcccatcaactccggcgagctccacccgccgccctccaccctcctccctccctccgtctccgtctctccccggatctcctcccgcggccggaagggatccaccggccaccggcggcggggggatgaagaacctaaaggtggttacccggatagcgcagaagcttcagctccagctcgacggggagaccgtggtagtctccgccgtcgacgccgagcgccgccgcgccttcttcgtctcctccgagaacttcctctactccgtcgacctccccgcccccacccaggtacggttcctctgctcaccaatttgttatactgcttgaaatcttcgttttattgtttgcctcgcaacgtagcaatagtagtaccacgctcagtacaagagggatacacatattatatggtgttaatttaccatgcgtatgattctcagattccagttttttgggtcaatacacccgtttatactgctaactaaatttgggcagaacactatgattttttttttttgtacaacgaaacaaacaaacacatcatcatcttcaatttgctatggtagcactgagcgtgtaccttctaacctaaatatttgatatttaggacaagatctttttcaaacttttaaaattccaaccatcaataatttctcaaattcttagtttaaaacaaaagtaatggtgtttgtagattttccttggaaagtacttcctgcttctgtttatatacgacgtcgtcatatataaatggaaggagagtaatatcataaacttgctatattttataaactttttctagtataaattttatggttggaattttgaaagtttgatcaaatcttgtcctaaacgtcaaatatttatggccgaagggagtatataatctgtttttttagtcgatatgattattaccttttcttttgctagtatttctgttttgctgattgcctattttgtctttcagcaatcactgcaatggagcgaaagtaccctagactctgatgcagaggaggttgttcttgaacctggagattacatagttgccatggattatctaatggagaaggagtctttgctgcttggttcatcaaccggttgtctattattgtataatgtggatgagaaaactactgaagttgtgggacgactggagggtggtgtgaagaccattgcttctagtcctgatggggcccttatttctgttacgaccgggtttggacaattgctcatcatgacaaacgattgggaagtgctgtttgagacttctctcgaccctcatgtaagtttttgtttacatgatctgactaaagatatgactaaaatgttctcattctacacatgcttgtttccagtgtgatcttacaggtgatatcaacagtcccaatggtcacatccaaagttctatttcttggcggggtgatggaaagttttttgctactcttggtgggcttgaagggagctctcagaaacttactatttgggaacgtgaatcaggaaatatacattcttcttcagataccaaggcttttataggagcatcacttgattggatgccaagtggagccaaggttgccactgcccatgaccggaagacagagggaaagtgccctctcattgtattctatgaaaagaatggcttagaaaggagccacttttccattgatgagccagcagaggctgtcatccaagctttaaaatggaactgcaattctgaactcttagctgctctagtctcttgtggccagtatgatgttatcaaagtatggtcctgcagtaacaatcactggtacttgaaacaagaactgcgatacacaaagaaagaaggggtgaggttctattgggatcaaacaaaaccaatgcatctcatctgctggacattaggtggtcaggttattacgcacaggtttgcttggactactgctgtcagtgagacttcaattgcgcttgttattgatggttcccatgtccttgtaactcctctcagtttgggtctcatgccaccccccatgtctttgttccatcttacatttccttgtgctgtgaatgaggtttcttttctatcctataactcgaaaaaccatattgctgcttatctttctaatggcagcttgtgtgtgtcggtacttccggtggcagatacttgggaagagtttgaaggcagtggcataagtgttgacccttgcttttctgagtcaacattgaataactatatgcacctgacttggattgatacgtgtaccttgatcggcatttgttgccgcgctgatgccttctcttcaacaccaatgaggtccagtgaagctagtagccttctagagaaaaatgactcgccatattttatcaatgagattgaacttgtatgttccgaggattctttgctaggttcagcctgttcatcaggttggcaggcaaaaatatcgaagaaaatgcctctgcaggctgcagttattggaatatctcaaaatccagcaaaagaaggttcagcctttattcagttaagtggaggaagggttgttgaatactgctcaaaagtgaatttgtttagaatgtctgccccggtacaagttagtgaaacaggttccgaccatacttttccaacatcatgcccttggatgactgctgttcaatgccatgaaaatggaatggttaggacacttctctttggacttgatgatagcagcaagttgcatgtgggcaaaaggttattaagcagtaactgtagcagcttcacattctattccagtgcttatggagcaaaagagcaggttgtgacccacttgcttgtgactactaagcaggatcttttattcatcgtggatatcagtgagattttacttaaaaatggcgaagtgacaaccgatagccatatcaggagtcatcctcgaggaaagcaaagcaaagagcatatcactgtatgggaaaagggggcaaagctgattggtgttctccatggtgatgaagcagctgtcataatgcaaaccacccgtggtaacttggagtgtatctaccccaggaagctggtccttgtttcaattgttcaggcactggttcagggacgttttagagatgcatttgacatggtaaggcgccatcggattgatttcaatatggttgttgactactgtggctggaaatcttttatgaagtcagcggcagattttgttaaacaagtcaataaccttagccacatcactgaatttgtttgttcaataaagaatgagaatgtcagcagcaaattgtatgagacctacatatcatttcctgatcactgtgcaacctctgtggctgatactgtaaatactcatggtctgttgtcagacaacaaagtcacatctgtactgatggcaattcgaaaagcccttgaggtgcaggtggaagaaagctcatcaagagaactctgcatactgactactttagcccgtagcgaacctcctctgttggaggaagcactgaatagaataaaagttatccgagaactggaacttcttggggttgatgatgccaggagaaagctctacccatctgctgaagagtccctgaagcacttgctatggttaaccgaaccagaagctgtttttaatgctgctttgggactgtatgatctgaatctttctgctatagtagctttaaattcccaaaaagatccaaaagagttccttccttttctcaagagtcttgaatgccttcctcctgctattatgaagtacacagttgatttaagactcggaagatatgaaagtgctctcaagaacattgtttctgctggcgacgagtatcatgaggactgtatgaaactcctcaacgctaaccctcaattgttccctttggggctccagttattcactgacccagataaaaggcatcaaattcttgaggcatggggtgatcaactttctgaagagaaatgctttgcagatgctgcaataacttatcaatgctgttcgtcgtatcagaaatctttgaaggcgtatcgtgattgtggggattggagaggtgtgttcactgttgcaggtcttctgaagtttaaaaaggaagaaattcttcaactagcacatgacctatgtgatgagttccaagcacttgggaaacctggagatgctgctaaaatagcactggagtattgctcagatgtcgatagaggtgttggttactttatcacggcaagagaatgggaagaagctcttcgggtagcttatatgcacagcaggcaagatctggttgatactgttagagatgcagctttggaatgttctgctttgctgatttctgagtatcaggaaggattgctaaaggtgggcaaatatctggcccgttatgttgctgtacggcagaggagactgtcacttgcagccaagctccagtctgaagaccgatttatggatgttgaagacgacagcatttcagaagtcagcactagcttcagcgaaatgagtgcatataccacaaggtgtgtcatctgccatttttatctgcgcatcctctctgacccaattttatcttctgtttttagttctttttttcactatttagttccaagtcctcctgctttaggatcaactgaaacttcaatcaatgttgagtaacattgttgaacccatacgaaattctaaatgctgctcgtgcaggtcaacaaaggaatctagtgcttccgtcatatctagcagtgccagcaagtcaagaggggcaaggcgacaaaagaaaggtggcaagatacgagctggaaggtaggcggcttctgttgagagtttttttttttaaataaaataaaataaaatccgagtggtttcttaagacgtcaattctccgtttgttttttcaactcaccgtcaactttatttgtgcagccctggggaggagatggcacttgtggagcatctcaaagggatgtctctgacctccggtgctctaactgagcttaaaagcctacttgtggttctaatacaactgggaagagaagaaaccgcccgtcaggtgcagctggctggagacaattttgaggtatctcaaagggctgcagtcaagttggctgaggatactgtatccaacgacaagatagacgagaatgcacatacgcttgagaattacgtgaaaatgctgagagctcatcagtcagctgatagtgaaaccacctgttggcgaatcaaagcattgtcgccgccttggaccggggtatactccaattcacatgagtgagtcattattactctgttaagaataaactagtactattagcccatctttcccttcagagtaaattgacaaggagttgaccgtgttgtggttttgaaaaaacgtttacaggcatgctgaatgttgatgagtggtaagcagcggtaactgttggaatggaattgaacgagaggcctcaacaatgattgccatatcattctgtggcggctgtcaagggtaacccggctatatatcgatcgcagccaattcaggatatttatggtgttctgccacttgggtggattgttacgtcaaagtggtgaaacatttttgcttataaatcaggatgttggaggccgcagccgagcccgcttgagctttttgctgcttccatttgtggtataattttgatcgagtagttatatgcatggaggaataaaaagttacatcatctgttcatctgaaaattgggtgttgtagacttgtagtgaatagtgattgtgagacatttaactatttgccacttttaagatgtggcatttaacagttggaagaagtcgtgttgttttcctgaaatttgtagtatctcttttgtagcggttgaattgttgaaatccgtatttcgattttttcaatatttcagaatgggtaatttcatttccttcaaaagtttgagcagccgtgcggaatttcatgtccgggaaatttcgagtcgttagtacccagaattttcgctcactgctcgaattttgacccattgggccgaggacttttgacccataagtccgcgtaaatttggcccatatgtggagagatttaggcccactcgtactcagaattccggcccatagatcggttgaatttcagcccattagtgagagtgatttcgaccgattagagcacgtgtcttgggccccatgattcgcgtgctttctggccattcggacgatctgccgaattcggctcataggtcctggatttgggccgtttggtccgctgagttttggcccataaacttggcttttcagttgatggctatcacgttacgatcttagaacattcaccacacaaaaaattaagtacacatgaaaacagttctttactgttacatcctacaaataaataaagtgacttcatcgcaatgccaaacggagccttagaacattcgtcacacgaaaaatcaaggacacgaacaaatgtcagggaattaagtttggttcagtgcgtgtaatagctcacttggcataataatacaatcaaatgttttgtgaataacaaaatccaagtatggtacagtagaaaataatcggcgtcacgtattgtaactatgtcatgaacaaagagaataaaatagttgcattatgctcttataaatgtaagtccaacaaagccacaaggcgtcctctattcaaagagatcggcatcatgaacaatatcgactctcttcagctgtaggaaacaacatatgcaattagctgctatattcttcctcttatttgtccaggacagctacaaggtgtcgtaatatccacaagaagaaatgctgcctcataaaagagtgtacaaggcccccggttccccctaataaaatctgctgtgtccatcgttgcatacaggcccatttgtttaatttccaagtatagcaagtgttcatcgcttggagaacagtccttgagttaatgatgaaaaatcatattctttgcctgattgagaggggagggaagaagaggtcggggatgtgctcttgttagcagctgcacttgcggccccatttgctgggacagatgagctagtgttgtatgctctgcatcaaaacaaaagtaagcatcagaaaagctaagccatgatttgtgacctcaaagcacatctaaatttctttcgcgaccaagtaagctgtggtatgaagttttaattgccaaaaactagtcaagcaatattgcttacccaggtgtactaaaattgaaattcccaaaagagaattcctgattgttgttcgcaacctgccaagtaacaaagacatgaaaagatgaacatacagtaaaacacatatttatacagatgatctaaaagcccttaccttggtggcaccattctgtgctgctactggagccaacccaggattctgataagcaagatttgtccagctttgtgaaggcaagcctccattggcaggattagaaccattaccatttagcagactggcgttccctggaatcatttggggtgcatttccagctttaagagcagccattagtaaagcttgctgctgagacagaagtgcaagctgctggggggtcataaaagcaagttgctgctgctggacagcatatggcgaaaccatactggactgcaaaatacacgtatttcttcagataaaccatagatgtgctctttcttttaaatgacagagccatttcacaaaagcattagtaaaagtaatgctggcgctgaccttctcaaacagactcatgatatcattcttcacatttacttgtggggcagctggagctgaggatactgtcacagctggtgaatctttaaacaagtcctctatgcctgatgtagactggggcttactttctactggcttagcagaatcctttttgtctgagctaggtactggctctgcagctgaacaattgagaaagagaacacaggagcccaaattaaaagatactccacagtatgcaagtaaggaatatggtgaagcactcgcagaacatttcataaaaagatgctcatataacaagaataattcctcaatagaaatgttaagtcataatatcttacactggaagccctcccatgcactatcatcattagaagatgactctgcttctttctcggttgttccatccattgataacatgttgaagagatcagttgcatagtcaaccttaggaggtggtgcaactgatggcctctcaacctttggtggtgttgcattaggaggtgatttctcgggttgaggaggtgaaaccttgggaactgatggttgtgcttttggctgatgtggtgcctgatttcaatgcagttgaccagttgtaccagattaaaactattagaagctagtaataaattattacacaacaaaatgcagcaagtataaaataaaacttaataataacttaagtctccaaattacttgaagtactcaatggatattgtgccaactttaacttaacacttattaacctaatgtggaaaatatcactggttgtaagaatgtgttttcaatcatgtaagcaaagtgaaaccattaattatcatcaagttatcaaggtcaggcacaagaaacaaaactataaacatgatcatccattagcatgatacacgctatcacatgatcattctcatttttcagtttggaaatctacagtttgtgcgcaaggcatataacacacacatatatgaaacttatagatcgttctccattttcgattaactattgaagtggcagatagtaattaagaactacaatttggaatatatatagctcggcttcaagaaaagagtgtcgatccctcaagctgtttacatctaaagatgctactaccaaaggcaagtatcaataaacttaactgataatcaacacctaggaaaagcttgtcataatccagtaggattacctgggtgggcgtcctagaaaccactggagcaattttgctcactgcagctggtgaagtgcggtgttgctcaaatgaagatctttgattatggccacccctgttaacactagtttgtgactctgagctcttctcatctctagcaccagatgatggtcttgatgacccattcctcggtatccatctcttgtcctcgtatctacattttagacataagttaataacattagtccaacacattgttccaaaggttagatccataaacacccctacaaattactccctctggtcataaatgtttgacacttagcacaaagatttggtcaaccttttaaaattccagcaaccaattttatattaggataagtttataaaatccaataagtttatgatattatgacagtacatttcaagtcaaatctatcgatggccattttttgtgtttaaaactaagcattttagaattttttttaatggtcagaattttagaaatttgaccaaatcttgtccttagaattaaatatttataaccggatggagcaactgccttttcattcccccattaatgaatggtaagtattaaaaagcaaaattaaacctttattttggttttgtatttgtttgcttgcgcggggggatgggaggccttggataggcaggtgatttacattggtgtactagatttatagcaagacaaatggattgtactagatttataggtactgaaagttggagaggttcattactttgcacggatgaagttctctatcccaaccctatcatagttagggggcagctccgcttcccagtagctatttgacttttcattccccattgctgaaagaagtgaagacgggaatacaatcatcattgagaactgcattacccctttgtttgatggcaaatattaaaaatttctggtcagggagtaatacatacattgaataaatgcaacttgctctggcagccatgtatccagggtagccgatcttacctgcgtcagggaaaaaaatggttcattaaatagacaaaaaccgcatgctattgatatagatttgaaggcgaggccacatgaaagaaagaaatgcatctcaaagaattaaacataaaacagatacatagctgtttcacgttctctgtttgtaatatacacaaacaatttggtgcaatgatgaccagtaaaaaattgtgagcacgagttctcaaagtacatgaaaaagataagccagccagctcagaagcttcgaagtcaaggttgttgcagaatccagatagctaagcttattggttgatgactatctttgccacaactaccaaaggtgtggtttgccacacaaagtgtggccaacaaatcgttggccacaagtgtggcaaagttaggcaccaaattgagtgtacgacatgtgaaaagagctaataaagtgtggcatgtcacagttgtaacaaaccaggctctaggctattaaagtgtagcacgcctaaggtttggtatggcaaactctggtcaccaaaccaaacagcccggtttcgcatatgatggattgatggccattctaccatgttgaatttatgttatgtttataatcttatataaacttacattagccaggatgcaatgaactgaaagaaacaagcataatatactttgatactataaaaaaaatgacactgatagagcagctaccaaattttcatgaaaagttggtcattcaaagtactcaagttgtgtttcaagccaaatttgtcagaacttgtatgaaggagaaaaaaaaaagtgggcatactgagttcgaaaataaacagttgaactcatgcacataattcactgaccttagatatatgtaccccgaggcttctatgaattccagaacactgcatgcatataaagatcccaagatttacacttgcccatcgaggacccctgaaaaatggggaaacagtcagttgacaagaactatggcacatgcaagtgtctacctatcagttctaacattacatgctcagagatgaatttacaggtaacattagacatgatggagaggaggtttaaccaactatactgactatataagtcaataaatagaacagaaaattttcatttccaggaatagatggttaacatgttggatgcaacaaaccagtgatgaagcaataagaataaatatcttaaataattgcttctagattactagaggccctccaaatgccatagaacttgctcaacacaaatcagcaagcggacaatgaatcagaatgttaacttctataaaaaacaacgtcatcaagtgaaagtactcttagcagcaaagctaatgataaaacataaacttgtataatgcatcaatagccatcttttggagaaccaattgcacaggatcactcactttgacttgcagtctgcacattctctattctcaggcagccgcaggaggccttccaatatctggaaatcaaggacgagccataaacatggtaaataagacagggtacttcatgaacaatacctaatattgttgaggcttgagcgggtcatgaaaaaatcaaaatggtaacaatatgttgtagcaacgaagatagctaggttgcttgtacagttgactgcgaattgtttaactttttattgccacgattgagaaggatacctactataaaattacaaacaatttttcaaataacgatttccaccagtcgaacaattcacaaaatccatataatcaagcttaaattagcaaaagcgcccgctccccgattcataataacggcaaaacaaaggaagcgaattccgatctgcgccacgctcttcctaacgccacaaaaagagttgcaaagcaaccgcgcgcaattcaggagcggggagatcaggaacccacgaaatcgcggatcccaaatctccctcacctaacaacaaacgaaatcgcacgccgaatcgactctgccgtagctttccaacccaaatcgaaagggccagcctccgatccgaacaaatcgacatataacggaacgggaggatatacgaaccttcttgtgcttggcgttgagctccttggagacggaggccttctcgttcatggctgcgcgcgcccccgaaatccctcgaccccgaacggaaactcctcccgaatccgggggcaaaccaggcgccggaccaggattcgccgtctccggtggggggcctcgggatctcagcctcccttcctcccttcccccctctcctcctcctcctcctgatctcgccgcgtcgaggggaagagagagagagagatgggcagcgaggagaggggagggatctgtgcgtgcgtgccctccccggcttgaccttcctcgcttcgcttctcctcccctcctccctccgatttcctttccttttccttctatatttttttaattaattatttaaaacagtttgggtttttttaaaaaaataaatgtgtggtgtgataatgacggcgcgttgggtttgctggcctaaccaatgcagaccacgttttactggtgttttaacccgtgatattctttcgaccggagtagtgattagctgtaactaatattctcggtagccatccagcttgttctcaatttctatttgatggtgaaaggaattattaggatattgtgtatagttgctatgctgtcgaaatacctaatgtttgttttctgttcgtgactattgcaccaatataataaataataaatcatggtgctgtagtttttacaatacaacaacaaacataacatcactatgaaaattgcaaatgaatattgtgatcgcccgaaaagttttcaactgatcaaacaagcttcaaaacacaatacaatgacgtgattttttatcttatagtcccgtgtatgttttattcagtacaaaatagatgcttggctctttcaagttttttttgttcttatactcatcgtattcaataattaattgcacgtggttatttttggaggtcagataacaatataagttatgtacgttatccctcattatatgttctggaacaatataaaagaaaataaaggttgagataaatattatgaagatcttacatatattgatcgtttctaatataagaattttacaagatttttatgagattcattttatttttattataaaaagaaggcatgatctgtaaaggtttttgtcatgctttgttaatgtttaattgcgcttcaaaccgctgtacgtcccaaaatcaactattgtaaatatagtaaattttatcttatgtttttgttatcattcgttggcaaccactcaagatgaaaggagtaacttgagagaagagagtgaaaatgattgaagatgacaggaacatacagtagtccaaagtggggactccatcttgaattgtccaaagctgaaagcaattgatgaagtgtgacctggagtggtgtactattgccactctttgatcagccgcatgtaatcacccatggctttgttagtcaaccatccactatgtattcccctttccattttatttctaaccgacaagatagtggtaatgatttccctttatttttcccttttggtttatttggtcttccatgtaatgcataaatgcatttgattagttggaacccatgtcagtatgttgcttatgcatgattggtcaggtgcagtagttggtcctccatttgccttttttcttttgtttggcttcccattagttttggtttggtggacagctgtcggatacttggggttagaatttttctttttaagtttagaggcttatctcatcagagtgattgtcagaaactaacgatgataaattgacattaatccaaagtctgtgatgtcacgggctcaaacagtgtcactgctatgtttggtttcttattcctttcgctttgtgccgactgaaaactgaacattggattcggttcagttttcaggtgaagaaaagcacacatgattttcggacaggcccatctccgtacatattgaaaaatctgaaatgaaaccgatgcatcctcgcaagagcaattccgttttcacacatttgctttccttttttttccgtttatgtgctatggcctcaagtttcacatattctttgttctcttgaagctgctacggtgtcaaaagttttcttgccaatgccgtcgactacatcgtttactttatagctgataagcccagagaaaataaacaaaaaaaaattaaaataatttatgagtaaaacttgtatagaagtgttttcgtgacttaaaaagccaatgctagaaaaggaaaaagtacaccgaaggtccttcaacttgtcatcgagttataaaatcgttcttggaccgcaaaactagatacaacgcattcctcaacttacaaaaccaatacaaactaggtccctcggcagttttgactccggttttatccgacatagcaactgactcagtgtgggactcacgtgggccccacacgtcaacctcttcttcccctcccatctccacctttctttctctctcctctcctttctcttctctatattgaccacaacccgctcgtcatgccgcccaaggaggtggtggccggcggcgttgccgctgtcaaggggtacatggccaggtggtggcgcgacgcccgcgccgaggcagcgccatcgccgagagccccaaggtgtcgacgcccaaggagtggctggtgtgcagcgtgttgtcgctgggcagctaggtgtctgacgtcacgaggtacggcatcgggcaggcggcagaggaaggaattgcgcgggcggcgggcggcgggcggcaggggaggagcggcatgcgggcggcaggggagcaattgggcaaggggatagcgcggcgagctgttgcctatggtgaggacgccgttgaggtcggagggtggcacggaggacagcggagacggggtgcaaaggacggcgagcaggttggagggatggcgcggtggcagcggatgtagcgagggacgacagcacgaagatggaggagacggggaagaggaagaggtggtgcgcgacctcctcctcctcctcctcctcgaacccatcgccatcgtcgttgtcgttcgccaccgctctgcttcgcgccgttggcttcgcgcgccatcgcctcgtaggcctgcctgctccgcccgcgaccgccccgctccgcgccgccggcttcgcgcgctgccgctttgcccactgtcgccccacttcgcctacctgctctacccgccaccaccccgctggcttcgtgccccgtcattttactccgcctggcttctccgctcgttgccacctcgctctaccccgtccactgtctccccattccacctgccttctccgcctaccgttgccccactccatcccaccggcttcgtgacgcggatagatacagagaagagaggggatgagagaggagaggagagaaaaagaaaggtggagaggggaggggaagaagaggctaacttgtgggacactagggcccacgtgggtcccacgttgagtcagctgctacgtcagacaaaactggagtcaaaaccgtcgagagacctaatttgcactggttttgtaagttgggagatacgttgtatctggttttgcggttcaaggatgattttgtaactcgatgacaagttgagggacctttggtgcactttttccgcttgaaaataaaatacggggaaaaagtacaccgaaggtccctcaacttgtcatcgagttataaaatcatcccccaaccgtaaaaccagatattgggcgtcccttaactaatcaaaaccggtcacaataggtccttgtcacgccggctcaaggacaagaccagctcaagaagtctaacagagagaggcagccctcgagaaggttccctgcaaacgagtggacccggtaactgtcacggggccactgttagagagtgagtgagaccttgtagtgctgtgctatttgtaaaatcaaaggtgtttttgatgattattctgtgatgaacaattgggcatcggagattattggttttgttatttggaatttattcacgaagtggttttggagatgattggatttcacaggtgatcgcaggattcattatttcatgtgaccggtcagaccgggctctggtagccggtcggaccagcggtatgcgcgcggtcagaccagccagcccacggtctgaccggccgacactgtgtcggtttcggtttcgggttgtttgtttggatatccgtgattatttcatgattatgacttctagatggatactatacatatgtaatactgttgtttgctactaatgagtcaagttggagatagcttggtctcggaatatggtttctttgtttgttccatgtgtaggtgactcgatgtctcgggagagtatttgcggtgatggaccgggagtcggcttggggataagacgacgtctgtggtgatcagagatcatgcgggatacttaggctagagttgatgcacgtggttgatggagattccatatggcatacgatgaagttattgtgtgcgtatgggatgtggagtcaaatttggaaggagtccaaatttggtacgattggttatgtaatgtttctttcttctactagagggtttcctaaggtgtttaggactcttagtatgagtttggttcgtggctttaggctgcctacctcatgtataaatagagggggagcgtgaggcttcccggtatcgcttttgagagcaattgagttgagttttgagttagagtttcgagtttagtcgaaatttttgtaaggagtgctgttggtgcactttgtaaacatagagagaagtaataaagtcgtcatccactttaagagttcttcgatttgtgtttcactgggtttcggcggtctaaccggcaacgcaccggcggtcagaccggcggcatcgcggcggtctgaccggcgggcacacgacggtcagactggcggtgacaggagtcgacagcaggcgttctcggcggttcgaccgatcaatctacatcggtcagaccgacgttcatcaagcggtcagaccgacagatcaatctcggtctgaccgcgatccatcgatttcgagggtaacttttatttccgctaaaagttttcggtttttgggtataccaaccattcatcccccctctggttggcttagttcttgtgattcgatcctacactatttaggtcggcaggagagagagagattaactttggagcaatgtacaaacaactttctccaaaatcaattccaatctctcctcctcttactctgaaactctctgttctttctctctgttcttcctctcgactccgttctatctcttccgctatctccaaatctctccaaaacaattgaatcgcagttgagaaaatcgagttcgtgacaatttggtatcagagcaaccaatcctggagaaaccacgctacacatcccggctgcaacttcaagtggaggcgatggagaagcaaaacgtggatttcagcaaggtgcttgtcgagatccaggagtcgatgttggcgctgaatcgagcacaaggcaagacgcaggccaccgtcatcaagatagatcaaggtgtgaataattggaggccacaagtggaggaagtgatgcaggaactgcgcgaggaggttggcgagctccgccagaaagtggacttcctcggcaagacgaagatggcttctccattggcatcttcccctcgagttccgttgacggacgaggaaaggaaggcgccgctgctttcccacacctccgtcgccgacgaagttgatgaccgcggcggaagaagcagagaagtgggcctatggccaccgctttgcacaacatcaccggggtagggcatcagggatggtcaccaccctgatcccaactccgggcaagggtaagttcgaagttactcctgtttcaatgaattctctgggaaattttgattcgggaggtgggaaatttgatggggatcctgatgagagacagtataatcaccgtgtgcctaagttagattttccaaaatttgatggttcggatccacaggattggcgtatgcgttgtgagcactactttgatgtgaacaacacatatccaggtctatgggttcgagtcgccaccatttacttcataggacgagcagcatcatggttgagatcttctagagctcatgtgaggtatcctgtttgggaagagtttagtgccactatgtccagtaaatttgataaggaccaacatgatttactcattagacaaatggatcaaattaggcagacaggaacagtttgggagttttatgagcattttgatgagttgatgaatcagctgttggcttatgatcctgaggttaatatgcgatacttgattcatcgttttactgagggattacatagagaaatcagaaatgctgttttgcttcatcgtcctcgcgatctcgagactgctctggctattgcgtctttacaggaagaggtgctggaggtggtcccggagtctaatcacagtaaaccctttcggcgctcggatggtggagtgcaaccgaaaaacagttctgctttcaagggagcatttccacttcctttacctccaggatcaggaggtgtgcgtgctgatgataagaaacatcaggatggccaacgtgctacaggactattgacaagatgtcatctattaaggctcatcgtcgggctcaagggttatgttacatttgtgccgaaaaatggtcacctgctcacaaatgtgccaccactgtgcaattgcacgcagtacaggagttgttttccttgttgcaagatggtgaacaatcttctttgatggattctaaaaatttagaggagcaatctggtccgtcagttatggctgtgtctgttcaagcaattgtggggtctgaatctggtggaaccatgcgcttgttggggtgggttcaaggttttgaagtactcatcttagtggattcaggcagttcaaccagttttgtcagttctcagattgctgcttctttggctggggctcaatgattagctaaatctgttcaggtcaaggtggctaatggtgaattgttgtcttgtgaccaagagattcctggttgtgaatggagctctcaagggtacttattttgtaccaatctgaaggtgatacctctgagcaactatgatatgatcctcggcatggactggttaatgcatcacaatcccatgacggtcgattggaccagaaagtctttgactctcgcgtggaagggacagactatttcattacaagggattacatctcagttagccacttgttccagtgtctctgttcaacaattgaatgggcttatttctcgttgtgcaatttcaaatctggtgcaattatgttctctgtcagtatcatcaacttcagaaatcattcctgaggcagtgcaagtagtgttgcaggaatttgattctgtctttgctgaacctgaaggtttaccacctgatcgaccgtatgaccactccattccattgattcctagggctcaaccagtaaatgtgaggccatatcgttatactcccacacagaaggatgaaattgaattacaagtgaaagagatgctttctaaaggtatcattcagcccagctatagtccattcttttcccctgttcttttggtaaaaaagaaggatggatcctggcacttttgtgttgattatcgccatctaaatgctataacagtcaaaaataactatcccttgcccgttattgatgaattgttggatgaactcaatggagcgcagtggttcactaagcttgatttacgctctggttaccaccaaattcgtatgcaagtgcaagatgaacataagacagctttcaagacacataatgaacactatgaattttgtgtgattccttttggtttaaccagtgcaccagccacttttcagggcgtcatgaacagcattctgcacccttggcttcgccgctttgtgttagtctttgtggatgacattttgatttatagttctactcttgaggagcatattcaacacttgagaactgtgttccaggttttgcttaagcatcagctcaaggtgaaacgtagcaagtgttcttttggccagcaacgccttgcttacttgggccatattatttctcctaatggtgtgtccactgatgaggataaaattcaggctgtcagggattggccagttcctacctcagtcaaagaattgcacttcttaggattagctggctactatcgcaaatttgtaagacattatggaatcatcagtaagcctttaactaatttgttgagaaaggggcagctctttgtatgaacagttgactctgaaactgcatttcagtcattaaagcagctcttatctcagctcctgtcttggccatgcctaatttcaatctaccttttgtggtggaaacggatgcatctgacaaaggaattggtgcagtcctaatgcaacagaatcacccggtggcttttctcagtcgagctttgggatctcgtcatcaaggcttgtccacctatgaaaaggagagtttggctataattcttgccattgagcactggagctcttacttacaacatgctgaatttttcattaagacagatcatcggagtctatccttcttagatgatcagagacttactacaccgtggcaacataaggctcttaccaagcttttgggtttacgttacaagatcatttacaggaagggtgttgataatcgggcggccgatgctctgtctaggtgccaatcttctgacaccattgttttatctgctctgtccgtggccattccagcatggatgcaggaggtaagggatggttatgttcaggatcccgattctcgcagtaaagttcagactcttagtatcagcgctcatgatgtgcctgattacactctgaaggatggcatactgtatttcaagcagcgtatgtggattggtcataatatttcccttcagcagaagatcttagccaatcttcatactgctgcagtgggtggtcactctggtattcacgttaattatcagcatattaagcaactgtttgcttggccagggttgcgctcgagtgtggtccaatttgtgcaagcctgttcgatctgtcaaaaggcgaaatctgaacatgtcaaatatcctggtatgttgcaacctttactagtgcctgaacatgcttggcaagtggtctcgttggactttattgaaggtttaccacgctcatcttcgtttaactgcattttggtggtcgttgacaaattttccaaatacagccactttgtgcctttgtctcatcctttcacggccttggacgtcactgaagcctatatgcaattcattcatcgtctgcacggattgcctcagtcccttatctccgatcgtgatcgcattttcactagcacattgtggacaactctgtttcgtttggctggtacacagttgcgcatgagttcatcttatcaccctcaaacggatggacagacggaacgtgtcaaccagtgtttggaaacctttcttcgctgctttgttcacgcctgtccctctcagtggagtagatggttggctctcgcagagtactggtacaatacttcattccattctgctttgggcacaactccgtttgaggtattatatggtcataagcctcgctattttgggttgtcagctactgcagcttgtcagtcttctgagcttcaggagtggctacatgaacgcgagaaaatgcaagtactgatttgtgagcatttgttgcgcgctcaatccaggatgaaatttcaggctgatcatcaccggtcggagcgctcttttgctgtgggcgactgggtttctctcaaactacaacccttcgtccagcaatcggtagtgacccgcacaaatcgcaaactttcgtttcgcttttatggtccttttcaggttctagctcgtgtgggagaggtggcttatcgcttggatttaccagcgtcaagtctgattcatcctgtcattcacgtttctcaactgaagaaagcgctggcacctactgaaacggttcaacttgttttgcctgtacttcatccgacaactgatgctgaagctgaacctgctcacattttggatcgtcgcattattcgcaatggctctaagatggttgaacaagtgttgattcagtggtctggggaagaaccaacagctgttacttgggaaaatctgcaagaactgcgccatcgttttcctcaccatgaagcttggggacaagcttcgtttcaaggaagggggaatgtcacgccggctcaaggacaagaccagctcaggaagtctaacagagagaggcagccctcgagaaggttccctgcaagcgagtggacctggtaactgtcacggggccactgtcagagagtgagtgagaccttgtagtgatgtgctatttaggtcggcgggagagagagagagagagagagattaactttggagcaatgtacaaacaactttcccccaaaatcaattccaatctctcctccagttactctgaaactctctgttcttcctctccgttcttcctctcgattccgttctatctcttccgctatctccaaatctctccaaaacgattgaatcgcagttgagaaaatcgagttcgtgacagtccttcggtggttttggccccggttttgtcctacgtggcagctgagtcagcgtgggacccaggtgggccccacatgtcaggatgccacgtcaatctctctcccttcctcctctctctcttctcttctcctcacccgacgccacgagaagggcagcgccgcgacggtggccggtggcggtgatggcagcatggcggcggagaagcagcgcacgggcggctagggagcatatgagggaagaggtggtgcgcgtcctccccctcaaatccaccgtcgtcgtcttcggcggcggcgaccgccatggcggtgggaagcagatggggaagctggagcggcgaccgcggcgggagtggagctcggtggaggaggcacgatgatgacggcggagggagttggggcgccgaagctgtggagatcggcggcgacggcgcattgtcgccccactctacccgccgatagtcgccccactctgcccgtcggctccgcccaccactgtcgcgctccgtgccaccgacttcgcgcgctgccactccgcctcgtcatcaccccactccacccgctgccgctccacctcggggtcgccccactccgctcgccaccgagcacgcgcgcccgaggatggaggggagggtctcgacgccgaggtgccctatcgtcctcgctctcccctcgcagtgttcctgccgccgacgccctctccttctcccgcctcgccgctactgccatccctgcgtcaccggccgctagctcctcctctcggcgtggcagaagggagaatccgacctcggcgcggcggcctcccctccagcgtcacagcctccacgtcgccgcctcgtgttaacgaccaaatttggtaatatcagtatcggagaagaagattagatcgaagcggaatcaaagatgaggattgtcgcggaaacagagtaagaatcggctggagtccgaattggctacgatcgagatcggctaagtccgagtcagactgggttaggtgatacagccgattccgacaatacgacttggtgtacgacattgggtcgagttgatatgcttcaagatgattgccacgcatggatagagtcctgagaatgcaattgtatctattagttaggatgttttatgtaaattccttagagatatgtttgggaaaaagtctgccgcaaagacttatggtatcttagagtttgttagggataagagtcatgtccgatatggacatgttgtgtaattctcgggtataaatagaccccgagccctatgtaatcaatttaacacacacgttcaatacaatctcgacgcatcgccatcctttttgctttagttttatttcgacgagttcttgctttcaggttgagctgcatcggtttcgatcttcaacaagaggtaaaacttgttatgacggcttacgttctcgggattagtgcttccatctttatgatactctaatcttgtttatgtaattcgtcgagttatcatatatcttatataatctctgacaatatcgctatctaacctacaatcggctaacatctatcaatagagggcagccgattaggttaaatatcgatgttggcttagattatatatgatatccaccactctatgaaacttccaatggcttgattgtctagatattgtccttctttttatacttatagctgcatcaattgagtttgatcttatgagtcgtgattagaatctcaatctctagcctgcttcttggttgccgattagggtagtatcggggtttcagccggtcttacctggtttaactatatttgttttatatgctttactgacatattaaatctgccctttatgttaagatcttgccgcatttaagtatattaggctctttgtttggtatatcctatttgcgttgatatcttaatatagagcggtatcgaagtattagccggtacatgctagatctctctgatcggctatgctatgaatatatatagtcttgttgttagtatatattttgatctaagtgatttatactgtctcggcatggcaaccgatctatcccaatcacttgatttaagtatatatcaatataaggattatatattgttaatatctacagccgatcgaatagatttagttctttattatctatttataactgccgatcgatacatatttaacatcggctcaaagataaatgatatgtcatcggcacctagccgatcgactatcatttatggatttaaccacagtttttttgtctttatttcttgttgattgcaggatcaaatcaactggcacgctagcatacccgaaggcgagttttggatctgcactggagttaagcagacctcccagggctcgtgtttttcatcaacacctcatcacccgccgcctcctcctctcctgcctcaccccggcgacctttccccacccatcggccagcttgctgcttacacataaggagaaaagtgagattgagaaggagggagaggaaagggaagagagagggtgctgacatggcatcttgacatgtaggtcccacgctgagccagccgccatgtcggacaaaaccggggataaaactgccgagggacctagtttgtatggttttgtaagttggaggatgcgttgtatccggtttcgtggttggaggacgattttgtaattcgatgacaagttgagggatcttcggtgtactttttcctaaaatacggtgagaaaaacttgcatgcggcctataatagttgggcctcaacgggaatgcgggctacgtgcggcccatattagttgggccgagagctagaatgcggcccatattaagtggtgttgcgcattgctgctttcacagttcgcaccatccggcggaggaagatggaggcgcaggcgacccaccggcgagccggagaccgcggcggcggtggcgacggcgggagctcctccgcctccatcgccaagcacctcgcaaaccagagccaggtacctcgtgagcacgcgcccgcctttccctctccatcagatcgtttgctgcttgctgccccggaggttctgtgatgctgccgattcctgcacacgtttggctcaaattctccacgaattcgtggcttctcctctcggattttcgcccatactcatcgcaagaatcaagcgcgcgtagccaatcgcaccatcgcggttacagttcagcgattgcctcctcgattgcggctgcggctgctcttttgcgctgctagatccacctgaaccatgccggctcacagtgttctgcagaaacctgagaatgcgtgctggcatgctcgatttcgttgtctggctctgatttctggaaggctctgattgcaactgtacatctcagtatcttggctgctctcgtcatgtgttgtcgcgtttcctgctcaggtcttgaagtggctgcaagatttctctgataaggtggaggagagagctaaaggagccgctgcagaagtcaatgtgttgttagatgaggctggggcgctggagctggatatgaagaccgcgatgatctccttcaacaacctgacccgccaaaggttcattgaacatgcaagtagtggttccaaatctgtatattgcacttgtctttggatgcctctagtctagaaagttatgcttgctttgtgattgatttgtttatatcagatgacaatatacttaacttttggctgtagtacacccttctatggtcaagtgtcgtatacttgttttgattacttttgtaaaagacataaatttcaaatttacataaattcaaatttatgatatctcctcattccctcagtggaaattgcttgggacacatttctgtactttgcctcaaggagatgaataacatatcaccgctcactgctgcaagtgcgtcttcaactgcagaaaatttcagatgaagatagtatgcatctgaaaacaacggagagtatgcatggttctctgcaatcccaagtgccagctcaggattatgaacgtgatattttaccaagatacaaagaagcattacacataggactttcttcctgtaaggaccacttccgaagcaagggacgctctaccacctctgtgttcagggtaatggccttacttgcagttcttgatgaaatatttacccccccccccccctcaaacttttccctgcaaattaatgccataatttgtcattactaaaattttgttgcggaggcttgtttaggttgatgccaactagttccagtttttagctgccaaatattatctgaatctttattatttttcttccaaaattctgtcaagattcccatccttttggcacattatggtaaattcattttcttgccgaaacacttccaattttcagcgacctattagatgaccaaattttggaacacattgccaatgcaatttttaccaccaaccctccccctggtcacccagatttcagaagcaaattaactaaaaagcttgctgtgaagtaaatattgccaatgtttttccagcaaactaattatatgccaaaactgacaaaccaaattttggtagttctgtttggtaactgcagctggcattatttcagaaattctatagttcacaagcgtttgttctatggtagcatttccaaattatctttgttgcttgactcttgaaggctatgtctgcatatggccctcttccacatataattggttctgaagagtacattcatgataacagctgtggtctggcaggtataagtattattcaattgtttttctttggaaacaattttatactttgtgaatatactcatgtgagcttttcaattttgtttcaaatagatgatatgcagcctctaagtgatgacttcagttggttgcgggagtttcaaagtgagtcttcagactcacggactgctgatatctctgagtctcaaattttcggggctcagcgaggttatgagaaggtacagtgtatttatagtttgcggcaagaatgatgtgttctggtactgatttgtttgctgtttcatatggagtttgtttaaactctaatcaatatatagtactcctagttgacgttgacactaatagtcttccagaccattaatcatgtgtgcgtgtttcaatccagggggaaactgactctgtggtttctgctgcacgagaattcaaggcaatgctggaggctgcacttgttaatccctataagttctgtatgtgattctttccctacttccgtcctaattttgacatcttataatacctgtatagtgtgttaactataatcttcttcatttattatgctttgtcctctctttgaaaagttatctttctttcttagtccaatttagatgtagtttttttataaaaaaaaatccgttatgattttccttttcattgattttagtagaccgtgcttttcacagatgatgatgcaactattacagcgcaagatgcttctgtagagaagaagataagcacaagtgaggtacagcataacctttctgtggcattgtagtttggactatgggtatcttcaaccgatatttctgtctggctaaaagttgtgtcataaccctgagtccctgatgacttgttcacatgactcacatctggagtcctactcccaaaacatcaaaaaaaaaaaaaaaacttgcatgtgttaattcttctctcatcttttaaatttccctttagttgtaagatttcatacgaagctcaacatgtttctaattgtgagctcttgcttttgattgttcactctggtccagtggatgtgtttttttttgtccaaaagtatatgctgatattgctatttggggaatatgataccaataaaaggagatatttccctcattccaaatttccagttttaaataatttatgaccctaacaaagttgccttgtgatgattctaggaccaagttatgctgacagggacaagtgaagcaccgagtggaagatcagcacaagaagataactctgaacagacaggactttttgcaagcttgcaaagcgcagatgccaatcctcatgacatctattctgctttggttagagaaggcctgtttgatactggtgatgagattctgtctatggatagaggggagtctgctgatactcctatttcaggcctagcgtcaggtttagcaaatcttggcactgctgatccagctgaaaggggctactcaataaacgagactacaaatgaggagggatacttgattgaaggggatgatccatcaccatcaaacaaagacgaacaagatgaccaaactgatgcacatggtgtgtcttcgccagagccagaagatggtgtttctagaccatcctagccatgctgatattggttgatttcttctcgagtgcagttcattctgtcaaaatctactgtagacgctggtgaagcaactgaatggcaatgatttagacgaggaacacacttttgctgccatgtgctgagtgctgtagactaagaaattatatactccctttgtttcaggttataagacgttttgatttttggtcaaagtcaggacaaatttgtagaaaaaaatagtaacattttcaagccaggacaaatttattatgaaaatatatttaattattgatttgatgaaactaatttagtattataaatattactatatttgtctataaactttgaaatagtttgactttgaaacggagggagtaccgttgctccagtgtatcaaaacaacgcattgaaaacataccattacgatttaattccatcactagcgcaacttattattgacgccgcgcttattagctcttttttctccctgatgaggatcaataattcgttacctcatgctgaaatctgcactgtagaatacctaagaccgacgtcgaggtctcgaggatgaagaatttggcacgccaaaaccatcctaagatcgagaggctgtgactgtgcctggtggcatattcaagatgtgatcaggttgatgaagacagcattgcacagaaatgtcttcgattgaatcaatgagcacgatcattggcgtgttttgcacgaatgaccaaaacagagacgatgatcggacgaagagatgaaacgaatgcaactcttatcgatcaagacatcggcaccgttactaccaaaggttcttttataggaaaagtattggtggagaccgggtgtcttataaccggccttatctacagcctcgccccggatgaatgccaaaaccatcctatgagcgagaggatcagattgatgaagacactaccattgacgtgttttgcatgaacgaccaaaacagaaaagatgatcggacgaagagattaaactaatgacactagcccattcttttctccaacaagagctggataaagattaagatttttatggcacgctttttaaactgttaaacggtgtgtttcgtgtgaaaattttttatatgaaagttactctaaaatatcatattaatatatttttcaagtttgtaataattaaaactcaatcaattatacgttaataataccatctcgttttgcgtaaaaaaacttattctttattttcatcttaagaaaaaaaaaacatcacaaagatgaccagaagtagccctcgggcgtgcctagttgtctctctctctccccctctctgtcgaacactatgccagaatatgaccagtggaacgaacacaaggtgtttggtgctgtcaagtggcagcatttctgatagtgttgattgcaaatgtaaaggatacgttagcgggggctttaaccacgactccaactttggatttgtttggagagcttaagattttaagaaactactgattggcagtgtcggtgacatgggaccgggagtatcatgacttagagacttgaggcagacacgatcacccacgtggcctaaccccctcgggggggtcgggcccgagggtgatacggccgcccttctctttgtctccccgaggggtcggaccgctcccgtctcggccccgagggccaaggcgccccgaccccttgtgggttttgcgccgcgtatatagggtaggtgagcatagcggggctcacctaaccgcatttattgcggtttggacgagcgcgtcacgccacatgtagcgcagtatggcacgctcgtttatccggtctgtgaccggtcacagatcggtcagattgcgggttaggtggcaacaggcgatctgacacacgcctcgccccgtcccgtcaggatgagagtctctaggcactcgtccctagccggagccagcgtgctagctcctggagatggcacgttggtcctggtcagatatatgccaggctttatcccaaccattataagcaagacgttgtatgaagaagggcgaacatgcagattgctaaactgacacgtggtggacaaaggtgaccggtctgtgactggtctgacactggttatgtcgccggaagacaaccgtgttcccacgttgcacctgcttccggcggagtggaggtaggtatgggccgtcccatcagaagggtcactcgggcagcagctgttgcaaatctccgcccatttatgaagagatgacagggtgatccccgaggtcagacgaacgaggacgcgtggccacactcaaaaacaggcagtgtttcagcttccaagagaaggcaagccaagttttactatagataggatgggcccccacccaaaaagagagagagggagaagtggtgcatgtggtatccccttgagatataaaaggaggaccttgcccacttaagaggcggggctggaaggggggatgatctggagagtagatcccacgagaggaaaaaagggagaagagggtttttagagtaagagctctctggctctccagctctttgtagcttcttcatacacagatccaccagaacacaggagtagggtattacgcttctcagcggcccgaacctgtatacatcgcccgtgtcttgtgctttttccattctcgcgaactttccacagactaggagcttagaatctcacccagggcccccggccgaaccggcaaaggggggcctgcgcggtctcccggtgaggagccccacgctccgtcaggcagatattttataagaatatggagaagtttcgtttcttagattatggcttctagttagtttttgaattttataactacaatttatcaggatttggatgaaaagctaaattgtttggaaattttgggagaaactggagctaccatagactccccaaacaaaaccctttgtgcgccacgatcggttcgcagcgtgtgccatcccacgcgctcggttcacacaccacgcagggaggctctggctcttcatgcgattctaacaaacctaacaaaccttatctaaaagagaaaaaacgaaataaagaaagagaaataccgaaaatactggtttgacacgcaccaggattttctaaaaaaaaaatccaacagtatcgatctaagacatcgtcaccgttattataagaggcatttgtaaatttgttatcgattttttcaatattgtaaggatgccactcgaatgatagttttagtagtatttttacaattttttagtggcagtcttataataacgattcaaaatagtggcaaatttgcaattgcccgttcttttatacgcagagactccgagagtcagtgcaagcaagcaggagctcgtcactgtcaattgacaaaattcagtagcaaatcctactctgtctgcatcaatggctggcccaaccatcgtcctcctcccggcctggggatccggccacttcatgtccgcgctggaagccggcaagcggctgctcgtcgccggcgggggcgccgtctccctcaccgtgctcgtcatgcaggcgccgacggagatagaggcgtcggtggtcgaggcccacgtgcgccgggaggcggcttccgggctcgacgtcaccttccggcggctccccgccgtcgagcaccccaccggctgcgaggcgaccgaggagttcatgtcccggtacgtcgagcgccacgcgcaccacgtcaaggcggccatcgccggcttggcgtcccccgtggccgcggtcgtcgtggacctcttcttcacgcccctgctcgacgcggcgcacgagctctcgctcccggcgtacgtgtacttcgcctccaccgccgcgttcctcgcgctcatgctgcggctgccggagctccgggacgacctgaccgtcgggttcgacggcatggagggaaccgtggacgtgcccgggctgccgccggtgccgccgtcgtacatgccggtgtgcctcgtgagcaagacggtgaagaactacgactggttcgagtaccacggccgccgcttcacggaggcgaagggcatcatcgtgaactcctccgttgagctcgagggcgcggtcctcgccgcgatcgcggacggccgccgccccgctccggcgatccacgcgatcgggccggtgatctggttcgacgccacgctgccgcccgagcagccgcacgagtgcgtgcggtggctcgacgcgcagccggcggcgtcggtggtgttcctctgcttcgggagcatcggcttcctcgacgcggcgcaggtgagggagctcgccgcgggcctggagcgcagcggccaccgcttcctgtgggtcctgcgcggcgcgcccgccggcggcgtgcggtacccgacggacgcggacccgggcgagctgctcccggaggggttcctggaggcgaccgccgggagagggatggtgtggccgaggtgggcgccgcagaaggacatcctgggacacgccgccgtgggcgggttcgtgacgcactgcggctggaactcggtgctggagagcctgtggttcggcgtgccgatggcgacatggccgctctacggcgagcagcacctcaacgcgttcgaggccgtggcctccatgggcgtcgcggtcgagctgaggaggacgacggcgaaggacggcgacgcggcgagatcgctcgtggaggcggcggaggtggagcgcgcggtgaggaggctgatggcgccgcagggcggcgggtcgtcggaggcgagggagaaggccgcggaggtgagcgcggcgtgcaggaaggccgtggaggagggcgggtcgtcgcacgcggcgctgcaacggctcgtgcgtgagatcgttcgtgtcgtggcaggccacactaggccggaatagctggctggttgcggttggttggcccatctcacacggtactcggcccagtctagacgagaaaattatactagaaaccaagacgtcaaccacgtgatgcggcttaagggtgtgtttgattcgtggtagggtatagccatccctacccctatgagcaaatcctggagagattgaagtcaccacagacgtttcgctgtcgacaagtacgtcacctaccactgactgaaagcacaacgtcgcgcttcgctgtcgacgggtacgtcacctaccactgaaagcacaacgccgttaaatcctggacgtttcgctgtcgacaagtacgtcacctaccactgactgaaagcacaacgtcgcgcttcgctgtcgacgggtacgtcacctaccactgaaagcacaacgccgttaaatcctggagagattgaagtcaccacagacgtttcgctgtcgacaagtacgtcacctaccactgactgaaagcacaacgtcgcgcttcgctgtcgacgggtacgtcacctaccactgaaagcacaacgccgttaaatcctggagagattgaagtcaccacagacgtttcgctgtcgacaagtacgtcacctaccactgactgaaagcacaacgtcgcgcttcgctgtcgacgggtacgtcacctaccactgaaagcacaacgccgttaaatcctggaaaattcgctcccacagggagttgaacccaggacctcatgtactactgaggctcttgtaaccactaggctacaagccctttcacgggtatagccatttatatttgtaggaatatggtggttctgtttgttttatggatatatgaccatccggataggaacggatagagtaaaatcaataacatattaatcaatgataaatatgttaattatcatcaatatagtcatatctatactaattaacaataaaatggactaattatataatcaacactaattttgacaagtcaattactccatacgcttcaaaatataagaaatctataactggatgagatattaatcatttactaatgattaagattaccaaatgtggatatcctcatccggtcaatttaacccactcatctagtatcttcgtgaaacattttctctttagaccacccaatccattcttacccatcaaccaaacatatttaaaaactggatcgtcatatcccatttagtgatatcactctaaccaaacacaccgttaccttcctcccacccttaacccccatcgcattagaagctgagaagtagctggttgatagctattccctccgtcttataacatagtaatccaaaactgaataagacatttcatattagaacaaatctggataggatggtatttagattcgttatactatgaaatgttccatccgattatagattattatattatgggacggatggactaacttttgagaatctggaaaagttgaaaaactagaaaggctaggtttccaaatttttatctttatttattttctatattctataactacaacttcttaaatctaacttaaaaatttatattatcttaaaatataacttaaaaatttatattgtttaagggagctaaagatttaaataaaagctatagcggttaaaaactcatcaaacagagatactcctagttagcaaaggagggtggcatttcggcttgggaggcccatcgacctcatatctccggcgaaacggtataagccaacaaggcaacaatgtactactacacgtcaagcgaggacggtgactttcgtggaggtagaggactctgtctgaactgttttcattgaagaaacggaattgaatacaggccaagtgcgcaggtacaccatagtcacctattgatatatatacgtacagagaaaatgaactacacgtctatctacacttcaaccgtctctcaactcacatcagtaatttaatttccggtttatcccaccgcatatccgtttgttgacatttttccatcactacttattaagtgcgaaatatgatgactgctcgctgtaaactgcaaggaccatttaacaggcttagctggagcaggatgaactcagttgctcgttttgctcatttctcatttccttctatttaattttattacctgtaatttttctcatttttcactgaaattttagtgagtccttcaaaaattaaataaaaaaacagaaaaaccagctggagtcgaggagtggtcgctgcatgtttgtgtgcagtgggccaacgaaattaaaccaaggttttctggtaatgaaggtccacatcaaactatcctctcgcatggcacagttaatgctaccaacgggtggtcgggtacagaatttaaatgctgtgtgctttaagccaaatgtagagaaaaatgggtctttatttatttcgaaatatctcatggccagccgctctcaatggtgtgactaatcacgttcaagccatgatatgatggatcaaggcgagacaagaaaaatgtatgagcagtcatgcgagcaaaagtagtagtactgatgagtgatgccccttcaaatatcataacctccctgatcttttctataattctattagaagaaataattaaaagatcgatcacacataggctctgctaatgaaaccggtaacaaaaatttaatcaacttcctctcttcatctccagcatatgtacaacatactacatgcacagggattacaagctgcatgcaaagcttagcattttgcaagaaatcaacaaagccaattaattaatactcctccaatagtagtactagtagccaaggcccaacgcaacaagcacacctcgcagagagcacagagacgtacgcagcaagtaggtcgcctcctcctctctctctctccggccatcaccgccggcggccggcgatcgtaggtagcgtagagctagctggcgtagagcctgtagtggcggtaggacttgagcatggcgccgcagaaggtgcagatgatggcgcgccacgtggccctgtgcacggtgagcaggtagcagaagcgcgtcgccgtctccatgtccgccacgctcgcgcacccgccgcaccgcgagcagatccccgccgccggcttgctgctccggaccttcctcctctggtccaccaagaagcagaagaacaccatcctcctcgtctccggccggccggctcgccggaatctcaaataacacgatgtgtggagtggtggtctctgacggcggcggaggtggtggtggaggatggcgcaggggggttttaaggaggagagcatatggatcgcattgatggcggtggtagtgaggtagcgggtaggagaggagagaagggggtggaggtattaatggcatgtcggcttgatggctggacggctggaccatgatgcatgggcatggcgcgttgtatgccactcttgactcccggactccacttgtccggagtaatacaattacagttgttgtttgttaattttttttcttttgacttaatgtttagtacgagatagatcagaattgaacaccgccactccgccacctaaaaaaactgactggcaattctggatcttcgatcagccagaaataaactgtctgaatcttctttttttttttagaaaatttctgtctgaatctttgatcagcatgtttgtatatatgtgatgtggagaagtaggttacgatgtttctcatcagttttatactagcacatttaggcttcctttagaatggaggaatctggtgagaattttacgagttttgaaccgattcctgctaaactgtcgtaataaaatccctagtagtacattttaaatgagccgtcagtgtctttttattttccagaaacagcactagagcgactgagtggcagctataaacatcgtccagaaattaaaaacagggacagttaacacgtcggtgtgagataggagtagatcgcacgacgctgactgcccactgggaggtaagagtctgggtgcgagctaggctgcgaaggaggaaggatgatagccagttggttaatggatagacagcaggagctagcagatggatcgcaagtatccgtcaaccaatttattagttgtgccttcgccaattccatttggatttcacacgaaagcgcctcgtgaagcaagcaaaatatgggtagagagagccttccctgctaagcaagcgagcagtcgatcgagcaatatattcatttgaccgatcactaacttctctttcgaagtaaatgatgggtcactaactaactgtctaactgtatagtaccatttgtaattgcagatcgtttcagagtatgacaaaggcaatctccatcagaaaaggcgccaacggtctccttttttttattctttttgaaaaagagaaggcgccaggcaacggttcttttaccaattcttacaggtttctcttgtttcagccagggatcaccctggagcttggggaggaggaccacctcctttgatgttggatgggatcatcactccaatactcagcatgttcatcaagtttgatttgatcccaggggccagggctcacattaaacttggtgaccacttctacgcaatgataggtccatatgaacacactactcttacggtcttgcccctcaagcggtcgattagttgggttgccgtaaatgaagtaccctttgaaaaatgtaattcacatagatgatggaataagataattcttatacggtctctaatagagtatttataaatatcaagttttacatgacatacaaatatggtacctcccgaaaacgataaaattacctatggaatcataatgaaagtcaaaattatacgttttcttactacttacttttttagtaatggaggaatgtacgtagtctgtctctgttcttactgtttagtgtactgctggtggaatcgaacattaaaaaataaaaacaccaatgctaatgatcttatataaaaaaacatctttttgaaccaaaaaaatgctaagaaaatatcatttccatcacattttgcatcccaatagcatgggacggaaacatatactctaactttaaatgattgacatgtgagcctcacagctcgtaggctcataggttaacgacacatgtcggagaactgtatgttagaggagcttcttcggtatgagatggcattttcctcctcaccgcttctttaatttcattttcatacacttttgtttttactacaacattcaactattgtataatcccaaatttaaaacagcgttcttaattaagcttatccaaacctttggatattagctagagaagaattatggtatggagagaagctagagagttcaaagaaccaggtgactagtcgttgtctttagtaaaggtggttctggcatctctagatgttcttccaggttttgactgccttctgttgcgtgaaaaatatactggtgcttatgtatacagtacataactataagtatatcttcttcaaatcttaatacaatcggttgtccgtttcttcggccaacccggccaaaaaaactagagaataattaattaattttcaataactagaaaaggatccataatatttaacaagcaataatgaattttatacattaaataaaatatataaataaatggatataacttttattgggttctatatatttgctcacaagtcacaactgctctctgtaattttggtcttcatttcatttatttattttagctgcttagaaggcatgacgagacataactacatagggtattgattattaaacttgtctgaaatgttatggcaccaaaagtagctgtaagagttgttgcggcgatttaagatgtgaaacgtgtgatgtcattagctttcttataagagtgtgttaattttcggtagtaaatcatggctgtcacatttgtgatgttatgttacgtacaggtcagctaccgcaataccgcaaataggatgaagcaaatgaatgattagcacacccaccatcgtccttttttcatcctactagccaagaaccaagagaaaaaaaaacaatgagttttagtattaattcgattaaacatatatttaagttaaatagtttttttatgattttccttattgaataaataggtgattttataatttaagaagaatcaacagtgaatcagccaggagatgaccgttgaagggtgtgggttgattaatggaatctatttgcctactccctccgtcccaaaatataagaatgtttttatattttgggatggaggaagtagtcagtggtgtaatataatactccctctggttctatattaattgacgttttggataagattaaggttaaacttttataactttgaccatcaataacattaaaaatatttagtttaaagaaactagaaaaacatatatagatttgtctttcaaaacactataataaaagtaaacatgcatttatttattgtatatattataatagaaaaataaggtcaaagatatatcttgtagagcgtgtcaatgtccaaagcgtcaattaaaatgaaactggagggaatattatataatactagtagggatggtgtggtagaaaaaccaccactacatatacatacagtatagaaattcttcattgtttacattattaaggactactcatacgtaccattcaatcttatcttcaaagtttccaacctcatgtatgccaagccaatccttgctccactacatggagtgcaaatgctacccaatgtatgtcaatcaataaagtgattaatgtagccatgtagggcaagtgatacaagtcatgaacagatcgatatttattgctttgctagttgctactgcaatatacatgctcaaatagtctttaattatcatcttgattcttttactatacctagcatatttcccaagaaattaaagaggggagctatgctggatgttgttgcccatgctgctggcagtataacttgggctgtgtttagttacacgctactaaaaatagaagtttaaagaaattggaacgatgtaacgaaaaaattagaagtttgtgtgtaggaaagttcgatgtgataaaaaaattaaaagtctaaagaaaaaaaagttggaatcgccttgagccatgactgcctccaaaatcggtgcttccttaactcggctgcattactccgtttggctgcattgctccgtttgtcacgctcgcactgattgtcttgtcgttgtagatcagtcagttaattaggaccacacgcaggcagcgcaattagagcaagtttaatagtataaccaactactagttacaattcaactatagtcagtctaatagctcgtccatacaatagttacatactgcactattaatacctggttccacctgtcatacacactgtgtcttggagtccgtgctacagctaggtataaatctgtagcccactgctctcttatttatcttcttaaaatatatttacagctgacttatagcctactattgtacctgctctgcctactcatcctcatatcctttccttccttcgactacagggaattagtagaagatgggtcggtctgacacgtaaacacgggtacattaagttttttggcccatgtagtatttgctgacaacgacaagttgccaatcctgccatcgatcggggcattgtacaaagtctcgaatactacaggaaaagtaagttccatgacatcgaggtttaaaagttcaaatttataccatcaacagagcagatcagagtacatttaaaacatttctgagaataaagcagtttaagcggcagcagcgacggcaaggaatcacggcgctgatcccccaacgccggcgaccggtcgattcctgaagccgccggccgccaccgtactcgtatattcctctccacccgtgtgtcgcgtcgatcgccgtcggcggcgggcggcggcaacttctggtttatggagaggaacaactagggtgggccggtgattggtccagtttcgactaaacggcccaattggttcatggcccaggcgcatcttaggggttcggagatttcttctccgtaccccgtcgaaacatacgcattcgccgttgtggtgccctcgtatcgtattaccggacacctacgaggaatcatcttcgctgtgtgatgcttggcaactcgccggtgttctttccctcgagggtcggcgcgactacgatgttgtctaccgttcatatcgacgtcgatcatagctccacaatagattagggcactatgtgaaaaaagaaaagcaaaattatgccaaaattaagattaggccaaggattttgagtaagaggtgtgtacaattctcgagtcatgaattcgtgatcatgggcacttcacctcgtagaagttgagattacacactaggctgcgtttggatcctcggcaataaacatactagcctcgcttagtaaggtgagctgtttggcactgcagctaaaatgttgctaccgtgggcaagattacctcattttagctaaaatgtttattgggctttagctgcaatgggctagcccatgcttatcaggctaggaaagccgatcaagggatctgcgcgcgcatggcacgagtagacaccgacctgctcccatcaattccattgacccacggcccaggcaagcccactggcttagctagttagcttctccccaatcctgcagatcttctcgtcttcttcgacggttcaatccaacgcctggtggtctctcttcgtaggggttcgggacttgggaggtctgcgtcgtcgccgttgctggtcgacgaatcgcgtcacccatggcgcataaaggggtaagcctactgtttccatgtatctaaaaattaattgagaagttgtgtcagtattgggacgacctcaaggtgttcgatagaatgcccagaagactcaacatgccgctgcttcgtcctatgcgccaacacaagcttcaccacgaacaccaaacacacgaattccaccactctaccaatataggttttagcattgcacgcggccactccatgatgcgcttattctacggtgactaacgaccagaaccgattgattgcagcccgacgtgcctgttgtcagtggcatcaacagcggcagcacggtgaagctcaaagacctcgccccggcggccaccaacaacgtgaacacgacgttcatcgtgctcgacaaggcggccagggcgccgccgccgccgccgcacggccgcgccgacgcaagggaggagacgtgcctggcgctcgtggccgacgagacggcggcggcgcacttcctcctgtggggcgccgagcgcgacgcgttcgagccgggcgacatcgtgcggctgaccggcggcatcttctcctaccacaggagcaacagcctcgtgctgcgggccgggcggcgcggccgcgccgagaaggtgggcgagttcacgatgctgttcgtcgagacgcccaacatgagcgaggtgaagtgggtgcgcgaccccggcgaccccaggaggatggtgcaggaggccgtcgtctcgccgcactctcaggtcttcaagccgctgcagtgactgactgactgactgaccaaccaacctaaggtttggttcttctgtcactgaatttttttgtggcaccgttgtacaattgctcaatgtcgattaaggtgtgattagctcataaaaccttgctttgattaagggcaaattaaactggatgattgagagagagaaaaaaaaaactcgtagggcatgtttggcatagtctccatcctttgtttggtttcacattgaattcccttcaaatctcacgaattaacagacctccctaggtaagagattggtgggaattggacccttaattctcccaaacactctcgaattttcaagtattccaaccaaactacaaacttatactctcgaaaataatactcccattttccatcaacaactccctccaatcaaacagactgatacggatactgatgcagggagtttttagagttattgtactttctagaagtgtggaacgaataaccattaaccaatacgaaaaatatcgtacttctagaagcgtggaatgaataaccagtatggaaaattgttttcatcattgaagaaatgttatttacatgtcagtcagataatcatcagaaaagtatccccatggtgtccgtagtctagtttaagataattttctccattacctactactcatagagtacaaccttacatagtagtttttagtgtaataacgggcgcacgggcgcgtgtctgcccgcaccgctgctaggggacacgcatgtaataacgggagccgtagagatcgcctcacccgacatgaattgattgatgagcccgcagagataatctcttatctgttcatcatcgtaaaattgaagttacgaattgggggagaaaaagatgggcctgtactttgacacctacttctcgtatgaccatgtccatgtaaagaagcaacgggaaagagagaaggagatgatggtattttcgtccaatacatacaaaatacgtatcttagtagcaccaatgaaattacaaacaaatagcagtggcatcgtttgaaatacgcaaaaagtaacagtatatttcaaaaccaataaaattttaatgatatagatctaattaatccattaataaatcatcacttacatagatgaaatttagttcagaaaaacaagtagtaagagagagaatcttccaatccctctcttccagaatgtgtggattattcagagaactgaacacacgtccagccaaatcccgaccaaaaaccatcatcaatcagccgatcctgatgttgtccctgccgcacacgagcgtggtggcccagttgaccgccacgtagaacctgttcctccagctcaccaccctcggcccagacacgcccattggctttagcttcttcccaatccaacgtctggtggtctctcggaggtctgcgtcgtcgccgttgttggtcggagcatcacctgggcggtgtttccctgtctgtcgagcatcacccatggcgcataaagaggtaagcctactactgtcttttcgcatgaatgtaaaaactcttagagaacttgtgtcaggattgggacgaccttaaagtgttcgatagaatgcccagtagaggggagtgggttataatctctcgagacgatagctccttattaccagagcaactagaggttggctgccttccactgctgtgctgtgtgttgcaatatttaatcaccaaacaagtactaataatctattgatttatctttgcacacaatatttaagtattcttgtttcttcgatattaaataggtagattattaatgataaatagattgttgtgagttcaaacatattagcaggtgctttggcttactatgcagtgtggtatggtaggggagcatattttagagggtatgcacataagggtacacatatgatctctttttttttttacgaaagccacctttggatgagcatagagtatagttgtgtgcgggttaccttgcctttaaggtgttcgttattttctatcagcacagagtatgaaactatcttaaggtgtacgttcccttcttgcctgttccgtgacgcacccatgcgcgaaggcgcgagctcagctcgtgaccacgacgccgtatcgcctcggcctagccagctcgcaagtcgcaaccgattccccatctccgcctctgctcatctccactcgcccgccgccggctcacctctcggcgacccggcctcagaaagcgtcggtggagcggggccgggggcccgtcaaccggcccatcaaacaagccgttggcaacaacgcgtacaggaagagggagaggtgtgggtgtgtgcagttaggtgcggcgccgccgccgggcggagtacatcacttcggcggcgctctcccggctaccgagcatcacccatggcacacaaaggggtaaccccgcagtttcctcccaagtacctcacatgtgggatttgattttgttgttgttgttgtgtcgaggcgttgagaagttgtgtcgatcttgggacgacctcaagatgttcgatggaatgctcagtagagccaatgatctgctgcttcggcgtacgcctacacaagcttcagcaacaacacatcactctaccgatatagatatcgactgtgcaagcggccaattcttgatgttttacagtgtaactttgactaacaattagaatggattgactgcagcccgacgcgcccggtgtcagtggcatcagcagcggcagcacggtgaagctcaaagacctcgccccggcggccaccaacaacgtgaacacgacgttcatcgtgctcgacaaggcggccagggcgccgccgccgccgccgcacggccgcgccgacgcgagggaggagacgtgcctggcgctcgtggccgacgagacggcggcggcgcacttcctcctgtggggcgccgagcgcgacgcgttcgagccgggcgacatcgtgcggctgaccggcggcatcttctcctaccacaggagcaacagcctcgtgctgcgggccgggcggcgcggccgcgccgagaaggtgggcgagttcacgatgctgttcgtcgagacgcccaacatgagcgaggtgaagtgggtgcgcgaccccggcgaccccaggaggatggtgcaggaggccgtcgtctcgccgcactctcaggtcttcaagccgctgcagtgactgactgactgaccgaccaaccaacctaaggtttggttcttctgtcactgaatttttttgtggcaccgttgtacaattgctcaatgtcgattaaggtgtgattagctcataaaaccctgctttgattaagggcaaattaaactggatgattgagagagagaaaaaaaaaactcgtagggcatgtttggcatagtctccatcctttgtttggtttcacattgaattcccttcaaatctcacgaattaacagacctccctaggtaagagattggtgggaattggacccttaattctcccaaacactctcgaattttcaagtattccaaccaaactacagacttatactctcgaaaataatactcccattttccatcaacaactcctgaagccgccggccgccaccgtactcgtatattcctctccacccgtgtgtcgcgtcgatcgccgtcggcggcgggcggcggcaacttctggtttatggagaggaacaactagggtgggccggtgattggtccagttttgactaaacggcccaattggttcatggcccaggcgcatcttaggggttcggagatttcttctccgtaccccgtcgaaacatacgcattcgccgttgtggtgccctcgtatcgtattaccggacacctacgaggaaccatcttcgctgtgtgatgcttggcaactcgccggtgttctttccctcgagggtcggcgcgactacgatgttgtctaccgttcatatcgacgtcgatcatagctccacaatagattagggcactatgtgaaaaaagaaaagcaaaattatgccaaaattaagattaggccaaggattttgagtaagaggtgtgtacaattctcgagtcatgaattcgtgatcatgggcacttcacctcgtagaagttgagattacacactaggctgcgtttggatcctcggcaataaacatactagcctcgcttagtaaggtgagctgtttggcactgcagctaaaatgttgctaccgtgggcaagattacctcattttagctaaaatgtttattgggctttagctgcaatgggctagcccatgcttatcaggctaggaaagccgatcaagggatctgcgcgcgcatggcacgagtagacaccgacctgctcccatcaattccattgacccacggcccaggcaagcccactggcttagctagttagcttctccccaatcctgcagatcttctcgtcttcttcgacggttcaatccaacgcctggtggtctctcttcgtaggggttcgggacttgggaggtctgcgtcgtcgccgttgctggtcgacgaatcgcgtcacccatggcgcataaaggggtaagcctactgtttccatgtatctaaaaattaattgagaagttgtgtcagtattgggacgacctcaaggtgttcgatagaatgcccagaagactcaacatgccgctgcttcgtcctatgcgccaacacaagcttcaccacgaacaccaaacacacgaattccaccactctaccaatataggttttagcattgcacgcggccactccatgatgcgcttattctacggtgactaacgaccagaaccgattgattgcagcccgacgtgcctgttgtcagtggcatcaacagcggcagcacggtgaagctcaaagacctcgccccggcggccaccaacaacgtgaacacgacgttcatcgtgctcgacaaggcggccagggcgccgccgccgccgccgcacggccgcgccgacgcgagggaggagacgtgcctggcgctcgtggccgacgagacggcggcggcgcacttcctcctgtggggcgccgagcgcgacgcgttcgagccgggcgacatcgtgcggctgaccggcggcatcttctcctaccacaggagcaacagcctcgtgctgcgggccgggcggcgcggccgcgccgagaaggtgggcgagttcacgatgctgttcgtcgagacgcccaacatgagcgaggtgaagtgggtgcgcgaccccggcgaccccaggaggatggtgcaggaggccgtcgtctcgccgcactctcaggtcttcaagccgctgcagtgactgactgactgactgaccaaccaacctaaggtttggttcttctgtcactgaatttttttgtggcaccgttgaacaattgctcaatgtcgattaaggtgtgattagctcacaagaccctgctttgattaagggctaattgaactggatgattgagagagaaaaaaaactcatacggatactgatgcaaggagtttttagagatatattgtactttctaggaggtggaacaaataaccaatacggaaaatatcgtacttctagaagcgttgaatgaataaccaagagtaaaatacaccagcggtccttaaacttgtcgggaggttttacttagttccatgaacttgtaaagcgcacatcgagttctctaaacttggtttattgtattattctcgtccaaagccgcgtttgaccctggtcttgcctacgtggcacgccacgtgaacgataacatgg

SEQ ID NO: 70683 - DNA, 656 bp, Oryza sativa
cagagtatccctgttaccagtgaaatgcaaatagaagggcagacctaaccagaatgacaaatttttagctgcagcgctgaccgtgaatatatgttccaacttaagagttggagtgactaagcatgaatactgacctccttcatgatggacttttcaagaagcatgtcctttgggagcatcagaagatcacttaactcgttgagcagcttgaaagaataaaaatcagcagcaccacttctggtcatcactctcatctcctgcttgaccatgcttctcaggggcagcagcaaccatgccaaacttatcttgcaaccatcgggacataataggccagccgtgcaggcggaaacaccagttggcacaagccggtggtgatgttctgactgatccattcctggagcgtaagagataagcttaaagccatgaatcccttttatacatatctggatctggatcctgcagaacaaacatataggatgagtagtatctgatataaatataatactcgagaaaaattcaagtattttaaaatatttataaatatgtatttcttctcttgtcaattttgatttccccgagcaaatgactcattacgtttaaacactctgccggggatcctctagagtcgacctgcagggggatcctctagagtcgac

SEQ ID NO: 70684 - DNA, 832 bp, Oryza sativa
gaagaactaccccagtgattgaggctttggtagtcctctccgtgggccggctcccgcctagcccaccccttgacgaagggggcgtgcggtggcttcgtgattgagcggtggagttgggctcgcctcaatggggattaggaaaccggcgtgtcggtgacatgggaccgggagtatcatgacttagagacttgaggcagacacgatcacccacgtggcctaaccccctcggggggggggggggtcgggcccgagggtgatacggccgcccttctctttgtctccccgaggggtcggaccgctcccgtttcggccccgagggctggggtgccccgaccccttgtggattttgcgccgcgtgtatgggttaggtgagcgcagcggtgctcacctaaccgcatttattgcggtttggacgagcgcgtcacgccgcatgtaacgcagtgcagcgcgctcgttcatccggtctgtgattagtcacagaccggtcaaatcgtgggttaggtggcgacaggcggtctgacgcacgcctcgccccatcccgtcaggacgagagcctccaagcactcgtccctagccggagccggcgtgttagctcctggagatggcacgttggttccggttagatatacgctaggcttcatcctaaccattacaggcaagatattgtatgaagaagggcgaacatgcagattgttaaactgacacgtggtggacaagaatgaccgatttgtgaccggtctgacaatggtcatgtcgtcagcagacagccatgttcccacgtcgcgcctgcttccggtggaagtggaggtaggtatgggccgtcccatcagaa

SEQ ID NO: 70685 - DNA, 627 bp, Oryza sativa
caacatgtttctctgccagcacattttgttaggtttaatttgagaggattctatggtggataaaatatcatcctgttacccatgctattacattatctacttgaacgactcaccaggtctaaccatgttccggatttgtagttccttacagccttagtgtgctagatactaatgatacatgattgtttcttgagtgcagaatcaagggacacttgaacgggatgatgaggtatatttaaggatgctagtttacccctatttaatgctttttttttgttcttttcacctgttttttagttcaatttaattaaaatttttagtacagttcctaaacgtttgtttcaatcaaccatgtaaaaagaatggaatgttgcatgcggataatagtgtctagaaccatatttgttgaaattgtacttctcactgagtggatttccattgttttctccttttaggatgtctattttgatgatgaatcagcagaggtcgtaatatgttctctgcgactgggagatgaccttaaaacttactttggtatcctctttttttttttgcccttgggctaattatgcgtttatgtatttaaaagcagatatgtgctaacctttggtatcctattttcagcaa

SEQ ID NO: 70686 - DNA, 26227 bp, Oryza sativa
tttagcaagagcttcaacctcttgctaactttcctttgagtctatctctctcatccaattcttgtgtttttcctgtggttcaatcaaacggtcattcctgtgtttttcctgcgttttgttatcctctgttttacacttacattcctatcaaaatcctacgtttttcctattcctacgttttctcaatcctgcgattcaaaggggcctaaagctttaaatgatataatcccctagataactgaaaagttttaggcctatgagcaagcacataaatacaagcatcactaagaccaaaattgtctcctcatctagttcttcagatgcatgcaccaaatatgtacaagcatgcctaggacggaaacatcctaaattatcccctcatccgcaatttttcgtgtacacactaaatcaccacaagtataacttagatgtaaacattttagttcctatacatctgtagattaaggctatgctattggtacttcaggaacaatactgataacataatctcccaggctcttcctttgaacaattttaattttacagcaatatccttaatttccatatatgtcaacaaacagtatgtggcttatttcggtaacaaaagaaatggggaatggtttgttattgttcaatacaacaaaattctaaacaataccataatattcatgtgtatccatcatagttcatgacaccactcactacttaagacacctaattgagacagttttaagctttccttagtgatctaagcaccacatttagcatctccgctgctctgagtgtgcgagtgttaaccaggaacaattgaagaacggaagcaagagagggatgaagtggtgataccctccactccacgagggcgtcgaggaagaacgaggagccgctcgatggctccgccttcacctcgtgaaggctgcggtacacgtcgatgtcgatctcctccacccgctgcgagaaggacttgaactgcacgagcacacgcacgcaacggacgcacgaaaccacatcagcagccgccaaacgcgcccacgagctcgattccgtggggaggcgggggcgagagagagattgctggaagcgcggggaggggcggatgctcttaccacgaagcgcttgcggctggaggacgacgtgttgaggcacttgaccgccgcgtacgacggggtcgccatggccgcgtccgccgccggcgccgccgccgccggagaggtggggtggaagacggtgggctacgagggggatggggggaagaggggcggcgcggagcatgcggtgcggggacggcggggtttaagcgaggagtagtgggttgtctagttgtctagggttttgaggcggtggcagttggggggagttggggaggaggacgacgacgagatggcctttagcagttacgcgggctcgaagactgggcttcgtgaatgggctcctggcccactacgcttagcttcagtttcaagatatttccattttaggacaaaaaaatcaaaaaacttgtgctaattctgaaagggttcataaatatttaggtttggtatcaaaattgaaccaatgtgaggagaatatataggtattttcaattcttttttgggtagtgagaggttttaatatttggtttattatcttaccaaaaatttatgataccgaaatttggtggtgtagcaacccatgttagccctaaaattcaaggtaagagcatcaccaacagcatctaatatgcttcccttgagctcttctgctcttggtgtaatgctctaagaacaccacatgcattcgacttatatgtaattgacgttttggcatgtaattctcgtgtctcaactagctccgaagtcttaggctgcgttcgttcctccgttgttcccaactcactctccatcattttccacgtacgcttcccaaacttttaaacggtgtgtttttttgcaaaatttttctataggaaaaatgctttaaaaaatcatattaatctattttttcaaaaaaagctaatatttaattaattatgcgctaatgagttgctcccttttgcgtgcactgtagtagttcccaacatctagtatcgaacacagccttagtcctttaagtttcctttagtcggctcttcgctctagttttatttcttgtacccttgtaatggcttccggccattgctttgagtaattgaaattttgttttcttttaatatgttgacgtgcaatctttttcgcgttcgtgaaaaaaaaacgttttggcatgccttttttaagtgtaactaattgaccagatatcgcagtttgtaatgcaaatcaagtctatggcatgaccaaaaatcctactcatgaaactgaaaattggaagctctaggaaaaacttacatccctacctattcagcagctgctgactaacacaaactacaatatcgactagtataaatgtataatcgatgaacataagcacacagtgaactgattagaaacagggcattccgcattcagcctttcactcagttaggaataagatgcctaataataaaatggaaaaccgcttccaatcttccatggtaatattatcttaagaaaatcttccatggtaattaatctactctgtatttcatcatgaaaaaaaaaatgatctactatgtgcttgcactagccggttgtgctatgctcatcagaagaagccacaacacattttttagacaaagatatgcgctgaagcaatcagtgtaatctgaaaaccagcttttttttagcagccaccatcatataatcaacgatttcatagtttcatatgagaaatcaacatcattcaggtctgatttattgactaagactaattactaagcagataaaatgattgcttgatctggttctgacaaaatgccggagagcgaacttgtgggctagctgtggcagcaccgctgcatcagcaatcagcatgaattgctagaaaaataaattccactggcaattccagcaaaaacactaatgcgctggtttagggaatacgcaaaagatttgtgcattcttgtattaactattaagtaaaatccaatatttttagttctaggatctcatttgacaaggtaacaaaaagagtgagaaaaatccttcatggcttgtgctaaacattaacatgaacagaaaaccagagacttcatggaaaaaccgcagctgcagaatacctgcaaaaaacagatgtcttgatcgcaaggaaaatttcagctgcaaaatacctgcaagaacacatgtcttgcttgcaaaatgaaaggaagaagaggacaccttcggccactacggtacatcatcacattttcccttgacatatcatcatcgcattgaagctaaaccgacctgaaatcctgaacaaatgagaattgaaaaacggtgaaccaaacgacacagcagttatggggcaacaatcagtaaagcaaaatttccccgagatcctttgttgcaggcttgcagcctcgcaggacctgaactgaagcctcgaaaccatcaactgaggcacatacgcacgtatcattcattctcctgcaatcctactagtgttatcaaacaatttgatcatctcataacagcaattcaaccatactcatgatgaaaatgaagcgtatgcaagtatcatcataagctgaagagtaaccgggccggagagcgcatggtcaggtcaggggaaccaccaagtggggggagcgttgtccgacgtcgtcgggcggcgatccaccggaggccacgcctcgctggccatgtcgtccatctcgtacctgcccatgtcggtgaacgagtagcgcggcctctcctgcaccgccgccgacgccgtcgtgtcgtggacgaagccctcgtcgaggaagtagatgatggcgtcctcgaacccggggaaccgagcggcctcgaacgatctggagcagcctttccccacgaacagcatccgcccctccaggtagtcgacgggcaaccaggtggcgcgaggtcgcccgctgatggcggcggcgggcgtcagcggcatgacatggaacctgaacacgcggagcacctccgtgccgccctcgttgtagatgtacctcgcgaccatcagcagctggccccgggactccacgaggtagcgcgtgatggatccgttgcctccgatgaagcccatgtcctcgaggtaatcgtcgcgccgcagcatgttgtactccacgcggcgcatccgcatctggttgttggtcaggcggccgtaccccggccagtacacgacgacgccctcgtcggcggtgacgaagtagaagcccccgttgtagtagacgacgtcctgcggctggttcagcctcgggcccctgtgcgggaaccagcatttgctcccctggacccagaacgcgacgtcgagccgccgcgacacgaggacgacggcggcgagcatgtagggccgaggagacgacgacggcgtcggcggcgaggcggagagggtggcgaagcgcgcgaccaaggggaactgcttgcccgagggggacacgatccccggcgggagctcgacgcggtggccggagttgaggttgtagagcgcgtagcggtggctggagtcgagcgcgaggacgaaccagccgccgtcggaggagccgcagaagcgcgcgacgcggacgtcgggcgggagcgggagggggtggctcgtgcggccgatccagctgtagaaggagggcgtcgcggagctggggaagatgagccacggcagctggggcgggagcggcgggagctggggcgccggcggcggggggcgcggcccctcccgcacggcggcgcgccactgcctgttgacgcaggccatgcggacgcggtcggcgcggcaggggaggcaggcggtgaagccgaggaggacgttctcggggaggtccccccacttcgccctgtccatggcggccaccgtcggcaaccgccgggccgccgccaccgcgccacgcccgcggcggcggcgatagtagtatctcgtgggctctaacatttttggcgagcgcgggtgggtgactgggtggggtggctaccggttcgatcagataatgggggatttatagccgcgtcagggcgggtggtgccttcgcttgcacgaaatggaacgcgaaccgaagaggcccgaacccggccatcgatggattccgccgcttcgctcgccgctcggactcgcgcggccagcggcctccgcttcgacacggagcagctgcgcgttcggccgctcggggggctcgcggcggtgggtacctagtccggaatcgttgtgtgttgccaagcggcgtggtgtcgccgaatgcgctggcgctgcggcggactctccccgtggagcgcgggctcgccgggaaggcgctcggcgaaatggcggcaaggcgctccactttgttgcaggccggaggctgagactgagagctggttagtcttttgggcctattggttcagatggatatctgggctatgcattgggccggccggtgccgtgataatgtgacatgacatgccagtgaattatgccaagctgccgaccttgcactgaatattccccctttctcccctcgaattttttttatttttaattttttttattaaaagttttacaaaaataattttccattttgaaaattgacggaagtagtcgcctaccgccctctgggaaggcgatttttaaaaatcgccctcccagagggcggcgaaaatgacgtggcagacggccgttcgctctcgggcgacggccgtcaacgaaatttgcaggcggcccccttgccgccctccgcgatggcgattttgtactgtgcggggggccgcctgcaaatgggcggcgagggggggcatggaattttgcaggcggcccccttgccgccctccgcgagggcgattttgtactgtgcggagggccgcctgcaaatgggcggcgagggggcatggaattttgcaggcggcccccttgccgccctccgcaagggcgattttgtactgtgctctatatttttgtataaatatcaatagttatcaaatctttttatattgaaaactatacaagattaaaatctccaagactggtaaaatacaattttattattatttagggcatatttggattgttaccgtacaaatattttgttaccgtacaaatattttattaatttttagggcatatttggattgttagtgccaaatttttcttcacgaccaaatatttggtaaggtaaaattgcatttgatcatatttggtttgctgccaaaatgtaaaattgtagtgaagaatgttctacataatctcaaatctagattacgtattaccaatgaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtaaacaggcagcgccgaaagttgatagtgataactcgagctgccgcttttcatgtgtgctgttgtggactgtgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccgtgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcatacaggtatttaacagtattaataaaaagtaaagtaccgtgtgggcgagggatcgacgctccgtgagaggaagagctggcgaacgcgcccgaagaggtggcgaacgcccctgcggagctcgtggaagcgccggtcgtgcctgcgaacgcgctcgaaggcagacgaggtcctgcgatgaggaaacgtgcagttaaaacatggtgacataatcgtgcaaaagctgaaacaaaaatgaactaatatctgggctgaactgtactgtgcgaaaccggtgctgtaggtcgcactgatccgaagctaggggcgctcgaaggcaaacgaggtcctgcgaggatggatcatcaagttacgacggggtgatgttttcgtacaaaaacagaaacaaaacttaagaaacctctgggctgagcagtaccgtgcgaaataggtgtcgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataacaaattcagtagttgtcctatattatgcaagataaatgaaataattgtaagaagtaatacaaattggatgtaccgccacgaagtagtctcggtcacggtgcgtgggatacgcgtccgtgacagcggcaacgtgcggctctagggcgtctggagtgaaggtcacacgcgcacgagtgcgaggaaggtaccaacgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacaaaagtcctagcggtgctctcgcagcgacggcatcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaagaaaaaaaaaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaatgttagtacaaaacactcattcggtcgcaaataagcacgtatgataataacaacttatttacttacagtgaactggagcaaccaagccttgctaggcccgactgtagagtacggaggaagggtgatggtcggtcctaggtgtggaaggcgcatcacctgctcgaagcgcgcagtgatatcctccttccacccaaaaacaccgtccacgggaccaactgctgctcccgccagcggtagcccgagcaggtacgacacgtcctgcagtgtcggagccatctccccacagggaaggtggaacgtgtgcgtctcaggtctccagcggtctacaagagcggcaaggagtgaccgatctgcatcccaccgcttcgctgggtcacggtcgtccgctgccgcctcaacaagcctacaaagtggtagaaggcctgccgcacgcaacctgtatagagcaaacttcaaacataagtacaacacagagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttgaactaagcgaattactaacacatattaaacaagagtacaaacaaacaaaagtgtttagtccgaacactcatcacgataacattatgatacaacaccgaataattcgcaatactactagtacaacaatagtcggaggtactcattacaacaacattgaattgaaattacacgatagaagtatttagtccgaacactcattacatcacaacagcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactcgatgtctccgtgcctttttgattttatcttccatgtactttgtcactacgttgccaaacactatgttgtcatcggccatggacggaccaattttcttgtatcgatccctaaagtacgcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaactagtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtacgtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcatatcttgcaccctcaattacctcgttctccttatactcccagggtacatgatcaccctctgatataacaagtccagagaagtcctcatttgcccaatcagtggccattacatcaccttcctcatcggatgatgcgtcgtcgtccacttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctacatcttcagtttgcattgaaacatttatatctttctcttgtaccgacacaaatataacgaggggccatgaccgttcaaaagccatttccacataccgtctctaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgatatggatctacacatatgtgctgtgtgctacagatgtgctaaaatatatggaactaaaactaaaacgcaacatatatactcaaacataacatattagtacaaatgcaaaagatgtatgggagcatacctgtgatgaattgagcgaaccagcagggcttcgccgctccccttctgctgccctcccctctctctcttttgttttttttggatttttagtgaatataatgaaattttacagaggagggactgggctttatagggggagaggcaaaaatcgccctcccccaggcggcaagggggccgcctgcaaaattccatgccccctcgccgcccatttgcaggcggcccccccacagtacaaaatcgccctagcggagggcggcaagggggccgcctgcaaaattccatgccccccctcgccgccaatttgcaggcggccccccgcacagtataaaatcgccctagcggagggcggcaagggggccgcctgcaaatttcgttgacggccgtcgcccgagagcgaacggccgtctgccatgtcattttcgctgccctctgagagggcgatttttaagggcggtaggcgactccttccgtcaattttcaaaatggaaaattatttttgtaaaacttttaataaaaaaaattataaataaaaaaaattcttctctcctctctctctctctttgttttttttttgtgtgtgtgtgtggggtggggggggatccaaattccaacacagggccaagcagagtggtgtttggccaaaggccttactaaatcttggctgagttttgagatatgaaattaacaaattttggtagaggatgtgttgttaatggtgtgcttggttgatactaccttatattttatattttaatgtatgacgctgttgactttttatccaacgtttgaccattcgttttatttaaaaaaattatataattattatttattttatggtgacttgatgcatcatcaaatgttctttaagtatgacataaatttttttatatttacataaaaattttgaataaaacgaatggtcaaacgttggtcaaaaagtcaacggcgtcatacattaaaatacggagggagtaccttgttagattctgataatgctaaactttggttgagttgagagtggcaaaaaaaaagcatttgaacggcgatcccctccattccatgagggcactgaggaagaacgactcaacgaggagccgctccaatgctccattgccctgaacttcactgtgtgaaagccgaggtacacatcaatgttgatttcgtccatccaccgcgagaaggacttaactacataaaagaacgcaggcctacgaatataagccacaccggccagtacacgatatatatagtgaagtcccgtagtactatacagtagtgaagtcccgaagttttgtacgctaattggaagagtatacgctaatgcaatatataaggagctaaatttcaatttaattatcattcttatgtacttctgtaattatcctatatatactaattatctattattgagtaatatactgtttcatctgtttcatattataagactttctagtattatccacatttatatagatgttaatgaatctaaacatggtataaaatagcatggtataaaattatcaaattttgataaaattataaaattatcttattatacaaagtcttataatatgaaacggagggagtaattaacatggtataaaatagctagcattgaataatttacccggggtcatgtgaccccggtaaatagtactctctccgtttcatattacaagactttgtagcattacccacattcatatgtttagattcattaatatatatatgaatttagacaatgctaaaaaaaattttataatatgaaactgatgaagtacgtaggttcgccagtggcagcagggagtggctgtttttagcccttaggtttggagagattcagggtccaccacaaattcaataaatcaaattcacaaaataccactatcaattttccagcatctatatccatgtaagatcttggatgggacattgtgcacatgtaaccaattaaatctctattttaattgataccaaaactgattattacacgcatgcagcatgcgtgttgctcaatatatagctcctcaaggtagctaattgcaaacactaatacttgtagtagaacctaatattaataaggcttaagtatatatcatgcatgtatgcatgcatggccttgttgatacatagctaagctaggtcatctgctgtagagatggctagcagaagcagtggcagaagtgacggtcgccgcggggtttgcactcgccgccgcggcactgcgactggcaccacgagttgcaggcgtcgttctgccccgggccgcacccagtgttcccgccccacgagtggaagtccacgcagcaacgcggctgatctgccgccgctcctgcaattaattagcacagtgaaattaaacaaacataaaattcttcagaaatctagacgattattcggcaaacaggaaatgttaattgtgaaatccaagtgcaaattaataagaactctctgaacaattactacgctaagagttcttacctgacgaggcaacaaaagcaactaggacaagaagggcgatcgctgcacaagtgccaatacgagccatggtcgtcgtctctttcgcgtcgtagtttctcgactagtttctgttgctcgatctctgcgttgatcttgcttgttcttgaggtttgcacacggtatggacgtgaatttatagtcatagtatttcctccaaaatatggaattcccaggtacgtatgctatggaaatttcagatatggaatatgtacagcacttagacattttgagatgatgtgttaccatgcatgtagtataatatggatatacattgtttggaaatgaaatatatatgtgctcatgactgttgccgtgcctagcttaccttttgttcgcaagaatcgaaaagatcgactattgccttcctttgctaattgctagtattaactgccatggattaacttgatacatatagaattaaatccacgaaagttggaagaatcggaaaaggttaattgctcccgtgacaacaatttttttctcttttgttttttactagcaaaatgccgcataatgacacttttgaactatttacatgaagaaaatgagtggaaatgagctgatgcaatatccgaatcacgacacgtaaaaattttattttcttataatatgtataatgtaattgttgaatatactcatgaagaaaatacgtgaagttgaaccgacgacacatccgaatagcgacatacagaaactatatttttaatgtaattgtggaaataatctcgtgcgttgctatgtgaaaaaaagtatggagttgaagtgatgacacgtctaaatcgtggcacgtaaaaatcatagaaaccaatgtaattgtttttttctaagggagtattgttttcgatttataaatcgcatgaggacaaatatatacctaataacaccactaaaaagacacatagatgacggcactataagtgtcgaaacagttaaaaccatcacatgtacaacttttcccacctatgcggggggtggaaaaattacagaattagcacatttcaggaattataggagccgattttaaacaaaaccgacacctatattataaatattggttttttttaaaaaaaatgacaccagaaaaactaagacgagccaaacgcgtcccgtccttgtccatactcgctccccaccctacacaaaatctctctcactctcgctctctctcactctcccccgcccctcctctccctccgccccctcatgcttcgctcgccatctcctcctctccctcttgcctccctcttgcagcggatacggcggcggtagcggcatcggcgacggattttttttcctacaacttgtgagtcaatgtcaaaatttaagttttaaaattcaattttgaagtggattgtatggtattttcaatgtagtttcttgctagaattgaacttaaggagacatatataaaagtttacccataaattattttttgagtaaaatacaccaccagtccttaaagttggtgcgtggtgtcacttaggtccacgatattgtaaaatcaacattaagatccatgaacttgtttaagtgaatcattacagtccaaaacacgtctgaccaggctgaccgtcctacatggcagtccagcgtgactacatatttgcaattaggctcctccacgcccgatccacggccttcacggtgtcggagacacggttcttgccgatgaccgacatgacggtctcctgcccctgacacgttagtgtaatgattataacatgagatgaacaaatggtgaatttctcaatcattttcacacaagaggcaatggatgaaaatttgtttgattaacaaaaaaaaagtatttaaagacaatttgttataggacattgaaagattgtggttttttattgtggttttttttgttgtgagacacccgaagaacgcgtctctattcatggatacataaaaacatggtaattagttgtttgatacccgacgcattattttattattttacaaaagacaagtttgtccttgagaacaaccacagccaccacctcctcatcattgccacggccaccgccacagccatgctactccttctgctcctgctgactatcgtgctccacctttggagccaccgctgccgtcccactctcccgttattgccgccaccggaccgctagctccgcagacactcccatcatgcggtccgccgcggcacgggcaggttccgcccatctagtcttggccgcggcgccacctcgcaagtcaacctcgccatctttctctgacatgtcgctcaccgctgtgagattccttaaccgggctaggcggctcgccgtcatatgcgacgtggcatgcacgacgccgcgccgtacggctgaggcgatcgctttgatcgacactaagaacctcactgcacatctcgtgcacatctcagtaataattatcctatcctatgcatgaaatgagtcagaggcccacgatagctccaccgctagtgtctctaatatgttgtctcatggaaaattttaattttttttacaatcgatattttttatctcaaacaaatattaatgggcaagtattttaattgtttgcattttatactatttaacggtttcttttacccgtaacgaagcacgtgtattttgctagtaataataaaataaaatattacttgtctgtaaagttggtatgtgtatgtcaaaaatagtttgttttcagcgaaattcaatcttgtggttaccacaatatagagcacaatggcacttgactgtaattatctaaagtctcaagcacgtacactatgtacgaccagtaaaaatatctagacagtcgctccctcttttttcctctctcttcccgtctttctccgcctctctccgtcctcactttctctgtttattcctctccctcaacgttgccggccgatccaccacatcgtcgacggcctatccacaacatcgtcgccggccttctttttccctcgagttgccggccagatccacgatgccatcaccacggaggtcctcctagagggcgaagacgtggaggcggcggtggtattcggaggcgagcagcttgaggcggagagagtggtcggagacggggaggccgagcgagccacggatggattcgcatcgctcgccatctccttctctccatctcgcctccctcccgcggtagatccggcatcgatggcggcgtcggcggcggccgcgggtggatctggcagcggtggcagcggatgaggacggatccggcggcggctccctctgccccctctcgcctccctcccaagcggatctgacgacggggacggcgaccgcgtgtggatctggcggcagcggcgccggctgagagtggatcgggtggcagcagctcctcccgcggcggattcgagggcagcggctcctctcacagttatccgatggctgctgctccccctacccggagtggcggccggcggctgcttccctccttgtgtgttggcagtaactccccgcccccctggctgcccctcacctccccgacgtggagccgacggtggttcgatttttgatttgtgaatattttgaggattttgtttttttgatttgtgaatattttgaggattttgtgatttggaatgttgatatagtaaccacagtacgacggcggtttgatttgggatgttgattttgtggagattttttattttgatttgggattgcaattgagtaattttgtgattcatgtattttgggaattgggggcaatgggattgggagcaatcgactcgattagccgattgatagagtcggcttcttttattttcactccaatgccgattgattaaatttgtttttttatttttttcggcttctttcgagtccgctcaggaattttttttttcaagacggtctcggattcaaacacggacgacagacgaaaaaaatcgatcggaagtattaggtgacgaccggaaaaatccaaatatttatattagttatagatatcgatatcatggacattttttaccttttatatataccacctcacaagtactagtatttccaatccccctttacaacttaatttctatatatatatatatatatatatatatatatatatatatatatatatatatatatatatatatatatatatatatatatatatagaaaaatacatatatagggtcctaatcgagctcatttcttataccatatactatgtttattttgttgcatagatgtttgctcataaagacaatggggcagcttgttcaaggaaagaagtgtgcattcacgctactagagagcgcatacagggtttggaggagaggctcctcctgccctctcggagggcacttttttaattaatataaaaaagctgtgcgccctcttataagagaagtggctgaaagcaaattttcccgcatagcttgtcacctctatattttcacaattttcaaatatatagggcatgcttggtacatctccaactcctaaatttagctccaggaattgggtttggagtggagttgtggagctgcctaaacccaactccacaactctagtacattttgtgagaggactccacccagctccactcccagttttggtggagctgaaactgtttggctgagctctagctccaaggggggtggagctagctggagctggagctgtgccaaacagacccataatatgaaatcggatgaaatcaaacttatatcaaaactatagagctcgacgagacatacaattttttttatttaagatcatttaggggtttcaaacattcgttacaaaatcttaaatctatttttacaaaatattatatctacatttcaaagtcctccgatggagataaactctattttaaagttgtagagttcaataagatcgataacttgtagtctatgactttttttatttaaaattatttagaatgccaaataagattataaattttcatagcaatacaaatcagcatgaagacattatttgaaatgacgtcaagggagaaggcggttttgtaggctggaggatgggatttgctttagcccgttgggctttttggattactaatcgctagagggataagaacaaatctagatcctgttggggcggcccatgaaaatgtggttgtacccgtcaattgtgtcaagctaccaaccggggccaaatattctctcgtctcgaaaaaaccaatcattttctatttttcctttcccctgcagaacactgttgccaccatcgttgcttcgagcttccgaccctatcaccccgaccacatcctcctcccctcccagccattgttgtgcttcactattcccgacctgcgccaatgccttcatgtgctttctaaacattggtgtaccaagttttgctaccagctctcttctcctttgacaccttcatgcgctttgtgtgtgtttcacaacagaggtgggaaagagaaggataccaatgatgccacatgtccatatcaatattgggcatgttcagctgctaggtataactagaacagtcccgtctgtagcctttgccggattcctaggatcaaaggtcggaggatagttattgacttgctatagatgaggtcagatggcattctgttaccgaatttttatttataataattaataaaaaataaattataggaataagtttgatttttttaacagggggagtataccacaggttcacagtaacaagtgctccagacggtggtgagacattaaaaaatcacacagtttgccagttagcagatgactacaaaacggacaaggatccgactctagtgaaactaaagttctatcaaacagctttatcacgtcacaaaattattctccataaatctatctagtagtagtatacagtctaattttatgtactatgcgatcgaaacaatccagtaactccactgaagcagtattaggacataccaattctataaagaaaagagtaaactttgttgatggcctataaacttggatctaggtgccacttagttacattattttgtaaattgttcatctagatcagtgatcttgtttgatttaccactcgaggtccaatggcgatcccaacagggggggggggggggaggtgggcttgagcccctcctactattggctagacccactatacatgctcttcaattcttcatatatacgtactctctccatttcatgttgtaagatgtttttgactttggtcaaagttaaactatctcaaatttgactaagtttatagacaaatatagtaatatttataatactaaattagtttcatcaaatcaataattaaatatattttcataataaatttatcttggattgaaaatgttagtatttttttcctgtaaactttatcaaaattaaagcagtttgactttgataaagtcaaaaccgtcttataacctgaaacagagataatataacttttaaacttgtcttatatttattctatgttatttcattagcacctcctaaaatttagtcttgcgttcgtcactgtcgagttccaaagcgtatgtgaaagattacgatctagatgagtcatttataagattataaacattagtgacaccgtgatccaaatttaaggatcgatgatgtattttactcaaaagaaaaatataaggaaatagcacgcttgcagcagttatttatgttacctttcccgcctccttttcgcttcttttatcctcaataattaccagtactagccctacacttccactggcgatctccctggcaatggccctactacctccctgttccctgaaactttacagaatgtatctatgcatgacagataagctaactattgttccttcacctgtcaaaactaaacatatttaattatctctgctgccaaactagtgctacaaattacaaatccaatttcggttggtgaacagaaaggagaaatgtaggggaaaaaaaagaagcaaaaaatgatttttattactgcgatgcactccagctgttggaagagatgtgcggcccaccaagtcgcctccattcccattggaagtttggaactggccgtgcagctctttgcattatattgcaacgtgcactgtgcacataatgaaatggccggtttagttgaaatgtatgatttgatctattaataaatcgatttaactaattaatttattggcaggcactggcctaccaaacctctgcaaattgccaattcctcctaccaattcttctgtttatatactgagaaagtgccaagtttttgtctgcttcatgtaacctatggatttcgctgtccaaaaccattgaaatttattcatggaattggccataagattatttttctctgtatcttttttctcccttgttaatgatcttttgaggtgacatgtcattgttacatggtaaagtgaagaacagaagagaagaggaaggcagtgcagctgtgcaggagaagggaaagtagctaagcaagtaaggctggcagatgccatgccagctgcaagctaggcgatcgatcaagagatcgcgtcatcatctctgatcaatctcacactgtggtaagctaagtttgatcgttgtcattcgaatcactcatgattcgtttcgtgtttgtttgaatttgttgcatcgattccatctccaagatcttcacatgcatcttgttgtagaacaagagtagaaagaaacctcatcaaggtcaaggtcaagctcggacgactcctctccatggatggagatcggagtaggaggagtgccgccgcgatcacgcggccgccgtcgcacggcggcccggcgtggcggcggatgatcgcctggattcaactactcagtgagtgatctctccaccttcttgctcgcgcggcgatccatccatggatcctagctgcagaaaatccgagctcactctgacttctctcgatcgatcgctggatgtgtcgcagaggtgttcgtccagaggtacggggaggtggcgaggtggcgcacggcgttcctcctcttcctggcgctcctggcggagcggggcctgcgccgcgcctacctgtcgtggaaggagtcgcggctgcggccgcgcgccgccgccgccgtcaccctgcaggccgcgttccgggggatggccgcccgccgcgagctctccctccggcgcagggccgcacgagccgcagccgccgcgctcatccaggcgcggtggcgcgcgcgcgcggcggcgcgggagcacgcggcggccgtgatctgccagtgcgcctggaggcgccgcgccgcgcggcggcggctcgcgaggctccggatcgagcaggagagggcggcggaggcgtgcaggctcagggagatggtggacgtgctccagcaggcggtggaggacgcggaggtgcgggtgatcgccgagcgggaggcggccaagaaggccatcgccgaggcgccgccggtgatcaaggagatcgtcgtgcaggtcgtggacaccgacaaggtggactcgctcgccgccgaagtcgcccgcctcaaggtgacaccatcgatgcctctaaatgtgcaatttattcatgtgatccatgaacaaaattcagatcaaagaaatcggtctgattcatatgatccatgaacaaattcagattaaagaaagtggtctgattcatgtgatccatgaacaaattcagctgaaagaaagatgcagtgaccaaccaaaccagatgctacattttgacatttcgagttgcaggatttgctgggagcagagatgaaggcgacgtttgacgcgaagaaggcggtcgccgaagccgagctgaggaacgagaagctggctaggttgctcggtgtcgaggaggtgaagaacaggcagctgcaagaatccctgaaaaggttcagtatttcagaattcagacttgttagctctgaatctctgatgtgcctgcacaattaatgtgtgatcccagtatgcgagttcatgggagaactcatagtgttttgcatggatttttatttatttttacttaggatggagatgaaggcatctgatcttgaggaagaaaaccagaagcttcgaggagctgtcgcgtcagtcccttatgtcaggttgccgtcaaacgtaaaccgtgatgatcctgatcttgaggtacctgaaatcacattgatgaatttcgacgcacaattttgatgctcagcgtgctcaatcatgtgcatcttaacagccaactccagagaatgaggatgagaatgagaatgagaaagcagtttattgtgaggtgaagccaatgatagtggatagaggggttgacatccatgtaagtataatcatcaaattatatttgatcagtatattcgtagaatgagttcctgatttaacaacatttaatttcaatctaggagaacaattctcaactgcctggcctgaatgatcctgaagctgagaagcagcagcaggtatgatgcttagtaattcggaacttctgtttgtgtttcaagcagtatcacaatttcgttcaggtgtcacgccttaaacatttttttctgaatatccaggagctgttgatcaagtgcatatctgaagatcttgggttctctattggaaggcctattgccgcatacctcatctaccgatgcctgatccactggaaatcatttgaagaggacaggacaacagtttttgatcgcattattcagaagataagtgctgcaattgaggtatgtggcagtggtatgcacatatctgcaactattattcataagaagatatatgcatcaattgtttgttttctcttgcaaggctcgagacaacaatgagacattagcatattggctatccaattcatgcacactgctgctgcttctccaaaaaacactgaaaatcaacggggcagctgctttggctcgtcagaggcgaagagcatcacccctgaagacgccacaggtaatgtaccgaaaaataaactctgtatgctcaacaacctaagtgattttgtaagtgagtttgggattctggactcaatattagttgcaaaaattccaggaaaatcaagcacctaatcatcctgaccgtagtccagttcctgatggacggttagtcggtggactaggtgaagtttgccaggttgaagccaagtatccagctcttgctttcaagcagcagctcactgcattgctggagaaggtctatggaattatcaggcacaatttgaagaaggaactgtccccactgcttggtctctgtattcaggtagcattgtgctttctgcatatctttctttcagtttcaaaagtatatttgctgaaagttaagaatgacggatataattttctctaggcaccaagaacatttgttgtaagccccagagggtcaggcgctcaaggaacagacttggcacagcaagcttctatggcacattggcagagcatcatcaaaattcttacaaattcgctgaatgtcctaaaatccaattatgtaagataaaaaaaattaaattggcagtagatacaattttaattcaagtatacacgccatctaaacctctttacattgcaggtgcctcccttcctaatctgcaagctgttcacccaactattttcattcatcaatgttcaactcttcaacaggtacacatgcatactaacgattcacttctccatatttctcaaactagcaccatgaactcatatgacaaatttttatcacttcaatggtagtcttctgctacggcgtgaatgctgttcattcagtaatggagagtatgttaaagctgggttggatgagctagagcactggtgcttttggctgactgaagaggttaaaaacttaaaaaagtctttacgttgtctgaacaagtctttcaggaagcagtctcta

SEQ ID NO: 70687 - DNA, 5400 bp, Oryza sativa
ggccggctgggggggcctcgccggcaccgttgacacctttcggctagccggcgaggccgggcggcggcgcgttggggtggcggcgcgtgaggaattgggagaggagagaggatttttagggtttggttgcctgcacgaattttaaagcaatcgggtggtccaaaatttgcaagatttatgagggggttttctgtcaaatgatctataaacagtccctattaaaaaaatagaggagcatttgtaagaattttgttgaaaaaaaaaacattgtatctatctttgcaacatatgagtacacaagtgtggaattaatggttctcatatagtcatgcatgtatgttaggatctgtccccacgggcatgatatgcttagggagcgttcttttcctcatagagattgtcacaacatattttttaaactgctaaacaatattatttgtattaaaaaaactttctgcaccaacattctcataactcttttaaaccgacttttcaaccttttaatatttaattgttttatttgtgcacatgaataatcgtcataaactaagaaacacatgaataaagcaatatgactgctaggagtagcatttacacaattacacaacacaactttcaattgttttttaaaaataaaacttagaggaaccatgaccttgagtccttccaactcgctagaaaaatgaaccccttaaaaaacttttcgcatatataattcaaactttgtatggaaaaaaattttctgcttaacactcgagaagtttatgattgacccatgaattatttccccgtgtttgaaatatatagctgaacaaaccagctagatgcactcatattcggaagaatagtcaagtgtggtgcagtgccccccaacagaaagattaggacatgaaagtggcttgcactccattatctcgatcaagctagcttggccccatctagagcatgattcaagtggaaaagaactaggaaaaaggtggaaggattagattaagggtgccatacaaaaaaccattactagcactaatcaaatttttaatttttgaaagctataccatattgcacatccaaccacatccaccaaaacagtggtggcagagtacacattgttttttaagggaagcatcgcaagtggattattgctactcattttgtaccccttttgagttaattattgctggtgatgagatgatgttttgtgaggttgttgatgatgacacaatataatgtgccatttccatcggtgtctttgatggctggtgcacaaccacacgaggcccagtttaaactaagcacaaccggccacatttaaaccaaactaaaattgaaccacactaccaaacaccgatcgaatcatcgaatcaaatcattatttgacagctaccctgcattgtacgtgtacgtacttgggtatcagcaagcaaatcagataagtatatatccatactaccgtacatagatgtgtactactccctccgtttcaaaatatttgacaccgttgactttttagtatatgtttgaccattcgtcttattcaaaaaatttaagtaattatttattcttttcatatcatttgattcattgttaaatatactttcatgtacacatatagttttacatatttcacaatttttgtttgaataagacgaacggtcaaacatgtactaaaaagccaacaatgtcaaacattttgaaacggagagagtactagtttgtactccctccgtcccaaaaaaactcaattcttaggtttccgtgcctaacgtttgaccgttcgtcttatttgaaaaagttatgaaaaaaattaaaaagataagttatgcataaagtattattaatgtttttatcatatgacaataatgaaaatactaatcataaaaaaaattcatataagacggacggttaaacgttgaacaccaaaacctagaaattgagtctttctgggacggagagagtacatacatgtacaacgaagatgattaaaaaaaagaaaaaaaaagtaaagctctattactttttgttggtatattacaaagtacaaacacaaaaatgtccaaacatatgtagtaattcacatcaagttaatcccctaatgcaatatcaagagagctttttggccattttaaaacaagcacaaaatgctccctctctctctctctctctctctctaccactctgttcaatggagtaattatatctctcccttttcacacactctagctgcattgatcctctccaatagcgatcaataactcaactgttgattctcctaattacccaagaatggagaataaatccgatgggtatataacccaaaaacaaaaacgaaattgaaatgtatttttttttgtttttccccatttttttcttttttttctctttttttttcagggtcagtgccacacctcacgtcgctaccttagtagttagaagccgacggcgacggcggttgcggtcgccggcgtctccggcaaggagatgatatcctcttcgtcgtcgtcgtcgaagagggagccgatgaccatgaactctccctcctcctcggccacggccatggccgacgatgagtcgtcttggatctgcctctgccacttctcgcggtacgagttgatcttctccagcgtaagccccgcgcggaatcgctcgatgaacttgtcggccttcgcgttcacgtcggggctcgcgcagtacgccggcgccggcgacgccgtgacggaaggaggcgcctcctcttccccctccgacattggcggcggcggaggaggaggcggcggtggcagcggcggcgacggcggcgggagcgggtaggtgtagtagacgacagcgcgcctgggataaaacggcggctgctgctgcggcggaggcggtggaggaggagcggggcgggacggtggctgtggcggtttcctggatcggcgcgtggtgggcggaggtggcggaggcggctgcggcggcgcgacggagtggatgcggcggctcttgctgccgcctttcttgaagaggttgtagaagatggatgatggaggcggcgggggagggggcggcggccgccgcggcggcgccggagcggggttggtggtgcggactgtggagtcagggctcgccgaggcgtcggacgacggcgacgagtagtggccatcggagaggtgatggtggtggtggtggttgtggtgatgcttcttcttgctcttgatgccaatgctcttgcgcttcttctggtagaacgtagcaatggcggaggcgaggtccttggcgccgcccacgctcccgctccgcttcttcttgctccgcggcgccgtcgccggaggcagaggaggaggcggcggcggcgttcccggcgggaacatggccggcgatgacgatgggagggggtacttgatctcctccacgactatctctgcctccaactcctctgtccttggcaggctctcgacgctgcggctgcgccgtcgtggccgagcaggtggtggcggcgtcgctgccggcgccacctcttccaccctcatctcctccagcaccgcgtccagcctctccgagttccacctcctgctcctcgtcagcgtcggcggcggcatcaacgtgtcctgctgctgctccagcgccgcgtccagcatctcgggattccatgtcctgctcctcgccagcgtctgcgtcggcatcaccgtctcctcctccacccgcgccacctgatccagcaccgcgtccaggtccagcctctcggagttccacctcctgcttctcgtcagcggcggcggcatcgccgtctcatccacccgcgccacctgatcgagcaccgcgtctagcctctcggagttccaccttctgctcctcgtcagcggcggcggcggcggcggcatcgtcgtctcctccacccgtgactcctgctccagcaccacctccaacatctcgggattccacctcctgctcctcgccagcggcggcggcgtcggcgtcaccgtctccaccggttgttgcggctgcgggtgtggtctctcctcctcggcgatctcggccatgctcgggagcctctcgatgctgccccgccgccgccgccgctcttccttgggcgggagcgatttccggcgcacctcgtaggtgtccacagggatcgtcttcacctccggcgtcgtcgttgttcgcttttgcggcgcgtccacgtcccagctccgctcaggccgccgcgtccggtaaagctcggcgtcgtcgtagaaccgccacgccgcctccggcgacgtgaggccccagacgccgtcgctgtcgagccgcagctccgggtacgagctgctgctcttcaaccgtcggatccccgtgctcccgtagtggttgttgccgccgtagctcgccgccgccgacgtgttcagactcgcccacacctcggcggtcgacggctcctcccccacagcctcggcagccggcgccgccgccaaggacggcgagacctgatgctctctcctgccaccctcggacgccgcccccgccgccgccgcggtagaagccgagccggaagaggactccccgtcgccggcgcggccaagcaggccgcacaggatggcgaacgccacgaggaagaggttgacgacgtcccagccgctcttgaggctaatcccccctcctcgtcctcgctggtaccctccccctcctcctcctcctcctcctccccctccccatggcccgcctcgccgcaccgccgacggcaagagcatgagcacgatcagcgagaagagcagcacgagcacccacaccttcgccccgccggcgccaccattctcctcgccgtcaatgctcatgtacgacgtcgtggcgccactagcaccagggcccgcccccgcgccatcgccgctcctcgccctcgcgtcgccgtccatcgccgccgccgccgccgcgcgccagccaccttcctccctccctagctcgactcgattcctcagcacacgcacgccgcgacgcgaatccgaaaccaaaagcggggagcagctagaggttagtggcgagctttttggatctctctctccttctctcgcttcgctttggctttttgattgatcttttcgtggaattcttgccctcttctgttctctctctttctgactcgttggtggagtggtggttatataccacgcgaggtgaggtgaggtttgcttcgagtgaaggcaggttgggggggtttgaatttaatttttttttgggagggttatattacgcgacacgaaatgatttggttggaagaaagacaggagggagcgtacgtttgtttatttatttatttatttatttatggttaaggaggggaatgattagtcgttgtaatgcgttggactaggcgagtgaaaatgtttgattattattaagttagtagtaggagtagattattggctaattacgcggttttctgtgtccaag

SEQ ID NO: 70688 - DNA, 837 bp, Oryza sativa
ttacgcccaccccttggaaaacatcgtttgaaggtactggatgatgcaatgctcatttacaaattacaactgaccatttatccatttctgcattcaatgattatttcttgttctgtacaaagtcatttgcttaatggatggatctatgcatttaataaacatatttaaattgcctagatttgtttaggtttagtcattttgttttgtagatttcagtctcggaccagatggagtacagaaaagaagggacccaggacctgtgccagtctggtccacctaattggattgggtctggtaaacctaattggattggtgctgcaattggcccagcagattgggcgtcccagtatgatagaatgtgtgactcgaaccgtttaaggccatttaaccaattaattcacagaaatgatgttgccgccagggattgaactcacggtctacagctacggcatttacacctaaactagttgagcctagctcatttcttggtttgcaggagtgtatatttcaatatatagaacatatcaatagtttttcattataaaataaaaggaaacgtggttcgtccgatgacctgataatctgatcatttacctggtgcccgtggctgggtcattcactaggctgccctcataagactgagttttggtatgttcatcaattcatttcgggtgagataggaatatccaagaaaacagagattcatgcatgctcgagtccttatgacatcaagtgttcttttgtcattaacctttatctgcagtgtataactcttcattctttttaattttggcattgaaattctgttttggtgattgtcgttattttttttgggtg

SEQ ID NO: 70689 - DNA, 1496 bp, Oryza sativa
taaaggtacaagttggtcctccgcatcagctgataatgcagtcatcaaggcaccaccgtattcccagttaggaaggttgcatctatagctagtactggcctacaatgcttaaaagcctcaatggaaggaccaaagcaccagaatacacgcataaaaattttcttggtcactccatcaacgttgacaaccctatcaagatgagtatcgatgtggtagaccatactgggattcctctgcttaatggcttgcagcaaagtgggcaaacggacatacgcttcaccccattcaccgtaaatgagcttcatagcctcctcttgtgccctccaagccttgccatacttcaccctatactggaaaacctcaaatatatacaaagctaacgcagaagcagagagtgtaggttgcagttttatggcattgcataacctatttgctatgaactttgatgtcagctgccggtggctccctgaaccttcggcagtagcacaactatgttccttacctacccgtgatatcctccacgtgccactagacctcttagttgcatggaccttctatttgcaccgtgggttttcacatttaacagtgtacctcctatttgcggcagaattgacaacacggtatggacgatggtgcacgatggcgtactcctggagccatagcttcaatgcgaccatggataggaactctaaaccctttctgagaccatccacctggaatggttctggcaactgatttaagttgatgccgccatctagtagtgcaccatgggcatgtgttaggtctctaaactcaggaatgtctggcttcctcccaaacaccttctcaaacgcatgacattcctctaatgctaacttgtcattattagtaagtggagggaatggacggtcatcatcagagtcttcagcaaattcaacatcatattgctcaacacttgcctcctcatcaacatcatctctattgacttctactgagacagaatcgtgaccaccactcaattcgacatcaaagtaatcatctggattcacatattggcctgctacttctgtcgggtattcagggttgcctccatacgacgaccaatgaacactcgccgacaaatgttcacttagatcaagcctctcttgtactaactcccttttcatctccctcactgcatccacatcatcagtaccgcaatgtctctttgatggtcctgtctcccataaatcatttccaagcaaaggtctcttcttctctccttccccctccaagtcttcttgtaccaactcagtcttacttgcaccccctccacgacgagaataatatgtcacaaaattcttctcaacgtaatgataagaaggagatttgtttagatccaaattttctacagtacgaactaactttgatgcaaacacctctagagatctaaactgagactcttttacccaatccaagtaaacttcccattccaactgacctatcacattaatatatacttatgcccttgaccaaca

SEQ ID NO: 70690 - DNA, 2261 bp, Oryza sativa
cccaaataattaatttaaagaacttgtttggacgatttgaaacttaaaggaataaactgagtccaaagataaacttcagggaccatattagctattcaccctttttttttattttatgtacggtgctttgacaactatattaatatattaaattatttagttaagtaaagtgaaaagagcatcattggatctgccatcaatattgcattagtatatttgtagaaaagacaaataatcgattcaaataaatttaaaagttaaatgagtcatatattaaaatggagttcctaattaccaaagcctgacaattaagtggttaaccatgatgattgtgtgctcgcctgctcggcctttgagcaatttttgtcgtgagcgaggtcattgattggcccagaaaaaaataggcccaagttcagatggaacccaacagtagttgatgtgggcctcgtaggatggtccagtacttcagctggtttgggcctgtgtttgtgtagacttaattgggcctcttttcttttccctactttatcaattgggcctcttgactagcttctctcaaaatatcgtagatttgatttttgagcaagttaatttattgcagaaatcatcgctccaccaaagctgtagttagcttgcaaatgttgtttaaccgcgtatcagattatctcagaatcaagcagagaaggatactcgagcacatgaacatactcaggggcgaagctacatgcagctatgggggttcctaggcatccgagtaagagaaaagttttagctataattaccccatctccaccatatatgcacccccctcatcccaacaatgtgtacccccaagcaaaccatcaggccgagcaaaggtaacaaggccaacagagaagcgcacaaccatgaggattttcttgtggtgcagcatgtttagttgacaaatttgccctgcataacagcactgttaactacttcacggtgaaacagaatgcactcggtggccagccgcagcctattaatcgtagcaggtaagggatgacgtcaaaagaaagttttgcaatttgctttcatagtttcattccattttttcgataatttcaaacgaaaaattaagctgttttgtctttttttttcttcagatgttgatgttggacgagtagttctccagttttggccacctattggttgtgattttaatctttaacttcttcagtacactgcgctgataactatcgtcattgggaattcccattttggcaagtagttttataatttaccgctaagttttcgttcttatatcactcgttcatgttaatgtagatactgaaatcaatggttttagtattgtttaccataatgttctttgataaaacatggtaggtcatacatatatcattttcgaacatggtaatatattgctactatagtggtgcaccaccctctgttttgctctagcttcgcgactgaacatacttattgaaaacccacaaagtattcattcctcttgattgaattgcagagacttaggggtatgtcgtttcttttggttaatactatatgtttatatgtttttattaatgggatctgttcacatgttcggcctccgtcaaaagtcacacaaccattaagttctattctttttttttaaaaaaaaggaatcattaaggttatgggacaaatccacttcttgtgcaatgatatccgctgaaatattggatagagattctataatgaaagttttataagaattatttcatccaaaacgaaataaaagatctctggctaccgattctaagagtgcaacaccattgtaaatagtatcttactcatactgtgaaagcataaaaaaaccaagagtgatgcaagctaaaagacaagaagataacatgcattcttttagataattctgtgtaattgaaaactatatagctatgtgttttcttgtttaaccatgtatgcattcactttgaattttttttaataaaggtatgcactttattttagttctatatatctgacttagcctaatagccttagccttggactttgaggcttgagcacatcctttatttttatttcggacttttcatggtactgaataacattagatatgtaatttgtcacatatttttatctggtttaaaatttgaactgaagggagtatagccgtcaaagttatatgatgaccaaggctgatgagcaacaattaactgattaaattgtgtctcgtgccgacgatgtcctccttttgtcgtggagcatatgcaaacatgcat

SEQ ID NO: 70691 - DNA, 707 bp, Oryza sativa
  unsure (1)..(707): unsure at all n locations
tcgagcaggaagaggaggcaccggcgtggccttcctccgcctcccctcggcctcctccgtctcctcttggccacgagccaccggctcggcgctccacgctgtcctcctcctccgtgccgccgccgttcgcgtcaccggccgccgcgcaacgtttttctccgggtcggcctcctgcttcagctcgacgggcagcgaccttgcgaccgcacgcctacgggctttacaaccactgcggaaggcgcgagcggcggggggaggagctactcgtggacggcggccggcgggggagcccgtgtgccgctttccccaccggcgccgggtngactgcatcaccgccgacgcccgccgcctaggcgctgccggccacagagaagggagagagagatgaggaagagagagaagagaggacaagagagatgagggtgttgacgtggccagctgacatgtgggacccacgctgactcagccgttacgtcggataaaaccgggttcaaaactaccgaaggatgtcgggtgacccgttttatataattaaagagaactcgcgtatctggtttttgcggttcgaggatgttttttaccctgattacaaaggtgagggaccttcgtgtaccttttcgctggataattaagctcatgcgttgtggccttattgggatggggccatttggatcggatttccaatgggcctatgcgttctattttgg

SEQ ID NO: 70692 - DNA, 693 bp, Oryza sativa
ttttaatcacaatattcacaccagtacaatatgtggggtagcctatctacttgttgtcgacatgccggtctgaaggtctgactcatagtcgacaaaagggtagccttcctcctcgagctcgcgcccgacggaatcagagacagtgctagatccctacggccggcctctaaaggtaccggatagggtcgatccaggcgtatctctgatgtcgatatccgccggcttgtcttggcgtatgtaggcttgtatgttgtggcttctggtgggtgttgattgtctcttcatggtgagtgtcgatcgtgttgatcgtcttatatcatgggtgtcttccatggtggttctccctagtgggtgtcgatcccccatggtgggtgtgtccccctgtcctcctaggggggcttgtatttatacccataggtgtccctttgtccaagtagaactagggaaaccaatatagatacaatccgagtagtccttgttgtttccatgtagaactctggttgtctttccttatccggaactccctccatatccgaaggttgtttccgtatagacatggtatgtggtgggtcctgccgagatttagtcaactactattaggtatcactacgccagatcctcacacctctgacgggatacctgtgacgggcaaacgaattggtcagtagtgaccattacctttgacgggttata

SEQ ID NO: 70693 - DNA, 586 bp, Oryza sativa
aggcctgtctccgcccccgaaagacctaatatcaaatataattagaaggggtgaggcttcgaacccagatcgtccagcccactactttgtgaagctagccaaaatatccctaggtgtttctggcaccacttgctgccgatcggtgccgaggcgaagctgcggggtgtcgtggacgcactcgaggctgaaatcgtcggacagcgagcagtttggcccgatgccgaacgggtactcgatgtcgacgttgccgcacttcttcggacacagcggcgacggcggcggccgccgtgatgcggccgcgatcagaggctgcagggcgagcaaagctaggccaaggaagagcagcattggatgatgcttcgtcatccgtgcctggaggtggctgtcgtagcagatgctaatttttgagaggagaatgtataggcgtgttaaattcttgagaaacttgacatctatgctaagctagcttcatgcatgttatatagtacttgggcgaacccgatgacttgagtgttagaataattgggctaggcccaacttataatattaaatctcaaaggcccataataagtgttgaggataataa

SEQ ID NO: 70694 - DNA, 556 bp, Oryza sativa
tctcaaaccgtgtcattaacattttgcataagttttagttcatcagataactactttgcacactgagtctcagacatcaaatttgacaaggagctgaactaacagatcattaatttccgtgaaagcaaacaattctctcactgacagaacagctgaaagattaaaaaagagaacagtgacaaaataagtatataaccaaataaaggagcgacagcgaagaacttatatgagatgttagtgtagacgctggaagcggaacaagttgacgtcttcacacttatcaacacaaaactgtgtaggatgcaaaagattatgcagaggcgctagaataaggcccatatcaatccaagatgaaacctgcacagcaggttacaaggttgatcagatcgatgagtcaagcagtgcgtgcattttaccaaacagaaagtaatcgggtatgagttgaaaaggggcatgtttgtacctgtaccttggatattagtactttctgtcttggatgatcggaatggttcctcttagcttacggcactgtctctttgagctctcgtttttgctc

SEQ ID NO: 70695 - DNA, 1265 bp, Oryza sativa
cctagatgattgcctatttgttttcgtagttgagttaaaaattcggtgcttcatacatagtagctttatgttgctattcattaccataggtgttttgtgctgcatttcaccccatcagttggtgtactaacaccttacacttgagttatcttttgttgcttgctggtagttcagggttatgcatcttgtggttactggtacatcaggggcatccgttagatcttttgtttttcttcaacaaacttaactgttgtttatttgttcattttaatcttatttttttcattctaggatgtgacgatgaaagtctttgttccactctttttcaacatgttttttgatgtcaaagctgggaagggtgaacaagtaagagatgtatgcttggatacactttcttctattgctgccaaggtgcagtgggagcactatcgaacaatattgatgagatgcttccgtgagttgagcctcaagcctgataagcagaagatcatattgaggcttatatgtgctgtgctagactcgttccatttcatgaaacctgcgcatgatgtctcaaggaattctgatgctatgaatgaggattctgattcttccttgactttctcctcaacgatagtctcttctgagaagcaacactacctgcaaaagatagtcttcccacaggttcaaaaactgttaggagcagatccagagaaagtcaacgtaagcataaacctggtagcacttaaaatacttaagttactaccggtagattatttcgagtcacaactttcaagcatcatacatcggatttgtaactttctcaagaaccgtcttgaaagcatacgagatgaagcaaggtcagctttggctgcatctctaaaggagcttgggattgggtacttgcagttcgtggtcaagatattgagggcaatactgaaaaggggttatgaattacatgttttgggctacacacttcattatttgttatcaaaaaccataacttctgatatgaatggtaggcttaactattgtttagaagatttgcttgctgttgttgagagtgatatacttggggatgttgcggagcaaaaggaagttgagaagattgcatccaaaatgaaagagacgaagaagagaatgtcattagagacactcaagctgatttctcaatgtgttacattcaagacacattctttgaaattaatctcaccgatttcttcccatcttcagaagcaccttactccgaaattaaagtcaaaacttgagatgatgttacataatat

SEQ ID NO: 70696 - DNA, 2047 bp, Oryza sativa
tagaatattaatttttggttgagtaggagaaaaaaccgtgtgaaagttctgaattacccatgggcccacatgctaggcttgccatctctctatccttctctctctcgtacatggaatccgcatataagcctctactatctttttccccatctacttcctctattcctctcactctcgcaggaggcaaaggtgagagagtgtctcggtgaccggcgacggcgaggcgagctagatgctggttgggaatggtggatcgtggaaggagatgagctcctactcgacatcatctgtcatagtccactcggcatcggcgcgctcctatgggtgtggcgcatccacacggttcacgctgcagcatgtaagcagcgagggagggggggcccaaaccatgcaccgacatgggagtaagcagagtcatggagaggatgggctccattccccccgggtgtgcgactgtgatgaagatagtcagagggtgacgatccagctcccgacaatgggtcttgaaagcagggacgccacaagtggtggagacctaagatcgcgtgcgaaggacgactcttaccacaacccacaggcgccatgcaaggaggagcttggggcggtgaccggccagaggcgcaggtggtggtagacgagcagaacgggaccaaagtggagctgcacctactcagatagtcagatccaatggttcacctattccaactagttgccgatgaaggtaggcttgttattgtgtgcttggcgatgcaatgaactaggcgtgcaagagctcctctccttccacagcaggcagcatgtgggttcatgtgcgagagagagatagggatagagagatggcaaacctaacatgtgggcccagtggtaatttcataattttcacatgatttctctcttattcaatcaaaaattaatattctaatggttgcggttcccatgagctaatttccacgcttccaaagtgtcttcccctaaaaatcacttcgtgtggtgttctacaactaaaaacgcgaagtcacaataccctctagcaaaattttccaattccttttcgtcacgagtgagaatctccttatttgacataacttatcaaattaataagtatcacaaaatataaaatgtcctaggatttttgaagaggtttaggtaaacaagaaaaaatatactataatatctctcgttaaatacttaaatgaggaatatgtaacgagtgaaggtggttggagataaggatggatgaaaattaattaaataagatgtgattatatgaaagaagtaattaaccctattttcttatattatatgacaaattcatgataagatctattttaaggctgtgttcggaataatttgttcccaacatgcaatttgattttttaagcaactttcctatagatttttttttgcaaaaaaagtaccgtttagcagtttgaaaagcacgcgcgcggaatacgattgggaggggttgggaacccagggttccaaacacagcctaatttgtgatgagtgatatctcggttcaattaggatgtggcctatgttacccatgagcgttgtgtgcccttgatttatatgagcaagagtagaatctcttataagccctccaaccataccacttcctttttttaaggaaatcatgccattttcggattaaccattttatacgaagcgagaatgaaagtgtaaatgaggtgctatacggatggttggtttgcggttctggaggatgggttgtccatcccaccatatcgtttttgggttaaccatttacacgaaatgatgatgaaagtgtatgtgaacatgtctgtcgaatgaaagtataagtgggtctacctgttggatgggctcaatactacttccaagttaatcatttgactcgaagtgagaataaaagtgtagggggtgctatgtgtcagtgttggaattaatagatgggctaaggcccattcgaagattaattctttgggaaatcacaaaagcccacctcatgggatggcatgcatgtggagtttagtaccaccttgcttattctagaagagggaggcct

SEQ ID NO: 70697 - DNA, 558 bp, Oryza sativa
gtgagtcctgaacaatcaaacagctaagttgtttcctaagatcctcccacaagatcaacactccaaaatgcccaatccttgtatcgcgctccaaccacccattcgtgcatccactctcttcgcgctccgtcgcacgcgcgccggctccccttttgccgcccaccttccaaccctgctcccttcgccgccaccaaagtcgtcgtcccattgctcatacgcctctacccatcgcaccgatccacactgccaccgatgacgatttcctccgctcatcccctaaccaccgccccatccctcccaagtcaaggtacacggatgttcgcgcaagggataatttcaggttgacgtggcatattcgccaaggtgtagtttgttagagttttgtgtcgaatatgtgtacgtagtcggttgcaatttaggacttggagttgtaataggtgtttggactagagtaagagtcagattttatcttggttgtaaccgcaagacgacaatagcataggtatggatacgactgaccgacggcctagccgatggagggtcgtgaatacccggata

SEQ ID NO: 70698 - DNA, 579 bp, Oryza sativa
cccatcaaccccccccccgctatcagaggcgaattgtgcgcctttattcttgcagaaataatgaacaagaaaggacgttttcatgccaaatagattcatgaaattggctagataatttattgtgatgtaaaaaagatgtttttataatttctggcgatgtaaaaaattatgtttttatagagtgcaatgtaattaactttcatatgtgcaatatttatggtactttactaaattgtcatcacatttgatcaactacgatttatgttgtactattcatctgttttctcctttttttttccttattgacaggttgtgcaggtcgatgacattatggctttaatccatttggtaagtatatatgcggttctatgagcaacgaccgaaattgtggctttcaaggggtgtgaatttgctgtgcaaaattatggcatttgaactgcatatatgtgttgttggggatctgtgatgttatattgggggggtaatgtatctgtgatggatctgtcactggaatatatctgtgatgtttctatttttcagagggcatggctagcaaatcctgaggctagccaatattta

SEQ ID NO: 70699 - DNA, 2087 bp, Oryza sativa
ccccctcggggggactaagaggagggcgaacacatcaccctcgggcccgacgtccctcgggggtaccaggccacgtgtgcgattgtgtctgcctcaaacctctagtcatgatactcctgatcccatgtaaccgacaaagggtaattcagcgggtcttaaacacaggatgtttgatcttttagacatgaatcaggctcaccttcatcgaatgctccttatggtgctctggcgtaactggttcgtaagaaatgaaatagttcatgataaaccggcgccaccaaccgaggtgtctagaaggtttttggaaagctatgtcaactcgctgttagtgataaagcaacatccccacattgatcttgtgaaagggaagcatgtgattaatacgtccccaattctccctgaagctcagccgcggatgaaaaatgatggggtctgtaggtgggagaaaccgataagagggtggatgaaggttaacattgatggttcgtatgatagccggaatggaattgggggtattggcttggtaatgcgtgactgcacagggagggccttttttgcctctagtcgccacttggagcgctgtaatagcgctctagaagctgaacttcaagcgtgtagagagggactgattctggggcttcagtacaccctcctccccattgtcctggagaccgattgtctggaggcaatgttattgattcagagcacggagaaggtgatgtcgacggaggcgtttatcgtcagggagattaaggacctggtccaagggaatagggagatcaagcttaacaaggctcagcgctcgcaaaatcgcattagtcactggctagctaataaagctcgttgcgagcatatctctgaaatctggttagagaacaattgtaaccatattttacagctcgtcaatgacgatgctggctgagtaatatatttctcccttccctcgcaaaaaaaaaaaagatacgcacatgtctgacatacacaaggtgttcatttgcatacatgcaccaccaaaaacatccaggtgtttttttttgtgaagacaggcaacatcatctctctctctatctctctcttttctttgactaatctcattttcagaaattacgatgtgcaaaagaaatagcacaactctcacaatctcaatccaatgaacctcgtctagtagtactttttgcatggattattggccacacacagcatcatttgaaaaggaactaaaatctacactgacatgaaaggtccacacggctaattaaccaaaacacacaaggagataaagaaattaaagcacgtgctcgattctgcaaaccgaagatcgatcggatccagcaccaccgaccgctccggatcagatcaaccgtgattgaaatttgaaagaacaggtcccaacttgatgcgaaatcgaccttgagcaaccattttcttccccatatatcatcactattttgcacaatgccatgtcacatcaaataattttggataataaaaagataaatgacttataattttcattaataaaaaaatataatggatcatgaccaattaaatctataagcacgcatgataccgtaggggtaaaatgaatattttcttcctcttaacggtgtttgattaacggttggcggcaatggtatataaataaaaaacaagttgttcgattatatattaaagaactgagctttgagctttgtcagtgttatattatagaatttatactttattgatcgtatagaatggatttactgcacttactgtctcacacgattttctactgcctattacaactgataggtcttgttttattgtcgcacacaacgtaatcataaaacctcaattcttaaactatgagcaaaaatatcccgaaatcatgtgccgaaaactgaaaaaacaaaacagcaaaccaatgacaccactcactgtttcacacgctctttgtaccgccttttaacacctgatgggcctcgttttgctgccgcactcagcgtaatcataaaatctcaactcttaaaactaacggataaataaaatcaaaacacaatatactaaaaacttgaaaaaaaaaccagtaacaaggtgcttcgatg

SEQ ID NO: 70700 - DNA, 606 bp, Oryza sativa
agacattgagcaacatgtattcagaagagggaaatgttatgatgatggttgaggctcaagacaaggtagagaatctgaagcaagaagggagaacagttcaagagtatgccagcgagttgcaacatttatgggcagatcttgatcattatgatcccctacaattaaagcatgatgatgatattgtgattggaaataaatggctgcaaaggagaagagtcattcattttttaaaggggttgaacaaggagtttgaggatagaagagcagctatgtttcaccaagctacattacctaatatggaggaagctatttcagccatggttcaggaggagatgaggcagaaagtgatgaaaggaagtaatcctgtgaggtctgcatacatcacaattaatgacagggagtgttataattgtgggttaaaggggcatgtgagctacaattgtccttctcctaggaacaataatggtcggggtgtagctcgtggaggagcacgtggtggctttggtggctacaatgggagccgtggtggctatggaggctatgtacgagaccgaggtggccaaagaggtgaacgtggaggccgtggtggaagccgaggtataggcc

SEQ ID NO: 70701 - DNA, 519 bp, Oryza sativa
ctgggactggtatcgattaacaggttaatttggagcgtcacgggctagttccggtcgggactagttcggggcgtgacaccaccccgccgcgcgcgccctcctccttgtgggccggcccaagccgccctccctctctccccgggacgccgacaggtgggccccacctgttgggcccgtctccttcctccagtcggcgccggcgcgcccgcaaccgccgccgcgtccacgcctccgcctcctccgggccacgtcagccacgcccgcgcgtgcgcctcatcaaccgcacccacttctcctctctctctcccgcccgcgcccgcgcccgagatggccgggattcgattttcgaatcccgactctctctcctcccccactccccacgttggccggcaaaatcccgcccctaccggccacgtctagggctcccctcccctatttaggcttccccgtcgctccctctcgctttttccccatctcgccgaactccctcgtgctccccattgctcccgcgccgtgcaa

SEQ ID NO: 70702 - DNA, 2160 bp, Oryza sativa
tgataccttgctgtttattaaggcaaaaacggaagaagcggatgttattaaagaggtgttgagcagctatgaatcaagtacaggacagcttatcaacccttctaaatgttccattatgtttggagaggccactccaacggatgtccaggaggcgataaaggcctctcttcaggttgcaaacaatagttttgaggacaaatatttaggcttcccgaccccggagggcagagtgtgtaaaggcaagtttcagtccctgcaagatagaatctggaaaaggttgttacaatggggcgacagtttcccctccagtgggggcaaggaggtgttgataaaagcagtcatacaggccatcccagtatacgtgatgggggtattcaaactcccggactctgtatgtgatgatttaacgtggctaacacgcaatttctggtggggagctgataaaggagtgaggaaaacaaactggaaggcctgggataggatcacaagatcgaaaggatacggtggtcttggtttcaaagactatagactctttaaccaagcacttttggcccggcaggcctggcgtcttttggacaatccagacagtttgtgtgcaagggtgctaaaggcgaaatatttccctaacggctcgttgacggatactccattcagtggcaatgcatccccgagatggagaggaatcgagcatggacttgatctgcttaagaaaggtatcatctggagaattggcaatggatgctcggtccgtatttggagagatccgtgggttccgagggacctctcaagaaggcctatcacgctgaggaataattgcaggcttagatgggtgtctgaacttatgcgagaggatggaagctgggatgtgaacaggttagaaagtatcttcctaccaatagatgtggaaaagattctacaaatcaggccgtcatctcgtcaggaggaggattttgttgcatggcacccggataagaatggtagattctctgtaagaagtgcatacaagctcgctgagcagttggcccaggaagaagagagttcgagttcctcgggtgtgagtatgaagaaggcctgggacaacatttggaagtgtaatgtgcccaacaaagtcagggttttcgcatggaaagcaacttccgactgtttggctaccatggtgaataagaagaagaggatgatggcgagctctgatacctgtactatttgtggagtggatagtgaagatacaacacatgccttgctgtggtgtccgcattccagggcactgttcaagtctatggagggtctacactgttcttcgcccggcaagggtgacggagcgtggggctcctcaccgggagaccgcgcaggcccccctttgccggttcggccggggactcagggagagattctaagctctctgtatgtggaaggctcgcgagacaggaaacacacaagacacgggcgatgtatacaggttcaggccgctgagaagcgtaataccctactcctgtgttttgggagatctgtgtatgaaggagctacaaagtatcagccagcctctcccttgttctgggtttctaatctggaaaagtccagtccccatctcagtgggcaaggtcctccttttatatcttaaggggataccacatgcaccatttctctcttttttgtggggacttaccccaccttttcataaacagacggagacttgtatggttgccgtccgaatgaccttctgatgggacggcccatacctacctccacttccgccggaagcaggcgcgacgtggaatcgtggctgtctgctgacgacatgaccggtatcagaccagtcacgtcggtcattcttgtccaccacgtgtcagcttagcaatctacatgctcgcccttcttcacacaacatcttgcctgtaatggttaggatgaagcctggcatatatctgaccaggactaacgtgccatctctgggaggtaacacgctagctccagctggggacgagcgcctagaagccctcgtcctgacgggatggggcgaggcgtgcgtcaaatcgcctgtcgccacctaacccgcgatctgaccggtctgagactggtcacagaccggataaacgagtgcactgcactgcgttacatacggcgtgacacgctcagcccaaccgcaataaatgtggttaggtg

SEQ ID NO: 70703 - DNA, 645 bp, Oryza sativa
ctaaccatctactattagtagtaataatttactactgctcggggtggactaacccctgaatgatggggacggtttttctaggattatgttctagggaccagtactgacttgtcggatgcgggttctatagctggaaactacaaagggatctgttgtaatcgtgccttctgttgtttattatatttgtagttacctaaaatgcacttaaccagttcttcattgagctatagtacagcacatcgtggtcctgaattgtagaagtggtacgtggcatgctatttgtcgcaccctagcaaactcatcagctcgagactagcgcctttcggcctacctggacgaatttttatacctttctgtcaacaacccaagggatatgtcacgccatcgcccatcgatgatcagctgacggccaccgatcgtgaaggcgagaggtacaggataaatactatccgtgatggctgcgtctgcattttttttttgtttagcattgttcgggtgactatttatggcagcgggccagctgctccaccgagctgaagcctcgtcaccgcccacgtacggtgcggcgattggctgggcttgcgctcgccggagacgctcctgatttaaattaatcgaatgatgaggagattttgttccagctaa

SEQ ID NO: 70704 - DNA, 630 bp, Oryza sativa
atctttaccactggttggcaccatctgttgtcccagttatacaaccggaacggtgaattcggaataaatatcgctatctttagtcccggttcaatcgatctttagtcccggttggtgtgatgtggtcccggctagagggttttttccttcttttttttcttctctctctttttcactgttcttttgctatttgcccaaatcatctcagatcaaacattcatcattcacggtaatatagttcatcccaaatcattcacaacaacacatattgaatcacacggtaaggacaaaagaaaaaaaaatccaaaagcagcgccggcctccaccgcctaccgctgcactagccttcgcaccggccgcctcccccttcggatccggcggtggccggctgcctcccctcccagatgcgcagccgcccggccgccgcggtgcgaggccgccgccgccgctgccgcctaggggaggaagagaatgaggagaggaggaggaagaggaagagatggggtgaagaggaggaagagataaggtgagggtggaggagatagaacttattaactgatccgtctcctcctcctcgatctcacgcatgcctcagcccctccgccgcgcatgccaatctttttttccggt

SEQ ID NO: 70705 - DNA, 895 bp, Oryza sativa
tccagggtttatttactagtagtagtagtcagcagcgcaagttcgattagttggcggagtggtgattgacgatttattaggttatttttgcttgtttctggctttctgcagttcggacgacttaccttgtgattactgattagcaagtgtgttagtatcagtatgttgggtggtgtctcttgtgaggaagtgagtttaaccagagtattcttaagatgaccaagctcaccaaacatacccagtgttttgtattatattgtctatgcttgcatttttgtttacttgattcaaatgccactctgtgcgtgtgacctaagcaaaacaatgtttactgcctatgttcaatttcatgcatcctcacatcactaaagtgaacttaggggcttccagatctagcagagtgcatcattttatttagtgaatgtgtttgtggacagcacgtgttttttcattatcattattttgtgtccttgtatgctgatggtgtttctctgatgcggcagatgggggtgtggctctgcagtttgagagcggctactttgtggagacgctcgtggaaggggacaagcttggcgtcacgccacacaccattagggtgtcccctgttgagggtggagagctccttgcagtggactcggcacatagcaacattgtgcgaataactccgccactgtccgagtgtatgttttcttcttgccatcctcagctcagcgcttccttggttattttaaatatgaatgtaatatatgacatggaacattttttggtgtgtcatccagcggactgtttttaggagtgatcagagtttgttccttctttccccaaaggcatgaaactttaaaattagctttgttaaacatatcagtggctaataagcatatatgcaaatattttt

SEQ ID NO: 70706 - DNA, 575 bp, Oryza sativa
cagcacagatgatgcagaacatagcggcatttacacatcagtagaacacacagtgaatcgatcctatctctcaactaattgatggatacatccgtagccgcatgaagcacaaatgcacaatggattgctgttagctattcaaatgattggagaagtatgtgctcttttacctgaggatcggaaacggaaccggaaccttcaacttggccggaaaacaagggcgaagtagccgaggccgcccaagtcgccgccggcggggggatggcgacggagccgggacggaagaagcagcccttctagccgacgggaagagcgcgcaggcgaggagaggaggatctcggaggcagcgaggtcaccggacccgaccgacgggcgagcgattcgacggcgacgagggcacgcaagcggaagcggcagcggcgacggcgacggcgacggcaacggcgaggaaacccttgccgagttgactagccttgtctggaattctggatgggccgccagataattaccaggcccacataaacttgtgggtcttaacagaggtccattaaaaagcttaaggaataagttcactt

SEQ ID NO: 70707 - DNA, 5565 bp, Oryza sativa
atgctccatgagcaaaccgaagcttggacgaccccatacatatgcactgtaattgatagaccggagtttgaagacacggtgaaagagatggagaaggtggtgtaaaatgcaacaataggaaatactccagctagcccaaagtgaaaacataggataaggggcggtctaaagtgaaagtttggtaagaaatgatgacccaatatgcaattcactaaaaaagaaagtactaaagatgtgttcgtctccctcagctgggaactaatgccctacgcacgaaaaacggagcagtacattaacgcgtgattaattaagtattagttttttttctaaaaatggatcaatatgattttttttaagtaacttttgtatataattttttataaaaagcacaccgtttagcagtttgaaaaacgtgcgtgtgaaaaacgagagatatggattgggaacctgactaaccaacgcagagtagctcgcacgatggctgttagttcctgtcttttgataagacaaaggtcgcagctgagatggcaactcggtttcaacgtgaagcacatgaggacattcaatgccatcgcattatagagtcataacaacaaataaatccgaaaaaaagaacttgcatatggaattgtgaaaaacataatttcctaacagcatctttggagtacaaacacatctattgtctcgtaagtcatatctatggcacattcgcgcaatctcaattcttaaaaccaagagttcaaaaaaattcagaaaacaaggaaaagcaaaccaaatgacgcatcaaagtcatggtcatgactcatgactcatgtggtcatccaaaagagaccagcaaaaaaaaatagaaataccaaagcgatcgaggcgatactaatatcaatatattacgttacgccgatcatcaagggaagaagcccaggacaaaaatatccgcacgtcgcatccaagagtaaaagaaaataattattttgtgattatccataaaatacttatagatactaaagttttatattgaaaaataagttcatagctcagttcctccactagcggtgtggattttgaagaaatcaaaagggtcaacggcctccgtcctaaaatataaacatatttagtacacagtcataagtcaaacattttcaactttgactattaatagtaaaaaaagattaatcatataaaattgatattactatatttattattaaacaaactatcgtaatatattgttgatcaaaatagcatatcggatattatgtcagagtaaaaaatacttatattttaggacttaactagttaaggtagtaaaagaaacagtacatgaacaattaattatcttgttgattttcgcctcgtagagaaataggcggtacaaacaaaccacccaaatggcgaagcgtcaacgtcgcaaaaagcaggatcaattatgcatgacacagtaatctccacacttctaggatcttgtttccggccagaacgaatcgtatccttttttttttctgttcctttttgtggtctctgaattctgatagagctgtgggacatattcgctcgtttccctggtgctgcttgctcgccaattcgccatggcctccaccgagcagcaagaacacgcagcaccgctgctccaacccgaggtctgtgttcatgtcaattttccgctatccaatatgtttccctcttcagtttactgccatggactgagttactgagctttgctcccgaattagtttagtgctcagtgttaacatggctgtggattttggttgctgcaggtagaagaagcatacacctcggatgggtcacttgacatcgatggcaacccggcgctgaagcatcgcactggtggatggagagcatgccgctcgattctaggtatagaattaatcacttaattactgattaaaacttttcttcttgccaatttgttcctggttaatgtctccactgaggcgatatatgcttattaattgtgcttgctgtggataggagccgagttctgctactgccttgccaacaatggcatcatgtacaacctcgtcacctacctcacaacccagctgcatcagagcaatgtcgccgccgccaagaacgtgtcgatctggaaggccacctgcttcctcacgccgctggccggcgccgtcgtcgcggattcctactgggggaggtaccgcaccatggtcgtcgcctgctgcgtcggcgtcgctgtcagtttgctaagatccccccacttcaatcagtcactgcatcccgccatgaattcagctcaggtttgaggtttggtcactctctgcttcgttcgtgcaggggatgctcatggcgtctctctcggcgctgctgccgcagctgatcgagagctcatcaacactgtccatgccttcagctcaagagttcgtcttgtttcttggcctgtacatgatcgctttcggggtgggcggccgggctgcagccgtgcctgatgtcttttggcgccgaccagttcgacgccggcgacacatcggagcgcgcgagcaaggcgtcattattcaactggtacgtattcaccatgaactgcgccgccgtgatatccgccaccggcttggtgtgggtgcaaggccactacgggtgggcattgggattggggattccggcgatggtcctcgccgtcgggctctcctgccttgtcgccgcgtcgcggacgtacaggtttcagacaacccgcggtagcccgctcaccagagtctgccaggtcgccgtcgccgccgtccgcaagttcaacgtcgcggcgccgggcgacatggcccttctctacgagctaccggatgacgcatcctccatgaagggagttgagaggatcgaacacaccacggatctcgagttagtttcttttctatgtcgatgtgccgtgttggttaattttcagctcccgaattcttgagatgtatctgccatgatcagattcttcgacaaggccgccgtcgtgacggcgtcggatgaggaggcgccgcgcaatccatggaggctttgcgtggtgacgcaggtggaggagctcaagattctagtcaggatgctgcccgtgtgggcgtgcatcgccttcttctacaccgggacggcgcagaccaagtcgacgttcgtcgagcagggcatgccgatggacgcgcacgtcggcgccctccgcgtcccgccagcgtcgctggccgccttccaaatgctcaccaccatcgtgctgatcccgctgtacgaccgcgtgttcgtgcccgccgccaggaagcacaccgggagggagaagggcatctccgaccttctcaggatcggcggcggcctcgccacggtcggcctcgccatggccgccgcggcgacggtcgagacgaagcgcgccagcgcggcgcggacgacggcgagcatactgtggcaggcgccgcagttcgtgctggtgggcgccggcgagctgctcgccaccatcgggcagctggacttcttctacagccaggcgccgcccgccatgaagacggtgtgcacggcgctcgggctcctcgccgtcgcggcgggcgactacctgagctccgtcatcgtgacggccgtgtcgtgggcgacggcgagcggcggccggccggggtggatccccgatgatctcaacgaggggcaccttgatcgcttcttctggatgatggccggcctcggttgcctcgatcttctggcgtttacgtgttgtgccaagaggtacaacaaatcaaggaaggcttgttgatatttcagggcttgttttcgggaggcacaaatcctggccgatgcacattgatgggccgaagaacttgatgctaactggcccaagacccggatcagccaacagagagttaggctttgcatggtaatcacatggtggaaaaaaaatccgctccctccgttttacaatgtaaattattctagcatttttcacatttatattgatattaataaatctagacatttatatctatctagattcattaatatcaatatgtatgtgagaaatacttatattgggaaacggaggaaatacattttaatggacccgcaatattaagcctcggggcatggcccaggtgactcgaggcttgggtccagccctgcaaaccgggctacccgcggattcttgcggtaatacgtataaaattgtcataagctaatttggtatgtgatatttggagacagagtattaggccttccattaggacagttgaaggatggtgaagccacagaactatagaagtggtgaagagctgtgaggtggcaaaggaccactaaaagagaagcgcctcaaacgcagcaaggagtcacaaaacgccgaagctatacacatgtcaaaaccacgaacgtattggctcgtgtaaatggcaaagccatagcggcaacaaagtcatgtcggtgaaggtcgcaaaatccgggtaggtcatttgaagtttggttctaatagacgcactggcttaattaagggccacggcccaagtaggcccatgaatactgccagagtcggtaagataaggaaatgacagggacgcccctttaggtgttcctattagagtatattcacctaccaaattgttataccttaaatggaatttatttatttaaaaaatataatgattagaaatcgctacttaatttttgatggcccaatatggtcctatatacgcacatgtctgcctttgaatgttttcacttcatccagaaaaatagaaggcaggagaaagctgcatgtgcttataaattggatttgtcgaaggcttatgatcgagttgactggaagttcttggagcagtcaatgtatagactgggtttcgcttatcggtggactcattggattatggagtgtataaccacggtgagatatgcaatcaaattcaattgaaccttgctcgaaacatttgctccctctcgtggactccgtcagggcgatccactgtctccgttcctgttcttgtttgttgcagacggcttatctctgttactgaaggagaaagtgatgaagggtgcaatttcccccgtgcatgtgtgtcgccgtgccccaggcatatcacacttactatttgctgatgataccttgctgtttattaaggcaaaaacggaagaagcggatgttattaaagaggtgttgagcagctatgaatcaagtacaggacagcttatcaaccctttctaaatgttccattatgtttggagaggccactccaacggatgtccaggaggcgataaaggcctctcttcaggttgcaaacaatagttttgaggacaaatatttaggcttcccgaccccggagggcagagtgtgtaaaggcaagtttcagtccctgcaagatagaatctggaaaaggttgttacaatggggcgacagtttcccctccagtgggggcaaggaggtgttgataaaagcagtcatacaggccatcccagtatacgtgatgggggtattcaaactcccggactctgtatgtgatgatttaacgtgggtaacacgccatttttggttggccggttaataaagaattaaggaaaccaacttgaaaggcttgggataggatcacaagatcgaaaggatagggctgcagg

SEQ ID NO: 70708 - DNA, 1192 bp, Oryza sativa
tcagtttgatgggcaaccccctttcacagtgacgattgaccctagcatcctcctatcaaatgaagacaccccttactcacgtagcgatcacaaggaaggaacaatagtgaggagaatgtacgtgcggtcagaaagtacgtgcggtcaaccgtcaccgccgatgtattgccgtaattgttgtgtacacgatgaaaactatttttggtgtattgaatatccatacaaatcaattgttgtatggcatatgttaattatgtatgattattagaatttttatcaaattgaaatcatccatatgctagttatatatgattattataatttttaaaagttttaaatcatgcgcatggtatttacatatgttaattagaattttcaacaatttattatcatgatatgctaattatatatgattattagaatttttattaatattaaatcatgcatgtggtatttacatatgttaattagaattttcaacaatctaatatgatcatatgctaaatatatatgattattagaatttttattaattttaaatcatgcatgtggtatttacatatgttaattagaattttcaacaatttgatatcatcatatgctaattatatatgattattataatttttattaattttaaatcatgcatgcggtatttacatatgttaattagaattttcaacaatttaatatcatcatatgctaattatatatgattattagaatttttattaattttaaatcatgcatgtggtatttacatatgttaattagaattttcaacaatttaatatcatcatatgctaattatatatgattattagaatttttcttaatattaaatcatgcatgtggtatgaacatatgttaattactttttttaacaatttaatatcattcatatgctaattatatatgattattagaatttttattaattttaaatcatatatttgcttattacgttttatccacttaatttactacagacaacaataatttttcgaagtaattgtcattaatttttcgactttaaataattttaattcagtgcgtttatcagtagtcccggttcttaaccctaaccaggtttaaaaagaatttagaaatagcgggaaaatatctttagtcccggttggtaagaacaaccgggagtgttcttacgaaccgggactaaagacccaggggtata

SEQ ID NO: 70709 - DNA, 880 bp, Oryza sativa
agaaactttaattagctatgctttgcaagatacatgaaaaatatcagtaggtttttcaatggctctgtcacatgtatggttccaagttcactgcaactgcaagtgatttgatctgtgcagctatcaaatgtttcttaagcatgatttctcttttttgttgactttgtttagctagagagttcctcatttagctgttgcatagattctgctggttgattataaggtcagggtataaggcatgatggataaaatgagctagggattttgttgctgaacagtcataagacatgatggataaacattttttgctggttagcagcttgtgatactgttatctcataagtcatatcttaactagtgagtttcacatttcgctgttgtgtagattctggatagactaagattctgttaaataaatctgggtatttattggttgtgaagcaacttttacgttttgtacgatacattagtaggtttttagctgaaacaaaaggcatgtttatttatgctccaatacggcgtccagtcccccgccgccaccgcctccgtcgaaccgtcgctggcacagggaggactccgcggcggactccgagaacgccgctgccttctccctccctcgtgcagttcttgccgtccccaccgattcgccaccgcgacgcagtccactccgctggtcacgatctccgttgccgtcgcgatgcaagtctcccctctaaaggtacacatgatccactccagcgccactcctcaatcagtcgccctgctgccaaaaacatttagctgctattcagtttcacaacagaaaatgttcacctctttattaatacatttagttgttttttgggatcaaactaaaaaattactccgtggcatgaggcat

SEQ ID NO: 70710 - DNA, 637 bp, Oryza sativa
catcacattaaaccttttctacacacataaacttccaacttttccatcacatcattccaatttcaaccaaacttccaattttggcgtgaactaaacacagccttaagcattctggcacctaatatctttgcaacctgtaatcaacttcttaatattaatgagtattaaagacttgtgagacgagaagcagcagatatgcaacaataatttgacatattgcagaactgcaggatggctgacaacagagacggattaaagtacgtgtactgcaaggagtgcgggatcgacgattgggtaccatctgtacaagaaaaggcacatgctaaacaacaccgcaaacagaatttagagaggatgaatctgcttcgccttcgagcacaacaactacaagcgaaaaaggcaatggaggctagcaaggccgcgaagaaagccaacagtgaagcgaagaaagccaaacctcaagctaaaaaatacccaaacaagcacagttcccctgttaaaagacactagaggaaacagtcgctaatctgctagcaccaattggaacacctgatagctaacacaatctaacagccaaatatggtaacgtactctacatactctattgttgtatttgtactgactacttagtacttaa

SEQ ID NO: 70711 - DNA, 609 bp, Oryza sativa
atagctgtgcaagcccaaatagttcagcatactgaactaccatcgtgttggcatttggaatatctattccactttcaatgatgtgtgtgcagaccagaattttgacttctccacaagcaaatttttccatagcaagttgtatgttctttgaaactttctgcgggaaaaagaattggcaagaaatttgattatgacaaaagcaccattcgactatgcaaatagaacataaatcttgattgttaacctaacattattccatatataataactagcaacttaagatatagacttgactgaaattgaaggttgtaagctttacagaaaataaatagtcattgacaatcaaaatcaaaacgaactatcgaagaacaaggtcatcgacaaggcccatatagagttttctggtaaattagtttgaacactaatcagccatgcaaggatatcctaacaatgataagagagtttcattggtagaaaatcacatgttggactttggctttaacacaatcaagggtatacaaattaaaattgtctacaataaataatagtcaaatagcatactaaacacatttgaaatgttaagtcaataaacctttccatgagcaacag

SEQ ID NO: 70712 - DNA, 727 bp, Oryza sativa
gtgccctcgcgagaactccctcgaccttgcctgactccgtcccgcagaccagcaagtcatgtcccatgtcccggacgagagctctgagatcttcccgccgctgcaaaagactgatggcacgcgcccggaggatacaaagctccggcatcccgatcacgcaccaggtctccctcgcagacaaatcatcgaacagtataggtgcgtcctcgagcgggtaacagccggagacaacaactaccacggacttgtccggctcgagatcggcgaggtcccccaggcgcaccaggccttggaggctggagatatagtcgaccaggcgagggggaggaggtaacgcgggggcgtccatggcggcgaggcgagggcgcggttgggcgcgtcgcgtcgcgtggggattcgaagcgcgagagcgaggcgaggcgaggcgggcgagtcttcccacgtggaatgaccaagctgcccctccgctccctgtgtcaactgttaaagtcactagagaggaaacgaagagcgggctgggctgggccgggccgggactgcaaattcgtcagtttgtatcggacctaaaattctagattttttttcatttttagatttttttaaaaaatatttacagaaataatctatcggccaaaaaaattataaaaatagaccctgccgcccactatggggcggcaagctgacgtggcagacggcgggtcgaccgcaccgtctgccgccgtcggcc

SEQ ID NO: 70713 - DNA, 2740 bp, Oryza sativa
tatatccaaacgtctgagttttgcaaaaatatctccagtgtgcagcttctggcatatgatcctatcaacgaaataaccatggaggtatgctttctcaacatgctgaacattccacattgaatgaatgctgtcaagcacaatagtcttttgtcttgtgtaaataccaagttcaaacaggtttgtttgtctttcaggattgatacaagaattttcagaagatacatgagtctcatacccatcttcatggttataaatgacaatagagagggaccgtattggtaaggttgtcttactaatcccttgaaacgaggtttctgaacgaacagtaattccaagggactgcaatttatccatacgcacaagctcattaattggcgcctcataggatgagcactgcagtaaattaaatgagcaaacatccagcacctccaaattctggagttttggtagtataccatttggaataactagatttggattattccgaagatgcaagtgcctcagtctggtaagacagcctaactccactggtaccgtttttattctgttatttgacaaattcagatatcttaggttgacctgcatgcaaatctctacaggtatattggacaatttattaaaagagagatctaggtactgcagtgaaagcaacgaggggaagttcccgaaagaaccgtcttccaaataattgtgctggagtatcaagacttcaagggttttttgattgctaggaatacgaggcagttctgtaattttaagccccactaatagaacttgctctgccaatccccaattctctttggtttggattctccatttgttcttgtcctcgccttgactgtgtacaacccataaggcaaaatcacggattgtagattgcatttgcactgcctctccatcttctgctggctctaaaaggcaaaattcttgcaaggtggtaatatgagagaaaccttcgttgtaagacgcttcaatgtcatccccttgtattaatcctgaccctatccagaagtctactaatttccgttgattaaatatatggccctctggccataaagaacacaacttaaagcaatctttcagaattcctgtcaagctgtcatacgcaagttttaatctgaaaaatgttgcctcttcactacctgaccattgagtgtcacgaaggcatgattcagtcagataatgaagggcattttgccaatatattgcatccttcttattgtgcatggcctttccaattgttaccagctccaaaggtgaaccaagcaattccgcggaaatatttcttggcaggtacacatgcttatggcccaagtaatcaagatcagcattctgcttgaaaatttcccatgattctgtatgatcaagacagtgaacctcaattctgttctccacttccacattcatttgatcacagacatggctagagcatgccgtgaaaaccactcttcggttgtagcagcttccaaccaagtcaagtgatggaatcccaacttcttctagatccagtctctgccatacacagtcaagcaataaaaggaaatttctctccttcaagaagtcgaaaattcttgctctatgttgcatgccgtcacagttagccaacatgagtttcttggcaatttcactttgaacctgaaagtggccaagagttacatgctagaaatgcatcttatgatggatatggaatgaaagggccaaattgtttatatctgtccatgcaatggttgtcaacaacatatccagtgcaaagtatcatacatttgctaaaaaaaattatatatttgtagatgtgctatttctcttcattttgtaaatacctcaactgaatatcctacctctcaaaaaaaaaactgaatatcctagtgttatactactcgcaataaatcagtatgcatgtatagatagtaccttggctacggaggaatctctcggagaggcgattcgcagcacgagatcgaaggtgtcatctcgggagaagtactcctcaacgagcttgagtaggtaagtcttccccaagccggcgcggccccagatcgcgacgatgccgttgggttggatcgtcctcaccctctcgatcgcggcccggagggtacgatccctgctcgcgaaccccgtggagatctccatcggttggggcagcttgctcctgcgcacgatccttcccccttcttcgcacagcctcttcacctgcggcatcatcagcgacgcgaccttgctgacgcggtagcagccgagcagatcccagaagatgagcctggggatccggccgtgcgcgctccgcagctcgccgaaccggaggaggtagatctccgcctcctctgtccaggctgccgccgtcgccagcctcctgccccgccgcgccgccacgcgggccctcgtgcgcacgcagtccctgacgtgcgccaggtgctcgcacgcgccacggaggacgtggaatcgagcgccggcgaaataatcccggttcctcaccattgctatcagtggagctagctcgagctccgtgctccatatgatcgtcgcggcgtcagatggagtcgccatggagaggcctccttcgtggtttctccaaagtcaaaccacggaaccgccagctctccacttttaatttccggtgtatgcccaactggggattcctatttagcgcgcgctagcgcttgatgggtaactcgcgcaggcgcgcacgtaccatcggcgccgtttttcttttctttatagagaaaggtagggctgcaggaat

SEQ ID NO: 70714 - DNA, 11711 bp, Oryza sativa
gtgagataagaagcattaaatttaagtatggaatagtagtgtttacattggaagaggagtgtctagtactagtttcttaatgatgtggagtttgtgaaaaccatgtctagtgtttttggttgggaatggcctcaacgatggtaacctaaacagtttgttttcccaaagccgtacttcataggatctctgatcacataacttcaattaggttaccggctgtgggtaactcaagactatacagtgacacccactatagatgattttgaaaaggaaagtgaaaggaacaaagaagaaggggatgagaaggatggtgagtgggcccgactagaaccaatggcgttagacaacaggagtggtgatctgcctacttttggggggcatttaaccatttgccatttttagcatgtacaaacatcaatgtggagcaaaccatttagaatttctctagcagattgagtaaattttacaaaatcctaggtattagggcatccattacataaaaccctagttattgtgatttgtttcacgaaatcacatgttttgagtcaaaatgtttcaagaaacctcatattcatatagactacttatattttattattacataagattgtttttttcatcaattcacattagttggctaaaaggacatactcttctcgtctactttatttttttctcaattttgcgccgaaaaagcttaacataataccggctgattataatataataataggttaagtatacacataaatgatcaaaacatgattaacaacacttgttaaaaagcaactaacgttatatatgtactaaaaagtatctcatacattctttttacaattattatagataaatatattagtcaaataaacgatgtaaatttatacctggggttttataaaacattttactctaaaacctggggtttcatgaaacaaattacaaaacccagggttttgtgttacagaagccgtaaaatacaaggttttgtgaaatttactcgaaaataacaacctacctgggtctcccttttcacacaaggaaactaagaaaaaatgactttgtacctctccttgaaaagattttctctagaataccaggttggaaaggttggtttctgctgcacatgaaactctggtcaagtcactcctatcttcaattccatcctaccagatgacaaccttgctaatccctcaatgggtcatcaagaaaattgacaggaacagaagagcctttctatggaaaggaactgaacctgataatactcacccaggaacaagccttgtgaactggcaaacaagcaaatgcactaggggttgggagcttccggatctggatcgagaggcagtgtgacgaaagagctggtcagacagatggaattcgatgagtccaaactacgtactaagatcgaccaagtatggttattggggcggtaggactcgtcaagcaccagacgatagaagcttcaattcagatcccccacatgtcagtttgtagtaatgcagaggaccctcactctagaagcttagtctttccgtttttccgtttttctttttttttatttggttgttactctattataaaacccagaatctaagtatttctgtaaccatcagctgtgtatatccactcatggatgatataagtgcctaatttctatccaatatgtgaaaaaagagagactaagggaggaaacattttttattttgttgtttcttagttacgaaacctagaatcttaaccttcggctatgtatccttagctagctatggatacaaatgcaaaatttttatccattatgtaaaagaataggagagccaaagtgaggaaacattttttttattttgttgttttctagttatgagacctagaatctaagtatgtaactttcggctacgtacgtatatggatataaatgccaaatttctatccattatgtaaagaagaagagagacaaagggacaaaatacacaagcatggagcatagcaagtcgacctcagcgggggacggcactaggctgggtggctagggaatcccttaagccctagccaacacaggatcttatcggccaccgttgcaaaggaagccctttctaacacgatgatctcacgagcgacaacactacgaccccccgctcacactccgtgctgcaggctgaggtctatcacattctccatgcttcccctccaatttcgagaggatctccgtaatccgttgcacctgcgctgcttcttgccatatagaacaattactcttccagcatccccaccctcacctaccataggggttctaaactcttgaggggatatttcctgattgcttacatgttatttaaatagttatttttttaaaaaaaatcaacaagatagattaatatatgataaatcactccacaaacatgcaaagccaaatttaacttctactagttgcaatagaaaaacaaattaaactatagctagctaatatatattcacagttaaatttgtttttttcattgcgacttatagaagttaaattttaagttatatgtttgtgaagtgatctatccactactacagaaaacacaaataggtgccggttttcccaatcggcaccacggaggcagcactaatatgaaaagaaataggtgccggtttaagaacaaacacctttgaggttccctgaataaaaaaaaatctggctcgatgacgagccgatgcattgagccgagcagtccctcctcccacatccatccacaccacagcaagaacgagcatatcatcatctatccatcacatatccaatccacagatggactcatccacatatcaatccattcatccacaacacaaattttgacacttaaattcatcctggatcttggcaataaaaaaaaatccatagatggattcatccacatatcaatctattcatccacaacacaaattttgatactcaaaattcatcccagatcttggcaataaaaaaaaagaatccacctctctgtcgttgtcccgccatcgttgtcgtcgcatggtcgcgtagccgccgccgtagtcgtcatcttcgagtcatcacgccgcctcccctcggcgagcccaccacctgcatccgcgagccccgccgcccctgtcgcagcctcccctcccgccggatctagcagaggggagggctcctccacctgccgctgccgcctcccctcccgccagatctggcgaaagggagggctcctccaactgccgccgccgcctcccctcctgccagatctggcaaaagggagggctcctccaactgctatcgccgtcgcgtctcctccgcgagcccgacgcctaccgtggcctaccaccgcagagccggtgggaggatgagaagaagagataagggaggaggagaataagatataagggagagagacagtgggagagagccggtgggaggaggagaagaagaaaagataagggagagagattcacaatatcgagagagataaaaagacgcccacccggccggcttgtctccacctggctcggctcgttttaagatgtgtcggttttctaaagaaaccagcagtgcggcacctttaataaattaaaggttttttttcaaaaaaccagcatctatagtataggtgtcggtttttctttagaaccgatgcctatagttatataaaaatgccggccttttttgtgtttttagcccatagaggagggaaaaggcctataggtgctggttttagtatttccagtacctatagtgatggcatctatatgatgttcatatactaatctatcttgttgattttttttattttttccataactatttggatgagatacaaagtttagaatccactcccctatgatgccctcaagccatgccaatggcatcgtagatgacctcctatccctagatcgacgcttccaactgtgaccaagcagatggaacaccgccactgcaactagctaccagatctcaaccaaggtctccaagtctcaaggtacggatgtaagtgcgctgtcgcactacccatataaaaacccgtgttttagtttatttaatataaaatttaaaagaaaaaacggaaaagaaagcccactcgccccagctgcgcttgcatacctacctcgaggcgtccctcgcgtccaggtcaagtcccccttccatgccctcgtctaaggagtggacgacggacgtcacgaaacggcatgtgtgccagtcgtttttggttgatcggatcacgcggacggacgaaacagcgtgacattacatttttttctctcttgtttttcggcggctgccgcgtcttcttcttgctcctctggtaaggtgtactacctcacatgcctaatgagaggaaaatatagaagagcgcgttgacaccgttgactttggattttccgtctccttcctccgaagtgcagagaagaaaaggaggagctgagctgagctgattgcttgattcctcgctcgttcaatctactctaatctatctctataggaagggaaacccaaaccataatgcaaagccgtctcgcagaggagttgcgagcgctgaagttcgaccgtgtttggcggccaagtcctcatcgctcggaatcggatggcggcagctgcagctaccgcaactcgatccagcgggtcgtcaccgcgtccgttgccgccgcgtccaccagcagcaccaccctcgtcttcccgtcgagtggctcggtcacgagctcgtcttcggcatcctttacctcctccgctcccggctcggaggcgcacggtactccaagctccgggcccgagagctacaggttgctgcgcggggaggcgttccggggcctcagcgagatcgcgagtcatatggtcagcgacaggtacaccgagaggctaataacggagttctcccggccgcggctggggagcggcagcggcggcggcggcggcggcgacgagatactgcagacctggttctccgaccttggcgttgactgggttctcagagtcgacgagatgaacctgcaggagaagccatggagcggcgtggaggagatgatcaaggggtggctcgccgcgctcaccgtcatggcggaagccctccgtctgacgaaggccaccctcagcagcggcgatggcgactccggcggtgtcattccggtgcttccgatcgagaagtacaggccacagatatctgcaccggcgtggatcgacgacgaccacgccggtgttacattacatgatgtaagtcctggctctggctcgtcgaatctcgaccaagaaagctcagatccggctccaaacacgagcaggagcaggagcattgccattgctacggtcaagcaagctataacagcgtattcccaagcggcgtcatcgaggtcctacaggtacgaccagcacggagctgcagggcctgaattccaattcgcgctcttcgccaaggcaagcctggtgaagatgatgtgcttcccggacgctatcgccgcgctgagcagatcgccggagaagatcctccgcgtgatcgacatgtacgcggtggtctcgggcgtctccccgagcctcctggcgctgctccccggagcgaccaaatggttggtttccgagaggatcacggccgtgctcaagacgctgagcggcatgatgaggggcatactccatgatctggagagtctgatccgagaggaggattcgtggcggacgacggcgcaggggaacgacatccacccggtcaatcagtacgtgctcaactacatcaacctgctgcttgagaatcgcgacgtgctgaacccggtgctgcagaatcgcgacgtgctggtccaggagggcgaggacgacgacggcgacgacgagctgttctccatcggggagctataccagctcgcggaggagaaatcgtcgctgacgagcaccgtcgccaggctgatcaactcggtggacgccatgatcgaggacaggtccaagatgtacgcagccgccggcgggcggatgcacatcttcctgctcaacaacgaccacttcatactgcagcaggcggagccttcgttgcagtcgttcatgggcgcctactggtacgcaaagcggaagcagcgggtcgatcggcgcatcaaggagtacctcgatctgtcctggggaaatgtcgtctcgtgcctggggtacgcagggcagagccgcaggaggtcgtcgcttttccgtagtgtctcggcgctggtggagttcaactccttgttgcagataacctaccacacggagaagctctggaagatcaatagccctcagctgcgaaccgtgctgcgcaattcggtgtgcgggaaggtaatctctgcttaccgagcctacctggagactcagggacagggcggccagttaggaacatcagccacgtatacccccgaggatctggaagatatgttgcaaaatctattcgaagggtgaacctttcttttccatatatatggagttttgatgatgtttttcttcggcgagtgcatgatgtgcgcggaacccatgacccaaagccaacacggacatgatagtactccctccgttttaaaatatttgacaccgttgactttttagtacgtgtttgaccattcgtcttattaaaaaaatttaagtaattatttattcttttcatatcatttgattcattgttaaatatactttcatgtatacatataattttacatattttataattttttttaataagacgaatggtcaaacatgtgttaaaaattcaacggtgtcaaacattttaaaagtatcttcgcgttgttttgctactttacttgttttaatcaatcatttaaatgttcttctcaaccttactacaacgcaccaccgttttctgtcttcattgaggacggttttgtgccacgctggcacgcagacgaggcgttatcactgactcatcacaagataggcagtaaattaaccgcccggccgtgtccccttctccgtttgactggtcaatgcattctgtacctccccacttccgatccgtaaccttaaagcaagtttaattttatagccaacctctagctctaaaaattaacacatcgtttatagctaatctaataagttacccatacaacggatgaaagtgggctatttgggtatgcgtgccgtcagctcatctaaagcaaataaagatagcaccaacagaggttgacagcgacggcacactagaggcggcggccactagacgacttctactcaccaaatctaaccgttcagaagagtacgtatattgagaagcagaggtgtgccgacatcatttatttttcttttctttttggttgagtgttctcctccttgtcgagatgtgagtttaagtgctttttttttttctgtatatattcttcgtgtacataggggccggattaatgaaagcccactgtctaaaaaaaattatactcgctagtgcgtagtattgtagtactccatctgtttcaaaatatttgacaccgttgattttttagcacatgtttgaccgttcgtcttattaaaaaagttgtgaaatatgtaaaactacatgtgtacatgaaagtatatttaacaatgaatcaaatgatatgaaaagaataaataattacttaaattttttaaataagatgaatggtcaaacacatactaaaaagtcaatggtgtcaaatattttgaaacggaggaatactattttagctgggattatggtctggttggagttagattcccttggatatgctgtagtaattgattactctaaagtcacctttaatatatatattagcctcgggagtgattattattcgagtggttttgcgattatgagtttttttttatgtgcaagttgactaccttttgtgcatacagatcagtagatggatccatccactggacaagatgggtgttcggtttcatttcatgggagatttttttatgatggaaagaaggtgtattacccttagtgggttatatgtgtatgatgtggagaaactaataacaccaccatatgtgactgagtgaagggtattagaatctaagaacaaaaatgtgtcgcaatgatgcaatggttatggtaacaggtgttccagttttggtgaaaagaaagaaccaaatttttccaagacttcataagaatttctctaattggtttgctttactccttattggttttgctatttattgttttattttatgcaagtattatttttaagttcaaatgtcgtgagatgataaataatgacattgttacaccttaggtgtcaacttttaaaaaaaaatcaatcaccttttatgtaagcagccaagatagatatattttctcgttgtttattaatggatagattgggcgtgggacgtaaggctacgctaaattcaatggtctcttagagtcccattgttttacagagtgtgagtaacacccatttgggatcgattgaagcagcccagcagagcacaaatggctaaatataactaaagatgcatcattacttatgggatgtaatttttataatgcttccctaattcattcgtcttgcttttattatttgagcatattttcttaggaaaatcatgaaccaattgtattgtttggtctacctaaagacattggatttttttttatgttatggtttgtgctattcatatttgagttagttctttattttccacatggtgaaccctgcaccctggtgtaagcaaaacacaaaatctaagtgcacctgtcctggaaccaacggtgaaactatatatacatatttgaagaatgatgtataataacacaatatatgttgttaatattttaagtatttaatttatttagatggcatgcaaacttgtaaaatgcacggtctataccacaatgacatattgcttatatatagcaaaacattggatctaaaattgtcaatttaattataaataaagcaacattttagatagaatataaattagatatgtacatttaaaattatggtcagcttaattctaaaattttagttttctctttttaatttgataacataaagaattaggaagagaaagagatggagatgtaaaagaataggaagaggaagagatagggatagggagagcgtacctacgttcttttttttttccggcccacacttatacgaagtcatacgtacataagtttttttctttttatggcccacggcagaggaagggattattttcttaaataatagatctaatctaatggtctaaaataccgggtccatcaatttaaatgaaaatcgatagttagattagatagtgttatgtggcggtctaggagtgtttgtaagagtgacatgttgcgtcttgagagcgtttgtagaaagtttaatggatttatagtatataataaataagatatgaaatatgttttatcgagatgaaaccagcgtgtactatttctaattaatatagcttagctgttgcatgtattgcattgcatgcctatacaataacaaaaataaaataatacattgtatggattgtttcaaccgtcaaataaatgtcttattgtttagtatatggtacctttggaattgtaaaaaatggcatttcccattaaaagtggccttgagccacctaaaagccactgtgatgtatggatggaagttcgttgcactggtcgttccttgtaaagtgatggagtaatgatggcctaagagcaagtttcttgtaaagtgatggagtaatgatggcctaagagcaagtttaatagtatagccaactactaactctaaatcatttatagtcaatctaatagcaattaatacaatagttaactacaaatatatactacatcattaataattggtctcacatgtcatatacacataacgttttagagttcgtgttacagctggctacaaatctatagctcacttctcttctctctcatctcttatctcctccacatgtgcttatagctgacttataatctattattgtactccctcgtttcaggtcataagatgttatgactttggtcaaagttaaactgcttcaagtttaactaagtttatagaaaaaaatagtgatattttttatataagataaatttattataaaaatatatttaattattaatgtaataaaactaatttggtaatgtaaatgttactatatttgcctataaacttagttaaccttgaagaagtttgactttaaccaaagtcaaaacacttaaaacctaaaacggagggagtacctgctaagagtattgattattaatgacaactcataccattcagcatgccaacgtggcacaaaaccaccctcaaatgggcgcgatggggtattgtgtagacggagtgccttctttattttgtttcataaggacaaaaaatagacaactcaatattgagcgacataaagtaaacttatcccaaagtaaatgaatataaagtcaaaaaaaattgagttagaactttattatatttaagttgaaagttttatttaatttgagttaaaagcttcactaaatttgaataaagcacttgtagtagaatttaatttcaattgaagatgtcaacatcaaaactactctattcgtccaaaaaaaatcaacataggcaatgatggaacataacctatgacaacgaatctggacatgctcatgtacagattcgttatcctagttaatatcccatccttattcaggttagcgttttttggggacttagtcttctagatcagttctctataccagaatttcatcattacttgtcagcttccgactgaatccttcatcccctattggatttgaacattttgaaggtcattctaaaggacaaatatttagacaaggccctgttagaaagcaatgcttcaaattttctctctcacccatctctagtctatcagtacatgtcccattgttagtctagacttgccgaaaagctgaagagcgttgtcagtctagacttgccgaaaagcttaagagcgcaggcatgctaccagcaatgttctcctaacagtcctagtccgtagctagttccctctccagaaatctatatctttaccgttgcccactattcagttaaatatgtcctgaacttccatgataggtttccaccctgccatcatccgacatccccttctgttcagtccgattgaattctaactttaacctaatagctttctcaaacatggctaaatccttaatacccaaacaactgttctcgcttggcatacaaattattcttcaagcaaccagtcagtgaccattgttgacttctaccactcgaatataaatctgcatgctctctttcggtgcgatgtatgtaccttatatagaaatgctcattgcaacatatattgcacttttattagtgctgacagactattttatggaccaattggtccatagtgtgcataaaaatacatgcgcaaatttgagtcaacttattatctaattagttggcttttttactaagtaaccaacaaacaattctaaaatagtttttggcaatgatgatatttctttttccaatatttttcataattactttgcaaatgtggtgaccataaaattgttgccaaggaacatgcaaaacatcgacatatgggtgaacgtattgagaatggaagagaatagattatagggattgtggattgtagtggagtgtggagctagtgcatgcttatatatgcttccttctcgtgcatggttatatgatgtttccttctctttggttgattgcgatgtgcatgtttctcctcctagtcggtagccagttccctctccagaaatcta

SEQ ID NO: 70715 - DNA, 650 bp, Oryza sativa
tgctagtttcattcattgataaacaaaagagaaagcttgtagatatacttggtaacttctccatatatttgtttattttaatggattttttttgacctggctttcagaggggctaaaaaagtaatttcttactctatactcatattttatttacctggaagttgtagctattttggctcttttgaactgttaatgttcatgctgtctaccgatttttatctgaatgatgtgttttgctcaagtgcatacgctctgctattgaaccagctgtttctggatctataatttgtggatttttggatgactttataatttgcaatgcaagagttgggttgtatttttcccgctactttaaattcataatagatattgattcaactttcaggctgtttggttttaatggtgggagactacggatggatgagagaattgatttgagcatgagcgatcctgatttagtccctctgattatccaggtaggggacactgatggtgcaaatctgtttttgtttatttttctgtagaattcttgtgggtcctgtgtcctgagatattttctgctatgaattgtttcccgatactttttgtattaaaagtagctcatcaggcttgcaacttggtttttccttcatttttgaatgagcatcaca

SEQ ID NO: 70716 - DNA, 711 bp, Oryza sativa
ttcctgcagcccacgactgctcgcgcaccgcgagagggaaccatgcaatcaagcctacaacgatggtggatttggcatccttgcatgacgctcgtaccgagggtgacggcacggggaagacctgacatgcggggcctcctatggctgatccaccctagagacactgggtaaaccatgaggaggccactatgcatggatactacgtccgcttaaacgaaaggtacaacgagtctacacccatacaaaagacacgggaggccggccgacagaggatgctgggatacgtgggttggggcttaatagacggccgacggcgctgaccgtttccggataccacccaaatcctttgtccgccccaaactaaaatagatgctttaaaaatatttctctgttcacaaatcatgtaatcaatatcatggaaatgtggcgctgatgtatacacatgccccatctctattaccttaccaaaggtaattgaccaagcataaagcattttgataaatatgagtatgcatgattctagaatatcatatctaaacaataggcataattgactgaggactcatacgtaaacatggttacgacggaatatcgggtaaacaatgatcaaggcatgctataatcacaagttggatgttcatcattgcatgcatttctatttgcatacaaaacaatctcgcaactgagatcagcatgttcaacgaatagtga

SEQ ID NO: 70717 - DNA, 925 bp, Oryza sativa
ataaaatatgccagataatcacgatgcatataatctgaatttcagttaattcatcaagcacgtgggaattgatttgtttaatataaaccagattagttaacagtatggtaaataaacctcatgtttctacttcgtttggagcatttcgtatttgacataacacaaaacatatttttaagcgccacaaagagtcagctaccaggtatcgaactgttttttttccgattttacaagaatatatcaaatttgatgatattgcaaaaatataaccgtgtcaccgaatcacctagcgacacctggtgttgccgaagggccaaattggaccaaattcccatttgttatcgcctacttcctccgtcccataaaaaaccaatctaggtgggaatgtgacaccagctaggataacgaatccaaattcattgttctaggtggtttcacatgcttacctatgataacgaattgtctaggtggtttcgcatccccacctaagttggtttttttggaaggaaggcaataggtgaaaacagccatgcattttgtgactttaccttcgctttgtccatgcttggtgcagtggctcatagcccaaggcaatgtccacatttaaataagctacatcacacagtgtcgcgtgatgaaatggtgtcatcatgtaaattgacaacacaaatatatttttatttgaatttcatatattcccacaagataatatatatatatatatatatatatttaaaaatttaattcccgagtattttccttagatcaatcatattttcaaatattgagatatacatttattttaatatctacaaatgcaattatatttctaattaagaaactaataaattgtatttttctattactgcacatttattgttccttaaaatgattgatgagatgcacatccttacatgttatcatc

SEQ ID NO: 70718 - DNA, 1831 bp, Oryza sativa
cacacatttggcctcataccaacaacttttgttttaaccaatttcaggaaccagtaccagctgtcggtattcttactctcaacaaaagcaaatgccaagagcaatacctgattgttcccatctacccctattgctgttagtatctagccccgatactttccagtcaagaatgtcccatcaatgcagagaacaggacgacagttcacgagtgccatcttgcatgcatgtagagctaagaacgccctttgcagcacactcttgctaggatgttcaattgaggggaatttcttcactgtgtaagagctcccagggtttctttcttcgataacaccaagcaggcgtggcaaattgtcatacgaggcttcgtaagttgcaaatctcatctctattattttctgtttggccctatacgccttggcatagctaatagtatacttgtatgtctcttcgatttgttggattattgaccttggttcatatgtgagattatcgatgacatgcgcatacatctcagatgcaacaaatgcacatgtaatgttcctgtggtatttttaaacaccaggtagaaaacatgtatgcttggtaacgactgacactgtccaataatctttccattttcccttataagcgtgcactctccagggacaaccatcttttttcttagcacaccgaacttcatattgcgaccggttgaacttggcaacccaaaactctctatgaagtgacactgcaaaatgttttacccccctcttcatatcttctgctctagtataaatcgctcccttgaataacctcattttctttgtactcccatctcacactatccttttcagagacgaccagactagaaaaatcctccctagcccattctgctggattaatatccgtctcatcatctgacgaatcacctttctctacacgctcgttgtcagaatcctccctctccatttcatccacaatggcaccgacagtctccccctcgtcggccactccacctagttgaatgcccactggagctactacgcccccgtcctctcgtgcgttgacctcttccacagaagtctcatttacttcagcacttggtccctcgccatcatccatgttcatctgcacacctggatccttcgggtgaacaaacggaaccatagctagaggctacccgcgttgcaatgcattttccacataccatctccacactcgagagttttgaactggcattagttcccaataaaaaccctcagttgcccgacttactataacattgattgttatgtcacttgtctgtggatcaactctcaagcccctcattaaccatccttttatagaaggtacactcctctcagccagtttatcaattcccctttttgatacaataaattctaatagatctaccccagttggcccgtaacggacgttttctgggccatggtaaacttgaaatatttgtttgttcgacatatctgtcaatgaaataactagatcatattactctttcatgcaataaacatctacaacgtaatatcttcttgtgtatgccaatgcaacggtaaagtattgattccaaactagcagatctacgtagttaccgatatctacaatacgcacttctagattagtacaactaaaaccctaaaaatataatgcatttattcaaacaaagtttttaaaaaatacacagtatttaactcaataaacacatataggatctatgaatattacctgtaatcggcgtctaaatccggcagggcttcgccccttcttctcttctcctcccctttcttcttttttttttactggatttgtggggggtggaatgagggctgggggctgg

SEQ ID NO: 70719 - DNA, 7670 bp, Oryza sativa
aatttcccattgtgctgaagcaataccttctctattcgagttaaaccgccccatcaacttggttctaataagatccaacattgtaacaatgggcttatccctgtaatcaatgatgtagttattgaatacttcgcttatgttattgaccactaaatctgtcttgcatgttgtgtcaaatgcatgcctagcccaatgcttagtaggtattttggtaagccactcccatgcaccttccctctccttcttcagttcttctatcgcaatctcaaaattatgtttagtatatgcatatacagcagagtccatgtatgccttgagatctccacccctaaaactagcggtgcaaaagttttggtgtatatggcgcttgcaaaacctctgttcacatgcaggaaatacatctttaatcccaccaagaagaccctgcattgaagtgatacattaattaaataaatagaggaaaacttaaaaggccatgtagataatagaaatgaacattaccttttacctatctgacattattgtccattttccgtatgggccaacctctccaccaagagcatatttcagttgttgcaggaaccaacaccaaccttcgtaatcttcttttcctaccaccccaaatgctaaggggaaaagattatcattgccatcccttctagatgcggcaagtacttgagccccattagtaagcttgacaaaacatccgtctactcctacataattacacatggactgttcaataacaaaaaaaaaaggatgcaagtcgtataataacacccaaaatagtatagtctatgaagggcctgcaaccatacttgaagccttctatttgtgcattgagacatatgaagaggcccttgaatctaggattgttaccaagtgggtacggattataggtagacacaatgcatcgactacctgggttcttatctagtacagtctgcaagtaatccctgatccttaggtattgtttcttgtggttccctaacaccacctcatccgccttgctccttgccctataagccataatctttgatatgtcaactccatatttcctcataacagcatccatcatagaagtgattttccaattttgggtcacttctaatgtcctcttcatacactttacttaaccattcactactcaccctactactatccatagttgtaccacatgtgtaaggaccaaccatattcctgatggcaatagttttctcattggcaatttgtgaggccaacatgtaaaatgggcaagaatcattcacacagcatacttttactctatcactatcatttcaaagatacatgtggtctctacaattgacaatgtggtagctcttaagtgcccatctaaattgatgaacatctcgaaaacacattttctcacacaatgcatcagaagaaagaaacatgctctcatcataccaaattctttgtactgaaagctttttcttttattcggtgctcgacaaggtgttgcttcatgcccatcatcatcactggaacataagtccacaatatcaccctcattgtcttccttgcccttccttgtagatggtgctatatgctggctacattttgctctggatgaattgacaacaactagaggggaattaacaactagagggcttggttgactctcatgttgaactgcaacttcattgccattccttctagctattggtgcagatcctgtgtctagtagattaatagccaatggaaatatgtcctccacatcagtatctccctcgcgacgctcatctggatcttctttttgcctcttaatctcctttaacttctcctctaaatcattattttacagttatagaaaatcttcatcaaccgatgatggatttgagctatctgacatggcatcattttccaaaacacacaagtcatccacctcggcaattgcatcacccaagtttgtaaccaattcagtatttgggccatgcagattgcttgactgagatacaccttgtctctggatgatgtacaagtttgcaactttttcactctcaaattgcttacacatttcatccacttgccaatcactttctatagcaaccatgctagctacacccctcccatcttttttgctgtagtagataaaatcacattctgagtagccaatgtccacaatcagtccaaccaaattgaagtagcaaatgatatctatgtccatctttttttgcacatgcatcaggccattaacaacaccatcacggaataaattcaaggtccaaatatcatcctccatcctatcagatcaagaaaatcacctatgactaaagctgcaatttagtgacaaaaaaaatctgctgcaacactatcatatccaacaaagattatcataggttcaacaactagaggggaaatttcaaacccatcatcacaattaggattcatttagaaatccaaatttgcagtaaataagtgaggaaaaggcattcttacctgctgcaaagttcagaacgaggctaatttgctctctccacaggtctccttgatccttcgttgggtatagatcaaatcacgtagtatgttgttggccagggcagagaagtggcgggagatggcccaggttagcaccaatacttcgcgcctaatgacgatgtggagagggtaattcccactttatcgtcatcgcaaaaacaggaaacaaaatcacggaaacggcgaaccggagcagaaaacgacgcacagaaggaggtgaacggaatatgggtgcaatgaaacaatatgcctcaaagggtggggttttgtgataaaaattagttaaccaggttttgtgataggtatgcccccaaaacttggggttttgtgatatttactcttaaaggaaactaattgattctacctaattaatagatagaattaagccgtcatgtcatagtcttcacgatttcttcttgaactcggtatcttatggataagtttccgccaactaattgtgctctttccttcaccgaatccactaaaaaatcttaccaattttggtgttaacagaatggagccgagagaaggaatccccagcttgcttggatccatgctagcttctcatcgaaaaagaaaataaatgggagaggagagatggagagaaagacttgaaacttttgtaaaatcatctggttaaagtggaaaaatcaggccacctctagtctaaagtgctctatctgtttcatattataagttattttgatttttttctagtcaaacttctttaaatttgatcaagcctataaaaacattatagtacttttttaacacaaataaacatagtatcaaaaaaacattcaatgctaaatttaataaaactaatttggtatttagattgttgttgaatgacaacaacgttcgtcgaagaccatggttcactcttggtggaagagtaaaacaatgtgtattaatattgaatttttgggatcccccattacatgtcccttatggtctatttatagtctttaatacgaactcatacaccctatgactaatatataaaggggatttacataaatacccttataatagggatatttataagggtaaaagtaacaatttggccataggcttgttagtggaccgtgacatgggccttctttggcaaattggcctgtttaggccccgtgttctttaattgtgatggcgaaaacgcctagcttggtggcaaatgctttcagctttgccctgaggtagctgcttgtgcaccaattggcacttcgctctggcacttcgccttgggcattgacttgtttcgataggctcggtcgaaggttctcatggcatgcctctaacatagatattgctaaatttttctataagtttgatcaaacttaacaaagtttaattagaaaaaagttaaagtgacttataatgtaaaaggagggagtaaaacttgggtaaaaattcgtggtctatagtacaattactttaatttgacacgacgatgggtagcttaaatatcttgtttgtacaatgagaaaaactaggtttatgatattttgtacacagttactattttaccaaggactgtaaccttcctgctattaccattttaaagagatatatatgtaccgtgatatttttctaaaaagttcgaaccccacaaatgttcaaaattcaaaccgttcaaatttccattggattcatccccgcgaatggggaatggggacgccgttgctctgcggccgacggccccacctgccattctccccgctacgccagccgcctagcaaagcagccaccgcctcgcaagctcccacacaccacaaccaactcctcccctcccagaacggcaaaacccccagaaacgccaaaccctctcgccacgaaaccctagggagagccgcggcggcggcggccatggcgaccggcgacgacaagcccccctccctcgacgccgacatcgacatggccgacctcgccacgctcgacgcacccgcgtcctccgacgccgccgccgccgcccgcttccgccccagggccaagggcaagccgaagccgaagccgaagcccgagcccaaggcggaggattcgaagctcaaggcggatgattcgattcccatgtccaagcccgaggagcccaagcctgaggctgccgcgccgatggaggactcgatggaggtggatggggtgggtccgagcgccagcgccagcgcggaaggggtgggagctgaggaggtggaggatgaggaggactacgtgctgcgggagattgacgtctactttacgcccaagcccttcgacgaggacaccatggtaatggctgctcgcagactcccttccgtaattgtgctgtaggggtggcaaatttgctaagttgttacttgttagtagtagtaaggaattgagctaatttaaccagttccaacctattgacccttttcctcttcacatgtacatgtccttgtagccaataattcagattatttggcctggcctgcacaaactgttctgctcatttttttttgtttaaagtgttctctatgctttttttgtttggttaatggaaaataaaaacttctctagtaaagttgtgttttgcatatagaaaattgactgattaaattaacatatataaaacgttaatagctccactacataagggcttttttccatgtttcaatctgataaaaaattgaacaggaaaatattttgtttttccttctggttgaattgagatacactgcaagtttgttggagtcttttggcagatgctatttttatcatatttattgacactaaactttatcatataattcacagctttacgtaatgcaatatccactgaggccgtgttggcgcccatatgagctaaatgaaatatgtaaggaggtacatgcccaattaactgtcctcttttgatgatttatacctaatttggaatttatactgtactatttaattgtactccaatactttattaaagggattatgactgtcaggttcgtgtaaagccattgagttcaaaagttgaagtagacttggatatcaatacagagtgtgaaaattatgacccagaggttcctctgccttctagactaactgaacaggtgatcatttcctttttgttttcactgaattaatcacatcaaggttttcctttgctgtgtacagagcaaactcttatgtatggccagcatatttctacaatccgcatggtgttcttattagttttggaataactcgatttcatatttttgctgttaaatgtttacgttcatctctgaagtacatatttcatagtattgccatttgagtgatcttttgcagtatagttaatcttcctgtctatttcaaattttttggataaaaatttatcaatttctgatatcatcttgatctaattattattaatttatccattggcaaaaaaaaaaaaccattgttactgctgaacatctttagttacttaattggaattggaacaacatattttcctgcatcgtgttctaaacctctagttcattttagaatgtaacattagtaatcaaactagtttaagttaaatttcctgctcttttttttgcggggaaatttcctgctcttatgatgttcttatgaattagttaatagttcactttcgaggcaagaaattggtatcctctgtatttgcattagtataattggtatttcaccttttctttttgttattttcagacactatcatcatccaaagcagctgatgtggctgattatgcagttggagttcttagaggcaacttggtaagcaacatgagaatagattgtaaggttaacagttaatgttcactaattgcactgagtagcctatgcctctatggaggtctagcatgctacataaggtaaagcaatgaacaccattccaaaccataaacctgaacttggtggctttgatggttgactactctttttaatgtagtagtgtaattattggagtggtggttagtgctttggcttgtgtataagttgctacctcccaatccaaaagaaacaaaccattcataagcaagcccttgtattgtgattaccggttgcttgtcgcacattgatcaggcactctactcatgccagtaagaatatctatactccttacaaaagggaatagtggtggtggtgctgcctccctaccaccaactcccagccttttattttgtagagaaaaggacatgtgggctagagggcccacatgtcaatcactgacaccactttttacttttttgtggaaaggaaaaaaaggatagtgtggggccaaagggtccacatgtcagtaacaaatatatacatcaatcaagagatgataataacatgttaatgataataattctttaattaattaaaatcccgttgcaacgcatgggcaatatgctagtgttcaagtaaatattcagtgaaaacaagaaactgatgtatatgccagtgaaatatggtggtagttgtttgtcacactctataaccaaaacaactccaatccaaactagagataatgagtttggttttccttgaatgtgttcttgtccttggtatgtgataaatgtaattcagggcttgctccaataaatcttttttatctggtgaaaggcctttcgcgtgctacaagttggactttatcagagttatttaaagtgttgctgtattcattgaatagaaccaatatcttgccctgttttacaggttcatttgaatcatattgatgcagtgatgcaactgcgaccatcaatgttacatgtaaattctggtcgatcaaatgctaggcaggcacatggaggagcgagtagtgatgctagcggctcaactatgccatcagttaaggtgaaacatttagtctgatgtcagggctggtactattttattactcttttacaagaacaaaaagctagagaaacctcagaacaaccagtcagctaactaatgttcttgtaagttccatagtctcgacaaattttgttcacagtagcagccataaatatatatatcaacctgataagattaaacaaatgtatttgcatagaatccctcttgtatcccttttgatatgattgtttgagttatgtatggtcatgcatttcctattaattggagtaagcatgtaaaaacttctgaaggactgattgcctgttagtagccaaatgttttgttagctgagttgcacgatttgtttagtggtctactgattttaatgtctggtt

SEQ ID NO: 70720 - DNA, 4301 bp, Oryza sativa
  unsure (1)..(4301): unsure at all n locations
ctacaaatttatcctttctggcattccatggattctgtttttactcttcacacgtatgatgcatcgtgtatcaggttgtaaagcaaggtgattgattgttttcttctcttgttttattctgtcacaagcggcatcttaaatatctgactaactatataaatttgccaaacaaacccaagcttttttttttagtttggtaaggatttgaatattgttacatctttgggttgatatgatcttaatcttccattgtgcttataaatctgaatggatttaggccagttcatggtttcaaatagattttcatgttattatctgaataaaatgttttgtgtattagtcctaaatcgtaattccaaaccctaaggataatcagctcatcagtgaatcggctaattagtttagcacttggaagttagaacttaatcaaataacatggaattccagcatgatataccttgatacctccatctatgctcaagaagacaggcactaaatttccattaatttctttcaatggctggcaacatattaattgatggacatgtcatgcttgtttcctgatgttactatgtttgaaaatcatggttttcttaacagtgagcaaattaaacaagccttacttttcttaacttgcctgaatcagtcaataagccaaggaaaatcaccattggtttttgaactttgttttagcaacattgaataaaaacccatgccttttcaagatgttgtggtccacatgagtacaatctgatctttaagatgattttcgatggtttatcatgagataatccaatcttatattgttgagaactgcagggagtcattgaggctggattacctcactcttctcttgagacaattgactgatccactgaagacaatgcccaaggtatatgtagatgtgatctattaattaactccttgttttgttctatggcattatacttgaatgtttcatgatgaggataatgacctggacactggcattttagaaatttatcttgatacctctaaatgcattagtgtactagccatcttctggagtattctgaagtaaggagtctctttaatttcatttgctgaaaaaaaaaatctgcaggagagcgtccataccttgacttgtgtacacggctcatcaattctgagttttaacatactgttatcttgcctttatgtaatagtattaccagtcttcttacaataattccctgttaagaatctttacctgagctatctgctggttatcttatatttgtaaaatcacaggatgaagctgtgcaaaaagtggtggagtttatggatacctactctttaagccaggaagactttgacacaattgttgaattatcaaaatttaaggttggtagttattctaatagaagccctatgtttgtgccatctattttatgttcattattaatctctttgaatggttttatacttattacaatatgtaatgtgctactgctaggtttgcccccttgtgtttgaaaatacttactctagatggtaggttctaggttgcatgcaaagttgcaaactgtatatttcactacactaatgatggcatttcaattgatttcgggaatgcaaaagctcatttgctataagttcttattgtgcaatgcaattttttgagaaccaaattgaaatttataaacatgtgatcgtgtagatatgaaatcagagaacaaacattttccaaagtactgaaagggagtgtttgcctgtgaatctttagtgccacaatggttgcatctcttgactgtttgtctatactcaactccctgcttgatatattttttctagaagcattaatgcatgaatcttttagctgagtaaacttgctgacttggttgtcatgattagtaatgccttgtcattatacttccaatggtgtttctgaatacatattttgttctgtagggtcatccaaatcctatggatggtattcaaccagctgttaaaagtgccttaacaaaagcatacaaacaaggaagtagttctcgtgttgttcgagcagcagatctagtaaatatcccaggcatgaaaaagccattaaagaaacgagtggcagcaatccttgagccagtgggagagagtttgcctgaagaaaatggagtagcgtcatctgaaggcgatgaagaggattcctctgatgctgaaaataatggtaagtttttctttttcagcaaatgaaatgactatcacataggaggctatagctgtgttttgcaaaaattgaaataatggagtactttctccgttttacaatgtaagtcattccagcattttccacattcatatcgatgttaatgaatctagacatatgtatctatctagattcattaacatcaacatgaatatgggaaatgctagaatgacttacattgtgaaacggagggaatacatcggatgaggacatgcgtgaaacgaagggaaacagaagttgataagtgagcatttgtaaatctggactagttttgtttcatactgggaaaactgtggtacagtaacatgtcatactgccatatcatcttcatatacatttgtgcttttattctcaatctttagttatgcaacttaggcctatgtttgtcagctgttgtgctagtagtgtttggcataacaatgccatgtcatgtcaattatattagcttcagcccaattttcattaggacatttaaatcgataatttgtattcagtgtatgttttgtttgaccaacctgctttgtttatttctttcagatgaactggtgcctggtgacacaaaaccaaaactggacctgcagagtgataagaagaaaggttctcgtactttgactagttggattctccaccagtcttaccttctgctatttacggtcgggcctgactctttggtaattttggttttatatccagggatccaagtgcagctcgacctgaagagcaatggcaatggcttgaactcgaagaagatgccggctggtagatcaaaagcttctggctctgctgggaaggctgctggaggctcaggtgggaagaggaagaggtaaacgtccgccggccgccgtcatttagtcggtggtgaatctacatgaacatcctctgatattctggggcagaatgcggttcanattttcttgcttgtacataagtcccaatcatctttgtaggcagtagtaggcaattggtatctgctccagatattttgtttcctcccacttgtatgagcttcatttcgctctactggcatttggccagttttcagctttgcaagacaacgtccattattgttgacttccgttcaatgaaattgtgtcatgtttgttgtccttttgatatcttgttgcattcatctcccaaatctgccgtagggtgacacattaaaactgcatgattctataaacctgtaattccatcttttcgttaatactagtaaactaggtgttacttttcttttttttagaaaataatgggcttacggaaaaatattatactcttgtcttaaaatataaggacttagtactagatgtaacattaacttagcactatgaatttggataacctgcctatctaatttgtactagaaatgtcgtattcaatcatacgttcttatattttgggatgaagggagtagtattttcaacacaacataaatatattattaaaatatattcaatgctaggtttaataaaattaatttaatattttagatgttgctaaatttttatataaactagaaaaatgttgcgttgcaacaggtgaatgctattttaatattattattgttatatggtttagttatggtaaatttattgtgggaatttgcttggatttttcttttggaaaattagcgagtccgacattcattcaagttagcatgcggagtttgttaaaagagatttcttatatgaattcttttgtgtttacaaaagcaaatgagcttaaaatccaactcaaacacaaatatgtattttcaaaaacgaatatccttaaaaaccgactcaaacacggatgacgtatcaaaatattggtaaaaatatctttaatttttataataagtagagatttgatcaaactcggaaaaaaaatcaaatgacttatatgatataaaacagataaaatatttattagtcccacgaaccgaacgaattcgatgccaggcaacaaagagttcctggccggcctacataaactctgtattaggtctttccgagctgataagtgatttttttataaaaagatatataggaaaattactttaaaaaacagtattcattctactttttaagtttatttaagctaatagtta

SEQ ID NO: 70721 - DNA, 1657 bp, Oryza sativa
ccatgcatggtgtctttgcaatcagtcaatcgtgggatcacattattcatcaaattgctggttcttatttgttacgtttagttcttgtttgttatgcatgaatttggtcggagaaaggatgcgatttataggacaccattccataatgaacaatgaggcaatctgcaaaatggtcatctagaatctatgtgaaactcagtttcagttttagaccttctcaagtattataagttacagatttgcagcattttcctttgatcagcagtagaagtttcatttacatgttctttactctcttgcttcttttctagcttgcttctgaaatctcaactttatttaggcaagaaggggacttggcctcacagcagatattattgatcattgcaagctagtccttagatttcctaaaggaaccaacagcacttgggtaagtattccctgtcatgttcacatgcagttacttctgttaacggatttgtgtccttcaacaaaggtccactcaagatatcacttctcttgacttatgcagtacaacactcagttcaaatattttgaaccactagaatacaactatgatgtctgtgaaactatccttctgtgggaacaggttagtacatggtttatgaattatgaaatagcgtgtttattagaatatatacttatgtgttaatgctaatatgatgccagtaccgtaacatgacgactgtgttgacaagggagtacttagatgtgcgacctgatgggtggttggattatgcagccaaaaggattgcacagctgtaagtttgatacttgttgcacatttgcactattcttcgtaacgaagtgatattaatccgcatactggttaatgtgctttaaaaaatatgcagcggtgctgacaaatgctacaatcgtactttgtgcgaagagcttcttagtgttttactccctgctaagcctccttttcatcctcgccagtttgcaacatgtgctgttgttggtaactcaggggatctcttgaaaacagagtttggacaagagattgatgcacatgatgctgtgttccgagataatgaagcacctgttaataaggtaatctcattgagttcttcatatgtatctaagctaacacttcatatgtatctaagctaacttatgtgaatggcctattttagtgtgttcttgttgaccccgtaggcagctaagctcctcctgttaagttattactccattctctcttcttaatgcctaccctgaaccccttgccatcttattagcttcttgttattttaggtgtcttctatcctaactccggacatctaaaaattatattttcttctaaagttggcacagattgacactcgtttactaattttgctcttattttatctttggcctgcagaagtatgcaaaatatgttgggttgaaaagggactttcgactggttgtcaggggtgctgctcgaaacatggcgccaatactaaagggctcctgtaatgctgtaatcctggtttcttccagataacttcaatcctgatagtgttttaatttactttttcataaatgagagaaaatataatattcgtattggtgttctctattatcctcgaactattagaaagcacatggcaatgtcgttcatttctggttttcgcaacttggaagatgccttgtt

SEQ ID NO: 70722 - DNA, 1273 bp, Oryza sativa
tgtgccctttgagttcttcctgctgtacatgtcccttttgttgaggaatttctatgtaatctgttgtatggtgaattggcttagcagatcaattattgctaacaatagacaattttatgtaacctgggagtttcttgtggccaatagtctcaccatatgatgatgatatcatgtgcctgttcatactcctcctgctgattaaatctgggcattattttgtgcaaatgtttgatgatatccctggcatttacaaactacaaagaatgtacaatggtggatttagtttttggcgtagaatatgtaggcgataaaagtgatgaattatcttcagtatgtcatgttccattgcgcatcatgaatctaatacaataacgtgtaacagggtactctgctctgatcctaggtttattgtactgctgcattagcctctgttagtttggctacaaacttactgcagtctgcaaattatacactgcttccattaccttaattgtttgatacatcatggtttcctgctgttgagtaatttaattactggatcatccaggcggcttgtgatcaagattgttcagctagaaggaagactagcaagtactttgcatccaaaacagaaaaggaggaagacaccagtgcaggaaaaggtaccgggagaggtttgcctaaaagaaaacttcagaaagtcagtgatgagcttgaggatgacatgaagcctttgccagcaaaggaagtccataaagaagaagaagatgatgatgacgacgactttgtggcaccttcaaaaaggaaaactccggtgaagccaccaccatcaaagaagttgaagggtgcatctactgctgaagctcatggaaagactggtcttgatgatgataacgaggacaagatggatgaagacgctaagaccccttccaaggcatctggaagtggaaggggaaggggaagggggagagggaggggaggaagaggagcaggagcagcccatggaaagacaattggtcttgatgacgacggtgaggaggataagatggatgaagatgccaagaccccttccaaagcagctggaaggggaaggggaggagcctctgggggaagagggagaggagggggtgggagaggcttcatgaactttggtgaaaggaaggatcctcctcacaaaggggagaaggtagcttattccttcttgttataatttgccagaaaactcaatcctaaacttgttattcgtgttctgtaggaagtcccggagggtgcccctgactgtttaactggtttg

SEQ ID NO: 70723 - DNA, 2565 bp, Oryza sativa
agacttgtatggttgcagtccgaatgaccttctgacggggccgcccatacctacctccacttcccccgaaagcaggcgcaacgtgggaacatggctgtctgctgacgacatgaccagtgtcagtccggtcacaaatcggtcattcttgtccgccccgcgtcagtttatcaatctgcatgttcgcccttcttcatacaatatcttgcctgtaatggttaggatgaagcctggcatatatctgaccggaaccaacgtgccatctccaggagctaacacgccggttccggctagggacgagtgcttggaggctctcgtcctgacgggatggggcgaggcgtgcgtcagaccgcctgtcgccacctaacccacgatctgaccggtctgtgaccggtcacagaccggataaacgagcgcgctgcactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgaggcggtagcggtccgacccctcggggagacaaagagaagggcggccatatcaccctcgggcccgacccccccgagggggttaggccacgtgggtgatcgtgtctgcctcaagtctctaagtcatgatactcccggtcccatgtcaccgacagtagctattacatatatggtcttattgtattttttttacagggatgccatattaaaaaaaccattatcactagtgatatgctcgtactaatgctactacgctatttagtaatgtaaaacaaacaaccaaatgtgacgatatatgttttaagaagcttctcacaaaaacttaaaaattgttactcactccatattcaaacaagaccgtatcaatcaaaaaaggcacatcataaagaaaaagaaaattaaataatctatgctacgagcctttaccattgatatcgcccctaagaactaaattacctacatactatctattgcattgcgctgatggatcatgcatgtcttccatattggaaaaacaaacattatgttctacagcagcatggattggttgttgggattccaaattgttatgctcctgaagctccctgttggtaacggtaggcacaaactggcacaaagtaaatcatgatcaattaaacaaaactcactaaaaacagtggtactagttcaaggaaattaaatggcatcataatttaaaagtatgctcaaggaaaattaaacaaccatgttatcaactattacaattcggactcatatttcattgtgaacttaataaccataccatgcttataagtcatagtagggtaataccatagccaaacttaacgcgtgacactgacctgaaggaggctaatacaggaaagaaaggcatccaaacaccataaaaattaaaaaagaattaacacaactactaaatggatatatatggtcaaaagttcatacacgagtacttatcccttataagagaaaccacaacttaaaataagagtttatccgactaacaaaagagaacaaaggattaaacttctagcctccttctataattccaaccatacttagaaaaaggaactctggaactctcttctcccttatacttcttcacctcgattgccttatcttcttaagtaccaaagactaaagtcatacccggtatgttactttagatataacctgcattaaaaaccacatcatttctatttaactgtatcgtcgaaaataacactgtaatattaacaaagattcggtttatgggcttaggatgaacacctttagccaactaccaaaaggttataaacattagtgggggtttcaatgccaaaagtaaagaaaattgctacatgtaaacattagttttattgaaaagttgattgcacatattttttaaggtttctatagtatttcttttactctttacaacaaaaggttaacattgttcttaaatttgctacttgcacgagcattacgtttgaagtctaaaccacattttttcttatcttacatcgaaaactcatttcagcatccaattaactccaaatacaaatacagccgttcaaattaacatttcaattcaatgattttgcccatatatagtatatccaaactctgttaccctcatccaaattttcttttatccctatacgatatgactttctttcatagacacatcaatcacacacgttgagagaacctaactcccttcgtcacataaaaagatgaatctaggataagatgtaatacatttttagtactatgaaactaaacagatgatatatgtttagattcatggtagtaagatttgtcacattcgatatatgtatagatttatcgtactataatatgtcaaatttaattctagatttatttttttaatagaatgaagggagtatgttggatttttacttgagagagagagaggacattgctacgagcaagagcaccaagccacaaaccccatcaaagcgaaaccaatgaatgtttgtgtcacgcacgctccaccgatccatccatccagcc

SEQ ID NO: 70724 - DNA, 1408 bp, Oryza sativa
attataattttacaataggccaatctacaagaaaaaaaagcagtgttctatgctgtgaaggtattttaaaagtgacttgaagagatgcatccagtgttacctcaatattcagttgtccactctgtggagcacaacgcagtaaagaaaagattgacatgatacttgagattttgccaaaatcaacgctcaagtttgaagtccttaagttccggaacttccatgtaattctctccaatggattttcatcgacctgaaaatcatgacaaatttaagttagactgatatatgatcatcaatgcaacttgatctacttgcttgcaaacagtgtatgagtaattggagtatcatactcctatagctgagctgaaattgaatctgcctacaggtaggatagaggacacacactcacacacacactcacacacacacacacacactctcttcatgccaaatgaataatgaggattaaaaaaggaccacaaataacaaaggaaattataccagtgtgattgggctgtccaaattcagaatgacagattataattttaaagcaattacaaaaataaaatgacgatgaaagcatctgacgttgatgcttttttgttttgtttttggaatggatagaaaagtatatttggagatcataacgagaatcttatgcaaaaaaataaatccgctagctctaaaaaccggttgcaaattcagcaaatttattattggagacaaacttattaatgggttaaatgctagagattgatcaataaaggaggatcttgtgtgcagatgagcaagtttcttttttgaatttagtgatttctaaaaatagtttccgcaaatgaacctctagcagaactttttctagaaagagactctcatttctttgtggggaacataaataatagactccaagtctcaacataaattgcagttggttcacaaaaagcacaacactttcataccgtgtaggccatgtgggatgcatcctagaattcacatgttgtccatgactctatgaactttaacgatgtgctctatagctggggctttgagtggtactgctaattagggggtacttatacgcacacataagaacagggcttgccgcctttctctccctcctctcctcctgaatctatatataaaccacccttcgtaggcagtttgtttatagtacatctatctatctatctatctatctatctatctattatatactaaaagtccattaaactccctataaacgctctcaagctgccacgtggctccctcaaaatgctctcatattgccacgtggcactctaatataatagagaaatctgaccatcgattttcatttaaatcggtgcacccattattttacatcgttagatctattttaaaaaccaaaaacctcccaccggccccacca

SEQ ID NO: 70725 - DNA, 16019 bp, Oryza sativa
caacatttttcatactttttatgctaaatattgtaaaattcactaatttacattattttcttagttaatatagaaaaggaagaaagaggtacaggtcatttaaacctctaaaataggcataagggcatatataattaaaaattcaattcataatgctccatgttctaccacaaaggaaattttgtgctgaaaatattattcatggacaaaaaaaaataacatgtcaaggtaaatattgcacatttgagaatggctttagtactagacaatgccttcttatttgtggtgctttgcactggagaacaatgttttttttcttatgattaccatcttttgtcataaccatgccatctgaagcttgtttatgatgtggttgcattattacaagcccattgttgtgacctgcaaccctatgctgccgttgcagattgacaggagtgctagagtcttgtggaagtagtggattagagttccttttgcttttggagttaaccatttgcagtgcaatcctcaacacatagtctgcctgagaaattggaagaaaaaccaagatttgtcaaagttgcttggtatgttatgctaagcttaaccttgaagtgaagctaacgtgacacaaaaaacaccaaaaacaagagtctctgtatgtgtttataataatggaagtatgttttgggttttgcatgcaccaactatgagcacataattatttaaccgtgggtagcaagatctaaattttgttcgtagagtcatacacctaagattccaccggactcctgatttctactctattcctattctaccagctagatactactaaactaaacttgagaggggagccactccacacaaatacaaaaaagaaaagcagcccaccctcaacaacacatctccgtgcaggggagggtctattgtgtaagcacgtgaaaagaagtatggtaacattgtaacggtagttttcatatatgtacaacataaaatagtttaactgacacattttgctctatagaaagagaaataggaacttgccattgatctggcaagaagaattaatcacccaaatttgagccgcgcaaagacgacccataattgggtgctggggatttaaacctacacctccaatcctattaatatcctagcaaccaaaccatagcctagttggtacatattttactacggaatcaaacgtgttttgaagtctgaacattatttgcatagttccaatccatagatgttctaggcatatattaccaacatttttcatagacctcatgaatcatactccctccatcctaaattataagtgtcagggttatggataccacatacctaatagtagttgactaaatctcggcaggatccaccacataccatgtcctatacggaagcaaccttcggatataggaggagttccggaaaaggaaagacaaccagagttctacatggaaacgacaaggactacccggattgtatccatattagtttccttagttctacttagacaatgggacacctatgggtataaatacaagccccctaggaggacagggggacacccaccacgggacaatcaacacccaacacaatcaacatagaagcctacatacgccaagacacgccgccggatatcgactttagggataagcacgactagtaccctacggtgtctccggatactgtcaggagagacgaaagcgctatctctgatctcgctgggcacggattcgaggtggaaggctaccctgttgtcgactacgagtcagatcgtcagaccgccatgtcgacaacagttagataggctaccccaaatattgtactggtgtgattatcatgaataagagcaataccggcttcggccaacaggatgtagggttattacctgacagttcaggagcccgaacctgtataaaaatccctgtctccatctctttacctcagtctcgcatatatcctagcaacgacgatccccatactatgcaaataccagaattgcgacatcaaacgtcgacaataaggcctatatttttttacacggtattcaatgatatactttaaccactaatttatctcatgttatgtttccaacatatatgaaattagcattgtatgaaagtactttaaaatatgaatatagtgatataacatgcataatatttagcatatatatggttagtatgattattagtcaaaagttatcaagtttattttttcttagaaagagggcgtcctataatttgggacgaagggagtatatatttccgctattatccagaatgtatcatttccaagtcaagcattaaagtagcatcaaaaagtgctaatcagtctaaaagttggcaactgctaaacttgtgtccttacattggaaagaggagggcaccatgataggtgaccactccaatttattcccttgatctggaaatcgttacacatgaacgaatatgtttcatttatcttcttctactgaaaccacaattacctccatatatagttaatagcatacctagcatacctttctagatatgaagatgcggcagacacatgatagaggatttaatttgttatgaaacagtagggtgcagatttagccagctcgatcaattgtactccctccttttatacagaatgcatgcttttcaaaaattcaaactttgtagattttgactggtaacagtaatattttaagtatatttagttataaaaatgtagcatgtttggtatagaccatatttcaaggggctttcacatcatatcagttttctagctactaacagcatattacatacaaatctttctaagtgaaaagagaatctcaaaacgtcaccttattgatccacataagcaaaaaattctagaccatcagataaagaaaaggagggtggaagtagccgttggattggattagtaaaaaaatagtgaaacattattctagagctttatagccttctttcttacagtggagagagagagcgcgcatatcaggcaacggttatggccggatggactagcttggccgatcataaataaatataataattcaagcacaaagattgaaaacatatgctctaattaaccaaatggtaaaaggaagaaaagataaaaatatgattacgtacgcacatagtaaccatcatgatgcttaaaggtgaaatctccaaaggcaatgaaatatcaataagacgcatgcatgctcgacgaaacattcatcaggcaacggtggcaacggttatgcccggatggactggcttggccgatcgtaaataaatataataattcaagcacaaagatcgaaaacatatgctctaattaaccaaatggtaaaaggaagaaaagataaaaatatgattacgcacagagtaaccatcatgatgcttaaaggtgaaatctccaaaggcaatgaaaatcaataagacgcatgcatgcttgacgaaacatttgagtagtgcaattaatgggtgttcttctaacattattggtgagtaaacatggcaaaccattttatttcttcaaatcagacaacaatatttcaaaacaataataaaaaataacatcttaacaactatagttacgattatgatgctatgctcaaacatatacctataatatttagcaacgacaggactaataaaactactatttattttcgtgataacatttatttattacatatcaatataaatatatttgtattgaatgtagatttttggtcaaataagtttttccggacacctattaagtacgtaaaaaaatatgagaatggtagggtcatgcaaaaatacacacggtgattagtggcaaggaggcagcttaagcaaaagcgtaaaagatgattagggagggagaaatggcagcatagaagacaaatacaaattaaacccaaccctgtccgctacaacaatcctaaaactctattctacatataaattatttttaaaaaaacatacaaataaacccacttctcatatttataaaccgcgaatccaccttcgccgatgagtgtagctatagactaagcataatttatcaatacaaacaacgtgtaaatgtaaacatgtttagtacatagagaggttaaagtcgtgcgaacgcacgactatatacgctagttatgtgtttaatgtacttcaaatttcaaggtgcacttccaccatatttgttttcttagctacaaacattaaatgtattatatcataaattactgtttgaccaattatttctcatatataatgaggagggagtaccttgctggtagcaaccatgtaagttttgtcctcttcattagtagcattatcctgaatcattttcattcttccaggaaaatctattggaaattcctccagaagcttttccatcctgtatacataagaagttactacttttaccaccaggtctataagatatgcagtacaactttatgctacatgcatataacttcggttgttgtcactctaattgattgagaatggatagtgtaattgtttttaatgaattctagtctgagtactgcagctgtatgtgttacagaccataaacttacaatgattgtattaggtgtaaccagtagctaaatattgagatggcactggtatatcatttcaatcttgattctttaattaatgctctagttcactaacccttataagaatgattagttaatttgacacatgattatctgtcaagatgagacagtaacatagtcatgtgtcgacttacaaaacaatatggctgcaaatattatagaaactagttgatttcccacgttttgctatggaaattattaagcaattctcgagaaaatagaaaatatctaattccttgtatatacatatatttctattagcatatgtatataaaattgactgaatgatggttggaatagtaaatatgatctgatatcttgattatatgattgtccaattaactatctgattaaatatatagcatttagatggggtggtgattaatggcattgtttaattagtgaggaagtggaggagacttttatctaacggctaataatggaaagacttgtcgatccaatggttaaaactattttgatgacgtggccactacaagataattaagctattgccaccaaattattacaacaaaaaatatttcgtagcaatatattgtactatagcaatgataatttttctatggcaaataattatattttattgcaacgatctacaatcgttattttatttagtacttttgttgcaatagaaaatgagatatcgccacgaaaaatcttactgttgcaaaaaacatgttctatagccacaattttaatttttatggcaatttatataatacatggtacttttcactactttttgttgccacgatccacaaattcattgcaataaaaaaattgtcgtctcataatttaacttattttttttcatatggatacggattgagacaaattttatatggaaattgtagctctcgacgagatctataattttatagttgataacttttttatttgaaatcttttagatatttaaatctatgattcaaatctcagttagataggctcaaatggaacgatatgcatattccaacagaattgatgcgtaggtgagttggtaaaggagatcatgcgtgaaggataggtcttgggttcgaatcctagccaatacatggtgtaaagaaataaatataaatagataggatgatagattaataatttaaacttttaatttggtacgtagaactaatgccacatatggagtggtggcaataacttttattacaacgatgtaaagtgttgcaatttgatttttttgccacatccattccgtggcaacatctaaatttattaccactaaataaaaatcgttgcaataacctattaccacgctatttattaccacggctagcaacgattttaaaattgtggcaatatgtatttattgtcataattttagtattgatgctacgatttttttcgtggcaacaaatgatttttttagtagtgggctaaacgtgatgcctgtttgtggtctcacttatatagaaagcatagatttataaatttggagtatagcttataatggaaggctcgtcatatgtatatcctttatatttacaccaccatccacacgcatgacacaaccctcttgggtcggtgggatcttatgagcacaagaatatatatttgtgcatgtagcttttactgatctcatttctggattgatgcttggttcgaatttaaaatttatgatatatgctagtaaagcctaaaaaaacacccttaatagtgaaggcagcatgactcatggttcttatgaagtgtatgttgcccaatgccaaatatccttttattagagtgcgcagcccggctcaccaaccaaccgtgggcgtgggccattccggtcacattgggcctgctccaccacaggcccaaccagagccacaactttaggtcttgggcctacacaacccaaaagactagtctgatgggtaaggaccgtccccaccttttaagttgtgctcccctatcatcaattaccgatgtgggactaaacccaacaatctcccccgtcacatcaatccatgtgaccccgaagacttgttacttggcctccccatcatgtgacctatggaaatcgttccgggttctaaacctgggctctgataccacttgttagagtgcgcagcccggctcaccaaccgtggtccattccggtcacatttggcctgctccatcacaggcccaacaggagccacaactttaggtcctgagcctacacaacccaaaagactagtctgatgggtgaggaccgcccccaccttttaagtcgtgctctcccatcatcaattaccgatgtgggactaaacctaacaatctcccccatcacacatcgggcccaacaatctcccccgtcacatcaacccatgtgacccccgaagacttgttacttggcctctccacaatgtgacccatggaaatcatttcgggttctaaacctgggctctgataccacttgttataaaagttagtcaatatagcggaacgacgactaaccatctcgatatagcatggtgattctaccacttctaggtggcatatattcatcaaggtggagtttgttagaatagatgtcgaatatactagtcctatttggttacagttggacttggagttggaataggtgtaggatagagttagagtcgaactctgtcatatgctctctcttaaataaagaggggggcaccacaatgtaaccatggcgactacgatgtagtgtagacacgcagagagacgatgatagcgtggccatggactcttagcggctaggagctatattggttggggaggagcgcccataattagagctctggggatgtaggcttcagttgaacctcagtaacaagtatcatgtgttcatctggcataccttgggtgatcaatgactgaagcgatcgggaaggttagtcgtcgttccgctatatcgacgaacttttataacaagtcacttgttagagtgcgcaacccggcccaccaaccatgggccacccaggtcaaattcggcctggtccaccataggcccagccaaagccccatcatcaattatcgatgtgggactaaacccaacaatctcccccgtcatatcaacccatgtgtgaatgtgggactaaacccaacgatctcccccgtcacatccccgaagacttgttacttggcctccccaccatgtgacccatggaaattgttctgccccaccttttaagtcgtgctccccatcatcaattacccaacaatctcccccgtcacatcaacccatgtgaccccaatgtgagactaaacccaactatcacccccgtcacatcaacccatgagacccatggaaattgttccgggtttcaaaccttgggctctgataccacttgttagagtgcgcggcccggcccaccaactgtgggccacccaggtcaacattgggcctgctccaccacaggcccaaccggagccacaactttaggtcctgggcctactcaacccaaaagactagtctaatgggtgaggaccgcccccatattttaagtcgtgctcccccatcatcaattactgatgtgtgactaaacccaacacctttcttggtcttttctacagagtgtatattatatctctcccaattaaaattaccctgttagaagtaattacacattctagattgttataaaaatagtgtttttgaacaatttagaatatacatagaattcaaaagtactttgtaaaaataaccgttgagcagggttgacagtattggtggttaccacatggtaaacgtagtaaattatcttggtggttcgataggataaaccgatgatatgatttggcaaagaaaatttaaatttaaatttgaaaatgaagaatattcgaaatattcctacaagtagtaaatacattctagtgctaactagtaaaatattgtgtgaaaaaataaaaaaataacttcgttcttttgagccaaaccaaagtggaaataacaaataggaaaaagaaaagaagaagtgggttgggccatttctcgggtaccatgtatgatctcggggtatatttatacttcaaaactaacaattagacatgcatgtaagtgtaaaatagaatattggaataatcattaaaaatgtataaatagatgtttggatggaatgtagggaaaaaacatagaaatattaaaaaagatgttgtgcccatcagttcaaaaatcaaagatcagtgcataaactatatttgacatagcatcaatcgaaatccatttgttaatttagttcctctccctattgagatccaaccaccgcacacaagcccgagcaagaatgaattgattcaaatatttgagctgccagagccaggcaacggcgagtggagacgcgaggtcaaagcagatggtgacatgggctagcttgagcggcagtgaccttggacttgagcattgctggcaccaactcaagcaggcggaggcatggaaggcagtgggctggcagatcaccgttggccggcatggcgtacgtgtgctagagcaaccaaaacagtgatgcaccgttgttgaagccatctcgcccaagctcctcatcgccattcccatggttgacaaatatgttataagctgcctgatcttctcgattccacaagaaaaaaggaaatgaagggaaaaaaaagataggatgtgatggaaaaatttcctacatttatcgcgtggaatctatagcaaaggaatatttcatccggcattactattaagtcattgctataatctaaaaggcgctatatatagtgatataatcgataggaatctaaatcctacaattttccccttgttttcctccattccaaaggaaccctaaaggttaatttaatctatattcaaagcataagcatgagagtgaaaagaagcaatcttacgtcatctcgattatcgtattgcgagcttcttgagaaatttgggtcctccagttgagggattgtcctgccatgttgtttgagctggaaccttccatttaaagagaaatatggtttccttcgtgaactgagttgaaaatgatggaaacaatggaaaaggaagagttttatcttgcacatagagtggaacaagcgatcggagatttataggggggaggggtggtgattaagggcatagatggtaatattgcattcggcgcgtgggtagttgggtgttgcaaagtttctctttagtgactgttgttttttgtttacattgttacgtgtgtgaacctcgactaccacgtgttggtatagttgcaatcggtcataatacttgacagagagcatgcgtatcagcatgactatgctcctcctatgttgccaacaatctttattggctgcatgcgtaatggtcccgtgaatttggcattacatatcaagtatacacatacaaccacatttggtagtagtttccagttgttcaccatttcaatgcttggctgaacaacatgtcgacgacacaatgtattgtccttagagaagatcagacaaaattcctacacgagcacccagcagcgagcaccctagcttgctttgcctctctttcacgaggaacaaccatttcacggtatcacaaccattgacagatggcatgtgtatgaattttttgaggtggaaaacaacagtccgatacaaatgtatatccttgttcctcgacttgaaaaaatgcacatgaaagtaagcaacaatattgaactgataaaatctatctatatgttcttggttctcagagacaatagatgtctagatagccacttgacttagccagatataactagactgatctggcaaccgaaacatgatatatatctaccaccgtaattttgacaatttgactctttgtaaaaacttattataataataggccgtgccaaaaacttatttcaaaaataagccgtgacctcagcgccataggaattggcgctgagatccaccatctcagcgccactaattttggcgctaacctccatctgatgtggcttgtattagctacatcatcaagtggtccgcgccatactctttggcgctaaccttgacagtagataaaatgtaaaaaacggtgactcctatcacgtaggtatcatttgtgtggtggtaatgcgctaaagattctagcagtaggtcctgggttcgacccctacgacatgcacattttttttactttttcctactatctgctatagcctaatttgctaccaagatcataagtttggcttataaaaatcattttattctggactagacaaatatgaaaaggatacatattataaaactttttagatatttccatgtattatagattaataaaattataaatatattcccaacatttaaaaattattttgaacttcagaaaatatgtaaaaaaaaatattgtgcatgttctcaaatttttatataccttaattgttgtaattgacatgtatatcgtcatatgctttccaaatttatttttattataataaaattgagaaaatatgtcctcaaattcttcctaataatgtgtgtgtgtatatatatatatgtatatatatatatatatatatatgtatatatattcatatatatatacatatatatacatatacatatatatatatatatacacacacacataacattaattcatattatttagttataagtaccaagcatggtaaggaaaaaatgtaaaaagatgaaacaagaaaatggtactgtgggttcgaacctttatcctttgaccttagattaaatcacctccaccactgagctaccgtaccatgaagctgtgaatgggagattcgtctttttagccagtacagaggtcagcgccaattggcgctgacatatgatgatgtggctagtttgtgccacctcagatgagaggttagcgccaaaattaatggcgctgagatgttggacctcagcgccattgggtgacggctcacttttaaaataagtttttggcacggactatttttagaataagtttttgtaaacggtcaaattgtcaaaattacggtatctaccaactgatggatgacaaacaacccgcaaaaattatagattgtacattatattgtagtacatatgcaaaccagcttggtcacaccgatatcttggattcatctccacatgtatagagctcacatcaatatgttttactctttgtagatctatccttgtgcacagcatcaatactaacggcaattagtttctctccctaattaactttcttttacagttttacctttgatgtacagtatctagcaacgcaaatctgatgatactagaagggtgctttacgtacacatcgcacatcaccttaggtccttaaactcccccatcatgtctttacctaaacttaattgctcttgatccgctgcaattcattattatctctcaaaaattcctcaagtcaaaacaaataaacaaaccataatctccactaaggctacatctcaaatttaggttgaaataataagaggtagacacttgatcatttgcacagatgtcagttgacttcaaatttaccatacactacatattatgagggcctgtttggggaaagcttttggcagatgcagtttctagcagaatcaaaaaaacttcccccaaatattctagcttttagattctgagaagctacttttcccagtttctccatattctcacgagctgaatttctaccaggtgttcctcaaacagacccttagtaagtgacgtagaagaaaagagaatgctaatttagctaagtttattaataaaatattaatatatggtcttttatatacaaatgtacaccctttacttctagagcaacaacatatagtttggaggagagagactactatagcacaccgatttcaaagtagtacataaaggctgtgtttagttggatccaaagtttggattttggttgaaattagagatgatgtgactgaaaaattgtgtatgtatgacaggttgatgtgatgaaaaaggactgaagtttggatccaaactttgtatctaaacacaaccaaagcatcaaatgacgtagagtaaaaaaatgtttgcccatttgtcaggtgaaggtagagaatttgatgtgagagataaagaaatattttcttatcttttgtggtctccactacaagatgtttatacacacaaacacattctaaaagtctcataaaaggaacctccaccttgatacctcttttccatattacacgatactaagagcatcaccaagcgttttcaacaagactttctcgagcattttggcttgtctagtttttgcaagtgaggaagctcatctttggagttcaaccaacgccaaggtgttctcattgattatgaatcccggttaagtaggcttgtgaattacgttgttgggagggtcttgttgaggtgctttattcttctcttttgctctagttctgtttttttctctttttgtgttttgtgctgggagaggggaggggccggtggctcatctccaagatggggagaggtggagaggtgagatgggttggggctggaggaaatttatattattttttagattttgaggcgtccaatttaaaattttataactgcacataaattgaaaaaaataagactaaaatataaactatctaagggctaatattaaaaattgaaaccatctccaaaaccattttgcattgtgagaaaaacccatctcaaatgtatagcctcaacctatgtggatgccacatggcatcggatatcactcctggataaattgcacaaaccacccaattgtcactctaattttgagattccaccccataagcccatcaccaacacacatgagtagttgattcggcccattccttctgacatggattcgtagcagatcatatcagctaggccaggctcgtctagtgtggctatgagttgggttcaactcgagctcattcttaggctagttagaagtatgaagatgaccgtaaatgacgtgagggctgagcgtctaggctatcgatgatagtgatcaacaacaagcttgcattggaagaaatgagacaaatcaactactcattacacaaagggggcaatttcaacctggtagtgttgggtgtgtaggcatttacatcaaaaataggttatgtagtagaatctcaaacctatagtgacaattacggtggtttatgtaattttgcctcaacacctattcatgccttaagagcaagtattgtgagcccctacacacttgcccccaaatgtcacatagcagcggcagaccctggaggggtgccaggtatgcaccggcatacctacaaaaatctataattttttactagtagtatgtagtatgcatcaggtgggccaaaacattttatgtgtgccttgccaaacgaaagcccaagatgtacaagcccagaagttgcacggctagaagatgcccatgtgcatctatgccctgttggctggcagcatggcactcacgcgtagggtttggcacttcgtcggactagcaggcgttggcggcggcgcggcgcggtagcgcggccctcagcatcagcagcctcacggcgagtttaggcgtcgtgggtctcgtggctttgtgactgcacagcaagctggagacggaggttgccagccaccggctagacactagctagcgcctcggcgcatagcggcagcgacagcggtgactgcacgaggaaggcaacgaccaccggccaggccaccaaggtccgagatatttaactatttgtcatttttagatgtggcaattaactatttgccactagacctatatgctatagacacatatagatctatatgtatttgagataggggtggcaaatagttaaatgtcaaacctaaaagtggcaaatatttaaatgccccgcagggtccagctctgggcatcatccgtccatatttaagtatactcgttcactattattagcttttttgtttctctgatacttttcttctcttaacagaaagagagaaagggagagagattgattgaagaattgaaaacttgaatgaatgagtgagaaatgtgaaatcgatgagttcgaacttctaaaattgaatccgcgtttatgggatttttacactgagatcaagttgaatcattggaaatatgaagaggaattgtggcatttctttctatagcaaggaaccatcagcttcacctaggccatacccgatgcttctttcttataactgaatgactgatggtgttgggaaattttagaagagtgattatccccttatgggaaacttaaggacagggatgaagactaaaaatgagttgtaatcggtgttgttctctgttccaccttgggagtgttaatacaacaccagttgaataattatattgtacttcccaaaaactatattgttggcattaagcattcaatttacctcttcaaagggggacacacccaggaaaaaaaaatcctacggtgaggtggagaagagaacagaagagagagaaggggagaaatgagagaaaaggaagaggaaattgaacaaacaaaaataaatgaaaattttagggccagttcattagagttagtttagatgtgatgtatataccacccctttaataatggctatcatatggataacataagaggtgacatctttctcttctataaaaaaaaactaggctctaaggtagaggtgtcgtttggtcttagtgcaccacgtccccttcacgtagacaatgttgtgctctaatgagccgctcgtcccctgctagctagaacccggtggccttgttagagagaagcagaaagatttcctgagaagcagaaagcaagagagaggtagaaagctagagagaatgagagagggaatgcgctgatgacctaggaagtgtcgttgacgaagagactaccaccgccaagttccatgtccaccacccagcaccgctgcgctttgatctcactgaccaaagctgcctccggtagggaggggtcacgacgactagatccaaacgtggagaagttcctaggcccaatccgccttccatccatgacgccaaagagattgctgtgtcgatttgcattggagggactcgccggcacagcgcagcctcagtctcctcgcacccgcaaccgctacagtacacgaattaaaacctaattgcttgctagtcgtccaaagctagttacagcaacttctctcccacgctttctcatcccacacaagagaattaattgggtgtgaattgaaatgagacagaaaaaattaattaataaaactaaaaggtaatttatgggaggacgtgtgttgtagttatatccgtcccataaaaaataaacatagtgccaatgtgacacatcttagtactattaatctggacatacatatatttagattgagtaaagtacattggcggtccttaaacttgtagggttgtgtcatataggtccctaaactctcagaacgcatattcaggttctaaaacttgtcaaagtgtatcatttagatcccaaatcgacacatcccctctaggatcctacgtggcgttgatgtggca

SEQ ID NO: 70726 - DNA, 8991 bp, Oryza sativa
agagaaggataaaatatattttcttagcacaagagcaattattcacaatatttgtaataatattattcttgtaccgaagaggaaatcaagccacatgaattaaagtggcggctagatcaaaaggaggattttagatatttggcgataaataagaataggtttggaatcaaaggattggtttaagatcaaaggatgggtttaacaattaattctaataaaattggaattgctttagtttaggttctagcacaaaatggaaaggttgcttggaccataattcataaaaataaaaagagttttcaaactaaatttaaataaaggaaatcatgatcagaggaaagtatcaaatcgagaaataacccgagatggttttaaatgaaaaccacaaaaagaaattaaataaaaggagaggttttgaattagttttaggaggtctctctaattataatattctaggtttaaggtgttaataagaatataagaattggcatgatgcataattagaaaatagcaaattttcagcatgttacaaccgctgccgctacctgtcgccgtcgatgctaccgttgccgccgctgcccgccaatgccgccacactagctcgggattgggaggaagattgggggaggagagaacgggaggaaagaaggggtgaaggggtagttgagtggcattttcatgtaaatacactaaaatattatagggtagtgggtcttttaaagtggagtggagctatggagcagcaaaaacctagctccacccccgtagtttattttatagaagtagctctgccaactccactcaaaaaaaggtaaatcttgaccgtttggcacagctcctgctctaggtaagttggagttgggagctaaagttgtgccaaacccttaacaggctgtctcgcccaaaatagaagaccctatatatgacttactagtcaatgtggctccggtatatagtacagacaagggatcgggccgacggttaaaccaggaaaaaccggatttatcagtaccctgagtagctcggtttatttaaaagaccgcctccgcaattgacccgggctgtaatcggccggtttttggcatgaaacggtgaaccgaagcaaaccgagccagccgggtcaacaagtgtagcaacagaacttgggccatctagaggcccatgtagcatggcaagcccattcattcgaaatggactctaaaataagagtctgtgttgagaattggtccctggctggtgggattttggcactccatggtgaccaactgagcagctgaacctggtttgctatctaaacatgtcaagtgtccctatggtttcaaaacgcagtttaaccagtgaacagttcactggtcagacaagtggaccgatgaaacaacagctggtttaacctccgatccggttttttctactatgctccggtagagtagttagcaaggtcgcttcttacatatataggattagctattaaacctacaaacaccattaagtttcaaattcaaatcaaaatattttttcccacatatacaagtatagtcaaatgtgcctcacaatttatccggatactaaaaattgaaaccaaacaactcatgtgcaactttactctttttttattagagtaaatttcacacgaaccatcatttttctttaccaagataggttatatgcaaacttaatgacatggagtaaattctctcttttttatttgcaattatatttcgatttgagcatttaccagttaccccccccccctcccgggttgatattatctctgtcaagtaataaaaccatagtattctaaaatgataagtagattgcatcaaagtcagactaatacggataaaataattgttatctaaaaacgtactctttaatttaccaatttgcaccatttccaaattagaagtgtttcatgtccgtgtaatgattcatattcatctctcccaaaaccaaatttgtaactaactattcttttgtcattatttaatactccctccgtccaataatataagggattttaagtttttgcttgcactgtttgaccactcatcttattcaaaaaatttgtgcaaatataaaaaagacaagttgggcttaaagtactttggataataaagtaagtcaaaaaaaaataattccaaaatttgttgaataagacgagtggccaaacagtgcaaataaaaactcaaaatctcttatattatgggacggagggagtacaagattagttttgagttttgacaaatgtttttataatcatgtactcctactactaagtgaagataatgaaacttatgaagtgtgatatcattttctttacacaaaatatattctttcaacattatttatttggcaaagctatacatacttttaatatatcaaatattaaaacattttactgttcaagtccctatcacctactccttcccgttcatagttcttcacattttagacaacgacatggctttcaaaacatatatttgactacgattttctattaatatatacaataaataaataaatatttacttttattatagtaccttttaatactaatctataatatgttattttagtgcctttaaattaaatacttaagttatgccaaagttcttaaagtttaaccataaattatccacaacgttaaaaaatatgaaaccgaagagagtatatattactccctccatccctaaatgtttgacgccgttgatttttctaaacatgtttaaccattcgtcttattcaaaaaaaattaagtaattattaattcttttcttatcatttgattcattgttaaatatacttttatgtatacatatagttttacatatttcacaaaggtttttgaataagatgaacggtcacacatatttagaaaaatcaacgatgttaaacatttagaaaatgagagagtatatatataccttgtgcagaatgaagcttagccacccagtgtacaaacacccaccagaaaatcaacaaagctttaagctgacataagacacaaaacacaccccttcttaatctaattatttgacgcgtactaaaagagagaaaggttggagcccgtcgttttccaggatggacaaatggtgtactgcgacgtggcgtcggccgattgggctgtcggcgcctccacgtcttgggtgcttcgcactatccttcctgacgtcggttttaaaaatctgcagtttctcaacaaccaagagggcattgcccatgatttaagggaaaaaatgaagagccgatgcccatcacaagtcactgaaatgtgggccatatgtatagctggggcccacatttcagaatcaattcagttgacttgggctttgctttttcctctctctatatatttttgtgatgagggtggcagatgcataattcctccgtcccaaaaaaaaaagataaactctgatttccgtatcctatttgaaaaaattatgaaaaaaaattaaaaagacaagtcacgcataaaatattaatcatgttttatcatctaacaacaatgaaaatacaaattataaaaaaatttcatataagacggacagtcaaagttggacacggaaactcagagtttgccttttttttttttttgggacggagggagtatgcttgtggctttgtgggaattgaatggttctttgcacatatatataaagatgaagtaaatttattaacataatatgaagccttaaatatgtggagtatatattaagccaatggatggttgccactccttggcactacaactttcctctaggcaatgagagagagtacaaagttttaatcatgggtagctttccttactcctaaagttgccaattatttggacttaatagtaccccctctatgaaaattagaggtttgttttggcaagcagttggaagtgtgttcttgatgcttttcatcttctcctttctttgctttcacatctggataactcttgttaatctgctgtgatgacttgtcatcttccactctgtcttgtcttttctctgccttgatccagtccatttcttacaaaaccaacaaacaattcgttttgtttcggttgctacaattttaaatctttccatttcttttggtttcttcaaagatttgtttcccctttttttagacgtgtgcaaatagtgtgcataactgttcattttgcaagaattaatggccggagttggggaagaatgcggcgaggtggcggcgctgcgggaggctctgcggcagcaggcggcggccgcggaggagctgaggggcgagctggaggaggagcggcaggcggcggcgtcgggcgccgacgaggcgctggcgatgatcgtgcggctgcaggcggagaaggcggcggagcggatggaggcggagcaattccggcgggtggcggaggagaggatccagcacgacggtgactcgctggccttcctcaaggccgtcgtcttccaccaggagatggagatcagctccctcaaccgccgcctcctcgccgccggtgacggccgcgccgccgccgccctgagatccaccaggagagcttcgccggagatcatctccgaagaagaagaagacgacgacgaccacctcatctcccgccacggcgagaaggcgcgaaaaccatgcaactgcagcgaccgcaccgccattgctgaattgggcgcagacatggcgcagatcaagctcaacctacaaagtcttcacaccgaattcatcaaagcgaaggaagccaccatctccagaggcgattcgcaggcgcgattgctcgccgagatctgcgcgaaactcgacgcgatctccaaaacgcgtcaggattcatcatcagatgatcctgtgcaggtgagagtgagcagggaagaaggcagctcatccaaagggagaagctacacaaatagtgagctgctgatgaaccatttcattgaggtgagtgcgatcatcttctctactctgcttgttaggcccttgctcaaggttgctgcatccatgtcattctttaggtgcttcttgatattggtactagctctggtgttcagaaaagttttgatgaactagtgatgtgtactaagcactaagcagtggcattcagtgctcaggagaatagtttttttttcatttaattttgattccttcaaatttagtcactgattgtaataaggcatatcttgggtgggaaatgctcaaacaaaacttatcttcatcagcattttggttgtgaggaaacgttgcagaatgattacttgaccaagtcattttggaagtgacagtgtaacttgtcactaatccctgtggtgaaatgcatgcttgtctattaccccaaagcatcattatattattgtactaaattattattatggtactatttaggcgtttactgtttttcaataagaatttcttctgggttttcttaacaggcaatgatgtacataccgtgagatgtgtgaaggcctagacagcatttttattggtttttgaagattgttgacttgagtacaaagattgctgatttacgattcctttttctaccatattttctctgggcgatgatgtctactgtgtacatacacatatggtgatatgttgatagcttatgtaaattgtgacgtgttatacttcttttttttggtacttttgacagaaaaggcactgttgatgtaatgtggagtaaccaacaattgtaaggaaaaaaagattagataatggattttgctgagcgattgagatctaatcaaacgtcattttcatctgtaggtctgtaccatgtaagtagccgtaggttggcagaatacgcaatgaaagctactggtaacgttgcttcatccatctccaaacgcctactttgctgcttctagtcatctagagtctaccgcaaacaatgaattgtaaagttcggcaccaaacatttgaactccatgaaatttgacatgtatacatgacttagcaacaacaaactaaacagttttcaaaagtagaacacaatcatttcagagaaaaacaattgacgggtgttccagaaaatatactcctatttgctaagtcgtaatatggcagctctgcaaattgcccccttgattaggagggcagaaggaacttggattggatacacattcccaattaacactaacaaaatatcattctaacaacggcagcaggcatccattctgcaactacatgtcacatgcagtctcaacgttaagccttctgacggtatatagttcccagggaacgaaaatctggaaacatgcagtcaatgctaaccattcctggagtctggcctagatgttgtgaacttgcaataaacctaaatctcagatgcttatgtactgatttccgtaactctgaagaacttcaaaaactgttggaataaacaaaataaaggagtaaatcgcttattagattggcaataataacaaatgaaattttataataaggtcaataggtggtaacagaactcacgagtgagctgacaaacacagtgattaaaacgattccctaaaagctatagtaaatatttctgttttgaatcatcattgaccaatcaacagaaattcagctcaaaatagtcaatagaaaaactaacctagcatctaccagcaaatggcacctgataatagagggaggacgtttagatgtaacggtcatcaattttgacagagatggtcacttgataaggtaaataggtaatgtaattcctccatttcatttttcatatatgctgcttttctctaagaactaaattctcctcaatatataaaagaaaagtcaaagcatacctgtaatttcaaggaatgggaaacactttgagcatttacaaggttcatcatcgtagcaagtgtcagggttcatcaccatttttcaacaccaagtgtccatcttcagtcaagatgcagacctcagtgacagcctaataaaaaaacaatgtccctactttagaaagaatggatttccaccacataaacaaattcaaatgtatggcttaaatatcagggtaccatgaaattacagccagaataaagatagaaaatgaatcctcgaggtagccactgcaatcttaacagaacttgaacaatctcttacggttacaggtttacttaggtatcgtaaaagattgtctacatgagaattgctcgtatagttacaaaacatcggacatgacttgtctttgctagaattttcacttaaccccaagaaatgaaaggaaattgctgttatttgaagatatggtgacagctcacaggcaaattttagttttttgtgcaattactcaaagaaagaatgaaaagtcctcaaaaggtactagaattgccatgtaggagtgagggagctgtgtcttcatcattaagcacacagacaagctctagttgtatgatataatggattctatgcaacaaaatattttttcctgtagttgggtaacttcttttcttctttttatttttttgcaaaagctgggtttttcacagtatctatactactttaaaagagtcaagtggtggtggtgaatggtgaatctgccaccacccactgacatgtgggaccatgaagttggtgaatttgctaccacctactaccatgaggtgccatttaggagccactaatcaatagaccacccattcccaaagctatggaggatgggagaaatcatattcaacctgctccttgcaaaacacttcaactaagaatagttctctctcaaaatttcaagcgtgtaaactatacacaatattccagtgggttttgtgcctaagattgtaaacatcatccccactcgtaaaaagatagaattggcaattctttcttcgtacctaacataagacaccaataagaatgaagaaaaaacgattttaagaactaaatagagtgagcacctgtacattcacttttgacctcccacacagaaccactaagaaaccttaagcaaacaaatgcgtaatcctaacaaaatcctcaagaaaaccccaagaagacagtttaaaaaaaaacttaactgacaactggcatgacagacccctcccaagaaaagcaatgcaccaaaataattgaatgaggccagctaggcagaattatgcagtaacaggacaaaacttaaagacaataactgattccctccacacctgatggtagtctttttcatttagacctttctttagatgattcgctgcacaatcaaggatttcttgcttggttaatttcgaatctggatctttatcacggaagagcttaataagaatatttctgcaggggaccaagttaaccaataagtatggacttctctgtcaacatcaagatggtattcggagtattttcaaattctgcataccgtggactattcggcttcgcaggctttgcaacgtacacaccatgaacaggaacagcaacttggtttagtgacttttggagatctacaagaggaaatgaagcacaatttgttgcagcgtttgacagagcttgcagttttggtccatcctttctgtcagaagcatatttagctgccaactgcctcaagtctctacgaattgcttgaatactacatcaacatatatccaatgcaatcagcaataaaaagaatacggaaataagaaaaccaaatacaacgagttactgcagtacttggcactataaacagcactttatgcaacacaagtattggaaaattctgtacttgttcgaaacatgcaaatagaacgtaaaaggctaaaagctatcatcaacaagatacaaatgaaagcttttatattggtctgttgtcttgcaaaaagtgcctccatgcaaccatgaatcatctaatactaagccaggtaaagtttgtagaacaaactaacacaaaaataatatttaatgcaggtgaaacattggtattattctattcatactgccagtcctacaccctgaaggtgaatatctacaacccactgttaactgtagtttctatacaaataccacaataactaataacaatagactgcttatattggtattactgaaatactgaatgttactaggtaggcatga

SEQ ID NO: 70727 - DNA, 22489 bp, Oryza sativa
gcatgccacattaacgctatgtaggatgctaaaggggttgtggcgatttgggacctaaatgatacactatgacaagttctaagacttggatatgtattttgagagtttagggacctaaatgacataccactacaagtttaataaccgtctgtacactttactcatttagattcatatcctagattcttttttatgggacgcagagagtaatttttgggaggacgttttgaacaaacttttataactttaattgtcaataactttaaaaacactagatttatcttacaaattactataataaaagtaaaaaatatttattacatacattataaaataataataataataataataataataataataataataataatatatttttgtcaataatgtctaaaacatgaaaaattatagaatatgactacaatgcaacgaagctttggcacgtggcgcgtcgtcttctcccgaatggaagaaagggccaacgaatttttttagagtgaattacactttgggctacattttattatttaattttcactttggaccacccttaaacacatctgttcactttggatcaaataaatttactattgttgcgatttggatcaccacgaacgattttttttcagcacaatcaacgacattaatcacatcagctctagtatacggccgaactcctctgtgtatggctcatatgtttaccgaaagggaagttagacatgacgagaaaaagttgttcatggtagttcaaatcgcaaccatgataaatttatccagtccaaattgaaaaagatagaaaacatggataataaaaggtggaccaaagtactatgagaaaatctacacaacagtatcccgtcacaatgggataaggtctcatcaaccttatctccttcgatcccttcccctccacaatctctctctctctcactcaggagttaggagaagtcctcaggagtcaggagaagtccaagagcatggagatgaagccagctaggaggaaggggtcgtcgtcgtcgtctccggcggccgaggtggacgacgacggcacggcgtcggcgaggtcggggcggcatcgagggtgatctcgtcgcgcctcctcgacgccgtcctccgcccgctgcggcgccgcttcttctactggcgccccccatcgctgccggcgtcgaggcctctcccctcctccctcacactcctcaccaaggtctccatcaccctcgcgatccaccagtgccatcgtccttgcccgctgctcccgccgcctccttgctagtgagtgcaggtggctcctcctccgccaccgcagaagaagaagaagccggcggtctcggtgcctctgtcaccgcaacgccaacgacaatctgctctagaacctctacctcctctctttcaccatcaacttcaaaatgaagttgctgaagcgcatgtttttggagatggtcgtcgccgacttccagccggacctcaccatcttttgcgtccgtgccatggccttctctattaggtattaatcgcgatacctcagtatcaagcctggtactcacaagtattaggcctggtacccaggtaccaaagtctatgatacctaggtaccagccggtaccaagttaccaggtacccaggtaccaagtctgtgatacctaggtaccagccggtaccaagttaccaggtacccaggtaccaagtctatgatacctaggtactagccggtaccaaataccagttggtacccagtcggtaccaaatataccaggtaccaggtatcaggtaccagctgatactcaagataccaggtgtcgggggaaacacacatagaagctaacggaaagaaagggaagaagtcacttaaaatatcccgttctaacgggacccgttatgtagtctctctctaaaaaaagtatttttattttttgagacaaaaggggaaacgaattggggccagggaatttaagagcagaaaaccctagcctagcctagccactcgatatggcgacgggcgatgtgcccgccggcgaatcggcggcggtggcggaggagcgggactggtcggagatgaccccggtgtgcctggcggaggcgttctcgcggctgggcctggagcacgtgtggcgcggcgccatggcgtgctgccgcgcgtggcgggacgccgccgcctcccgcccggcgctcttcgccgcgctcgacctcgagcccgccttcgcgtccgtcggcgccgacgccgccgagtggtggacgcccgccttccagcgccgcgtcgacgccatgctccggtccgcctcctcgctcgccgcgggggagctcagggaggtccgcgtccggcactgctccgacgacgccctcgccttcgccgccgaaaggtacaaacgtgtaaaattttatatgttttcttcttttttttttctggaagtgatgttttgttcgaagttattagagacgcatgaagctttttgttgattaattagaagttcaaatttcgtgtgatatgatacctaattgcatatgtagtttctcacaatttccccgtcacagaggcctcctggaaatgttttttttctctaatttctctttgctgaccaagaaatatgcacataccaagcaatggtcttcatcttcttagacggtggctgagctagaaagatttttgagtccgggaaaacttcaatataactagtatttgttatagaaatttcatcatcaatattaaaatttaatggagtttttgccggcgagcccgaggccgcctgggcaagccgggtggtgtctctgcccctgttcttagaccttcgagatcgaatataatgatgcgcatatttgcgttctgtataatggttgtatgcgcaatttaccactgttcctttctcaattacgatgcagttttatttgtgcgccttaatgccttgaatttatacaagttactgatagtttttttttatgtagtatgcattcattcataattcttcttggtccttagatctatattctctgggctttcaggttgtaaaatgtgttcatgacactggagggtgttggtgacttttttttctctatttagcatttattcccaactctgcagaatataatatattttaaactacatattccgttcttaatgataagttatggttttcttatttgaactaatatattgactgatgcttgatttttcattgatatattttatagtgtgtaggaatagatatatggggcctatagtctaactatggagccacaaatatgtgggaatctgtactaaaggtcataattccattcttaagtcgaatgttggtgatgttattttattcaggaagacaaagtcttagaaaaacctctcaaatttctatattcctccagggaaccaacagctctatttgttgtaggttttgccgtgttggtgatctagattttattttttttattaaactgactgcatcacaatcaaggaaaactaggtgctgttttgtactcatgaatttgcaagaaaagattttcatgtattacattttgagtgtagtagcctgaaactttgcttcttttcagcaatgaagttctctagaaactcatactcttgtacttatttaaacacaactatttcaagaagtaaaatacgtctgttcctgtcttcctgctaatatattaccaaaattcataatacatggagaaccaaccatccatatagtttttacaggttcatcttgaacgtttgtctgcttctacaccattctaagtaaaatagctttctcaattcaactattctgtaatttttttttcaattttttgtattgctgtttgtataattttaatgtttttattgcatatgtatccatcattcagcctcttatgtaaatgtatattggtgtttctgtgcatgttaacccagtaaattatttgccaacactacagtaatagatacactaaactgaaattgagttggtggttggtgtattgctcttatttgtcaagcttctgtggaaaattattttgtgaaatatagtagtattatgaaaattatatttaaattgctcgtgtcacatgcccgctcacgttttctgttatttggaaaattgtagtgttattgcctttggtgaacatatgagtggacaacagtggaggaaatgtgtttgagtgcaaggggtgataaagagtagtctcacacttactctcacttacccccttatgtgtcgtgggagctattcccagccaatagcaatgagactctgacctgacatagagttagggatatcttttaacatagtcgctaacctgagctcaatcagctttttaagttggagacttgatgagtcatgttgaatgtgatccccagggataagttgtttggtatgaacaaaccaacccgatatgagaaaacaagtaacacaacttatctcctaacacctttctttatgttattatccagaaatgtaccaaacctgtgtcaggtacctactctactttgcacctacatacatgtggcttcacaacacatacaaatgatccaaaaacaagcttataacaaagaacatatttgcttgcaacttcgtttaaaggaaaaaaaacatcatatagccaaacagttttgtttccaccacaatactagacagaaccttacagcaatacagaggctcggtgccatcatcattgagttggagctcttgcagctcagcgtcacccattttagcaactgagctgcagccgaattgacagtgctggtgacatactgacatgtcacaaaattcatcaccagtgatcttggcgtgagttgtacaacctcattgcaaagtagtataaaagagcattccatttctgcagatagttttaggttgggtccatttctataagttatttagagcaaaagctacatgctattttgctttctcttcagctacatttgacatgtcaatgagattgtaggtgccactattgacttgctttattcatatgcaggtctccaaagctcagcattctttccattagaagcagcccaagtgtaagtgatcgatcaatgtttattgttgcatcgagctgtcatatgcttactgaattggacatcagctactgccatgaggtttcatacaagtcactggagatgatcggtcagaactgccgaaacctcaatgttctcaagcggaacatattcaattggctcgattcatcggagcatgttggcatagttcctgatgattatctaagagattgcccccaagatggtgacagggaagccattgcaatttcgaagttcatgcaaaatttgaagcatctcgtaattaggttctcaaagctatctgttgttggcctcaacgcaatatcaggaggatgcaaggaattggaggttcttgacttgtatggctgcgcaaatttgacactcaggggtatacaacaggctacttctaatatgaagaacctgaaggaactagagaatcccaacttttacattcccaggtcctccttccacatgggtaggtatgggcactggcagttatacgatgaaaggtttcagacaaatgtattccagatataaaaacagcctcaagttcaacgatcacctcaggtgtttgttctctgacatatggcttgtatttattagtactgtgaatgttgtatttgtgttgtgttgtggaaaaataatgacaataataccctgtatagtgctgctttactcatcttttccatgtacccataagaaaattgtcatgcttcagtaataatttgtaaggtcacctacaatgattcttcaaaatttcttagtatcaaatttcttaatatctggtgctcttgtcatctgtgtttgagaagatagctgatgctatgtgtttgtgtaaacatttgaaagcaaagacatcatatgtgtatgcagaacttcgtgcatacatgtataaaaaatgtggataatcagtagttgtgttatgttcagacccttgttctttgttggtcctggaataatggcataacttatgctcacgtaacatggttggtttatttgatgctgattcagagcacctctcgatcatggctgtcaaccctgttgcactttgcttcattttgattgcttgtcatgttcatgtgcaaacagatacgatatgctctcttttatggacagataacacatcacctttcattctgttgtgaacttgggatctcaaatctggtatgtttgttaggtttatcaatcatccacatctcatatgcagcagaaacaacaaatcgatcgcattgtgaaaatgattggcatccttgtatagagacactagagaaggtaaattaactgcctttctctgtctcaatataatgagaggcctttctttttcagaattctgtcatgtaaaaggacccccatttgttttctccttcaattcgtactgacatcaccttatccttttcaggacgaccatggtcgtaaaaacagaatatccttcataatctataatgaacaccgaccaggtagtgagataattttcttgcatattttgtacgaaatttgtttaatatgtcgctatcctttccatgatatcctttgtgctgcattttagtggcacgaaagaataatggggctaaagggagccttcagtatttactagtaaacaatatatatctcaaaggtacaggccattttttttcttcagtcactgacaaaagatgaaaactaatttctggatccacagatttacaggctgccacaatcttgtggatgagatatggcaaagttccctggtccatggagaaccatgaaaaatctgaacaaaccacatgcaagaaagcaaccatatctgctccttgtaatgctttgtgtccctctctatccccctgcagaaggcacaagcttggaaacagaaaaacatatgataatcctgtctgagtgctaaattagcaatctttttgggtgacaggtcccattagacctgaactaagccaggaatcctgatttataaagctcaacagtgagcgacaagggcacaaagcacctccacttcataatgttccctaaacctttctccagagttttcccaaacaaagcagataggaatatgtgttttatgttactagaggaggtaccatcattttcattgtttgtgttactttccggcgtcctaagacattataaaataggactagctatattaatgaagccatattttcagtaaattccatatatttatattgcaattacactgtagtttttagtacttacattgtaatttttatagtgcacactatataagagaattaggataaaagcaattgattacctacatggaagaggacataggagggattggaacatacatatgtaaaagagatgtagcaatcacatatggaaaaaagtgactgacattaagtaaaaaatgtggcgtcattttttttagcaaaagtgttacaaaatttacactaaaatggtgtacccctcgttactcgtcaagcacagtaaaaattctccatcttagtagctacagtgctacactatagaagttataagaaaaaaaaaacgctggatatgagaagaagggctcttataacagaaattattaagaggagcgaggctcaagatagcacaccaccttgtggtgttagcgggaagactcccaggcctttctctacagaagttataagaggaaagagcctccacacacactccacataatagcttcttgttgatcagtccatctcaagatgaagaaaagctctcttgctgtcttcctcctcctactcacccttgcttcccagggcacatggtgtgctgctgagagaagccacaggattaatggagctcatctgagacctcatgtccaggtggaagaatcgcatagtcagtactctctctctctctctctctctctctctctctctgttgcttccttgccatggcactaatcttgtcaagaaatgaatttgtgatactaatcaatcttatggagaatcaaataactttttgctgaaaacctttggtttgttcagtcactgaaggcaagaagctcctggagattcaggtccccaggaagcttggccatgaggtgaagtttcccaagagaatggccatagctcacaagggtggcagcacgggcggcggctcgacaggcggcaccacaggcggcgccagcaatgtcaacagtggaccggccgacacgcggccgaggaaaaacgcggcggcgatgccagctccggcgacgacgacgtccatcctggcactggccttctccttcgccattgctgtctcagctttcagcttctgaagctgtgtgagtggtggtgttcttgcaagaaaggtattagtatgtgtgttagtggtgtggtaatctctgaatgactgaatttgtgtatccagtttatcagtagtgcacactgaaattgtttcatcttcctgtatcttatattcaatattcttgatttatcgtctgcacaatgatgtcccagacattgttcttgcagttccaggttcttgtggttctcattctaactgttcttatcttggattctgtccaattggaaaaccacatgctgaaacagtctgttaaaaaattgaagctttttcttcagtcactgacagaagatgaaaaccaatttctcaattcatatatctcaatccagacattacaggctgccacaatattatgggtgagatctggcaagggccctggtccatggtgcaccaaaaaatctgcaccaaccacatgcaaaatagctatcagttctgctcctttcagtgccttgtgtccctctttcttcctgaagaacatcattagattcagaagcttggaagtaacaaaaagaacatagcataattttgtctgtttaagagtgccaaatcagcaatcttattgggtgacagatcccattagacctgaactaagccaggaatcctaaattataaattacagagagtgacaagaccacaaagcacctccacttcacaatgtccccttaacctttcttcggaattttccacaaaagaagcagacaggaatagctgccatcctgtcataacttgtactctatccattctttaaatacaaggatttctaggttgtctagtactccctctaatgttttagggtaagtctgtccaaattcgtagtactagaatgtgtcacatccaaacaaaaaaaccatacatttagacaaggagtacagatttaaggttttagaagaaaagagcatctcattaaacggttggatggttggaacttgggagtaggaggctgggtggttgtgggtaagatgaaaagaaatttgaatgggaggtgattagtgagataagtattactctagaaatacttatattacgtacaaaatttaaatcctagaaatacttatatttggtaacagaagaagtagcgcatatcttagcgaataactttacgatacacgataggtaccgtcaattcaatgttagttttgctgtacctctcctaatatcttttaacactagggaggtatcaaaatttatactgaaaaatatttaacctctcctcggttaacttatcaagttccatgaaatgtctcaatcttagtagctactcctacatgagttatactccctccatttcaaaatgtttgacaccgttgactttttagtacgtgtttgaccattcgtcttattaaaaaaatttaagtaattatttattcttttcatatcatttgattcattgttaaatatactttcatgtacacatatatttttacatatttcacaaaattttttaaataagatgaacagtcaaacatgtgctaaaaagtcaacggtgtcaaacattttgaaacggaggaagtaattacatacaggagttacatataagaggaagagcctccacacacacacacagttcacataatagttttcttgttggtgatcagtctccatctcaacatgaagaaaggctttcttgctctctccctcttcctcctactcacccttgcctcacaggccacatggtgtgatgccgagagaagccacgcgatcaatggagctcgtctgagacctcatctccagtttgaagaattgcatggtcagtcgtcgatctctcacttgctttcttctttcctgatgctttcgtttcttcctttgccatccatggtgcttctaatcttctagacaaactgaaaactttcggagaattttaacgttttctttattttctgaaatttgttggcgttttcagtcactgatggcaagaagcttgggcaagcagctgacactgacactgacactgacactgagagccacaagcaccatgacgaggtgaaggttccgatgagaatggccatagcacacaagggcggcggcaggggcggcggcgttggcggcggagtaggcggcccgggcggcggcacgggcgtcggcgggaggaacgtcaacggtgctgccgacacacggccggtgcacaacgggaggagcaacgcggcggcgatgccggctccggcgaaggcgacggcgtccgtcctggcactggccttcgcatgtgccattgttctctcggctttcagcttctgatcgaagctgtgtgtgtgtggtggtattcttgcaagaaaggtaggagtattatattagtatatgtgtgtttagttgtgtggtaattaatctctctgaattatgtgtatccagtttgtcagaaatgcagtgaaagagtttcatggccaattctcaaccagtatcttatgttcttgatttatcatgtctcatggtgtccgaaatattgttcttggattctgtccagttggaaaatcacatgctcaacaatttgccatctgttcaaatcttgcaggctcacttagtcacttccttgtgctgaattttgggtttgcaaaagataaaaaaattgatctgtagtggaattgtcctgtataagatgatagagtgaccaataatttacttttctcatgaaaaatatataataatcttctttgaaaagggaatacttggctcaaagcattgtggggccaaggattagagatgtgtcaccacgtgaaatcattcagtttgccacttcttctgaaaaggaaatgatattatatggatatccacttgttctgttccctgctgcctgcgcacagtttcgttcgttgcctgcaccgtgccttaacatgaatagatttggcgcactcctgaggaaagttttcttcttgtactggagtaaggctgtgtttgaggaggagatagagaagatttgaaagatacgcaaaacgaggtgagctattagcgcatgattaattgagttttaactattttaaacttcaaaaatggattaatatgattttttaagcaactttcctataaatttttttaaaaaaaacgcaccgtttagtagtttgggaaaaaacgtgcgcgcggaaaacgaaacaaacaatctcacaatcacccagggccgaacgcagccttaagatgggataagattattgaccaataattattctgttaaaatatattttatgacaaaaaatgatgttactagtttcatatttaaaagtatgtttttattattatacttttgtatcgtataaataatataatggtaaagtagttattagtcaaattcttatcctaacaaaataaaatacaccttacacttttatatagaggtaggatttaaaatttggatatctgtcactctaaaaattgaagtcctaaaaaataccacagaatatattgtattgtaaagatgccaccataaagacattattatcggatattcgcaatattggtcgctttggccacgatttagatcacaacaaagacattttacacccttcttttatcatattctttttctctcttctcaccatccatgacagcaagcagctcaagatctagctcactgtagcaatgctcgaaaatgctaataggaaaacagggatttcggttggtattttttttctttcttttttttttgtgtgtattcaggggatcggaacttggagcatgtgtggtcctcaatcagcacagacaaaaacgttgctgtcttggagagattgttgtcgctccttgtcgcctcgggcatgtgcagtggaattgcagaggatggttgcaagatacttccttcgtccgctaaaaatatagtaacctaggataggtcatcctctatcctaggacaatgtatctggacatgtctggatgggtcttatcctattctagattgttatattctgggacggagggagtagaagactgacatgatggcaaaattctaaacaagggaaggagataggtcacagacatgagtagatgaaattacaatctagagagcaaccggaatcttcaaattaatgagcaatggcgagtactccctccgtccaaaaaaaactcaattcctagatttccgtgtcttacgtttgaccgttcgtcttatttgaaaaaattatgaaaaaaaatttaaaaagataagtcatgcataaaccattattcatgttttatcatctaacaataatgaaaatactaatcattaaaaaaatttatataagacggacggtcaaacgttggacataaaaaaccgaagaattcggtctttttgggatggagggagtagcccttaaggctgtttgtcttttgtctttgcttttgtgtgcccagcttgttttgattgcaaccctactttcgacatcctaatgtatttcggtcttccttgtatttttttctccgggaagactaaatggctgtcgaatgatttttgatagctaaatcattcatgtttcaatatatttagaaccgttgtttaatatgttgtagcaaaatatttcatgaggtgatttgattgtgtttcagttttttaaaagattgaaacttttttatctacttggtgaaacattttcgatctacttgtgaaacaaagctcggttggcttcaaaatctatacgatggaagcctaaaaaatcatgtaaatcccatatagactttttctcgatgtgcatggatttgtttcatgtttcaatatattcggaaccgttgtttcatacattgtagcaaaatattttatttggtgatttgattgtgttccaacttttttaaaagattaaaatatttttgatttacttgggaaaacactgcatgatggaagcctaaaaaatcatgcgaatcccatatcgatagcccttttttctctcccaaaatataaaaggatagatcatagacaagttgcttgcttgctatgtttttttagtaattacttatttacctcgttttaaagcttgactactaatttagcctgattttttaaagtttgcacatttgaccatttttcctaaaaatgaatatcaggtctaaacctgtttcgggaagacaacctaacggtgttaacacagggaaaaaccatttatgtccttcttaatttgacccttttttttaaaacgagtatcaggtctgaccctattttgtaaagacaacctaacggtgtttactcagggaaaactaccgtttatgcccatctcatttgaccctaattttccaatattttaatttattagacctagtatttttttcacttcatccctataaactatgtgatgaaatttgactaaaaatatgtacaaaattgatgtaggtttgacatatttgatttaggtttatcaaaatttgttccgtgctgtgcccagtactaggatttggctaaaatatcgactctctaaatatattttctaataacacttataactgtgtggttagaagagagtcagagggcatgtttgtttttgaaaaatagggtcaaatgagtagagttgaaaaaggagagtcaaattgatagtagcctttacaatagtgtcaaaagcacaattatctttttttttcagactgggactcttagaaaggaaagtgggtattgcatgtgtactttattaatacttgcataatttgactcagaccctctttaatttttgttgcgcgaaatgatgtacactaacagcacatcttgataaccgtagattgtattggtttcaaagattggacggccaagattgttttttctttttctcaattagtcagacaatttatagctgattttgattaatgtgaaaaaattttagcttgcatttctcatataattaaggagagcctccaattagcataaagataataaaaaaagattttaacggctcgtagtgtcattattggtgttgctccctccgtatttaattatatcgcactattgactgcactcggtttaaatttaaactttgaccatcgatagctctcaaaattaaaaaaatataaaaatcatattagaagtgttaaatatattagaaaaacagtgaccaaagttacccatcaaaatcaaataaatttaatagtaatttcttgtctctcccaatatcttagcacttggaaggtactccctgtgtttcatattataagatattttgactttgatcaaagtcaaactacttcaagttgaccaagtttataggaaaaaatagtaatattttctacccaagataaatttatatgaaaaatatttaattattaatttgataaaactaatttgataatgcaaatattactatatttgtctataaatttagttaaacttgaatcagtttaattttaaccaaaatcaaaacatcttataacctgaaatgaagggagtatcgaaattctcaataaaaaacattgtacctcttgctaacgtgtcaagtagcttattttagtagctactccctccgtttcataatgtaagtgattctagcatttcctatattcataatgattttaataaattttgatatatatatatatatatgtctagatttattaatatcaatatgaatgtgaaaaatgctagaatgacttacattgtgaaacggatggagtagtagctacggtactggtgctataagaagaagagcctccacacacgctccaacataattctgtcttgctggtgattagtccatctcaagatgatgaaaagctttcttgctctcttcctcctcctactcacctttgcctcccatggcacatggtgtgctgctgctgctgacagaagccacaggattactacagctcatctgaggcctcatctccatgtagaagaattgcatggtcagtgatctctctgctcctttcatgattcttcttcctttgcaatgatactaatatttagtgttccgaattttttgctactaatctcctggagagtttaatttaacaagttttctgaatttgttttggattgttcggccactgaaggcaagaagctcatggagattcaggtccccaggaagcttggccatgaggtgaaggttcccaagagaatggccatagctcacaagggtggcagcgcgggcgccgccgcggccgccggcgcaggcggcggaggagtgtccgagtcgcggccgcgcaacgggaagaacggcgcggcgacgctgccggctccggcgacgacgtccatcctggcactggctatcacctgtgccgctgttctctcatctttcagcttctgatcagatgtgtcggtggtgttcttgcaagaaaggtactagtagagtgtgtgtgtgtgttttcttttgagatgatagtatgatgtgtgtcggtggtgtgctgatgatcactgaattcgtgtgctgtgtgtccagttcgtcagaagtacactgaaattgttttcatggctaattatcagcatgcatcttattgttgattcgtcatctgtctcatggtgtcacagaggttgttcttggtagtactggtacttgtagttctaactgctctcatatctttgattcgatctgtacaattggaaaaccacatgctgagcacaagttgctacagattgaagcatgacttcattgtgctgaattttgggttgacagaatttcaatctttgattatgcagtcaaattgccatgtctttgatgatagagtgatcaataattcacttccgtcgcaaaaaaaaatgataatcttttggaaaaggagacactgggcttgaagcactgttggggccaatgattagggctctgtcaccacgtgaaatcactcacttcagattgccacttcttctgaaaacaaacgctattttatggatatccatttattatgtttcctaaggacagctttttagatttaacatagggatgaaaaatggttggaaacgatatcatttctatacatttatatagaaatggtctcagtatggtcgcaaattttctatatttatcaatttaactatttaataacgagttccatgtagcattaacggaaattagaaaaaataaattttatccgtagctagaattataaatggttgggaacaatatcacttttattgaaacggtctccggacggtcggaaattcctgccaccatattcacccctaatttggcgcactaaagagtaaagttttctcgtggtaccagagtaattaagataggtgacaatactatagctctttttacttttgaaaattagatgtgtcttccttattgacattctaagaaatgccaccgaatagattgtaactactctgaacacatagtagtcggatattcgccggtttggccacaatttctagctagcactacaaagacttctatgcctgctttctcatgttcattttctctcttctcaccacccatgacaatttgatagccagcagctcaaggatctagctcactgcagggaagctcgaaatattactactagggagtgatggatttgggttggtgatcgaaaatttttagttcagatggccgtttcttggagcatgtggccctcagtttagacaaaaatcgggtgttgtcttggagcttgtcattgttccttgcctcctcaggcagtcaggcatgtgcagtggaattacagaggttgattgcaacgtagaccaagaatatttactccgtccaaaaaaaacttaatctaaaaagagatatgacttctattattacaattacatccccttttaaattgagtttttatgggacggagagagtatgtcacgtacaagttgctggctggactgtgtgcaactgactagtcgtggtcacagaagttagtacagtgtgcctttgacagctgttgctgctgtcgatgggaaagagaaatgggtagcaatgcactgggtgattgtgtcatacccatggcaaaatttgctacaggacactcaaagattgtggtctttgctgtaagacacccgaagatcgtgtatttgctcgtggacactgtaaaaaagtggtaattagctgctggacactcttcccattattttattatttccggtcaagatggagagagaaagagttatgtaagtaccaaaatacccctggacactgttcttcctctctctctatcttttttccccttcttcttccttgcagcagagcagaggtgcgagtgtgcgacggcggctggcccgagcctggacggctcagccatggcgaggcggcggcggggcggtgtaggccccacatcctttctttttctcttctttctctcctctctcgagcaggcgtggtggcagacttgcgtgaggcggccggcggcggagcagggggcggcggcgctggagagagggagagagacggccgacgcgatggcgagctcgacggcggagagtagcggcgcgcggcacggcagcgggggagagggggcgcgcgcaccgcccgtcctccatcgcgatggcgtgcagcacgttcttgtcctccagcgacgccggcgtgccgacgtcggaccacgaccaggccacgttcttcttgtcccggaagtccagcaggatgatgaaggaggtgtctgtccgtgggaacatggtcgctgccatgagcgtgctcgtgccgtcgagccactggagcttgtcggcgtcgccgagtgcacagcccggcggctcgtagaagaagtcggcctgctcgccggtggtgcagtcccagacaccgatgccacctatagctgactgaggtcttatgatcattgtgacaggatgcaccctgcatccttaaaccgtgacagcctctgcaaagccaacctcatacacactttgctgctcattgctgatcgatcacatgatgcatgatatggccattcatgtagagaagaatccggacaagaataactactagtggatcatggtgcagttgcagagattggggaggaagaagaacactcaatgaatgccccttgttgcccgagacgcggccgattcgcgcctgccatctccagttgtacacgcgcgatgcggaagaggtggcgcaggtcgccgggaaggcagttatacacgcgcaggtcgccgccgctcctccatcgctcatttgtacacgcgcacagcgctgccgtgcgcgacgcagcagccgccgtcgggcgcggcgcggacagccgtcccgtcgcccgcggcgttccctgccatggacgccgccagctgcagctggtccccgtcgaacggcccccaccgtgcctcgcggaagcggtcgaggaggccgtaatagagcgaggtagagcgcctcgcgccccccggcaaaaccttcgcgttgctgtcgaagaagaacagagaaagagagattgataagtgggcccatggacaaacttgtctttaacctaagtttctctctccgttttcatcgaaaataataaaatagtgggaggagtgtccagtagctaattaccacttttttaccgtatccacgagcaaatacacgatcttcgggtgtctcacagcaaagaccacaatttttgagtgtcctttactcctttacatatgaccgtgtcatatgtaaaggagtaaagggcgatgggagaaattagagaatgacgaagctagggagaatacttcctgtggttataaatatttcatacactttaactacaaaatctaaccattcatcttagtcaaaattttagtgtcaacataaaaaatttaagtcatgcttaaagtatttttaacaaatagaataagttacaacaaaatatgtaataattacattatttttttaatatcatgaatggccaaatttaatgatcaaagtcaactatgtcaaatatttatgactggatggaggagtatcatttttagaaggaaccaagcttctaaacttattcaaaaatagcaaaggtggcaaaatatgaaattgccacatctttggagtggtatcacaacgattacaatcttttgaatagcattttgaaaagcatcaatctttagagcaacaaatatccaaattaagcaccaatctttagagtgataaatatccaattttctcctttttaacgtgtagtctactttggtgtgtcatgtgggcggagctttaatttgatatggacttttcggtttgatgccaagtttatgccaatgtatagtatgtatcagcgaggaactaaactataatctgggattctaggtgctataaaaatcttgcgagatgctatcaactttgtgttcccctctacctgccatgtccctacaactcattgcagatctctctgtcttgggctcatcatctagccccatatagaggaccacttgctttccaatcctacactgctgcttgattatgcaatcttatgttgctcctatgtccaactttaagtactaaaccaacctacacatgacgaaaaggaccgaattcaaattcatggaggaaagcttttgagtcatcaaaaaaactcgaatattagggaaggacctaatatcaaataatgagaaggggtggggctttgaacccaggtcatctagcctaccatcttatggagctagccggaagacccctgagcatttctcacttttgagttatcacgatgatagtttcatgttttgaattggaggtgttgggaatgctattaaaatttaaaaaaatattttgcaaaagttttgtttatcttttttttttgtcaagaagccagtagtttcatggggaaagtttgaaattactaactgaaatggtgttgcctcacttgcctggtaaagaaggatgccacagaccttggcaagttatgggttgttgggtacctgtgaattagcatcccctctttttatcctttccagaaagagtgatgctttaagctatctcaaagggaacataaatgtcatgtgccaattcagccttgattagagggggttttgggaaaagaaacattttggagtaatggatatgcaggaatttaactgttgatcattatccattatgcgatggaaaaataaatggtagggaacacatgagatgctcctttgttacaggtgtgataggttatcttgatgcttgatatggtcctcttgaacagtgaaagttgctgtgattcgttagaagataatatagcctaaatggagcctgtaaagcacttcttttacagaacaacaaatggggaaaactgtgtaaggatcagatactctgcatcgtacttttgtgtcatgtggtctctatgatcatcacagaataattgcaggcagagtagggttccaaaatccggagtaaccggccggttaattgcccgttctacaagccagggccggttaggagatgaattcaaattaagaactattccgaatgctagttataggtctggattacaaggttggtattttgggcaaaacaaggtttttgaatcctgccatggcccatggggtatcagaaattatttagaatcacgaattgaaatgatgcgtctatgcagatgggcagctgatactgctttgagctgaatcaggcagctggcaatataccaggaacagtaacaactagatagaccaccacatggtgaaagccttttgatcctgtaattactgactttgatgtatactagcaacatgcccatgcgttgcattgggtgaagcatgaaaaaacaatagtaatggatgtgcaggagtaaaatgccaccaaattaattgaggtccttgtagtcaaatcgaatctttccggtgtatgtaagacgctaacatgacataattatttgttactctaaatccattgacatgaatgatcataggaaaactattaataccactttaaaattaaattatgtattatagagtaaagtttgaaacgcaaaaagtatttacttttgtcatgtattattatgagttggttctaatgcatggttattttttgtacttgatattgatagactttttttacatattgtaaagagtagcaatagtataagaaatgtttttcgctatctatcatatcaacctcactgcactccaatcgcataatcattttcactcaaaaaattagaaggaaatcatacaatgaatagaaaaaaattggatgtaaacacgatttattttgttggtgattacaatttttttgaaaaaaagacatgcgattgttttctattttctaaaaataatttattttgtcgtaaatactttattttgttggtggtcacatgttttttttaaaaaaaagacatgtgatttttattttttaaattaataaaattgctccttatttttatctgcttcctggtagatgtggatccaacctattttcagtgtagtagcctcgggcaagccttctatttaagctagtgctgcctaagctaggcaaaaggtggtattatttgtgcactgacaattgacccgtgtggggcccacttgccacgtaagttaaaactggccacgacactgccgagggatctaaattgacatagcattgtaagttagaggatgatgtatacctggtattttgatttagggatggattttatattcagcgacaaatgaagggacctaatgtgaacttatttccggttgctacaggatcacacagtactgtactgggctgctgctttgctatgtgggctgactgctaggctgcgtttgcttttttgttgggtcggcctgctgctgctttggttgggctgcttgctagctttctcttcttttttttctgtttctcttttatttgtggagcgtcaaaaaattgccgtcacgcatcctgattcgcggattactggcgaaaatcgcgtgggcccacccttgaatgacggacgaaaaaattaaccggaagctttacctattttttatattatatagcaaaagtgtccgtgcgttgtaacgtgaagtgtacagaccagaaaattgaggaaaagttaaagaaaaatttacattatgtagaaaggttatattccctcccttgtgtaaaaaatcaatttacaagtaaagcaagtatgataaataaaacgacatgttaaatttaattttattaaattttccatgttaagttaagctatttggaattttattggaattttcatagcttaattgctaattttaataatataaacctcatttaacaattatttaattggaaaaagaatcaaaatcctccctttcaggtttgggccgaatatagaaagtttatagtctctccgttaagtctattctatttatctggcttgtttcctttctctgttgaagtccattttgcatcctcctgatatcgaccacacggtccatttggcagcccaataggccggcggcccgacgcgggagcagttggagccgtctgatcaaatggacggtctagattaatcctaacctaaataactacacccaaaacctaaccctaggactcattcccaccccct

SEQ ID NO: 70728 - DNA, 588 bp, Oryza sativa
agccatgttcccacgtctcgcctgcttccggcggaagtggaggtgggtgtgggcggtcccgtcagaaggtcattcggacggcaaccatacaagtctccgtctgtttatgaataaaataggataagtccccacaaaaaagagagagatggtgcatgtggtatccccttgaggtataaaaggaggaccttgcccacttagaaaggggattgaaggggggaaaaacaatcccagaacgatcgggggctggctcgcgctttgtagcttcttcatacacagatccaccaaaacacaggagtagggtattatgcttctcagcggcccgaacctgtatacatcgaccgtgtcttgtgtgatttcactctcgcgaactttccacaaaccaagagcttagaacctcacccagggcccccggccgaaccggcaaaggggggcctgcgcggtctcccggtgaggagccccacgctccgtcagctacccttctcttcttcttgtagctgtcccatctcctttctccttctagtgccggcttgacaccaatactacccccaatctttcgctcaccgtttcaggcgtgaacttccagtgagg

SEQ ID NO: 70729 - DNA, 1147 bp, Oryza sativa
cctcgccggcgccatcaatggcggccggatcttccgcgctcgtttccccctcgtccggccgccctctctcactcccaaccctatataaaccctccccgagctccccacctccgtttccgccactcgtcgccctctctccccgtcggaatcgagctcgcgccgtcgttctctctctccgccgtcgccgccgagctccggtccgccgccgtcgtcgccccggaccatctcccgcctcggcgccgcctccttcggctccgccgcatcctcgccgacctcgtccacccctccgtttcgctcgccgaccgccggaacgccgtcgaccccgtcgacccgagccgcgccgctgccttcctccgctccggccgcctttttcgtcgtcgccgtcgacctagggtgagccgtggaccgtcgcctcgtttcctcctttccctcccttctctcggccgccgctccgccgtgcctatggccgccgccggcgaccataggggcgcgggcgcgccgcctgtcacgtcctgataaattcatcccgaaataaaattcattttctaaaaggaataatagaattaattaaaattcgaaaagaaattggcaaacactaaaatacgtacaagaaaaattcgaatgtggcccggagaatttttgttaaattctccttggtctaaacggagccctcaaattttacttgaattttcagagcactggaaataattattaagcaacaaaaacaattatcggagtttattaaaaagaaaaactaaaaataatcccccttcctcctttgggccgagtttggcccaaagtctttccctcatccctcctttttccccttctctctcgggcctcctctcccctcggcccagctccctccccctcccttcctttctcaggccgcccctccctcctctccttcccggcccactccctcctctcccctcccacctgggccgtgtcccggcccagccgagcctccccaggccgcgccgcacgcgcccgtcacgcgcgcgcccacgcgcgctgaccacgcgccccgcgtgggtcccaccgcccggtcgtcgtcctcctcccgcccagcttctctctctctctcccgtgaaccctagtttcttcctccctcaaatccacgcgaatcaatgccattctttccaaa

SEQ ID NO: 70730 - DNA, 21103 bp, Oryza sativa
gtcaccgagtaagtataggatggaatacaggctagatctgttggaaagggtaactcaaagatcataactgaataccttttaagttaacctcgaggccaatgcactatttctaattgtagtgtacctccaataattctccatatttaagtatattcatgctaaatttcttttgaaaattaccgaactacgcttccatatcattacaaccttacaaaagcattgcaaaccgatccagctcgatcttctgtgtggacttaaatatgttttaagtagtataagcaatatgttcatacggccgtaagtgaatcatttcttaattcatatgtgactaatatatatttagcatgttacttcgcatcaagtcgatgaatcataaaaggtgaagaaaataacacatataagcacaatatacttctatttcatatgacataaatattttttatattatatatactccattagtttaggtcgatgttactatgtatcaatagtagatctggtcaagaatttattttaaattaaacataccgtataggcaatcctttagttcttttattttgttttttttagtttagtctggaaggaagattctaaagttacaacttgcaacttattacttcctaatttttgaatatcaaactaaaaactatcaaattgagagtaaaatagaagaacaaacatgaagtgattaatttcagaaatattaaatcatgtaaaattttataattgttactccaataacagtacaaatcgatacttactaattatgaattttagaattacaaaataatgaaaatccataaatgagaatccaaaccaattacaattcaatagttattaaatatgattttagcattattaaatcatgaaaaagctaacattaagacccccaaagccttttctctgagaaaaacatcaagaccccaaacggagtacaaccgatattttttaatcatgaatcgtgaatcattttagacttcaaaaaatatacaattatatactaactaattatgcatatcaaattattatgtcatgaaaagttataatggaggggaaatatcctgtgtacacaagcttttttttttttacacatcgtgcacactaacaaattttatcgaaaaatctaaaaaaagcgtaattaatcatgcgccagtgatccatcacttttatgagctgcgaacagccgcatagatatctgtgataatccaggatatgcccaatcactagttatctgttgcggccaatcttttggtggctagatgttcatgttcaaaggaagaggtatcttacatctagccaaattctaactactctgcattagtgtgcagcacatgtggattcatttgcgcatcttattataccaagtgggacagcagagactgaaaacaggcaccagccaaccaattgcctcttgtcctttgaaatgagtatttttgggccctgattggaattttagcttctaaaatcctaatgattagatcaataatagaagcaatattgaatgggaggaggaagaggagggacttacatgttggtcccacagctcagtctcagtgacacgttggtcccacattcacccgactcgactgtatcaatgtttcgctgttgtgtttagttcacactgaagtttgtaagtttggttgaaattggtacgatgtgacagaaaagttgtgtgtgtatgaaaggtttgatgtgatgaaaagttagaagtttagaaaaaaaaaaactttggaactaaacaggaccatactactgcatagcctgtacaaatcaatgctagcaactaaacacgataataaaattgcctcatccatttttattttacctgttactttgaccacttttcaaggttttacaatactacctccgtcccaaaataagtgtagctgtggatagtcgtgaccaacgtttgaccgtccgtcttatttgaaaaatttgtgaaaaaattaaaaatatttagtcacacataaagtactgttcatattttatcatctaataacaataaaaatactaatcataaaaaaatttcaaataagacgaaaggtcaaatgttaaacgtaaatagtgcaaaactgtacttattttagaacggagggagtactaatcaatacattctttccaaggtggtgatttccctttttgtcctttgtaggccaaaaagtgatatttaaaatactagtcaatacatgcttttcaaggatgatatttagttgacatatgtatttagaaggtttagatcatacatcccactcaactagggtctttttcatcattttaccttaaacaagttgattgcattggtatgtgtacatgttcaaaagtgacaaataaataaaaatggaggtagtacaactaatatgtttattgttagagacacatgatatactcgttataacgatcacaaagtacaaagttgcatactacaagtgaaaaaacataatcttggatacgtttatagacataattacaacagcataacaatcagtttttgctctcagatgtccaaattacaagtgagacatacttcagtgccatgcataatccaacaagggaagggtaggaaatgaacactccagggatgagctccaaaatctgacaaggggttcaaggatgttatctattccctacaagagggtttgttttatggcattcaattccttaataatatctccagttgacattctattcgacggtatttcctgagagcaatacaatccaagcctaagcaatgaaaccaggcaatcaatcatgactttgtattcatccgtggtacgaagttcattctcaaggtgcaaagatagctgagtgtcgacaacatccatcattttaccatgtagacccagctcaacatactcacggaggctcaatccttgtatgaatttcttatctgtgggcctcttcccagttaccgtttctagcacaagaataccatagctgtaaatatctccttgagtcgataccgtatttccagcaccatactctgttcaatcaaaagtttgccaaaaagttaagatttttgtaatccaaaatttaacatagatttataatattattggcaagaaccataagttgcttccctaaaaacaaattttcttttgcatcttccttaaaagtttgtttagctgcacacgtcattaataaaagcactagagtactagacaacattaaggaagcaaatgagagaacagtaaacaatatttttaaaaaaaaaaaaatgttacagtaaacacatcaggctaacctgggggagcataaccgattgtccctctaagtcccatcgagcttgtagactgttggagcaatgagttgccttcaaaaagaatcttagcaagtccaaagtctccaacatgtgctaccatctcagcatctaaaagcacattgctcggtttgagatcacaatgtacaacaggtgttggtccatggcaatgtagataatccagcgcattagccacatcaagtagtatgccaactctctgaagaagatttaagtactttgggttgtttgtggcaggatgcaaccagccttctaaattaccactaggcatgaagtcaaacacaattgctttgaagtcattgccgctgttatcaatgcttgagcaagctgtaattatcttgacaagattccggtgtcgtagatttcgcagtgcttcacattcagctgtgaaactcttgagcgctccaggagtttggagttttagcactttgacagcaataatatctttactttgaccagattgtttatctaattctcctttatacacagaaccaaatgatcctgatcccaacaaattggtcgctgagaaactgtctgttgcccttgccagctgagagtaagagatcaaaggatggccttccatgcatgtggttgatggtatctttgattttattttcttgtaccgagccagaagcttgtagaataataaaagcaggagtaatgttgccacaagagacacaacaataggaattaccagaaatttctgccttctgtgcggtgcttgtgatgtacatctaggcaaatgtagatcaggcacgccaccacaaagtttgccattcccttgaattgaaattgcagaagcattcaaaaagacaccaagtgtaggtacttctccaacaaaatcattgaatgaaaggttgagataaccgagcatggtaaggtttgataggaatgtgggtatttgaccagacaaattgttactcgaaagatcaagagtttgtaggcctttcaattgactcaggagtgatggaagactaccagttaacatgttattttggagatagatattctggagaagttggcattcaccaagggtagtagggatttcacctgataatttatttgatctggcatctaagtttacaagatttttcagattcccgatttgttgtggtattgatccctccaagttgttattcgacaggttcaaaccttcagagagactgacaatgctgactacctctgttgggatttgaccagtaaagttattgctgtctaggcttagtcctaataagtttgtaaggtttctaaaaatgcttggtatgctaccgctaaaagcatttgatctgagttgtaaaatatatagttctgttaggtttcctaatgtcaatggaattggcccaccaattttgttgttccctatggagagaagatgcagattttgaagcctaccaatggaggagggaagatgccctgtgaaattgttgttatcgagattaaatgcttgcagattgatgaggttatcaatatcttcaggtatgcttcccgaaattttgtttgtgtcaaggaaaagatttgtcagagaggacaaattggaaagtgaatcaggaagaactcctccaaagctgcaactagccaagtacaacacgctaaactgggaacaatttgttaatgcggttatgaatttccaatcgttggggcttctagcttcaagaaatgtttctgaaagctgtagaattttgagatttcttaagcctccaatctctggaggaacgataccgcttaagaagttagcaccaagctgaaccaaccacagatgggaagcattggcaatcgacgtagggatactaccatgaaacttgttgtggtccattcctataagctggagactgggaaaattactgaatgcatttggaggaatggttccacttaacgaattttgctggacagtgaacgccattagtgctgacatgttgttccaaatagaactgggtatcagcccagttaaattgttagagcttaatgtgagcctagataaaccagacatcttgcctaaggatgaagggatgcaccagatagcctgttgtaatcgagaccaagaatccagaggttggtgagattgcccaaagcgggtggtatctcaccagagaatctattgactctaagattcagctcttcgagcaaaggcaaatcggccaatgaccgagggatctcaccagagaaaccatttttctcgacgttcaaaagcacaagatttttcagactggctcctatctcggtagggaactcgccttgaaattggttatcgcttaggtggagcaaggagagattggtacatcctaccagagcaacaggaatgttaccttggagagaatttgtgctcaggttaagcagccgcagcctgctgaggcgaccaagctctggaggtatcgacccaactaggcggtttcatgaagatcaagaatcttgagaaaggacaggttgcccaagaatggtgagaggagcccagagagtctagaagatcccaatctcagtgagataaccctctcagggtgccgacggctgcaaacgactcctggccagctgcagtagtggattgacttgttccatgatgccaacgagccatcggatgcgaacatcgacttgaaggagaggagagcgagctcgtcggcagtggcattgctgctgctccctggagacaccagagcatcagaacagaagagaaacaatgagaagaaaaacaatatgattgttcttgccatgaccatgaggaagtgactataagcacaggcctatgttctctaaatgacttacatttttcatatcgttgcatatgtgtatatttatgtctgaaactctgacaaattaggaagctgtcgctttgtcagtcattggttttatttttctagacaacaagtcactggttgtctcgcaccagtctttggtcaatgttcttttcatgaagatgcatccaagaactacactcttaacattcatgggaaaccttccaagataaattgtcaagtgggaaggcgatacagacactgaaaagcagccaataattcggcgctgcatcacttcagcagtactcttttgaatgataggattcatcctttcgctttccaactgcacaagcacagatctgcaagttgcatatatcatatgccgatcaacaaggaaaatttcgacagcaactagctgcgctcttcaccaatttcacacgactgtccccaaattatttcatatccaatcaatcaactaatcaagaacacctcattatacccagtattcattactcaatatgactccccctttatcctcaagttcttagcagcccaaactttatctgggttgcaaaagttgcaaaaacatttttttaaaataaaaaggttctttttcaggaaaattttgagccaattttttttctcccccctttgcttttggtctacgcccatggtatcaagaaaagcgggagttttttcattgcagcagtgaccaaatagtctacagtaaagttgcggaaagcgaagcgaagaagactaaccctcgatgccatctgatcttcctccggtggtttgcccgtcgccaagaaccacgaaacccgtcggctctttgccgcctgctcgctcaagccgggctccagggcatcgcctgcattcctatcgccggagagggcctccacctccgccgcctcctacgggtccgccgcatcggcgtccgagaggaagtattcggattggtttttcggactagccggagggggaatacggtggacggaccgaggaagaaggaacttaggccctattaagttcccaaaataaaaaatttcatgatacacgtgcatacattatttaaacataggaaaaacaattacacacgtaacatctaaactagtatggtggcccgcgtaaattgcgcggctagtatcattatattttctctcatgtaatagcatatatgttttctcaatgtattattcaaatatattaaaatggcaatataattttaaattttgtactaactttacgaaactaatatgtaatatttatattgtattatatatacgtgctagttattaattatttttaatatcaaattttagttatttgtaaattatattcctatatttactctagactcgtctttcaatatttcctttttttaatttcaaatttccgttatatgtaaattgtatttctatatagactctaggctcttcttccatttgtaaattatatttttatacggactctaaactctactttaattttattatgtttattctaaattttaggttaattttaaatttttatatagactctatactctacttctaatatttcttattttttaattccgaatttttaatttttcttaattgtatttctatatggactctatactttacttctaatattccttatttttaattgtatttttctaatcatctggcctcacaacaaaaacaggaagttctttactagatcaatgtataggatcttgtcttttgggagggtcagggatactgatatgtgggaaatctggaagtgcaatctgcctcttaaaatcaaacattttctttacctagtatgtagagggagactgccttgtgctgatcagcttgttaaaagaaagtggaggggtactaagttctgtaaactgtgtcttaatactgaaacaactaatcatatttttgtgtggttgtcccttggctgtttttgtttggtgtgtaattagagaggccctgcacctctcctctcatccagccaatttctgggactgtttgaggctttgggtgaacaaaaaagattcgaggctttgggttttctttgtgggctgtgtttgttggtccttgtggattattaggaatggttgggtttttgagaacgttttattgtcctcacctccacaggcagtttataaaactttatcttttgtatagaaatggtctattctgctaggagaagaggaacgagccacgctgagaagctggtgtgagaagatcttggaaaagctgaatcatctgagacctcgtgctttacctgtgtccctgagtctgtagtgtaaggaagtgtgggggttctggttgtattttgttggatggatgctataggctccttaagtgtttgctcttgtaagctggcggtcccagcaaactttatcttttacagttttccctttatgtaaaaactcagttatgtttgggctttcttcaaaagccgggtcataatgatctggtatcaaaaaaaatactctacttctaatattccttatttttaattccaaatttctattattttctaattgtatttctatatggactctacactctacttctaatattccttatttttaattccaaatttctattatttcctaattgtatttctatttggactctacactctacatgtaatattccttatttttaattccgaatttcagttatttcctaattgtatttctatatggactctatactctacctctaatattccttatttttaattccgaatttcagttatttcctaattgtatttctatatggactctagtctcctcttctaatatttcttatttttaatttctaaatttcaactatttctaaattgtatttctatatgtactctagtctcctcttctaatatttcttatttttttaattccgaatttcagctatttctaaattgtatttctatatggactctgctttttctttttctccgattaatgtgagaatttctaggccgtgagagcgaacgtggaggctcctttttctattcctttaataatataatagattgcaagacgaatctgttaaacctaattacgccatgatttgacaatgtggtactacagtaaacatttgttaatgatggattaattaggcttaataaattcgtctcgcagtttcctagcggaatctgtaatttattttgttattagactatgtttaacattttaaatgtgtgtccgtatatctgatgtgacaatcaaacccaaaatttttttcccaactaacgaggccttagtacacgttaaatttcgatgcctgcaatacgacatccattaaaaatgagatataactgctgatagtttcaaaattttaacccatcaaagatgactatgctacgtatattccccaacattgtagtgaaatacatgcgcctttacctctacctctactttcacctcagacacgagaaaacaacattagcacaagaggtggacggtggcaacctcctccatcccccttaaccgtggtatcttatagcccttgcgcggtggctagacaccttcaaatttgtacgtgccagcctagtgcgatgatgaaacaatgtgccagcaaggcgcagtgaccagtgagagaggcaagacgaggagcaaatggtagcgacttccccaaagtagacgaccttctccaacttttgccgctgtcatgtccttgatccctggtgtggtggcagaggtgggaggctaggacgataggaagggcaccgaaattgtcacgccccgaactagtcccgaccggaactagcccgtgacgctccaaattaacctgttaatcgataccagtcccaggaaacagtgctggtatcacagggagacagaatatcacagcaacagaggtctctttattatagagtagatgtacagtcatgttgggctgcggacagatcccgagctcacaactgcaatacaaaagggaaacggaagccaggatttggaccaaacatcacaggcgcgacttgggaactaggccgaaaccctaaaactcttcatagccggcttgctcctggaagaactcctcatcagcaggatccgcttcatcttcttcagcaactgggggcaattatttatatagagcaagagtgagtacggggagtactcagcaagccatgggaaataagtgtttaatgcgggcttcaaggaaaggctgatgtttttgcaattaattttatttgaactattttctgaaacgactaagtgagtgcttctcaaacgacacggatgagacagtgcatctcgtccggtcggagtatgtgcaatgtatcagtctttagaatttaaacaaggttggcacccggccaacagctttttcaacggccacccgggccaacaacttttcaaacggccacccgggcccagctgatcccatcagctgcagatttttcaaacgccgaaccccttttcacacagcaatttcacaagcagtagtcaaaccaaactacgctaggaatcacctcacatccgcccatgaccgtggacacggctgttcgaacagtttgttaacctctgcagagggggtacactttacccacacgacattactaacccgggtcacctagcccgtggggatcagccacgtcgggagacctccaagctttcatgacaaggcatttctaaagccgacacaggtttaccatatgccgacgagaggggtcccagaccaacaacaggttaggtcccagaccatactgtgccaggaagcccaggggtcctccccgacaccaccccggtgaatccacatgtctctcggcatcaaggttcccctgataagctagttactcagccaggggtgtcccattccacccatgtggtcgtacttgtcttatgtttggatgaaattccaaggaatcggtccttaagtgcgagagcgggaaaccgtacacccggtacatttcccggtccgcggtttttggaaattcatttagttcgcaagcaccgacccaggtgtcgggttttccaagtctttttaaaactccagttttacccaagttgttactcagattttaagtttgaaggcggccgtcgatattggcacagggtgcacgaatatcgaggcgcaactagatggttacaaggggacatggtatagaaattatcaatggaaggatcaatgcaacaagttaggtaggcctgccaatctgtcttgcagacggaacaacagattaagtgcgatcctatcaatgcataatatttttcaagcaacataattagatttcaaatataggctcaagatgttcaaaggtggcttgccttgctcgagatctggagcttgatcctcgaaatcctcgcactgtgggtcttcgggctccgaaactatacgcgaaacgggacaactcaacaaagggcgaaaataaagccctattaatgacctctaagcgtgccattaaatagatctcgagatttgagaaattttggaagttgaacggagtcaaacggatttacggttgggatgatattgaatttctaagattattggatttttggtctaaaggaaaaggatttaattaaatcccccttttttttggaaaagaaaagaaaagaaaaaggaagagggagggaatatagacttttcctcgggcggctaaggcgcggcccaagggaattggagcggctcggccgagcttaacgggccggccggcctaagaaggcggcccagagcggcccaagacgcgcgcgcgcggagggaggagagagagagccggtggaccaggctcaccacgcgcggtcccgggtgggacccgcttgtcagcggctcggctcaccatgcggagggagtacgtggctcatgcgcgcgggcgggggagggacgcggcgcacgcgcgcggttcgcggtggacgcgggtgcggcgggcccacgcgcagcctcacggctcgcggtggaacgcgcgcacggggagggactgaccggggtcggctcggcccggtctaggctgagctggcaccgacgtggcgcctacgtggctgccacgcgggccggcgggaggtagacgacgacccggccgcgaatggacggcgggcggcggcggcgagcggcggagcgaaccacggcgatacgggcaaaagcgagcacaccgggcggttgctcgagacgaggggagacgagccaacggctcggattcgccagagggagttcgacggcggcgaatcacggcggcgacaaccggcggggagggaagagggaaacgccgacgaggtcacgagggaccgattcccggcggtgagagcatctacgcggcttcgggaactcgatgccagcgtcggattggacggagctacgccgagcgaggctggcgacgtgcgggtgctacagagctcgagcagcgacggcggcgaggacacggcgagcgacggcaacggtcggggcggcgccggctaactacggggagtctactcgggctaccaccgaaagctagggggaggagatggagcgaggaggaagaacggagggaggcatcaccgagaagaggaggggcgctgtgacgagaggccgacggcgcgggagtaatctctccggcctcgggccagggaagaggaagaagtggcgcggccgaagtccccttccgcgtcctcgaacgcaccgggtctcccggcgctcggcgaaggacggcggaggcgagacagagcacgggggcggcggcaatggcgcggagacgaatggatggggggggaaagggggaggctggggtttaaagggggcggcaatgtcggtttgggaaccgacttgcgcggtcaagggcgcgagctggcgctcggcggtcgcggccaaagcggcgacagggaggatgacggcggcgaggaggaaaaggggaaaaggagggggagaaagggggcttgtccccttgccgattcgggaaaaaggaggaggggagcgggggcgacgcggcagagggaggaggggcgctgcctccgtcccttggcggcttgcacgcggagtggcgggggccgggcggtgacgacggcgatgacggcgggcggtgtggagcggagcggcgacacggacgacaggcgcggcaggcgctgacgacggcggcgaccagacggtcggccacgcgcgcgcggctcgcaacgggaggcgcggctgggcagcggggccgggcggcaaccacgcgggcgcgcgcacgcgaacacggcgcgcgggggccggctttgcgagcggggagctcgccagggatggggagaaggagagcgaggggagggggcgctcggcgcgggcgactcccgcgcacgcgcgcgggcggaccggaggaggaggagcacttggcgcggctcttcgcgcatgcgcgcgcggcgcgcgggcgaggcggagcggagctgagcgggggagaggaacggagcgcgccggggaggagagagggcgagagagagagagagagggagtgcccgggagagggagagagagagggccgggggagagggggagatgggccgggaggaaatcggcccatcgaccccgggaggcaaatagacttttgcggaggaatttgatttggaagaatttggattcggaattggactcgacgatagatcggggattgagatcttgagatggcacggacactagacgacaagcaaagaaacaaatttcgcaattagggtttttaagagataattttcccgctaggcgccacgacggaacgggcgctacagaaatcctctcttttggtgttgtgggcttactgagctccttcccgatgctcgtcgccattggaatcctcccaagggataccgccgttcagagagaaagagagagggatttggcaagcttgagctcaaacaaccaatgtgtgctcgccgctgcccccttctcctcgagtcgatatattggtgggtgacaaaggacaacgccgatattgttgggtagaggatgcattcatgcacctccttccctatggcactacatacactggtgcacagcgcagctccttcccaccatgcgttggtgtgctttagacatagcgaaaattttaagggggtgtaagttagatagttagacttatctttttctttgagtaaagtgcacgaacggtacttaaacttgtaatgatgtgccatctacgtccctaaaatctcagaatgcatatctaaatcttagaacttatagagatgtgtcatctaggtctctaaaatcttagaatgcatatccaaatcttagagcttgtcatagtgtgtcatctaggtcccaaatcaccacagcctcttcagaatcctacgtggtgctgatttggcgtgccacactgacatttaaaagtttcccttttcttttttcttttttttgttctccttcttctcttttttttccctttcttctcctttttccgtgacccgagcaaaagaaaggaaaaaagaagaaaataaagaaaaagaaaagaaggaaaaaaaagaagaaaatggcacatcacgtccacgtggcatgccacatcagcaccacgtatgatactaaagaggttgtgtcgacttgagacctaaatgatactaatgatactgttagacaagttctatgacttataatccattttaagagtttgacgacttagacaacacaaccctataaatttaatgagtgtctatgtactttacttttttattttttttcttctatcacaaatttaccgagccaagccgagtcaaacttgtccgttccaatgtcactaaaatgtggaccaacgtgtaagttccttcttcctccccacatccccggctacggccggaaaaaaaaaaccaaccaaaatactcacggacgccggcggccggcgtgccgactagtagggggcggcggatgtggagcccctccggcgaccggaaacgaaggcgacgtcttggcgccgtccggctagagctctcaggccgcagcgggcgggctggcctctctgccgccgccgcctcccagccagcgctgatgagtggcctggtttcgtgcaattaattattggcgacgtacggacaggaccaagaaatctcgcatcgagagtgacaagtgagaacatcacttgacccctagtctacttcatttcaaatcccgcaacttgatgctctagactactggtcactaccgcatcgaagacctagatgggcatcgatttcaagtcaatgtcgtcccatgtgcacaaatcagcttctggtggtggtagcattctagctggaaagaagatggattctttttccctagtggatgcatgcattcataccataggtcagctgagcatatccaattgacagtggccttcttcacacgttttctttttagatatttattcgggcttttgcttggatagaaactatagccaaaccaattatgtagatatgcctagtatacatatgcattctaaccttacttcctggagagacattgcgagaaggatagtcttcctcatggcaggagcaagagcaacagcattgtcctgcttctcactgttgttgttctgttcctatgccctggtctctccagggagcagcgatgccactgttgtcgatgagctcgcgctcctctccttcaagtccatgctgtcaggcccatccgatggtttgctcgcgtcatggaacacctcaatccactactgcgattggacaggggttgtctgcagtggccgtcggcaacctgaaagggttgtcgcgctgctgatgaactcctccagcctttcgggccgcatctcgccgttcttgggtaacctgtcctttctcaacaggttggaccttcacggcaacggatttattgggcagataccatcggagctcggccatctcagcaggcttcgggtgctgaatctgagcacaaattctctggatggaagcattcctgtggctctgggaaggtgcaccaatctcacggtgcttgacctcagcagtaacaaactccgagataagataccgactgaggtaggagccttggaaaatcttgttgatctgagacttcacaagaatggtttgtcaggagagatccctttgcacatatcaaatttgctatcggtggagtacctgtatttgagagataactggttctctggtgagataccacctgctctgggcaatctcaccaagctgcggtatcttgaccttgcgagcaacaagctatcaggatctattccttcatctctgggtcagttgtctagcttatctttgttcaacttaggccataacaacttaagtggattgatccccaattctatttggaacatctcctctctgacagtgctctctgtccaagtaaatatgctgagtggaacaataccgccaaatgcgttcgatagtctgcctcgtctccagagcatttcaatggataccaacaagtttgaaggctatatccctgcatcacttgctaatgcttccaatctgtcctttgttcaactcagtggtaactctttacgcggtattgttcctcccaagattggaaggttaagcaatatcaattggctgcagctttcgaacaatttgcttcaagctaaggagacgaaagattggaacttcatatcggcattgacaaattgctcccagttagaaatgttggacttgggtgctaacaagtttagtggagttcttcctgattcactctccaaccattccagttcactatggtttctctccctttcagtcaatgagattacagggagcatacccaaagatataggtaacctcatcagtttacaacagattgatctcagtaataactatttcataggaactcttccatcttccttgagtaggctcaacaaattgcaagctctctctgtttatagcaacaatatcagtggattagtcccatcaaccattggaaatcttacagaaatgaattatttggacctcgactccaatgcttttagtggcagtataccaagcacactcggaaacatgacaaacttgttggcactaggcctttccgacaataacttcataggccgaattccaatttgaatacttagcatccctacgctctccgatattttggagctatccagtaataacttggagggaccaataccacaagaaattgggaatcttaaaaatcttgtggagttccatgcatattccaacagattatcaggtgaaatccctagcacccttggtgaatgcaaacttctccggaatctctatctccaaaacaatgatttaactggtagcattccctgactcctgagtcaattgaaaggtctagaaaatcttgacctctcaagcaacaatttatccggtcaggttcccaagttctttggaaacattaccattctctattatctaaatctttcattcaatagctttgttggagatattccaaactttggtgtttttgcaaatgctactgccatatcaatccaaggcaatgacaaactttgtggtggcatacctgatctacatttgcctccatgttcttcagaatcgggaaagagaagacataaatttccactgatccctgttgttgtttctctcgctgcaacgattttcatcctttcattgatctctgcatttctgttctggcgcaaacctatgagcaaacttccttcagcaacatctatgcaaggttacccattgatctcttaccaacaaatagtgagagcaacagatgatttctcgacaaccaatttgttgggttctggaacatttgggactgtgttcaaaggaaatataagtgctcaagatggtgaaaatacaagtcttgttgctataaaggtcctaaaacttcaaactcctggggcactcaagagtttctcagccgaatgcgaagcactgcgagacttacggcaccgaaatctcgtgaagataattacagtctgctcaagtattgataacagagggaatgacttcaaagcaattgtacttgatttcatgtctaatggtagtttagaaggctggctgcatcctgacaaaaatgaccaaacagaccagaggtacttaagtctccttgagagagtttgtgtactgcttgatgtggcttatgggttggattaccttcactgccatggcccaacacctgttgtgcattgtgatcttaagtcaagtaatgtgctcttggatgctgatatggtagctcatgttggagactttggcctcgcaaaaattcttgttgagggaagctcaatgttccaacagtcaacaagctcaatgggatttagagggacaattggttatgctgccccaggttagtgttatatgtttccttacctgtttgcaccccaatcaccttttcaaaattcagaagaaaatgtttaatttgatgcaaccttttgttttccgatttctagcttatcctacatttctgttctgtatttccaaatgtttgattcaacagagtatggtgctggaaatatggtatcaacaaatggagatatctacagctatggaattctagtgttggaaacagttaccgggaagaagcctgctggtagtgaattcagacaaggattaagccttcgcgaatacgtgaagtctggtctagaagacgaagtgatggaaattgttgacatgcgtctatgtatggaccttacgaacggcattccaactgggaatgatgccacatacaaaagaaaggttgaatgcatcgttttacttcttaaacttggaatgtcctgctctcaggaattaccctcaagcagatcgtcaaccggagatattgtgaaggagcttctggccatcaaagaatctctctcaggcgacgagcacaagatgtgatgatggaagatatatatgccaaatgtcatgctgcgatgattcatgtatcgatgatatatatgctgttggatgacattaggctcctttctcaagtgttccatgaaatgttttgaacatcgaatgatcactgaaattgtatctttctgctaatctgtgaacctgagagaattatttcctgtattttagtcagagctcaatactagttcataagcctccactgcatgctgaacctctgtagtatatcaagtatgcagtagcagtctattagcttcagctataatcctgtgccgtattatcgtttaccagtaacgcgtctagcattgtcgtttcttcagtttcgtcagagtctgtttcggcgtctgtttctctgtttcttttttcctataagccgagtcttccgggtcgtgcgtcgtgtgtgagtcatccgggtttcagcgtcgtggtcaagtcgtcgtggatgatggcgtaatggtgtcagtttgagtttgtacatattggctatatatatgagcatcagaaaacgtcgcatgttggttcgtggcaccaaaatcctgttcgtgttcatcgttaccattctcagagaatttgcgtgagagagagagatagtgaggatccacaatcttgggctcgggcgctcggctatcatttcgtatcatagccatgtccgctcccaccagcggcgcgccacgcactcccggcgaactggccgccggctctcgccgtctccgccacggccgcgcgggcgacagttcgttgttgctatttcttaatgatattactagaaatataattcccaacaatagcgcagaaatacttctagtatattatggttacagagttcatccgcaagtgtatggatataccattgtagcatttcactcgagagtattccaagggtatcgtatttgtttaatcccataaaaagattataatagagagaatcatactaataatttatatatgacttgtaataatccaaagtctaagcatgggttaatataattcagagggtagagtgacactaagcagaagcatttatactctcattcataattatctaaactaagtggaaagaacatagaaagatactattcctatacttctagtatacatacatattatacatacatcctaggcatattattacttagctaatatcctctttccgataccctcttggtgcttcgagaagtcacccctgattgccgagtttcttacgacaatccgtcatgactgtccaaccgggctaaatacggagtaccctccccaggaaattaacttaggactatatacacgtgcggaggaatacccgtactgagctgtcaccatcagcggcccacctcgcttccgcagcatataaccccaaataatgatatccagtaatctaaacaccacgcttaaattaccaaatactactctaatatcatcgtcatgacatagagtcatcgtataaacgatcattatacccacaccattgcatctcccagataagctagcatcataataaatgtaacttggacatataataaaattggtattcatatactcggaaagtaatacaataccaaagtagtataaagaagaatattctaaataaagtacaagtcttacaaaagaaagaaaagctactagagccacacccgaattcttccgaagactttgaggactgaagattatattctatttctattccactatactctagagactatactaaacttgagagatgaaacgagcttcttgcttaagatgtgtggagaaagtgagaaggtgaagcccttttatagcctcccaatgatggttgtaacagttggaatgatcggaaataccctccaaccgtcattaggatgcaatcccagacgtccacgccgaaccttggtttcaacagtggagatgggggttcggctgaaccatgggctggtccaatctagcccattttcggctggcggcctcctggacttcttctcttcgcggacttgtgaatcttggcccaattgatcgtgtcatttctgagttcttggcccattcgttgataagtttaattctcgacattgtccgattgattgatcgcctgttttgatgtcgattcttctccatcttatatttattctctgcgagaggttagtaatcctagtgctagtgaaatatttattatcaaacataaatatgcattgcaagcatgactagttctcctttattttggtactattgacaatcgaaactgatcgttaacgaccgtcaacaaaatcccccaagcttgaacctttgctcgtcccgagtaaaggacgaaaggaaacaaagtcctgattgttgatcaggagttgctactatgatgtatatctcaaatgtacaggtgcaacgtatgtgtactctttctcaaatcaaataatttttggcacggtgttttacccttacccctgattttgtcacgaccggaaataaccc

SEQ ID NO: 70731 - DNA, 5573 bp, Oryza sativa
atgtaattacactgtaacttgcatgtaactacggtgtaacttgtataagtttcacgtaattttgaattgttaaatctattataagttttgttttggtgaggaagaaagaaaatcacagcgcacacatatgtgtaaggatttgttcccacgacctctattttaccaaaataacatattacagagagatttttgaaagttacatacaagttacactatagttacagtgtaattacactacgattgtactgtaattacatctatcaaatttttgggagaaaatttgtcgacaaatatatagcaaaatcgatatcaacatatttagaaatacggtaattaccatattataagaaacgataatttctataagaatacggtaaatatggaaatgatcggtataacagcaaaactatttccgtttccatttccatattttttaccatttacttacaaaaatcttccagaaaaaaatcttatcttaataaccatcgttatctaaaagtaacatgttagttacgttagatatactcgtcttaaaaaaaaccacggaaaaaaatccgccagcataagcgatagagaaaaacaacggaaaaaatggaaatccagaaaaaaaaatctaccgtggtggaaaaaagcaacggaataacaatggaaaaaaaaaaaagaaacccaccctcgggctgcgtgcgtgccggtaagcacacacgtcaactaggaagcccctgaaacaatatactcatcactatcttctgtataccaaacaaacagaggcagggttgaggtgtggcgattcagagtaaaatacaggtataaaacacagaacatgcatgatcagatatgctggatcaggaaatagccacgatgactttagtgatcgtgtggtagataccactgaagaagtctgatcggaagagcattccaatctgaagactagtggcaataaaacattacaagacataacatcagaattcgaggctcgcaccttcacacactggaaacaatccggagagattctgtttgatggcattcagttcgtcgatgatatctccggttggcgttctactcaatggcaaaacctgagagcaagacaacccaagtctaagcagcgaaacaatgcattcagtgattcttctacatggagaattatttgtactgttcagccagttctcagaatccaaaatgagcttcgtgtcaacaacatccgtcactctgccatgtaggcccagttcaacgtactgacggaggcccaaatcgggtctgaatgtactgtcagttggccgcttcccggttactatttccagcactagaattccatagctgtaaatatctccatgtgttgatgcaatgtgcccgacgccatactctgtttgagtaggaaatacgatttcaaatttccagtgttaaataaaaaagaacttggatgtataattatgtaaaattacgtgttaaatatcacaaataacaaggatggctggacaaatggtagatgtaaaggttggattaatttttattatataaagaaacataaataccaatgaaatttcatatttaactttaagaatctaatttacaaatacatatctaaagaaatttggtatgattgtgctatacagttaccccaagcaatcagttgctataatggctaattacttttgtacgaatcctgtttgtgttcattgtgattatagtatatcacacaacataggatatttcgtttttgtatctatattattttcaccacctccatgtgggaattagaagtagtaccaagtatttttcatggtcaatgcaagttcttgaaataaaaaattgtaataactagtacatacaaaaaaaaagtgtttcttaaatgtagaattgacaaatttactcaaatttgatccttctgataatcatttcatattgcagtgtagagcagaaaacacccataatttgatttgagtgtgtagtagctctagagtcctatataaaaaaaaatctgtacctctatgaactagctatatttagcatctgaatagatatggcaaataatcttatttttgtgcaatttaattagttcaattaattacttatattctccatcagtttcactagaggtaaaaactatttcatatagcactagagatcagaaaatgcaaaatactggaaggacttgctgacctggtgctgcatagccaattgtccctctaaatcccatcgagcttgttgactgttgtatcaatgaggtcccatcaacaagtattcttgcaagcccaaaatctccaacatgcgctaccatatcagaatctaacagcacattgcttgatttaacatcacagtgtacaacaggttcagggccatggcgggaagatagtccaatgcacaggcaacatcaagtagtatggtcactcttcgatgcagattcaagtgcctctggtctgctggatcatttgtttcagggtgtatccaatctttcagactgccgctgggcatgaagtcatacacaattgctttgaaatcgttccctctgttatcaatgctcgagcaaattgtaactatcttgacaagatttcgatgtcgcatatttcgtagtgcttcacattcggcagtgaaactcttgagtgccttaggattttcaagctttataccttcactgcaacatgatcttggatattaagctttcctttgtatactgagccaaatgatccagaacccacaaaattagtcggcgcgaaaccatctgttgcttttaccaactgcgaataagagaccaatgggtggcctttcatggaagttcttgaaggggctccctttttagttctcttgtgccaggttataagcaagtagagtgatgagaggatggccagtgctgcgaccagagaaacagaaataggtagaactgggaaatgttttctattctctagtaatggacaacatcgaggcagatgtagatcaggtattccaccacagagtttggcattgccttggattgagatcccggatgcatctgcgaaagcaccaatggttggcacttcccccataaagctgttgaaagaaaggttcaaggaatgaagcatagtaatatctgctaaggatgtgggtatctggcctgacaaattgttgcttgagagatcaagagtttcgagacctttcagctgacccaaggctgatgggatgctaccagataacaaattattttgcagataaagataccgtaagagctggcaatcaccaagcgtgttagggattttacctgataatctattcgattctgcatgaaattctactagatttttgagatgccctatttcttgtggtattgatccctccaagttattttttgatacattgatcattattgatagtgtttgaatattgaataattcactgggtattggaccactaaggttattagttgaaaggcctaatgacaacaagtttgtgaggtttgagagtgtgtatggtatccaaccactgaatttgttggtgccgagcagtaagatattaagttcagtaagatttcctatggccaatgggatcgaaccgctcaagttgttttcgtaggcgactagaatgcctaagtttctaagcctgcccaacgatgatggaagagaccctctgaaattgttgttgcagagatagagatgttgtaagccaataagattgccaatatcctttggaatgcttcctgtgatcttattcaaatcaagtgcaagaaaactaagcgaagtggaaagattggaaaacgaattaggaagaactccccccaggttattttctcccaagtccaatgtttgtaatttggagcaatttgttaggtcagaaatgaacccccaatcttcttgttctctagtttgaaacaaatttctccagagatacagtgttgtgagatttcttaaccttccaaaccccgaggtgataattccactgaacaagttgccatcaatctgaagctgtgtcagatgagaagcattagcaactgaggcagggattttgccatagaaacggttagtgcccatatctatcacctcgaggaggtgaagggttttgaatgcatttgtagggatcataccacctagcttgttttcgctgacactaaacgctcttagagacgaaaggttccagatagaattggggatcatcccacttagattgttctgtcgcaaattcatagtcaatagactgctgctgagctgccctagcgatgaaggtatagctcctgataatctgttgcagctcaaatcaaaatactgaaggctagtgagattgcccaaagcagatggaatctctcctgataaaccattggtgtgaaggtacaaattcgagagatgtttcaagctggcaccaatctcacgtgggatcatacctcgcagttggttgtggctgaggtctagcgatgtcaacttggtgcatgctccaatggccgcggggatgctcccttggatggagttaccgctcagctccagcagctgaagcctgctgagacggctgagctccggtggtatctcgccggagaggtagttgtcgctgaggtccagctccctgaggaaggacaggttgcccagcgacggcgagatgatcccggacaggttggacgagcgcagcagcagcttcaccaccctgtgtgggtgccggcggcggcggcggccgcacacaacacccacccatgtgcagtgctggccgtggccggacgtgttccaagatgccagcgacaagcccccctggtgtagcagggatgacttgaaagagagcagcgcgagttcgtcgccggcgacgccgcctgtactggtacgagcagcagcagcagcagcagcatcgtcactgctcgctgggccgatcaacagcagcagcagcaaagaagagatcatgaccgacgttggtgatctcgccatgcatgcggaggaggagtgcgctacaatgagctgagctgatcaatgcagtgtttggattcaagcactggtcctataacagtaaagggatcccaagtcccaacaaatggctcctgtcaaaaaaaataaaaagaagtcccagcaaaaggaaaagaatgaaacattactggctactccaagaaaaacggatcaagctcttctggtcaaagtcttcaatgaaaataaaagatactccagttggtgtaccttatcaaattttcaaagtttcagtcatgctgcgttctttaccgcctcttcctaactttctaattaagggagtgtctagatcacaccctaaaattttgcaccatgtcacatcgaacgtttgaacacctgtacgaagtcttaaatataatctaaaaataactaattgcacagattatgactaatttgcgagacgaatcttttaaacctaattgctccatgatttgacaatgtggtgttacggtaaacatttgttaatgatagattaattaggcttaataaatttgtctcgcggtttactaacggattctgtaattatttttttattagtgcccgaacacctaatacgacactctacgttatcgagatgacatgccaaaactttacacctatggatgtaaacaccccctaattttatatgcatatgcgtgatgaaaaatactcagtgacactacctatagctat

SEQ ID NO: 70732 - DNA, 8214 bp, Oryza sativa
aacaacaccgctaaaagaattaacaccaaaggtaagcatggagatgttggaagcattagctactgatgcagggatatgcccatgaaactggttgttatccatgtatacctcttggagatggggaagtgtactgaatgcatttgcaggaagcataccactcagcatgttgtactgacaccgaacacggtgagagaggagatgttccaaataggatccgggatcagtccacttaaattgttagagcttaagtgaagggaagacaatctagacaatcgacccagagatgaagggattgctccagacagcgtgttgtcagacagagcaagctccaagaggctgttgagattgcccaagcacgaagggattgttccagacagtgtattcttgttcagatagagagaggagaggctggtgagattgcacagagacgaagggatacctccagagagtgaattttctgacagtgaaagaaacgagaggccagtgagattgcccagagcaggtggaatctcacctgatagcccgttgctacctagtgacagttcttggatcgatggcagctctgccaacgatcgagggatctgtcccgacaggcgatttccttcgagatacaggtaggcaagatttttcatggaggcgccaatctggaggggaattttaccttcgagctggttgatggtgaggtccatctcgatgagacgaaagcagcctccaatggcggcggggatgctcccttggagggagttgccactcatgttcaaccgccggagcctgcttaggcggccgagctccggcggtatctcgccggagaggtggttgccgccgaggtgcagcttagcgaggaaggagaggttgcccagcgacggcgagatggtcccggacaggttgaacgatcgcagccgcagctcgaccaccctgtcccgccggccgccgcacgcgacacccgcccatgtgcagtgctggccgtggccggacgtagtgttccatgatgccagcgacgagcccccctgggacacaagagacgacctgaaggagagcagcgcgagctcgtcggcggcggcgccgcccgtgggaacggcggcagcagcggcgtcgtcgtcgctgctcgccggagggagcagcagcgaggaattgaacaggagcatgagcaacgcgagtgatctcgccatgcgtgcgtgtcgatctctgcaagagtagctatcgatgatcagcgcttacctcgttgtccgtggattgaaagcacttttcaccggtcaaagtcttgaacttttttttctaatatatttttttcttgtccattttagaaataattaacagtggtggagtgagcataaaccaattggtgaattttctggtggtggaacctgtctactcgggttaaagttctagacttagcatggatactgctttacgatggctaattattctttcagtggaacatatacccatcggcgacgagatatctgtggtgactttatgaatcaaaagatatatactggtccagtctttagaggtacttataaagaaagatagagtgtgcaagcgcctgcgtttgtcctttgtttttgcaaaaagagaaaaatgattaagaaagcatttgactttggacaaccaatgtactaatagtgatgaagaaaaccacgtatggtgtactggttaattttggaggagactgaaaatttttagagacacgcagagccaaacttcagtcgcagtcaggccgacgtggagaactcagctcgatattcatttgttggtcaccatgtgtttacttctgcaacttgtgcaatttgcaaagcgaaaggaaccctatcattcaaaagaatactgcagctgaatgctgattgctgagccgaataaatgtccttatccatgtggttgtctgttttctgggcgtctgccttccggacgcggatcgtctgactcacggtgtgactttcaagccatatccaccgtccgactcatccgacggaggatatttcctgcgtgtggttcctgactcattattatttacttgcggattctaattaaggattaatgaatctaattaaacactattacgagattagtccggtaaccaaaaatgacatgccactatgcgagttaagctatttttattttggtgattaaagaaaacaaataatcttctcatggcattagcattcagatggcattaatggcaggaagcagcgcgcggccgcgggagagacgtcggatgagtcggacagtggatatggcttgaaagtcacaccgtgactttacttggtaaaatcggacgatccgtgtccaactcagggcattagcagtgcgtcaccacatggtatcagacttggtgtgccacctagactctcaggaacatctagaaataatgttagccacaaatcccacaatgctatgtaatctcaagtggggtccacaacaataaaagaatctccttttctcagtttttcccctccctctctcctcaaccaccgacgccttttcccctcctctatcgtgcaatggcggcggtttagggtgacgacggcaggcggcccaagcggctacggcgatgtcagcgagctcgcccgatctgatgcctggtggcggtggcggcggggccaggcggagctgcgtcaccgacgccggggcccgggcagcagggctgccagatccagccttaggtgacgacggagacgggcggagcttcggcgccgacgccggggcggccaagcggctgcacggccagatccggctcggtggtggcggccctcgcctcctccctcggccggtgcctctcctcccctcccagtccatggagtgacctcgtcagcgacgacctcaagttggctgtggcgcttcgacctgccgggacggcgacgagccctgcgatgaccggtggtggcggcggcgacgagccccacgacggcgcctctcctctctccctgcttcccccggtttctccctcgacgtgggcgctcgttcctctcccacgctctgacgtatttctgacgaggaactcatgcccagttttggctccctgttcttcacttggtcacgggagtagcacatatggcatggaatctttgacgtggagggttgagaatgaatgacatatatgtgcattgtgaatggccttacatgttacaccaggcaagttgtgaaaagcaacagcgaacttaccaccagccccgcacacaatttgaacaaggctgctactgcctaagaacagacttgcctcagaccggacaccacccacgtcttccacttgttcgtgatcgacttcgcacctgctcccatataggtactcaacctggtaaacttacaacttctgttgcgaggaattcagaataactgaaattcagaattaaaaacaaggactattgaaagaagagtacttataagaacccaatacgagactaattaatattatattattaaaacaattttgaaagtaggcaccacgctcactgtggggctagaaactcccacattaatcggagaaaaagaaaagaagagtccaactagaaatacaattgaaaaataattgaaattcgaaattaaaaacaagcactattgacagaagggtgaacccaatacgagactaattaatattccaaataaaaaataaaataaaattcgaaattagaaaaaaataaaaagaagagttcgagtagaaatataatttaaaattaactaaaattcggaattaaaattaagcaatattgaaaaagattccatataaaaacccaatacgagattattaaaattcggaataaaaataaaaataattcgagaatagaaaaagaaaagaaaactaaaattcagaattaaatataagcaatattgaaataagaaataagagtacatataagaatccaatacgagattaattaaaatttgaaataaaaaaaataaaatctaaaattatacaaattaaaaagagagttcaaataggaatacaattttgaaacaacttaaattgaaaataaaaaataaaaatattaaaagaacataatatgatattagttaaaattcaaaacaaaaaataaaataaattctgaaattaggaaaagaaaaataagatttcatctagaaatacaatttgtaaataaccaattaaattggtgataaaaaaataaagactattgaaaaaaatactatgtaaaacacatggcgagattaattaagtaacagacctataaataagtagagtgctagcagttgatgggatatctaaaaactattaataaaacaccaaatagagtcttaatgatgattaaaagaaaggacgacgggtaggttgtgaagcaattggttaaggcggttggtgggacttgtagaaagtaaaaaaaaaataaaccccaataataatcatatttgatttttaaagtctcaatgacaataaaaattagaggcagtgggcgggtcgtacaggagtataatggcagagcctctgatagttggtgagacttctagaaagtaaaaaatgaattccaatgatagttatgttcgattttcacagtcccaatgacaataatgaataggcggtggacgggtcgtagagtagtacagtggcaacgtttgatgggaattctcaaaattatataaaatgaaacccaacgagacaataaactcaataaattataaggtccaatttttaaaggttcgggcttctaaaaagtaagaaaataaaccccaatgataatcatgtttgattttaaaatctcaatgacaataaagaagggagctaacaggcgagctgtagaggagtacagtgacaaagttgctgacgttttggcgaaacttcaagaaagtaaaaaaaaatgacctaaacaattattatgttcgatttttaaaataccaatgacaataaagagaagaggtagtggacaaccgtagaggagtataatggcagcggttgacgggacttctagaaattataaaaactaaacccaacaagacaatgaactctaaaaactataagatccaatttttaaaggttccaatgacataaggggtagcaattggtgtgacttttaaaaactagaaaattagaaataggaggatgataaggtttggtctttcaaaatattaacacaacgagataaccatttaataaattttaagtaaaataatattaaaatatatataattttgtatgggtgctagccgcgcaattgcgcgggccacctagctagttacatatgatttgtgatttgtttagaatatatcagtagtacataacttccatccgtgatggcctctaacaagcctagaattagcgggccgtcacaaggaagttatctcaatcgcccgattgagatatggtcacacagacatgttagataggcataaaactcaggctcgtcacggataacacctataagtgacggtctgtagtttaggcccgatttagataacattccatatctcaatcgggcacgggcccgccacggatgacacctatccgtgatggccggatgcccgattgagatatttgcttagtgacgggggctctacccgaaagaaacaaggctttaagcccgttagagataaccgatcccgttttagtgtatacagaagttcaacgccgattatagttgaacactgccaatctatggagatcaatggtcggatgagtcgtttcacaagattttgtcacacgtacgtttagcagccataaagttttgccggtaaaggcttgccgtaacctatacatctatgcgaatgcggatgaggcggcaaggggacaaccgatatcagcgtcttcctcctcacgtcgatctcgaccgtccaattcttgccgtcctcgtcgtcatcgcatgcgacgaaccagacgacgtcggggttctccgagctcacgaacgggcacaccacgtacacgcgacgcgggaggccgtcgcatggcgccagcatcgcccagagctcctcgcagtccagcacggcttccttcacccacgccatcggctcgccgccgccgtcgccgtcgccggcgttccgcagggcaagcctccagatggtcaccatgaacgccgagctggagcggtcgcacaggctgcgtatcaccggcgcgccgcagcagcagcggttgtcgatgctgacgaaccgcattgtgtcgtcgccgtcggcggcgacgatgttgcggaaatactcccatggaatcagctcgtcgtggtggtggtcgtcgtcgaagtcgctctccttgggtggaactggcttcaccggcagcggcacgtacaggagcttggggttgtcgagatccgccgccgccatgtcgcagatgaggaaggtggcgaggtcgtagttggcccagcacatgaagcggtcgccgacggggacggccacgttggtctcctgccacatctccatgccatggcggcgttcgccgccgccgtcatggtggacgatgggcaccgccgtcttgagctcccactcgcggtggccgtggccggggcggagcacgaagagctcggccgtttcgaacggcggctcgtgcgcgatctggagctgcgccactagaggcggcggcgcctcctcgccgccgtcgccgccgcggaggcgcaggatgccggtgtcctgctggtcgaacacccggcccgtggtgcggaagctgtccttgaaacggtgcttgctgacccagcagcgctcgttcatggggatgtcgcagacggggagcagcgtcagcgacggcggcttgccggcggcggccatgtagacgaagtagtcgttccaactcatccggaagaggacagagtcgccgtgagccgcgatgacgtagccatcatccccgcgatcgaagcagatgaaggagatcgctggcggcgacgcgcgggcgagggcgacgcggaggggttggccgcgggaggtgcgggactccgcggcggtgttgtcgtcggcgactacgttcgccggcgtggagcccctgaggcagccccaacgttccagcatcaccgaggccgggtcagcagtcgcggccgccgccgtcgaaccagcggattccgtcggcggcgggtgggtcacggtggttgccatgtggcggcggcggcgacctgggaagacgagatcgatggaggaggagaagcatcggaacggatgttcttctcggttgagcaacctcaggccaccgagaggccgcagcagcttgttcattggtgatggtggcgatcggaggatcggagctcagcaaggtgcgtttgccctagctaggttgatcacgacgatggcgtacgcgctaacaggtgatgtccgatcgatgggatataccatgtatatacatatacatatacatatatatatacatatacatatacatatatatacatatacatatacatatacatatatatacatatacatatatatatatatacatatatatatatatacatatataagccttgttaatagcagtctcttagcgaatattcgttgatatgagagagagaaagattagagataaaatattatatattattgctatgggtagggaagaaaacggtcggaaacgatcggaaaacagcctcaaccatttccataatcatatttttctcggaaatgaaatcgaaaacgataaactcggaaacgaaaacgatatcagaaatatcgaaaaaccggaaacggaataatactgaaggaaacatgtcggtatagatcgaaaactggtaacaaatacagaaacattaaactatagaaaacatatatttaactttacataagtatgttatatgtacaaataaattcaagctatactatataaattagaaatcaactccattttagccatgcaatcaagttagggatttgattaaatagtcaatcaatctctaaactgtaagtcaagtagagacataccctataaatatcaacgggaccatctatatatttgtcgacaaattttctcctaaaaatttgacagatgtaattatagtacaatcatagtgtaattacactgtaacttatatgtaattacactgtaacttgcatgtaactacggtgtaacttgtataagtttcacgtaattttgaattgttaaatctattataagttttgttttggtgaggaagaaagaaaatcacagcgcacacatatgtgtaaggatttgttcccacgacctctattttaccaaaataacatattacagagagatttttgaaagttacatacaagttacactatagttacagtgtaattacactacgattgtactgtaattacatctatcaaatttttggg

SEQ ID NO: 70733 - DNA, 575 bp, Oryza sativa
tcacaaaaaaattgtaaaaaacctaaaatttcgggcgagatttgagcacaccggtgggggacgaaattaccgaaatttcggaaattatgaaccgaaatttcaaaccctaccgggagatcagtaactaaaaatccgagatcaaaacgatgttgccactaaacgctcttgatttctcaacgaaacccaacaaaacgaggagtttctaaaacagcgattaaaatctctccagcaaccaaagcggaccccattttgaccagcgaagcatgtcaatcaacatggacctcgtcgacgtacgagtgctccggccgacaagtccccacagtagccaggtgcaggcaaagccgagcggagaggagaatggataacctcgccgacgagtgcgctaccactgccggaagacgtgaacggtaactcctagtggtgggagttcagtggggatttggaaaggaatgacgtctgggacccatgtgtcaacgatgtggaaagaagacatgtcacaggggtattttgggcaatacgaaatgtcatggcctgcacgtgggtacactagaggctaggtgtctaaaatggcatat

SEQ ID NO: 70734 - DNA, 571 bp, Oryza sativa
ttcatctgcaaatggcccataatattatgagcctcactccggtgctttctacttatagtagaaaataatccgagccgttgatcgtatataatcgtagggttgagatctaattctactaccaccactcatagtggtagtagaaacgtggaggggtatatttgtccatagataataattcatgtaagggtattatcgtaaattattattcagtaactctaaaccttcgccattctcaagcggctgaccccatccatcgttgacttcgtcgcttgtccatctccctctccgcctccatcatctccagcgcgatcgacatctcctccccctccagcgaccaagggtggcccttctcctcttcgccaagccgctgaaggtccttgcccacggcggacgactagtcctgccatgtagctttgaccaagacaggagatcgccgggcaattggacggcggacgaaattcaacgggttccggcgaacggcggcgaggtaggaggaatgggcaactgggaatgaacgagtgtagtatggggatgtggtggacggctcggattggccaaaaaatgagctatg

SEQ ID NO: 70735 - DNA, 574 bp, Oryza sativa
gaattcgagctcggtacccacaaacgtatagagaatttggagacaatttagtaagtgctttaacatcttagaaattatcctttgaatgaatctttatctctcgtctgattcctgcggtccaatcaaataatggtcattcctgtgtttagcaatcgtctgttttgcacttacattcctatcagaatcttgtgtttttttattcctttgtttttccattcctgcgattcaaaggagctcttagattcattcttgatttaatagttgggattaaatctgtcttagatctgacggcttataattgcgtattggcgtggtgcattctagtggtaagaagtattatcttttcactacttttagatatcttgtggctaggcaaatgatcacactacaccatatcctcacccctttgactgcatacctgtgatgggcataagtgttggtcagtgatgagggttacctttgacgggttctacgggatgccgtcattagtgagccatccggctatagcccgtcacaggtatctactcacttgtgaatgcaacccgtttacggtcgagaatgcaacccgtcagag

SEQ ID NO: 70736 - DNA, 914 bp, Oryza sativa
atgtaaatcatttgtagcattttccaccatcatattgatattaatgaatctagacatatatatctatttagattcattaccatcgtcacacaaggacagatcgttctatctgtgacgggctctaatatgcttagaaataccgggccgtcacaagaaagtcatctcaattgggccgaaaagtgcccaattgagatatggtcgcacagacatgttagatgggtataaaacttaagcccgtcccgaatgacacctatcagtgacgggccacaactttaggcccgattgagataagatcatatatctcaaacgggcctcaagttgtggcccgtcacagatgaccatcatctgtgatgggccacaactttaggcccgtttgagataacattccatatctcaaacgggcatgaccatcatctgtgacgtgcacctcatctgtgacgtgcaccaacttgaggcccgtttgagataacaactagacccgtcacagatgactcatcagtgacgggctatatacttaatctctatcgggcattaactaaagcctgtcaccgatgactatttttccatttttcatatgaaatgtttatatttgtaagttgactatagcaaaataattttacgggtagaaatgatttcaaatggaaaaaatgtcaacaacaaagttgtataacttatcaatatttacaacttttagtttggtcatttttcaatataacattttttttgaacagtttgaatttgaatttaaaaatatgaaaacttcaaataacattttcaaatactaaatgatttcaattgaaaaagtcatcaacaacaaagttgaataactcatcaagatctaaaacttttatttttgttatttcttcatctgacgaaatgttagtaatattattcacaaattttacatatatgtg

SEQ ID NO: 70737 - DNA, 6275 bp, Oryza sativa
agatggcgcgtgcgaaagcggcgcatagtggggctgatgctgcttctagtgcgtcccctgcggcgacctcgacggaagtcgtggccgttactaggaccaggaggcggcgccacgtagtcctatcgcccgcctcatgcccgtccggcctccgtcccccgacgccctcacttggggggagctccaggctgagatggagagcatccttcaagcgggcgcccacggcgtgggccgcgagatcgaggaggccagggcggcggcgtcgtcggcaaaccagcgtgccgatcagctggcgcgtgatctggcggaggcccgcgaggacctccaaaagattaaggggctggtagctggaaacgagacgcagcggcgcggactcgagcactggatgtcagagctcgagggccatctgacagctatccgaggttcgctgcggacatcgttcaccggcctgcaccaactcgccggggagtgcggcgtcacgacttcgatcctggcgcatcctaacgagtggtcgttgatgtcgtcgctcgtggagctggctaaggcaatggaggtgatcccctccagccacgcggccaggattggtgaggagacgtctaacggcatctacatcggggcgtgccatgttcttgcgtgtatgaggctggcgcatcccgacttagaccttaaagagactttggatcggggggccactgatgacgcgcgtaaggacacgatggaggaagtcggtgacttgggggagtccgtcctccccctttttgaagagtaggattttcattttcctctatactccttaatcaacatgctgtaatgtcacgcccggaaattcactagtaatttccgaacttatttgtgcataaaatcctcgtccaggaatcagccgaggtacacaaactgacaatttaatatacagattcatcaaattaactaaaacgataaatacttacttatgaggcacttagtcctcatcatgaagaaaactgcagcggaaaataaaatctagcgaagctccggctccactcccacaggcagctcaactggggtataagccaaacgtcttctccttctggattctttttcttcaactgaggttgattgattattgcaaggtgagcatatgacatactcagcaagccacacagcaaatatgcaagtgcacaaggataccaaaggatggcataatattggctcatttgcaaaagcagcatttagcaaaacatttaagagaagtaaaacagtggagtaattaatcaggaattttaatcaacactgaacagcacacccatgctgcacaggcccaaccatcctgaacaaccatacccggctgtacagatctaactccaaaccaggagctaagcaaattattaccagttataacatctatagttatggtgagaggtgtgggactaatcacgaaaaacattgctcaactcgcccataaccgcgggcacggctattcgaatagttttactctggccagaggtgtaccactgtacccacaagacacagcctcaacatcatgtctaccatgcgtcgcggtactggtaagtacccgaatagaggctgtgacaataccctctgcataacacaactcaccacagtgcaccattcctggatcataatcacccccttataaaacaaggcatggactccccagcgacccccgtgggcttatttccgccacttctcagtctggtgctccgcaatgaatcatgttatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagaaattaattaaccaatcacgattgaccatcgtgaactatcattaagccatcattaaataatagtgagtcataagttatcccaatagtatgctaatgtttctaagcatggctaagcaatcatatctaatatctagctgaaccaatatataaagctcaactagtcaaattataataacccaaggtatcaaggaatagagtaatcaatgcgaataggccataacaaaggaataggttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctatcacgcaaaatgaggaaaaagactaataaaaaccaaataaacaatacataaaaagtaaacaaacatgtagatcataattttagatgaattatgagacttgaacggcctcattctgatttcatatgaatttattatgaattttacaagatttaattccaattaaacctattaaacggagactattccaaattaattaaatcatttacaaatgatttataacggagataaaggattaaagcaacctccggaaaagattggatcttatttggtagatgacatatattaaaaagaaataatatgccactgaaaagaggagaggatttatattgattttggacagctgagattaaccttgaccgagtcgactaagatcggatggcttggattgatttggcaagcgggcctcacgagataccgactcaacgagtcaactccacgtgacacgggatcacccaaatgatcaaccgaaaccggcgaacggaaccggcggctctgaactaaaggacgactcaacacggacgaacgaacgaagcacggggaacacctcattcgaacgaacgagcgaacgactcaacaacggctgcggctaaaccggtggactagaaacgattcacggtaaagccccggtacgacaaacgataggccggtgggaaactagggttgcacctacggctacacaactcgactaaaagcagcggctaggtttaagcggcacacagctgcgacacggcggcactaagacaacttgactcagctaggcggcggctcagcggacaacagcgggtacggtgcacggcaatgaccggctcgacgctaggaccaaacaatattagattgaattaagaccctagggataaagtacaccggtgaacgacaaaggagcggcggttgccggcgaaccacgatacgacctcgccggagatagagcggccggctgcggatttggagggcatgcacacgtagaggacgacgaggcgaacccaacggtactcaccacaacgacaatcgacgtccgacgacggccggcaacgacggggaacgggcggcggctcggttgaccggcggcggcgaagaaggacgggcggccgggcttcctcactcctcggcgcacctcttggcggcggcggtaagcggcggcgacggcaggggcggcgctgcggcgcggctgcaacccggccggcggcggcgacgaactaaacgcgcgcggcgacgaggctacggggcactagagagctcgggagagggggcaaacgaaagaggaggactagggggtcctttatatagccataggaggccgggatcgagcccacatcgacgggaaaaactcgggaaagtttatcttcgccggaaaaaggaaaggatttgatccgcgaaattggaaaggatttccatataaaattttggggatttcttggggaaaaggaagaggagattgagaggattccattcccgcaaccaatttggaaataggagcaacggggaggtcggatttggtggaggaagcggcggctgcacaggtacaggacggcagctcgggctctgtccaggcttgaagatgaacagtgccagggaggcaaattagacttttggctgggcttctacttcttggcccgattgaaagagggacacaaagcagactttggaggagggataaggccagccgaaaggaagggagaatgggccgaggacagaagctgaacttttcctatttcggcccgaaaaggagaaggggattttaaatacttttccaattaaattaatcactgaaatgatctttgaattgttaaaaatacttccaatgctcaaataatttcaagaaaaatcctgaaaatacttggacacccaaagtatttaacaatattaaaaccagaccatttaatgattaatttaatatgtgggtaattactgaaatgctctttgtatgattaaaattaggaattgagctccgaaaaatccgagaaaatttcagagagttgacttaaccatggagaatttaacaaaaattaaatccatccatgctttatattagggaaattttatttcccacatttaacttcacttgtaaattaatgaacatttaatataaattctataaataatttattaaataatttataaatcctgaaacaaaaatcaggatgtgacaaactaccccccttacaaagaatctcgtcccgagattcggaacggctagaaagaaaaagggaataggtaaactgcagtctatcttattccataactccgataattattctaaggctttaaagaaaactactgctgctttgaaactggtggctgagttgtaacacttgaagacacaactctagaagacgcaactggcactgcattggctcctgtgacaacaatgttgttgacctgaccttgcggctgctgatgcttcggcttcggacactctcttgcaaagtggcctggcttgtaacagttgaaacatacctgctgcttccttccactactgttattctcctgagactgatcctgctgaactggcaccggctgattagcttgctcgatgttaacttcattgctttcattagtctctgatttgatctcaccaccgatgtttaactgttgcgactgtccttgaccagcgaaagaagattcaccaatttggagtggcttgatacgctgcctctggctactaccttgtgcctcctggaatacagtcattttccttttacggttgtccatcctgttcttcttgtcttcaagtcgaattgctttgtcaaccagctgctgaaaatcagcatagtcatgagagatcaacataactgatagctcatcctttaagccttccaaaaacttctcctgcctttcctcgtcagtacgcacatcttctggagcatagcgagctagacgattgaactcatgaagatattccgtcacggtacgatccttttgcttaagtgcccggaactcacgctttttcaaagcaacaacacctgcaggtatgtgtgtcttcttgaatgcttccgtgaactccgcccaagtgattggttgtccttctgctctgttcatccggaaatgatcccaccattctgatgcaggtccttgcaactgatgtgaagcgaaaacaactttctcctgatccgtgcactggagcagttccaacttcttctcaatagtgtgcaaccaatcacctgcttccactgggttggtagtgctagaaaaggtaggcggcctcacacgaagaaaatcagctaacttgttttgcggcggtggagcattattgttcccttggttgagctggttctgcatctgttgtatcatcatgttcattaactgagtctgttgagccagaacttgagcaagagttgggttcccttcattgttattgtttccacttccattagcacgagtgttcaccatctattgcatattagagaagatagaaggagagaggttacactaaagacaagaccttaaccaggttaacactgatctggtgtgtgtagaccattatattgttcaagttgattaagcaagcaacctagtataattacacactcatcattgaaccactccaatgacgggaatgcaaccatacctacacacaagcaagcaacaaacgttctaccctactaactattcttcaaggatagtttggcggcataggttctaaggtaggatccaaacttcattccatgttgacatctgggcacttcagttcttcctcgatccacttgactgacctccataagttgaccacatcagcattttctagtttcaacaactagtttcagaactactcaagttgaaagagagaggggagtagacaatgaaacaatttgcaaagaattctagataaggaagaaaggagaaattttcacaaatcatgttttcggaaaatttgtccttaaggtttgaccatttggcttatcctacagtcgagatggctctgataccaacttgtcacgcccggaaattcactagtaatttccgaacttatttgtgcataaaatc

SEQ ID NO: 70738 - DNA, 855 bp, Oryza sativa
cttcagttcttcctcgatccacttgactgacctccataagttgaccacatcagcattttctagtttcaacaactagtttcagaactactcaagttgaaagagagaggggagtagacaatgaaacaatttgcaaagaattctagataaggaagaaaggagaaattttcacaaatcatgttttcggaaaatttgtccttaaggtttgaccatttggcttatcctacagtcgagatggctctgataccaacttgtcacgcccggaaattcactagtaatttccgaacttatttgtgcataaaatcctcgtccaggaatcagccgaggtacacaaactgacaatttaatatacagattcatcaaattaactaaaacgataaatacttacttatgaggcacttagtcctcatcatgaagaaaactgcagcggaaaataaaatctagcgaagctccggctccactcccacaggcagctcaactggggtataagccaaacgtcttctccttctggattctttttcttcaactgaggttgattgattattgcaaggtgagcatatgacatactcagcaagccacacagcaaatatgcaagtgcacaaggataccaaaggatggcataatattggctcatttgcaaaagcagcatttagcaaaacatttaagagaagtaaaacagtggagtaattaatcaggaattttaatcaacactgaacagcacacccatgctgcacaggcccaaccatcctgaacaaccatacccggctgtacagatctaactccaaaccaggagctaagcaaattattaccagttatacatctatagttatggtgagaggtgtgggactaatcacgaaa

SEQ ID NO: 70739 - DNA, 806 bp, Oryza sativa
aatttcccgcttcatgctaacccaccagtatttctccttcaagtctaagtacatctttgtactgcccgggtgaatgaataaggactttcatgagcttcctgaagtatcagctgtttaagttctctgttatctggaacgcatacccgctttccgttccatagggttccgtgttcatcctccgtgaaaccagcggctttaccctgtttcatattcttgaggagtccatgcatgttcggatcattcttctgagcctcgcggatttgatcgagcaaggtaggcttggcttccaacgcagccaagaatccacgaccaactatgcttaggttcagggcttccatctgttggttaagctcgggcggaatgccacggacgttaagattgttgcaatggctctttcgacttagagcgtcggcaatgtcgcgaccgggaaaattgccttttcccgaacgctagtgtattaatccccgtcccaggaaaagccggggtacaccatacaaacatgatataaaagacacatctttattacatcgataatatttacattattacaaaggcacttaaggcctgacaatcaaaaataaacagcagcggactagcgggcctacggctccatcttcacaggcgctcaactggggtataagccaagactccacctaagacttcttctccaaagcttctcttactgaaggggggagaaagatagagcaagaatgagtacaaccacagtactcagcaagccacaccggcagatgcatgattaatgcaaggggggtacaaggagtaataatataggggttaagttttgc

SEQ ID NO: 70740 - DNA, 4692 bp, Oryza sativa
ctctatttctgctatatattccattaatggtgggagcacgatgtgggacgtggggtgggatcgaaagggaagttgtttttattatcgaagtaaatcgtttactccgataacggtaggagtgggatgacggaaagtgcggatcgtaaccagagaagttgattttatcgaagtaaattgttactccgataacggtgggagtgggagtgggatgatcgaacatggggtgaggtgggcctggctgatacacgtttggcgcttggaatataggagcgcgcagcgctcccaataatagttctatgaaattctttaaaattcctatgtttcctccaaatcaaagggtagtaagtaaaagagactcggtaaaagtagagtaaaaggaaagagttttcacagggctctacgagggttcgcaaagtctccctcgtcgttccagtcctccagtcctcctgccagcgtgaggatagtgcgttgaaatactctggttatagggtaaaaatggaaaggatgcatgttttacatgcatatgcaaatatctttcatacaattttggtaagtaaatatccccttcgttctaaaaaatatatttagtattattgtttctacatggtctttaacattatattttgattgttgttttctttcataatattatcaagaacaaagaattaaatccacatcataagaaaatattttaaaatctaatataataatactacatgcatgcataacactaagcacggatatttttagttcatttattggtcaagttttcaagtgttgattttcgtgaaagcaagaacacattattactttatcatataataatttactcccgtctgtcattggtggtttatattgtttggcttttttccggattaaacttttaattaaagttcagttctatctgccaagaaaaacttgataattgggcacctatgcccgacacataaaacacacttctcagacaggtattaatagagtcgtgcaagacgcgacttatgtacggctagtattgattgatgtcgccaggcgttagctagatggctaagctgctttgctatatcccggcgcctggcctattctcaatctaccgacaagctaattctctaatgaaagaagcaaattcagattttatggacgatggttgtaatatttgttaatttaatttcgaattaataattgtaaaattatgtttaccttgagtaggtaatttagaaaataaccaacatatttagcctacaattaaatatttactatatatataaaagaatatgcccccatataaaagcccgtgcaatgcacgggctgatgactagtattactaattggtgaaatcccatattgataacatatattcacaacgatgattcagcattgtgggttgtggtctgaagaaaaaacagtcagtttccattaattaatgggcgccatagctgtgtaccattgtataaatagagaactctaaacaaggaaaaagaatgtagggagggtattcgcagccatacttgtgaagtcctccggttagacagagcctaattaaggaggtcacttgttatactaatatatatagatatataaataccatgcagagatatcgtggcgtagaggaaaacagcttgattctaattaacgaccatggcttcattcacgcctaattgctctacgttgttctttttccttgtcttccttgctgcagtattcgtctctgctgcggcagcctccgagcacggccgggtgttggaggaggatcagaacattcggtaccgtgtggaggactcggaacttccggacctctactacgaaatctgcatgtatgcgagggagcacaggccatgtaggagggtgatggccaccatcccggatctaaaattcaagctctccggccaggttgatttagccttgctgctctctcacgtcatagccaaccggagcgccgaggccaaggccctggccgatccgttgctcgccgccgccgccgcaaagaagggcggtgatgagctccccaagtgtctcgcatcctgcgccgccagcctcgacgacgtgtccaaggccatgtccgggctccccgcggatatcgatgtcgagaggtacccgaaagtccagagcttcctccgcaacaagttcgaatcgggcgccgctcccccactatgcaagagcggctgccccgacaagacttccaccgccgatgaggccgccatcgccgacaagtttcatgccatctgggcgctcatggattgcgcagagacactcgcccaatactacgtcctccctccgcctccgccgccaaaacgctaattaattaattgacctactactacgtacgacagggaacatggtcgtcatcactcatcatattgcagacaaatactgcatgcgtccattccaagttttttttttgataatcgattaagttctcaaatcaattatatgtactcctatacttggagactgattacagtacatttatatcgcagttcgttcattcacatgtactcgcaagtgctatatatattatattttgatatgagataacattcacgagagtcttccggccattcatccctgtgcgcttgatcaaaccgaatattcctacagttaagccgccttgaatataatgcattctttcatttttttaaccataagctagccggcagttgctgcctctcttcctcctcgtccgagcggccttggtcttctccgctagctgcaggctccgagcctacgacggagatgggttttaattactcgggtggatattcaccaatttattgcatgttaactaaataatcataaaaaatctcaaaaaagttgacaagaaatattgatatataatatacaaatgcaagttcaaattcaacttttataagttagaacaaaaataataaatttaactatgaatatgcatacattaatcagagattgatttgttacaacttgtagaaatcttgcatgtttgtggggtgacatattacatatgaatctatcttgtcaatttttttttgaaattttcttatactcattttgttgatatgcaacaaataggtggatattgtcacgcccagtaattcactagtaattttcgaactaatttgtgcataaaatcctcattcagaaatcaaccgaggtatacacctgacaatttaatatacagattcatcaaaataactaaagcgataaatacttacataagagacaattagtcctcaccacaaagaaaactgcagcggaaaaataaatctagcgaagcttcagatccactcccacgggcagctcaactgggatataagccaaacgtcttatccttcgcaacgttttttcaactgaggtttgattgattattgcaaggtgagtacatgaatactccgcaagccacaaaacaaatatgcaaaagcacggggatacaaaagaatagcataatagagctcatatgcaaaagcagcatttagcgaaacatttaagaactataaaaccatagagtaattaattatcaatattaatcaacagtaaacaacactccaatgctccccaggctcaaccaaacctgaacagccaaccccggtcatacagatcaaacctctaaactaggaattaatcattccaaaccaggagttaaattaactatcattaattatcacattattattattaatgagtagtgttgaactaatcacgaaaaacattgttagacccacccataaccgcgggcacggctattcgaatagttttactgtggccagaggtgcacaaatttacccacaagacacaactccataatatgtcaccatgtcatcatgtgcccatactgaacatgtcaccatttgtgtagttgtgacaagacccctcacataactcaactcagagcagtgcaccgttcctggttcttccgcgaacggcatggttatgaaaataataaagtcatgctctcttaagcatgagcatgatgttgaaaaaaagaaaagaagagaataatgtatagccatgccttctccttaattataaaagaaggattttggagaaggaagaaagcacaaaagagaagcattttctttattttccacatttcatttccaccatatatcacacacacactttgcacgatcttgatcttgagtatgtttagtcatctattttagtttaagtttttgacttagtaataaatgtgaatgcaagtatgccatatttgatccctaccaaactccacatatcaaccttagaataggaataaaaaggcaaactggtgaggaattcttattaatacacttggagagatcaagtgaatcatttgaggaacttggatttcttttgcaaaatcatttgaaaacctccggaataaaagttgaataaagattgggtgattagtgttctaattgttgttctgtctctcaaccgctcaagacaaggagaggcactgtctcatgggaatctgtcgcgtcccaaaacgactctaaaatacatcctctaaattatgcctagaataattaaaatccatgtgaaagccttcaaaaattaaaatgtgcaaagttaaaaatcaaatagggcttggaggatttttgtatatttcctaaaagcctaaaatgcgtaaataaattttagtggaatttttagagcacaaataataattaagaagaaataaacaaagttaaaaaggttttataaaaagaaaaaccctaaaagttccctttccctccccct

SEQ ID NO: 70741 - DNA, 739 bp, Oryza sativa
tggtaattggtttgtgagtttcagtgtcatgttgtaatatacactattaattgaataaaccgggtttatttagctattgaataaatttgaaagcacaagtactttcaagattgaaacattctgattctggtgtatgattttttttagtatatgcatataactctacagttgaaggatcccctgagccaatcctctgagccaatctgtttcttttattcagggctatgttgacaaatatgtgaagctatagttggatcagtaaatgggactatgaactggagcaatcaggacagtgtccttttcctgttgcagaaatcgtgatgggactatggactatgaacagctcacacgaatctgagctatgctatggtatttggatcatcaatttgcagtctttcagcagtaagggattccgggtaatagttctgcagaaatggatgtatttatcagaaaatcacgagtttacattggaacaattgctgcctagtcttcatagccttgtaagatgtatctttgctccactgtttctttttttcttttcttttgagtagtttgctctactatttcaccatcattaggcaagtgatagtagaacgttctttaatactgactgcatgaacgcattgctgaaaagaattatatttcttcaaggtaaatgtaaatgatttaatcttattgctacttcaatagttcaatgaacgtgttcatgtctgattaacccaaagatttccttaagacc

SEQ ID NO: 70742 - DNA, 744 bp, Oryza sativa
  unsure (1)..(744): unsure at all n locations
ccctatcaatggcaatgccagctaattaaaatacatcacaatgtattttgaggataacttaaggggccgtnanncgacaannaatttttggtacctcaatnnccagagaatggcananngcagtgtcttctttggactggatagaangatctgcatatnngttccagctcgtcagtattcaccagctatcagggcagacatcacatcatgaaaaacttgctgagactgtatattccccatgaaattttctcatcaatcaagaaattccagaccggtagctgttggtgtcaggccatggttagccaaatattggtcattgaagaacttacttagatgcctcatcccactgtcacagagaattgtcacaattgtatgtcctggacctaaatcttgagcaactcttacagcaccaacacaattcatggctgaagaactcccaacgaacagcccatcatttttcaacaagaacctaagttaatatttacaagtagattgaggttagataattgaaatacatttttagcttttcttgaattatcttaagataagagaataaacaactatgagcttcctgctaactatgacacagaagactgattcttttcatcctttttgcttcagtacttgtttattacaagcgaaatgtgcagaactttgattaatgcttatgatgatttgtactaaacaataacagttcttgcatggaaatttcagattgtaactcctaagagtcagcgaaagcac

SEQ ID NO: 70743 - DNA, 788 bp, Oryza sativa
agactgtgaaaagagttttagtaaaactaaacatacaggagcataagcaattacaggctttctgatgttgaaatactgtttgtactttggaacaatcttaacagaagcatctagcatagtttagttcagctagccatgaaaaaaatggataactcaagtagcaatcacagatactacaccatggagtatgttataagaattatgaacagtatgtgacttactaccttctcaatggcagcatcatcaggaataacaacatgacatttgcagccataagcaggagcaacaatggccaagctaatagctgtgcttccagcactcccctctgttactgtaccaccacagagaagatcaccagattccagagcctggtaatgacaagagttccaggatcaaatataaaggatatgatatacggttgttagtatataacaacatcataggaaccgaaattaccaaacaacatgacacggagcaaactatctcatgaatccatgattcatctggtgaaatttgaaacaaaagaatttagataaaatcctattacctgtttgtttcaatccaataatactagaaataaaaccgcataatgtttttcccatgagtgctttttttcagaactgcaattctaaaattgttgggtcactgacaacatagttttacaggttccaaaagatgatggaaaaatcttgataccaccctgttatcgacttccaccttacaattgctttttgaaggatagacaactacaggctagagttaatacaagtaagcatttatcaccacat

SEQ ID NO: 70744 - DNA, 934 bp, Oryza sativa
tcgggggaaatcaggaggagggcagacacctcaccctcgggcccgacgtccccgaaggtgccaggccgcgtgggcgattgtgtctgcctcaagcctctggtcacgatacccccggtcccatatcaccgacaaggtggttttataactttagactttgggaattctcatatcatttggatagtatggaatgattggcttatgttggaattggacacacacctccccctctattcaaaaccccccaaacggttttacgctgggctcgaggtgcgtggttttgttttgttagtcatacctcaggtactataaggattaagctcgcgcctctgttccaaagcactaccgtactaaccacatgtctaatgggtaaggcttaactcggtgctcagtctagtcctgaacaaaaggacacggatagagatagatgaagtcgttgcgacgatggatatctctaaggcaaatgaaggctacgcgagctgcggctcggtaatcgagatgtctaggcaaatgaaggctacaagggccggtgtccgttagtcgagatgccatggcactcgactagtacgcgggtggtctcacccctatgtgtgtggcgcacccggtctagatcctattgctaggggctcaatcctggcctgcttgtcccgggaaaccggccgtaggcagggttggatcggtacttttgttcactgctaggatgggtgaagggttatgtcacatgtttacgacgggttccaaggccttggaatgcggagtaaagatgtgtcttgtgggtacagatgtacacctctgattagagtataattgtcacgaccggaaataacccaacgggcgttcctgacgtgcgtgcattaatccttatcccaggaggcaaggacaccaaaagttgatacaattcagagtttaacaagcggaagcgtaaatagaattatta

SEQ ID NO: 70745 - DNA, 1169 bp, Oryza sativa
caccacatgagcatcactagttcgagcccagctcagcggatgcttcaaagacaaaaaaaaaaaaagcaacggcgttatctattaaaaaacggaggtagtacttgaaagatatgttagttttagtctcagaaaaacttaaccaatttggataagattttctagtttccacatgaccattgatatccatcttatctacacagtactacatgactacatgtgagacttcttttgtgtggtttatatgagatttttgttagattgagtttccacggttccaccgtatatttggcctagttaagtaggaagaaagtttaacgtagacaaactagatgaattacaagcagcacgacaacgagacgtaccaggcgatggttgaagtcgacggcgttactgttgccactgatggactatacgcgcgtacacctgaccgatatatatctctatcaagtttggaatctacaaatgctagaacaacagcaaacaagatatacattggtgccttggtgggtttaacaatgcttgtacccacccaggatttataagatctggccatttcattagtatatatgttactattatattgcatgtgctttgcatttcattagccaaatgtgctaccatgccaaaagtgcatcatgatcaaccatttttaatagtttactctatttctatgcaaggatgtactaggtatacaattgcttgtgctagccacgtaatacaaacaaactaaagggattaaaggtgacgcactgatatataattttttgtacagctactacctctgagcaccacatgagcatcactagttcgagcccagctcagcggatgcttcaaagacaaaaaaaaaaaaagcaacggcgttatctattaaaaaacggaggtattacttgaaagatatgttagttttagtctcagaaaaacttaaccaatttggataagattttctagtttccacacgaccattgatatccatcttatctacacagtctacatgactacatgtgggacttcttttgtgtggtttatatgagatttttgttagattgagtttccacggttccaccgtatatttggctagttaagtaggaagaaagtttaacgcagacaaactagatgaattacaagcagcacgacaacgagacgtagcaggcgatggttgaagtcgacgg

SEQ ID NO: 70746 - DNA, 549 bp, Oryza sativa
tcagtaaatctgtcaaagataagatcccaaagtacagcacaacaggtatccattgggcttctttagtacctccgacaatagttggcagtaaaacaacctgaaaagtactgatggccaatccctggacagatgtaattttcttatactgatggacacttgataaataaaaatggattattagttggttttaaatatgaatcatggtgcccttactgcagcatcgacaggaaccagttgaccagctaggagtttagtaaggagtggtgtcatcactatagcaccaatagtcgaacaactgaaatgtaaagataatcacaattagtcagagtagaattgggagcatgacactcaggaagaaaacagagtatctagggtgtgttctatactgcactttcccaacttctactccctctttttccgcgctcacgcttcctgaattgctaaacggggcgtatttcgcaaaaaaattctatagaaaagttgctttaaaaaatcatatcaatgccatttttcaaggttttgcttaagctaatacttaattagggtgtg

SEQ ID NO: 70747 - DNA, 715 bp, Oryza sativa
ctctttcaacagagacatcttccttgccactctactgttctttgatacttctttcaccaaggaaatcactcccttcatttgctatcttttctatcattcttccagcggatccaaccgaggagtccattttttaactgaaactacaacagcatgaataattcacacattttttcagtcattttttggccccacacataacaagcagaacacaaaccattatagcttgaaaaaaatagacatgctgatacctacactagagacaagctgatacctaaactagagaaaaacactgatacccaaaactagagaagatgatacctgtctgggcagaagaaggagcactcctgctcggagtgaggcgtgccgggttctggctggggctgctcggagtagttgcggcgtcgcggagcgtcgccggcgaggtatcgcacgcctccgcgcgcgataccgagccaggttctggcttgggggagtccctacttggagtagttgcaggcggtgccggcgaggtatcgaggattcggggcgaaggaaggagcgctcttgctcagagtattgcggcgtcgcggagcgtcgccggcgaggtatcgagcgcgataccgagctgggttctggctggggtcgctcagagtagttgcggcggagctccgcgccgccggcgaggtatcgcacgcagctgggttctggttggggttgctatgagtagttgcatatc

SEQ ID NO: 70748 - DNA, 2737 bp, Oryza sativa
ttagagggtggctcgcacgcacatataggtgctcggtaggggaggtttcatggcatgcacgaccatcggggctaggccgcacttgtgcaaaaagcgctcctaagccaggcctgcgagttgcgagcttcatttgttccatctccacatgcatgttgttgtcgtctctccattggtcgttcagatctagcttggatccgatcgacttgggttttcttcatcgactggatttggccggcagcaaccgtcatcgctttcgcctccaccttttcgccgacggccacccccaactagatctgccatcctcgtccttctttgctagatgccacgcccctagccatctccaccatcatcgctggctacacctacaaatccgacgatggagaacccccaaccagcggattggttctatgatggtggtgagcaattgggcagtgagtgggtctggctcagcggcggcgagcccacgaagttgccccttgtttttcctcccccaccccctccccctagcccttttcctcttccttaatttttcttttcaccaatcaagtagtcatgtacatatgtgatgatggttttgctgttcatggatatatggatatgaattcaatttttattttaaaaaaacaatgaatttatttgacttagctgcatttatatctgaaatgtgtgtattttataataatttagagtatcttgcacttggtaatatttctatttatgggtagtagggataatcttaccatccacatagaaagatgagtatactcaaggttcatttatccaaccaaacgaataccatgcatacaagttttcacatatcgatccaaccaatgaaacaacacctcatataaaaccaggttaaactaatacatgcaaccaaacaaccactattacaccttgctaaccacaccaaggtcagcctgaatgatgcacatatgtaaggcaagctgagagtatttgagcaaccggccccggccctatgaaacgcaagatagaaaaaacacaagaaaaggaaaaaaatgcagaaattgtgtagttgcatgtttctttaatcgtacaaaaaaagcgcaggaaagatgaaaaggagctcttcgctagcattgtaggaactaacaaaggaaagcaaagtttccaagagatttgacctcttgcttatttttcccctataaaattgaaccatagcagtgcaatcctttatgaaaaatttcctatccttcctatgaatcaaagggctctataggaaaatttttccttaattaggaaattgaatcctccaaattacttatggcaaacattcatttcaaagtggtatggtgctatcttcagtaaaatatctcctttatctgaaaaataaatttacagataattgtatttcacatatatagagatagatctgcactgactactgattgcgtgtttatatatgtgaaaacctgcaaacatgcgtattttacatatgataattaattatatcagttgtcaactatagtagaaacttgaacacatgacatatactttgcacacgatttataagatgacaaatatatatatatatatatatagcatacgtacgtatatcgtacggtagcagcagctgggtcttatagggggtacatactccatgcaacaacaaattaacaagatcaaacataattaactaataaacacaaaacgagcacagatatatgctaaaggggaacgatgagcatgcatgcatgagctgagctgacgacggtgataataagggggatctgaaatttggtactctccccagtggccggcctgcaggctagctagcttcatacgagcttcaccgccgatatagatcgccgccggctccggccgccgccgccgccctagccgctgcgctccatctgcttgaagatgtcgaagctctcgaccacctgctcgttggccctctcctgatataacatcaataatatagcacataattaaagaacaattccacggtgagatcatatcacacaagaactatctaaaatcataatcgttttgtggtggccatgcatcaaataaatcaaatcatatagagaaactgccttaattatactctcattttgtgtgtatgtatatatgatcggtgtctctgttgctatggcaagttaattatcgtcaatatgatcatcacctgatgaggaatgggagcagctactactctgggctcggggttgctgttggaggtggaaaccgtcgatgagcagcgggggtcgcacttcgcccactgcataaatgcagagctgatcatcagacacttgcatctccatcggtgcaagtaattaatattattgtactagtaattgatgtgtaagcaaggtgcgagagatctagagaccgatggatcggttgattatagctaataactgtcacaattatcacatgcaaattgggggccgggagatattggggatgagtagagcttacgttcttggcagccatgctgaaggcctccctgtgagggatatctggcttggcagctttgatacgctgtatttcctccctgcatcatcatatattaattataattaattgatccgctaaaatatccatgtgcagatttatttctgagaagagagtgtagtacgtacgtaggtacatgcaatgcatatatgcatatggttgtgtcgattagatataaactggcattgtctacatatatatcccagtttagttgtcccatgcatattttattccctttggttaattacttcatcgatga

SEQ ID NO: 70749 - DNA, 1592 bp, Oryza sativa
attgatcccccaccaatctaagtacaccaataaactccatgtaactatcaatccatcaatccctccatggaccacccaagatcgcattccatgcctacctgcccctgcccagaaggagaaacggcaagcagatcgagtcctcacctttcaaacgaacaccggcgccgcaagaacagcggtggggggattctgcggccacggagcgaagaagaaacacgaggatagccgccgattttgttgcgaggttggggagaagaggggaaaaaaagaaaaagaagagaaaaacaagtcaatggaaaccacgaggtgaccgtagaccggccgacctcgtcgggagcgcaggcgcggatctagatgctggagagtcaacgcggggagagcccgcggcgcacgcgatctgggggattgaggaggagggagggaggggatcgcgcaccggcgcacgcgagagagattacgctgcggatcgaaatatttggaaatggcgccttgctatctcatcaaccctcgcgagcgggcgatcggccgccattcgggacgcgccgccgcgggtcgcgggtcgcgacgcgagatgccgagatgcggatgcgatgggaagaggagaggaaaacccgtggacccatatccacgggattatcacgcgggccgcacgttcccggggggctcgcagaagatgggccgcgggatgcccaaagccgaagcaggccgcagcgtcagcccatgtaggccgagtgaaaaacgcgggactcgatcggctcgtgtaacgctgtgggtggctcgtgggattgtgaccggagtgacaggcctgtgcgggtttcccagacccagcacgcgcggtcccaataatgcgggcggggatgcagagccagcacgcgcgggcggaagacgacgacgactgggctgagcagccgccgtgccgtcacggcagctcatatcgcaggcggcgatgcaaggtgtgatttgatgacgcgagaacgccggacttgttggtgcgagatgcgattcatcacccttggtggcagtagtttggtggggataaaactaattttcttgcggtgcttcgatctgcatctgaaaactctttgcttgcagacttgcacgcgcgcgctggccggcagccggcagcggactgtgggctagatagagtgtaggatgccaaccccctccaaagatgggccttcttaactctctctgggctagctagcactgctctccgtgctaactggcctcatcagggagtttaactaatagtagtatttaattagagcgtagtacttctgtactggagtacgtggtagtgtgtgctagtagcttgcatgtgctcaattagggctggggaagttgggagatgaggatatagacacacacaggtcaactgatggatcaaattagttttattcaccacgcaaaaaaaaagttttattcagctcagtttaagaatacttgcatgtatatatatcacaaacacatgcaatctcagggatacacatgaattttcttcttcttcttcttcttcttcttctttgtatgtggcaagggttaaggacaaatcactactggggtaaccgtttttactcccggttgggaactag

SEQ ID NO: 70750 - DNA, 4358 bp, Oryza sativa
tgatcgtagcaggactgcttctcgcgatgatctcgaggacaagatcgtcgggaagaatttggtgcggttcgatctccatatccatatccatatcgagtacgtgacgcaccacgatcgagcgagatagactcgatcttgtaccgatgtagtacgtggatatatatacacacattcggtttgtttacggttcctgtgaacaataggattcggatgcatgtacatccgtacaggtaacgtgtgagcagttatgttaagttattactactactatatatgcactacggacgatttggtatgggaagctccatacggtcaggtatttcagtcgtatagacatctacaatgtggtataaaaataatccataaacaatgaatattccattcagccatctattactattatgcaattagttcatataaaaaaatagcaaaagatacccatatgcatatgggctacccatatggaataaattatattatctatctctactcctctctcttctactaataataccttgtatatatatgcattgcggagattaccatagggataaactatttatgtgagtcccatctatatggaccactttaccatatacattggtgatgccctaatggaactatggaagtatgctgttatacctgctctagcaacaccagtgctgcgggacaaggtgtacctagatgccacggtagcatgcgactcaaatagttataaaaaaattgaaaaaagttaataacatcgattgtgatgatatacgactatacacaaacatacgcgactaaatttgatctataactagagaaaaaaaaaataaaatcagacagtgaatagtacccgtacatcacagataaaatttgttaattttgtttctttatagtcgatcaaatttagacttgcatgtttgtatagggtcttatatcatcatagtctatcttattaaattttatgaattttttatataattgtttaaattttatgaattttttatataattgtttaaattacatgtatatatctaggtgccaattaaaatttatgaattttttatataattgtttaaattatatgcatatagctacgtgccaatattttccccgtatgattcttttccccgtccctgtcgctcccgtcgctggggcaacacgaacaccctcgaggcctcgaccgcccaccgacgccaccccctccatccttccctccggctcgccgccgcccccgcccgagcggtcgccggaaagccgggcgcggctgcaaggacggcagcggcgggtctctctcgccctccctgcgcggggttttagcagttgattctgcttaccggtaggccggccgggcgctggtcaatgatttggggccatatggcagcctcattgtgctgatttggtgggctttaacgctcaacgtaggtcatatgtactctagcagaaacaagcccacaggccacaactaattgttcaacacaacgaagtcacgatctctctgcacctgagtagccatgctggaataaccatttacattgatgagaaatattacgtacatatacatacatccacgtcgatgcttagaagttacagcatgaaccagggtttttattgaacatgtcgaaagcgtttataaaacataaacacacatttaattacgggacattcccaccggccgcctatatattgatcgcgccggtcaagtattttttttcccaccttttagcggacgccgggtcgattagatggggatcgcgcttgtgatccgcgggtagacgacgttggccgggtgccccatgatgcggcgacccttgcggtggcggaacaggtacacgaacgcgccgagcggccacttcacgacgccggccaccacgaacgccacgaaacccagcgtcgggccgagcaccttgcacctgcacgggttgctgtgcgttccgcactgcacgcacaccggcacgtaagccatctcctcgctcgcgcccgcgcacgaaaccgaagtcctccgcctcgccgcttgcttgccgatcgacgagctctactagcgcctctgcttggaatgcctgtgttgatggatcgaatgagcaagggattgcggatacacgcctccacggagtacgggcttaaataagcaggggctatgaaagcttcgcatcagccatcagggacgcgtggcggggtggaagggggctacgtacgtggggcgctgctagtgtctgtcttggtgagtttggtgtaaagggaggcgatgagtcgtccgtagaagattgccacgtttgcttggggaaggcagagcccaaatcttgagtcgacacgtgcactgttcgtaccggagctttctggaacacagattctcgtttcagagcaagagaaacggtatcgtagtattttttaaagcattgcttttcgttgcctattggagcaagtacaaagcaggagctataaatatattttaaaaagataaaaaagagagagaagagtagtgtgctatagatctgtagcacgatctttaagatgtaacgtgtgtatgataggtgagaccgggtattattaatagtatagtactccctccatttcaaaatataaggcacaaccacccttaacccaaataccaagaaataattaatatttcatggttatcatgaatcacctcaatcaatacaatacatgcaaccaatagaattaaaaatcttgtgagtataggatttaaaataataataatttagaggagagaatgtgctaattaattatatgcatgcatgcatgccttatattatgaaaccactttaaaaagtagatgtatcctatattttggaatggagagagtaaacaactattgtatgaattggctattatattggctataaatgatttggagctagtagttggctatactattaaggccgagtttagttccaaactttttcttcaaactttctaatttttcatcacatcaaaactttcctacatacacaaactttcaacttttccgttacatcgttccaatttcaactaaatttttaattttagcgtgaactaaacacaccctaaacttaactcttatgggtgtgtttagttcacgctaaaattgaaagtttggttgaaattggaacgatgtgatggaaaagttggaagtttatgtgtgtaggaaaagtttagatgtaatgaaaaagttaaaagtttgaagaaaaagtttagaactaaacaagtccaatatcgaacgatacaaggcctttggccaaaggtgggctccatcttgtctccgtacccaactctcaggccctcacttgcgtcatcgcaagttcagacttctgttagaaacgtcgtcttgactaattattgttcgaaagattatccctttctctttcaatttctttcgaatggcttacaaacataaagtgattgtaattcggctctcgttgaataatcgagaatcgcttgaaattatggttttcacttgagatatgaaaatttgataggattttcacaaaaaaaacagttcagttccttcaaactgactagaccctggaaaaagtacaccgaaggtccctcaacttgtcatcgggttacaaatcatccttcaaccacaaaaccagatacaacgcatcccccaacttacaaaaccagtgcacattgaggcagggcccgcttatattgctccaggccaagcacgcttaaccctggagttctttgaaaatcggcttccggaaaagaagttgcaacgtgtccagtgcaccactcccggtccacaccagccatgcgctatgtaacgtcttgcctctcccaagtcaggcccgcttacatctggtagcttttataggtaatagactgccctcacaggccaacacatgccttttctgcacactttgtcctcactcgtgtacacccggaaagaattcctcggtcggtcactcatcccaaattgctccaggccaagcacgcttaaccctagagttcttttgaaatcggcttccagaaaagaagttgcaacttgttgacatgagtattttattaatactattaagccctgggccgggatgtcacactaggtcccctagcggttttgactctggttttctccgacccggttttctccgacatgacagctaactcagcgtgggacccacacgtcagcctcttcttctcctctcctatccacctttcttcctctttcccctcctctctcaccccctctcttctctgtattatccgcgtcacgaagccggcgggatggagcggggcggcgatgggcggagtggggcgaccggcgacggcgaggcggagtggcggatgcgcaacgccgagagacccgcaggggtggccaacgggcgccatggccacaggcgccggcgcgagggacacccgccgctgggggc

SEQ ID NO: 70751 - DNA, 3309 bp, Oryza sativa
cgctggaaggaggggatagagagaagagagataagagagctgacatgtgagccaagggcattacatttcacgtgatttttctctcatcttcaaccggaaattattattttaatcggcgcggtgtccactggcaaattaccacgtttgtggagtgttttcccccaaaagtgagtttggacagtgttttagggctaaagccacatattagcagtctccagtagcaaaatttgtcttttttttctattagttttggtcaaatctaatgaactttgattaagaaaaagtcaatatgaacggggagagtagtattttttaaagaggaattattagcgttcgtagatcaaagcaaaattacagtacttcatccttgttcctggtgcaaggctcctaaattccaaactatagttccgtgcttccgtttcctagtggttttgtccacaagtggaactatgcagaagtgtgaagaaaacaagcagtcaggtagcagtgtagcacttgtcttctacggcactaccacaatccatcaccagcgccaccttcccagctcccaagtcccaagtagccgcaataatggtaatcacggctctgcagcttctccctccaatccttggccttccggcgacggcgagaaatggctacgccgtcagaaggccacggatgatgactgtgacttgctgcaggcacaaccaggtaccgagtatcttggctttgccggatctctgaaattccctttccagtttccactgtttcgtttgggatgaactgcttccgttttccggaataacatcgtgggatgctgggatccaatatgcatgagctgaaccacgaaatgttctttttattagctagaggcctagaacgagtaggataggttgatagattggggaaacaggggactggaggtcatctctcatgaggatggaaagatagatctcccctgtatgcgatggggcctggatgagcagctgctactttcagaagtactttgtattaaggcaacttgcaagaatcaactgtaggttttatatgcacaagaatgtcagatatgatgaacacgcttcacttcggaaatagtactaatcagaagtagagccgggtggttcagtgatgttatattgaaaaatgctatgcctgctatgtttcatcaccaattgatgaccagtttctcttgtcatttcttggatttttaagcagtactttggtgcctacattcctacaaatatgtcaaaagctgttaatttttttctagaaaaatatgtcaaagctataggtgcatacaatatgttttattagattgattcagaacactcaggtattgaatggattattaggtgcaaaatcctgctgtatttttatgctgacaggtttaacattttttttatgtatgtattgcactgcatctatgcatattcagttattctactatatatgtccatccccttggtggtgaaaattaattaatagatgaaagttggatagttcatacttggatgattagatccaagtttgataacgaaatcctccatcatagagactattcatactaacaaaacaaaccagtaattggattttgatatgtccatgcatgtcaatctttggttatataggccctatttgattaaccgtgtcagttgggtttgtcgttttttgtcgactaacactgtataatttttcctgctctactattaatatacaaggcaaagcttttgccttccttcaaaaaaaatgtaggccctatttggttaactttgtcttccatatcttcagaaacagtgaccccttgaagctatactcctctgcttcttgtaatctaaattatcgtgttatatggattcttcttcagttctggcataaaccgctcccctgttaattagcaatttgtttcctgcaggcaaccactgtacatgaatcaaggctaacaagcagtttatcccgtagagatgcactgtcatacatgtcgtctgcgttcatagcaacgcttctggtggctggtcctgcagaagcaagaacctccaggcaagagaacaagagaaaagtaagggagaagctggagaagctccgggagaaggcactaggcccagatgataaaaatggagccatccgtaagaaggaatctttggcgaacttgttgattcctcctaaattggtcgaggctaccatttgaaaagccattgtatcgatgtgaacttatattcagacgttaaggaacaataatatggaagtctgaatatatggtgctcctctgaactgttgttgccaactcgccatcactcgtgtatgaaatatgatactagttgggatctcaatccaaattaaattatgccttttctatatcttgactcgtccccgtgtcttatgtgacgtagtagagcacccaattcgttcacatcttaaaacataggtactgcattacaccagatagcgatcaaacacatggaaaacaacacttacaagtgtgttttcactgaaaagagtacagcactgagaaaagatcagcaaccggcatttgaatagatagaattcgaaaccgtcccatacatgaatgaatttaaaagtaaaaaaccagaatcagaaagttttcattacgaacagcatgtaggagatcagatctaactcgtacgggcaaggcaacttgcacgagtcgtcccagctaaccgtctcgagcttattcaacaccctgcgttgtaggtcgagcagcagaggactgtcgccctcatccccctccaaaacgagggcgccactcccctcgcagaaccgcacgagccaccttcctctcaaccatccgtcgcgaaaatccaggccgcctgatgctattctcgcggataacgtgacgcagctcccagcggcgtgacctccctcgcgcggtggtgcggagtctgcggacccacacgagaatgcggtcgcttccgtggacgaccacgctcagcaatgctgcgttgctcgtgccgtcgtccgccgccgcggccggcgatagcgcgaggcacatgttgtgcatcccggatttgcacgactccgggaggttcactagtgaagccttcggctccccgccgtcgcctcgtcgctttaggctgaggatgctgtaacccgagtattcgcagcacaaccagtagacggcgccgcgcaagacgacaacattggagtcgccgtcgaataagcaaatcctgtagatggggcaggcaacgggagtgccccactcgcgctcgtcgaaggagaagacttgaaagatgagcgtcctggcagggctcactaacagctgcgcggcgagcaacttgaacgagtgggttccaatcgcctggtcgttgtggttga

SEQ ID NO: 70752 - DNA, 1375 bp, Oryza sativa
accaacgatccccatacaatccaaataccatagtcacgatctcaaacgtcgacaatattataattatatactatagttatatttaaaaagttgggggaataaccaaagtggtccttcaagtttcatgcaatgatcagtttagtccttaatgtttcaatctgtccatgttagtccttcaagtttttattttaattcaaacttatccctgaacccacataaccaacaactctcttgataaatgacacttataccccctcattcgcatatataagagaaaatttgcatgcaatgaattctttttatagataatgcataacagtttatgtaaaccaaaaataaatcatgtacttgcaagtatatacgatagccattaggctcaagtttcatgtgcacatgttgaaataataggaagtacatatgcaatgttgtttatttatttgggtttttcttttttctactatatagttgtatacaaattaagggcaaaggggactttttctaatagaattgttgactagaaatagccatatttcatattaagtgggcccaaggatgattttaggccaaaacaaatatttagaggatctatgtggacaaaatgaaatatgaaggactaaattagctattcacccttaaaagtttcattaaaaaaacttgtagcatttttttaagatagtccattgaattttacctatgtaagaatcacaccccgggccgctcaaagagaaagacattgtcgataaattcctgatcccttgctaaacccttattaaaagtgtagcaagatgtacgccatcgtgggcacacgaatttcaaacctggcgaatggaataaggcatcaacaactccatcacaacaaggacttcctgaggaacatatacacacaagacacaaccattgtgtgcacaccaactaataaatataaaaaaatcaagaaaaaattatgcatataagttacagctatatgtaaagttttaacctcaaattcattatatttagcgataacaaacaaacatttagactgttttaatttaagactataaatgaaaatctgtaagattttttttctccctatgtatgatgaatttgaagatgggattttacacgtaaatataatattattgacaatatatgtacatctttttttaaaaaaatatgacatttattagttggtgtaaacggtacgtgcacatgaagacttccgtgtataggatacgttctctccatagtcacctctacttcatattcattgaataggataactggatcattctattttttttatttatgtttctatacttccgtcatttgagtccttgactactttaaaatgtttacaattcaatgaaggcacattagatgacatgagacaaca

SEQ ID NO: 70753 - DNA, 1046 bp, Oryza sativa
acatattcttctcccacctctctctctctctctccccacattaccaacaacacgtacaccaaatcagtcggactatcatatcgggtttattccttttctcccatacgccttctacggcatcgcctctagcaccgaaaaggtcataccaataatgccttctttccctccttctcctctacactaagatgagcagcagtgacatgctcctttcccacagtattttcccatctccggccggatggcttgcgccatcggagatgccaccaatcaccccttctaactaattcagataacacccctgccactagccccacccagggtcctttggcattgccaacgccacctcactgccctctcatgttcatcacctatcatcgatctaccgtctctccatttggtcttctaagcttagagaaatcttctcttccctctttcatcgtccctaatccccacccctaccttgtaaccctaatcccagcatcaccgtcaacatcacataatcataggaaaagacaccatcgctgagaaatatgaatagagcacgaataaacttagtaacttataaaattggtaaaaatatttttaatagtttctttccaaaacttttatataaaaaatatttgtaaagaatcatattatttaacagtttagaaacatacccatggtatttagtggtggccacaatctaactttttatatatagttggtacacactaacaattagttgaaactaaaactcaacatggaatgatgcaacatcatcactcactagcagttaatattctagagcatcttaaatcttatacaaagatgacatatcagttaggctatgtccatttcctggagttggaaactaatccctctgacctgtacaacggaacgactcattagcacatgactaattaagtattaactatttttaaaaaaaagattaatatgattttcaaaagcaactttcgtatagctttttttggtgaaaaacgcacaaccttagaatataatgttgtaaaactcaacatacaaatatgtcaaatattttttcttac

SEQ ID NO: 70754 - DNA, 703 bp, Oryza sativa
ggaccttaaactctgctaaagaacatagaatgatccattataattatggacatagggagtaatcggtgttagattgatgggtagaaggcattgtggttgatgacgtatcgtatttagtaataggaaatagggtgaaggattgcaacattactacctgattggatgtccgctcaatcataactagtgtaagagtcaaagatgattgttgggataggagtaacaccaatggataatctttatcggtatacaagggacacattctaacaacatatgtctttcgagattctttctttgactgcattatccacttgtcataataggatcaatggccatatatatagtggtggaggtaaaaacaaatatacgattgtttcatcggatacaaatgatctttacattttagaaagaaaatgttcttttttacataaaaccaagataatgggtctttcacatatcctccaatatactagcccgctcgcccaccctactacccccgcacacacaccctacccctcaccgcatgcgcagatagaactgtacccctatacatggaaatggctataaatgactatgaactaaatcctaatgcctgcgaatattgtgtacatgtgagtgtgctttcaatatgagttctgtgaggtaagaatatattttccactggcctccatctcgttaagcttgagtattctatagtgtcacctaa

SEQ ID NO: 70755 - DNA, 6693 bp, Oryza sativa
  unsure (1)..(6693): unsure at all n locations
gaaattcggatttcgcgctaccaccaatccaaccaacttaaatcgactgaccacccgccaatcaatcaatcaatcaaatccgagcagctagaaggccgcactaaacttaagctgcagagcacgaatcccgcgcgaaacacttcgatcttcgggcgatcaaaccgagcgaattcgcggcgggaggggagattttgcgcgtgtttcttgtgggttcgctcgcgtgggcgtaaggggcgttgtgaggtgtggatttcgggggcgagaggttggagaagaatctgggtgactcctcgctaacaataggccgcagctgggaaagaggaggtgaaatgtcggaactgccccgttccgggaaagaatcttcgcgggaatttagcgggtgtttttttttttagctcatatccgtttcaggcattgcgatagtgtctgcttcttattaccggcgggaataacctctcttgtttattcgtatccagcgtggaccgaccaagctgtgctttcgtcagctgtaaattatggtaaatttggaaagtattttgtattttaactttgatttaaaaattttacatggtcctttttttacttgtcttgcatcatgctccctccgttttcactattgtatcaaattttaccactcataactctcaaatgattagactacaataaatttatatttaagggtaattcgatccatggtattgcaaatatatcatttcaaataaatatcattacaattcgtctactcgtagccatgacactgaaattttacaaaattgtaaccgtgccactatcgttacgttttccatccatttactcatctgcacatgggaccaatcatgttagaatcatcttcttcctttcaccctctcttatcttattccatctctgcaattttcaacactgcctcctgtgccagccacgagcgtcctggctaactccatcggcgtccgccccctacctgttgggggcctccagcttgacgtccagttgcagcgcgtgtatggccatcatgtatctatatctgaccttatcgctgctacttagtgccaccggcgaacctgcgttgcgcctagttgccgtcccggagctcgccgcaatggatctgttcgtgccattaccatcctcgacctggtctctgctagtaccatcggcgaacccacgcctcattgccttccccgagcttgctcgtgttgttcgcatcgccaaactcaccgctactgctagcaccattggtagacccgcaactcattgccttcctcaagctcgtcatcatggatctactcgcattgttcccatccccaatcttatcgctactgctagtgctaccggtggatcagcacctcgttgccgtccttgagatgagctcactgccacggatctgcgccgtagagtcgagctcgtcgacatcaatgggcctcgctgatgccctcgcacctatcaacctaccaaagatggatgaacctcatctcagatatatgcatccggtttacacttgcctgcatatattttattttaccctaacgaacaaccataatttaacagggcacaaaattgtatcgcacatatcgcacctaaaattgcgatttcaattatgtaatcactattttataattaattttttattaaaatagtgctatttaaaaaattcgggatgcgatcaggtggagagagcggagaggaggtttaatagtatagccaattactagcttcaatttatctatagccaatctaatagctcattcatataatagttacatactaaactattaataactggtctcacctgtcatacacacactgcgtcttgtagtttatactgtagctggttataaatctgtagcccgttgctctttgctctcataatttatagcctgctacctgctctgagagcaggccccctcggtcagctcgacacgctgcctcgacccgtcgaccgggcgcaccgtacaccagctaaattatattgcgtcgccccttcgccaacgttacgtggctggcttgctggccgcgccgcccgagctcgcgccggtttcgcgacgcgcgtgccgttagctagctagcgatcgagccagaaagagggagtctccgtggcgcgcgtctccgtcgatctcgtgccttccggaagcggccgccccgggtgccacgtcgcggtggcagctagagccacatcggtgagcaggacgcctacactttgagccacgcatcacctgtgtacagtacactactactagtagtacagtacgtctacagtaaactaattgaggataggagtagtactctctactagtcgttcaaaaaaaccaatcataaagctagatacgcatgtgttagtattgaatatgacgtgtttgtattgagtattttacagatgaaaaaagtataaattatctctctaaactgtaacgagattcaattataccttaaactacaaaaccagacattctttgcccttaaccccagtttaatccgcggtggttttgatactacgtggtagtcccgtcataaatttttttcccctcatcctctctctcgggcgtcattgggcattggtcaagcagcggcgcgggcggtcgacgcgcacgatagcacacagaggcaggcggcgggcgtggcgcgggacgcaaaggtgggagtggcgaactccgggagggagctagagaggcaacaatgagctcaacagcgccccggtactcaacagctgcggcctctccccaatctgatgttgccggctatctatctgacggggacgacaccttgaggagaaggccagggaataggaggactgggagaggcgcggctgactgccggaggaggtggtggagcctgcctgtgaggacgggtctctattggagcgacgttgttgatctggatcctcgccaccggtcggtgggtatgggtctccaccctcgccaggtcgccgtttggttctagaaccgcgccgtgaggtggaaggcgaagcaaattgagcaccaacttcgcagtgcacctctcctgcacgatgccctccgcagcgacaaagatgcgctcgctagggacggagaaagcgtggggcaaggggggtctttagaccctcctagcccctaatataccattagagcccctataataccccctctaaaattttaatccatatatttatagatgaggggttattatagattttgtttgaggttgttagaagggccaaaaggctaagaaggcccaaaaaaatcctaacccaaccctatatctctctttggtgctcttggttattttggtttagccccgctataattntattctggcttcggcactagcgctcgctgacgtgacaggcagagttggcggcggtgcggcagtaggggggcacgtgcattgccccttctgctaatgcaatggccggtggcggcaagaggtagagaaagaggatagggagagaggtagaaagtgggccccactgtttttttaaacaaatgctgactagactgccagtaggaataaaaccaccgcggattgaaccagagggattatttatacggtttgcatatttaggggtgaagaatatttaattttatagtttagggatgtaattcggtggacttaaggggactaattcgtattttttttcctcggcggaatggagaggtactccttaacctatcgtcatacagtatcgtttagtcttctggaaacaaccgtacgcttgacgaaatctatcagtgttctttcccagatcacatgtgaagtactcgtacagtcgtactactactcccgatatcatatcacccatagatcgctaaccgtttgctgctcctgggatcgatcttgcttgcatcggcgaattcattattgacaccggaggtttcgacacacgcaaagcgcttgggttggatcggatcgcacagcacgtgaggattattagtgtaagatactatcctatctgcccataagctgattgtttaggctgtgtgtagttcacatgaaaattaaaagtttggttagaactgaaacgatgtgacgaaaaaattgaaagtttgtgtgtaggaaaattttgatgtaatgaaaaagttaaaaatttgaagaaaagtttggaactaaactcggccttaactgacaagtcctctctggtaaacacggccgatgcctcaaaaactagctatgtctttgtcgacaaatccttgggtcaaaatcacccagattttttcctaccgttagattaagatccagaggacacaaaaaatgctacatatttttttctctgactagtcagatcacaaaactatatgggctcgaattctagcccatagaacaatacaaaaaattatacaggccataactgcaaatacatcatggcccataatgatcaacttcacatccaataaaggttagaaaaaaacaaaataacacagggagaccacaccagttcgcacaaatcccctagatcgagcaaaacaaatcgagcacgccatagacagtgaggagaacgagaaaaagaagaagaagcaaattcttaccaagaacattgaggtcaagaagttgaaatcaacaagacataatcttccaggtaacaaattacctagcacaaaatccacctttacctttccccattgacttcaccatattctgccagtcatcttttaaatcaaacaaaaacaactcagttctgtaaaaatattggagaaaagcacttggaatagtgaatttcttttggagaaaagtgcttggaataggaaatttctttagatcaagtagttaaaagtatgtaactttttcagaaaaactcgtaacaaaaactatcaatctatagtcagttacagttacaaataacaaaagttacagatgtaactactgtacatcaaactgtaactgggttgtaaatggaatcattcttaaatttctttaaaaatttagtattcatgcagcaacattaaaacactttcccctagtataacaagctctaaattatgttacaaatatataaagaactatttatctacggtcagttacagtaagaaataacaaaagttacagatgtaactacagtacatttgaacagtaactgggttataactggaatcatcctttgatttttttttaaaaaaaattcagtactcatgcactaactttttttttgcctatgacaaaatgttctaaattatattacaaataacctaatcatgtagggtcaggtatattgcaatctcaaaaatcaggagatacacaatcagatggatatgaaatgagaagcaaaattgtgtctgaagaaatgagaagcaagaagacagttaaaggtgagaatcattctcacctagcattatggaccattttttatcttgtcagaaaatgtcatgtagcaaaaatttatatacaacaaattagagatagtagcatgataaatttttaaagaactatatatctatatccagttacagtgagaaataacagaaattacatatgtaactacagtacatattgactgtaattgggctttaactgcaatcatgcttgaatttcttcaaaaaattcagtactcatgcaatagcattaacatttttttactattatgacttgttctaaattgtactacaaatgattgaaacatgcaacgcctgatagattagaagctcaagcaacagtgaatacagagtcaaatagatgtcaaagtgacaaaattttctcagaaaaattaataagcaagaagacacttgaaggtcagaacaatggacagatagcattatgcaccaaatttgatcttgtcagtcataaaatctagcacaattttgtatacatgaaagcatgatttttttttgaaaaactatctatctccagttacagtgagaagtaacagaagttacatatgtaactacagtacatattgactgtaactgggatgtaactacaatcatgcttgaatttcttcaaaaaaattttgtctaatatacattatctaaattatattacaaataacctatctatgcaggttctgttacaattcgatctcaagtaacagtggatacataatcagagagatctgaaagagataacattaatttcgtctgatgaaaaaagaagcaagaagacaactaaaggtcataatcatgataacctagcattatggtccatatttgaccttgacagacaatttaatctagcacatatattagagatggcggctttgaaaaatctaaagacctatctatctatagtcagttacagtgagaaataagaaaagttacatatgtaactacattacatctgaactgtaactaggctataacagctttcatgcttgaatttcttcaaaaaaattcagtactcatgcagcagcattaaatattttcccctattataacaagttctaaattatgttacaaataatataaacatgcagggtctgatgggttacagtctgaaaaatcaggggatatgcaatcggagagatatgaaagtgacaaaattttgtccagagaaataagaagcaagaaaacattgaaaggtcagttatcatgctcacctagcattatgcaccataaaatgatcttggcagacaatataatctagcataaaattatatacaacaaattagagattgtagcgtgataaattttcaaggactatatatctatagttagctacagtgagaaataacaaaagccacatatgcaactacaatacatatagactgtaactgggctaaaactgcaagcatgcttg

SEQ ID NO: 70756 - DNA, 6976 bp, Oryza sativa
ttgctgaagtgtgagattttaaaaagctcatgtcgactgaaactgtgcaatagcctgctccaagattcaaaaaatactgacaattcaaatagatttacgagcgtgctatcccctgttcccaattcagaaatagtgccaattatgttcccaagttcagaaatagcgccaattcaaacagatttacgatttacgagcgattgacaatgaacaaaagttcagaagagaagaaagagcagatgcaaccaatagcccataatttctcaaagcaacagggaccaagttcaggtattggcttgctgctaactcatttagatcagcactgaaaagttcagaacatgtacaggaattttataaaccaaatagtacagtagaatacaatctgaagaaagcagaacgcatgtaggggtttgggtttaatttaaccaagcaactcagcatactgggaaatcaaaccgtacatctctgaaacgaaatgattcatatgctgcagaaggcaacacaaaacatacttggggttcagttagcatgcatatgtaaaacgaaattcttcagatgcataagaattcagatatatgcagggagttgacagataaatcatctctgaaacgaaatgcttcacatgcagaaaaattcagacttatgcaaggagtttaacagatcagtcaactaatcactgaaagtgaaatgcaacattcagataaagttgcaatgatgcttccctactatattcaaatcacacataaatcaaagcaaaaataatcaactcatgaatctgaccccctccctgaagaaaattcatgcagggatccaaaaaatgatcaactatctgggtgattagaaaaaacccctaaatccacctcgaattaaacctttaactccatcaaatacccctgaatccaacccccaacatgaacacccctgaagaaaaatcgaaccaaaaatacaaaaaccctcgtggattagaaaaaaaaacatagaacaccatcgaatctggtcgtttgcaaacaatggactagtaacaaaacaccctagactgaactgaatcaaactataactaaaaacttagggaatccaaaacctaaacggattccaaaactaaaacaagtgattatgaatcagatccatacgttgggagcaaaaaaaatcgtcatgtattgacccgaatcttctaaacctagccctattgacattgaaaaaaccaaaacacaagctaatgatgccagcaaatcagggaagaaactcaaaaaacactctctctcgagttgtctcccccagcgagcgcgcgcgctctctctctcccgccggggagctgctcgtgctctctctcgccggcgagctctctctctctcgacggagaaaacgagaagagaaaagaaagaggagaaagagatgtagagaaagagcgagaataaagaaagagagcgaggaaacaaccaacggttacggacataatagcgcggaatccaaaatttaacatgggttggcccacattgactcctaggccatctgctcacaggccacacggtctcatccacacagggaaatgcacgaatcatggcgcaaatcctacggatagaaaaacgacaaatattgggggtgaaaatctgttgacaaagatctagcaaaatcgtttgcgttttgattgacgaagatggattagttacgggcctgctgctgcggaggctgaaattttattcggccctggactaatacctatcagcccaagtaaattacctggaaattgggcctacataatactggaagtgggcccttggtgtttgtgctctaggagctgcaggcccatatataatttctcaatccttttaggcaattaatttcctccatttgtagcacataactacatgagaagatatgtcacgtgaactctatatttagcataaacctgaaaactaccactgaaaaaaagtaaacgtttaagttttatttatctaggatttaaaagttttactcatagtgacgtgaatacattttagacgttcatttctgtcttctaatataagggattttgacattctgcttgtactgcttgaccacacgttttatttaaaaaaattgtgcaaatataaaaaacaaaaaaaatatgcttaaagtactttggataataaagtaagtcacaaataaaataaataataatttcaaaattttttgaataagacgaatggttaaacaatgcaaggaaaataccaaaatctcttatattaaggagcggagggagtagtagttttcaagtttgcgggacatatgaagtctgcactacatattttcccttgctacattggtgcatatcctgaacacacatcttctttgtttatggcttattagattaatctgaaaaaaatttggaagggattatttccacgtgtaccattatttttctccaaactctttcaatctcgtcagcaatctctttaggaacgggattaaccgagcaaagctcagtaggatacattctgcctagcctagctattgagattgactatgtccgttttcaccaataagagtgttcgatcctataattgcctaccataatatctttacaaagcttgattaaattaaagagagtgcagtgatgcaaggccataaaacccaaaatgtgacccggcgaaaaataaaacccaaaatgtacataggctgcaaaaccatggaaaggggagggcacccggattaaatttactcaaaaagaaatatctgtcaccataggatgactgtcccataccttttcattccatgatgctaattaagcaactagctagttgctatctcgatatgtcttggtagttggttatccatgcatccaacatcacctctgctagcagaggcaacttttgaacataagactgctttcatcactcatcacaattatacaatgatggcaaaacaaaatgtttacgtagcaaaggtcgtaggagtctagaagacatggacagttctctcatgatctccttggataattttcaccgccaccaacttgtacttttaataagccctagagttgatgccatatctgattatctgatgccccttgagagtgatttactcggaaattaaggccaacccatagcaaacctactctatagaccaatttgcaattatttatagcctgttatcaagatgaaggtgttgacacctcatagttaattaattagcttgtgcagaagatcaacagcacctcaatttttttcagctaagttgctgtttcagaacgttccctgtgctatcagctcttctaaaaataatcatcatttagcattattggcttattgccgcagaacatttttcacgatctcatcctctctgtacgttccacatacactagctactaatcgctgtccacagatcatttagaccataattaaccatcatttgataaaacatgcaacccagcatttctctatcaacgattattatgcatttctaacagacggcacaggagacatgcctgtctggatattgtctgaaaaattatcaccccctgattttgtctgacaattatcaccactgattatcattctcacactccattatttggattgatagatacggatcctaataactacaatctactgagcatattagctgttcctgttggtcaggaaactgcacgtgtaactgcataagctaagtacgtgtgtacgtctgtctgttccaacctgcaaatcagcagcttgctgaattattaactgcaggtgtatctgcataaacaaagtgtacatttatctgattcattaaccgtttcagttgcacgggacgctgcaatgtcgggcaaaacacaggcaaagcagaggtagcaggcttgccggccatcatggtcagagctcggaattctgaagtctgaagataaataagcatgtacgtgtctgcaattaactcttcgagcgtgtgaccatgactttttttttaagtacttgtattttccattcagaagattaactaacctgcctcctgctgaaatgtcaaaggcagcagctagctagatatagattaattactcgctgctttgcttgcgtgctactcatttccaaaccagattaacatacagaatagtatatacaagtaagcaacagatgcgtacgtgctcattataacctgtaattaaccaagcaaattgtgaacttcgaatatcggtatgaagctgtacgtgagagtatgataatctaagcgtgtaagtggtggcagccaactaactcgccgagctctcagctgcgtacgatttgacatgaaaaccacggccacttatgctccaaacaaaccgcagcacacatgcaaaacgagcagcgtgtacaagacactacgatgcatatgctgatcagctgatatgtgtaaaatgtgttcgtatttaaatttggcaatttggtctgaatatttctttttggcaagttggcagtataacttggagatatgttacttcttcagttctgaaaaaacaaagagatgtgtacttcagtgtactgcttcgtatacatcattttttagggtctgtagttgttggtgaccaagttgcacaaaactctgaaacaaaagcaaacaattcttaatgggttatccatgctatggaacaacgctaaaaccagccgagaataagaatgagccatactgattcatataaaattctgcttaatctgaaaggggagaagccgtacatgcgtgtcccacacagaataacttgaggatggaagaactttagccataagtttcacatacataatgcattgccattcttaatttcaaactggtttcagattcgtatggtcgtccagtacagttctctatcgcatggccctggcgaaagcatgaggtatagtttcaaaaaagaaagcatgaggtaagtatgaccgtcagaatgagagataaaaagataagtaaaatcatggactccattgaccactcccatccagtagttcatctactccctccgtcccttaatataaagaatattcactagtattatttctcttaatataaagaatattcactagtattattgtaatgtttgactactcatcatattaaaaaaatagtgcaaatataaaaaacaaaacgttgtgcttaaaatacttttagataataaagtaagtcacaaataaaataaataataattttaattttttttaataagacgaattgtcaaacaatcgagcattacaaaatcttttatatatctttatatcatagagacggagagagtatctcgaacgtgttgcgttgccagtttacgtagcattacaaaaggctgacatgcatttttgttgcaaaattacttgaacaagaagaataaaaaatgctgtcaaatcttacgtcagaaatgatgcataggtgacctcccttaatactacttttcagtagtttttggacggttatgttcaggtcattgatgacataattcacgtatcaatgccattttttttatgaaccagcataagtcgatgttaattttattgaatagagtagaattaaatacaatggcctatacaaaactcagaaaaactatacagggattttaaaggatattttaaaggataagctctgagagacgcttagcgcttgtaagaccgtcgatgatattttgttgtgctcaaaagactatggtttctcttccgccaaatctccaatgatatcatgaggatgattaagcgtgctctagcttggataagccttgacaggtggctagcacttcccaccacattgatgaaatacgcgtaggctacgatagtataaataaaaattttctatcgcgtaaaccaggaaccatgcaagtattagatcatagatcgttaccactcgacgcgctgcgcagcggaagaaggcgctaagaagtcgaatgaactctcacgaagtagcgcgcgtcgatgtagaggaagtagtcgatcgcaccggctcgaccttctcctcctcgtgcattcttctcgccgtattcccacaccgattagcaccgcaaagcagcggcgcctctaccagtatccacacgtacagagacgaaacgccacgcgcagatgtgctagcacccgcgcgcggctagggttttgctcggggaggggagtgacggctagggtttctcacgtaatgcgattccttagccaatcacacccctcacgaatatataggatccatgactcgggcctccaaggtccataggactcctatttggatccctatccgaattaagctcatattggatctccatccaatccccttattccggcccattaaacgtgcgaccctgtagattcatgtacactctgctgtaacccgaaaactaccttttgttccacgagtcaacagcggcccctagcagaacgtattgacccaccgggcatacataaatatcaaatcggttgaacctctagagtatacttgtatgaacccctttgtctcacgatatcgattaagctcaaagctatatatgtgccatcctctaatagctcaatcattcactcgaacctgtgatagttatataacttgtgattgactcctcaatcacctttggtatggccatgcacttccataacctacaatatcgaagggcccagagatatctctccataggaggagcaaatcatatcttgattattcatatcccactacatgttttatagcatacccgaaaactacttttataactacccaattacgaagtagcgtttatctgtccctaagtaagctactacacatattgggaaccataataatctcagatgtaaggattcaacaccaacactaaatgagatcactgatgacacaacacatatggctcttgcagtgtctcatgttgggtctatccaacaacatgtgtccacattattaatttggtatctctatactatgatccatgagacatgatcatcaattaatacatgtgttcatcacttaaatatatttattccacatatgatatttgatcgcggacactttaaaaatagtaacaaacaacataaagagtctcatgaaagagtcatat

SEQ ID NO: 70757 - DNA, 521 bp, Oryza sativa
gcgcgcgacgcgcacggcggcgcggaagcagagctacggcggggcggcacaacactgagtggggcgtcgccgggaaaacagagagggggcgcgagaagttacgggaggacgacgacgagctggttagacgagagagaagggccgacgacggcgcgcgactgctcggtggcggacgcagcaccgcgtgtggtacgaggaggaagaaggcggcgatgcggaaacagagcgcacggcgagctacgcgagtgcggggacagcgaaaaaggaagccgaggagctcaccgacgggaggaacggtgtcggcggcgagttggggataggaagggatggaaggcggagggtagcacgcgaccgagcggcggcgcacggcggatgacgcccagccggcgcggcgtcgaggcgtgtgcgccggggaaggagagatggagtgcggcgatggggcggcgcagagctcctcgtgcgactcctcgtgcgcacgtcggcacgcgcgacggcggaggaagggcgacaatggcgcggcg

SEQ ID NO: 70758 - DNA, 1509 bp, Oryza sativa
  unsure (1)..(1509): unsure at all n locations
gcgtttcgggttacaaatatatctagttattcttgatgattgttctcacttgtgtgaacctttcccctgcgcttcaagtctgacatgtttaccacgctatcacacttctttgcctatgtcaaaacccaattctccaccaacatttgcagcatccagtgcgacaacggccgcgagttcttcaacatttcggcccgcacnnnnnnnnnnnnnnnnnnnnnnaccatgcggatgtcttgcccccacatgtctccccaaaacggtaaagccgagcgcatccttcgttccattaacaacattgtgcgctccctcctttttcaggctagccttcccggcaccttttaggttgaggcccttcacacagccacctaccttatcaacagacaccccaccaagacgcttcaacaccacaccccattgtttgccctctatggtgtacacccctcctatgcacatcttcgcgtattcggttgcaagtgctatcctcacctttccgccatagccccacataagctctcgccccgatccaccatgtgcatctttcttggctatccactacaccataaaggatatcggtgtcttgacccttccaccaatagggtcatcatttcacatcatgttgtatttgatgagcattcttttgcatatgctaacatttcttctccaagcagtgctgatgagctcgactttttggaggattttctgctcctacacaggcaccaattggaagaagacacgctgtgcctggcgctggcgccagctcccctgctgcaccatcctcaccggccgccagcccactcacgacagcttccggcccgtcaagcatcgccaggccgcctcccccaacccgtcagcacaaagcgggttggccgactcccctgggttggtccactgtcgcgtcccaaagcgaccctaaaatatatcctttaaattatgcttagaataattaaaatccgtgtgaaagcctccaacaattaaaatgtgcaaagttaaaagccaaataaggcttagaggatttttgtaaatttcctaaaatcctaaaatgcgtaaataaattttagtggaattttcagagcacaaataataattattaagaaataaacaaagttgaaaaggttttataaaaagaaaaaccctaaaaatcccccttccctctcttgggccgaatccggcccatctccctccccctctctcctctcccccgcggcccatccggcctctctccgcgcgcgcgccgctgacgggcgggcccgctcaccaccctcgctgacgggtggggcccacccgtcatccccttcctcccgccgctcccgccgcctcccccgcgccctagcgccgccgccgccgcgaatcccgccgcctcccgccgtccccgcgtgcaataaagtgggggaaatcactccccgtgatcccctctccctttccccccatttttccctctctctctagcgttcaaacgggcggatttgcccccgcaaatctcgccgcgccattgatggtggccgaacctcc

SEQ ID NO: 70759 - DNA, 5385 bp, Oryza sativa
tatggagtttattggagtaaaagcacttttattttccgttggtcgtgtatacgttgcagcttcggaagatccactcttcgtggaggttgaagccaatgtttgggaaagcgagcaaggcaagtcacatcatccttgaacatattgcatcccagtttataaaattattttgatttaaattattgcattatcgctttacttaaatgcccgcgttatcactgttttatttagccatgcctatttacctttgttatgaccttattattattgttattgatattattaccttgttcaccctagattaaacaaaaccccaactagtggacactctactcatggtaccactagtatgattttaggtagatgcttcgctggttagttaggcaacattaggtggttttacaactctagactgtgggaatattctcatcacctggacactatggaatggttggattattgtggaatcggattcacacctccccctctattcaaaaccctaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaaggcaaatgaacgctacacgagctgcggcccggtagtcgagatgtcatggcacagggccggtgtcctgctgctaggggctcagtcctgcctacctgtcccgggggttccggccgtaggtgcggttgggtcgttactcttgtttatggctaggatgggttggaaactatgtcatgtcttctgtccgtataccgtggtggtatgtggcacgtggttacacgtgaggaagatgtgtcttgtgggtaaagatgtacacctctgatcagagtataatctattcgaatagtcgcgccctcggttatgggcaagccgagcaatgtacccaagttagtgtttttaattcttaaaacctgcttaacaactaaaatgtggaatggttggcctgggttggcttgggacgagttaggacccagggttgggttgccagttcggtctgaatcatcgtgggccttgggttaaggcaggttcgtgtgggttcacggccttgattaataatcttgtatagctctaggaccgtgtttacaaagtagctttgagcaactaagtgacttttaatgctgtttactgcaaaccctaaccccccctatattatggctcccttgtactcccttgcatttattctgcacttgtgggtgtgtcttgttgagtacggtggttgtactcagtcttgctcaatttttcccaaacccagaagaggagcccctggatgatgaaggctttggtgtctagctcgtgcctgccgtcaagcgcatgtggtcgtcgccctagtcttccgctgtttcccatttgtctttgtgtgtgctgggccttcgccgcccatgtaataaagtaactatttacgcttccgcttgataaactctgaaatgtatcaacttttggtgtaccttgcctcctgggacaaggaataatacacgcacgtaaggaacgcccgttgggttatttccggtcgtgacatccactcatccggttcggcccactcacctgggtcgacccactcgcctaggccggcctcttcccccggctcggcctcctcacctgcgacggctcgctcgacaactacggcaatcccatcgccaccagtgccatggtttgctgcggtgcccacccgaccccggtcggtgcgcgtgcaaatcgctcctccaccgccctccactacggcaccgctcgtgatcaatgatcacaccatgaccacaagtggcaaagccggtctgcgcaagcctgtccagcgactgaaccttcatgcctcgatgctatctccagtcccacacacctaccgagctgccctcgccgacccatactggcaaacagccatggaagaggagttcactgctctcaccgccaaccgcacatgggacttggtgccccgaccatccagcgccaatgtcgtcaccggcaagtggatcttcaagcacaagttccaatttgacggcacacttgacagatacaaggctcggtgggttcttcgcggtttcattcagcgccccggcatctgtcacatcctgattttcgtttcaggatttataaattatttaataaattaataatagaatttatattaaatgatctttaatttacaagtgaagttaaatgtgggaaataaaatttcctaaatataaagcatggatggatttaatttttattaaattctccatgattaagtcaactctctgaaattttctcggatttttcagagctcaattcctaaatgatacaaagaatagttcagtaattatttgatcaataatgatttaattatatttgttaagagcttttcttatttaaaaatccttaaattataaattgttgtttaaaaggaattattagaaatgatcttaaaagcctaaaagagaagatctaattttaatttgtgaaatctcaatataaaatggggccagataaaatttcattaaatactttgcttaattctataattcctagatttttctgggatttatttgagctaaggaagtatttttaataaatggaattgcatttcatgaataatttaaattgaaaaaggttttaaaagtctcttttggctttgggccgaaagtcggcccaaaacccctctctttctctctctctccggcccagtcggcccagccagtccgagctgccgctctcctctctctctcgctgtcgctgacaggtgggccccacctgtcggacttgtcttcctcctccggccgccgccgcccgaaccctagccgagccgcgtccgagccgccgccgtctccttccaaatccgatcgattctttccttctccggtgaaatcttttgaggggaaatgatcttctcgatctcctcttccttttctcttttggaatcatcgtctcaatcgctttggaagttcgtggattcgaggtcgaatcggatcggtttctttcctccgaaccccgagctttccatcccgtcgccggtcgccgtgggccttcgccgctgccttccaacccctttaaaaggatccccggtgtctcctctacccgccgcctccctcgccttcgtctctcgccgtcggaagcgccctagcgccgtgtgacctagcgccgccgtcgtcgccgccgcttcagccgtgcgccgccgccgttccggtcgtcgtcgtcgctcggggaggtcgccatcgtggtcgccggcgccatccgttgctcttccgccgttgttttggtcaccggtgagttcgccgcgtcgccctctacccgttggtgtcctccgtttgcatcgtcacgccgtcgttcgccggcgagcttgcgctcccgagccgccgccggtgctgacgtcatcgctgacgtcgttgctgacgttatcgttgctgttccccgtggcccggtcgtggaccgatcgatctcggccatccgttttggataagatcgatctcggccgtccgttcccgtgaaccgctgccgtgcacccggtccaccgcaaacccgacccgctgacgcaataattccctttttcttttcaaaaataattcattattgcgtcataattcaattaaaatctatataagtgttttaatccgatttaatctttaaaaattcataactaattcattgtaactcagtttaatgtggttcaagttgcaaaagttgtataaaataaagatctacatattaaaattgtccataaattgaattaaatttatttaattctttttaaatgggctttaattagatttaatcttgtaaaattcataataaattcatatgaagtcagaatgaggccgttcaagtctcataattcatctaaaattatgatctacatgtttgtttactttatatgtattgtttatttggtttttattagtctttttcttcgttttgcgtgttagcttgtcgtttccgtcgttgcgaaggttcgtgagtgcgtcaggagtgttcagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctcttcctttgttatggccaatttgcattgattactttattccttgataccttgggttattataattggactagttgagctttatatatattggttcaactagatattagatataattgcttagccatgcttagaaacattagcacactattgggataacttatgactcactattatttaatgatggcttaatgatagttcacgatggtcaatcgtgattggttaattaattacttgccaactaaaatatgattaatggtgggttgtgagcacatggttttgagagtcgtgctcatgacaattaaggaccggttcgcgagctactgttgtgaaacattaaccgtgccaaccacaagccagcatgggcaacggctttaccttttgtataacatagttcattgcggagcaccagactgagaagtggcggagataagcccacgggggtcgctggggagtccatgcctctggtttttgagggggtgattatgatccaggaatggtgcactgtggtgagttgtgttgtgcgaagggtattgtcacgatttccccctttgcagtgccgtggtggtacttcggggcatggcaacatgtgtgaaatcgtgtcttgtgggtacagtggtacacctctggccagagtaaaactattcgaatagccgtgcccgcggttatgggcgggttgagcaatgtttttcgtgattagtctcacacctctcacaataattatggatgttataactggtaataatttgtttagctcctggtttggagttagatctgtacagccgggtatggttgttcaggatggttgggcctgtacagcatgggtgtgctgttcagtgttgattaaaatttctgattaattactctactgttttactactcttaactctttgctaagtgctgctttcgcaaatgagcctatattatgccatcctttgttatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttatttttccgctgcagttttcttcatgatgaggactaagtgcctcataagtaa

SEQ ID NO: 70760 - DNA, 9437 bp, Oryza sativa
aatttccgggcgtgacagcatcgactttgatgagacgtttagtccggttgtcaaaccggccaccgtccgcactgtacttagcctagcagtctctcacgattggccaatacaccagcttgatgtcaagaatgctttccttcatggcaccctccaggagacagtctactgcattcagcctcccggcttcgtcgaccccacacgacttgacatggtttgccgcctgaacaaatcgctctatggtctcaagcaggcacctcgggcatggtacagcagatttgctacttttttgctgtccattggcttcactgaggccaagtccgacacatccctgtttgtccttcatcgcgactctggcacaatatacctgcttctctatatcgatgacatcgtgctcactacctcctctgctcagctcctccagtggaccatctcatccctgcagtccgagttctccatgaaggatcttggtgctctcttggtgctcttcatcacttccttggtgtcaccgtcgctcgcagggacaccggcttgtttttgcatcagcggcagtacagtcttgatatcctggagcgtgctggcatgacagattgcaagccgtgcgccactcctgtggatacatgtgccaagttatcttcgaccaacggtccactagtggcagatcctacagattatcgcagtcttgcaggagcacttcagtacctcactttcaccagaccagatatttcgtatgcggtccagcaggtgtgcttacacatgcatgatcctcgcgaggtctatctcaccgctctcaaaaggattttgcgatatgtccgaggtacaattgatcttggtctccatattcagcgttctcaggccactgaccttgttgtctattctgacgctgattggaccggctgtccaaacactcgcaagtccacatccggttatgcagtttttctcggtgacaaccttgtgtcatggtcatccaagcgccagaacactgtctctcgctcgagtgctgaagctgagtatcgcgctgtggcaaatgcggttgccaaagccagctggttgcgccaacttctccatgagctgcattccccgccgtctaaagccaacttggtgtattgtgataatgtgagcgcagtttatctctcctccaatccagtacagcatcaacgaacgaagcatgtcaagatcgatctacacttcgtgcgtgacaaggttgctctaggtgttgtccaggtgttgcatgttccaacttcatcacagtatgcggacatcttcaccaaaggtcttccctctcttgtcttcatcgagtttcgctccagtctcaacgttcgctccatcgacgttgcgactgcggggggtgttagacaatatggtttagatatgcatggttgagttttatctctctaagcctagatccttatcctcccgattctgttgctataaatcggtagagtggttatggacaggcatatatatgtacgcactacgtgattaatccaatctacgttgagttcctccatctcacaaagaactcaatggtcgttgcgatgttgatgaacttgtcaaatacgactcgcagcaacttcttgatgacggattgagatcctctacaatcaaatgcagagtgcttttatcactgacatgtgagaccgcgtgccagtgacgcatgacttcaactgcagagcattctgatcccttgacgacatacttttgtatgtatatgatgccttgggtttgggacacgagttattttcgttctcgattcgcccttgcatataccatatgagttttactcaaatccaatgttctaacaagcacaaaaagaatagtacaaaaccatactgtagtttaacgatctacttcagcataagcatccgccggcacagcacggattgccaccgacgggcggctgcacccatctttgcacctcgggcaggagcacgagcagccgcaggagcactcggggcacgacggcgccggcgtcgcgcctccgaggcagcaaggcctgccgcagcagcacgccgacgatcccttcccgccgccgcagcagcagcagcaggaaggctccccctcgcagcacgacgactggcacttgcagcaggacggctgccccttgcagcacgacgaccggcagctcagccaccgccggagcagagccaggcagccgacgcacggcgccgcgcaggacgagcacttggggcagcagccgccgccgcaggacgagcaccccgtgccgcagccgctgcagctcggcttgcagccgccggcgcagctgctacagcaccgcgtgcaggacgagcacgagcacttgcagctggagcagcagtcgctgggcggacagcagccgccgccgccgccacacaacggtcggcagtggccgcagcctgtgcagccgcagctgggaaggctgcaggtgcagcaatcgctgctgcagcagctgcagttggatttgcagcagcacgaagaaggggccttgaggcagccgcagctcggtctacagcacgatgtgtcgcagcaggagcagcaagaacaactgaagcagctcggtttcttgggctttgggaggcaccggcaccaacagcagaggcataacaagcagttgcacaatttcgatctgataaaaaacaacaggtttaagatcttttagtctttccaagggagcgttgaaacagcatgtcatttgcaagaagttcagaacgaaaaaaaaggcggtatttgtcgtgtaaatagcgctgcagttctgggaacagtattggctccacaaaaagactgcgaaaattgctttgatgccaccataactgatgtcagatatcctgacttttttcatcaaaagaaggcagtactccgagttatcatgtagtattaaagtgtgacatttctgacaaatcactttgttggtgtattgaggttctacaaattgagtgagcatttgataaaatgggctaataaggtgaaattcagttcgggcatttgacaggaacagaaacaagtaggagtatgagtcttaacagtgttgactgttgaactagtttattcagcaacaaactgaaaccagcatattgtcatactttgccctatgagtgttacctacttattcactaatggcttgaatttaataaactctcaaattataaacaacaatatattccctcggtttaaacagcaaagcttttagaatgtttttatccgtacacccaaaagcatggacaagggaagagtaagggacctgatccaccgatagaggctgcaagatctgtgtttccttttgtttctggaataaataaggcacagggagaacactgatcagcaaactttgaaaaaagaaactctgaaatgcaaaacataaatcaatatattcatacattggtataagcggatccgactttgcaccaacaaattcgttgacactgccaaatgtgataatatagcattagtatctttgtaatcgacaatggcatttgaacgttacatagtacagttccaaaaggagcaaaattgaaatgtaggtcatgcatgaacagttcacatgttgactgttggaccaccaggtcagaagttactagcagagattattattggcattcaagaaaatcgaaaagtatagtaaatgtcgcaattcatgtgggccactttcttttttttcaaaaaaaaaataagtttgaggaatgtgtcaggattcagcaaataaaaagaacacaatggaaaaaattctaatttttagtgctctcctcggaaaaagaattgtcttgtttatcaataagaccactacaaatcaaagaaacaacaacactaatgactcaaacactactgacattcagagtagctgtgattaaatggcatttgagcctgaaaggctgagactagatcactagaatgaacaagaacttgctagttgcccatccgagcgaaacaccagcactgccggcgacaagatttgcagagagaagcgaggctaatgaggaaagcagaaaggagaggatagggcgcatactctttgcaacacctcgagaccggctgaatccgttcaagtccctgtagctcttgctgcaaaaagggagcccccagtcaggccgaggcacatgcacatggcttccacagacctatacacagtcctgctccatgtgccatgaatggaagcagtaaagaacacgagcaatgcgcagcagcagcagcagcgtctctacctactgattgccattgccaggtgatgtcacgctcaagagaagcagaaatctgaaagtagagttctttttatttttaattatcaattgcaggtactcccccatacccctatagttccagaattcatcagactttacgcatgatgcaatgtaatgaggagacttcggaagtactactcctatactgcacttgctttgcaattctgaaatgcctgatgttgcagggggaaaaaatacatattgcagtagaactctactactactactactccagaagtaaaatggcattggttcatggctgcccattgttcttgttctctctgcaagaagacggcagtaggggcagccatgacagccgcacgtactgctagtacaacatgggagcctgtcgcgcatcggttgtcgcgacagagcgagctctcgcctcgcttccgtcgcgaaaccccaaaccgatgagctctccacatcaacttttttccccggagatttcctctctctctctctctctctctctctgtctctccactccataggaagaacaaaaaaaaatgcacgcttttcttcatcactgtgaaagaaagcgaggtgacatgacggggaagtgaagtgaggtcacctcgaggaagccgacctcccggttgaggatctgcatctccagctgcagccgccgccggccgcacaggtccgggtacctcggcggcgacttgggcctcggcgcctcccccatctcaacccaacttatccaccggagacgcaagacaaccaccctcagcgccgcgagcgagcgagcgagagagctagctaccctgcaggctacagctgcgtagctaaggtgggcgaggagagcggcgaccgacggcccgcgctacggtgagctcggctgcagggccacgtacgtacgtacgtacgtacgcacgctcgccaccggcagggggcgggggcgggggcgtcggctcggcgaatggtgtggatggtggtggcgacgcgcgcggcgttgggttgggggtttaaatgctggcgcagtggctcatcgcgcgcgcgcgcacgggaggaggacgcggaaggcgaggcgctgcgagtgcacgttgttgcgtacgcccactctgctctgctctggtgtggtggtgtgtgtggctcggggttgggcgccgcagactctctcgcgggcgcgcggtgggcgtgggtttttctgcgtgcgcgggggcgcgggggtgcgggtgcggggggagatgggatgtgcggccgtgtcgcggttggcagtcgtacgagacaatgttcagtcgtgtcatcatcgctacgcagaatcgcagacgggtggcccccgcccgggcggacgcgtcacggcgtcagctatagggggaagggaaagtagtaggacggggacggaacgacgattgatccagccgtagcggctttttcaccgattgattcatcactgctctaagttcctttttatttttcactcaggtcctttctgtccggtatgttatgtgtttattctttaatactttttataaggattgttaggctgtgttctttttttttcccaactccaccccactcatttacagtgtacgtgttttttaaacggctaaaagacgtgtgttttgaaaaaaaatgatttaaaataccatattaatccatttttcaagtttattttgttaatacttaattaatcatgtgctgatgaactgctccgttttctgtgtaggaggaaaacgttcccaacacacccaacgaacacaaccttaatcatcaactacttcaagagttctacgaatatcaccctctttttgggatttgtgtttgaattcatattagagcaagtttaatagtatagctaactgctgtctccaaatcatctataatcaacttaatagccaattcatacaatagttacatataaatatataccacgcaattaatatctggtcccacatgtcatacacacatgcatcttggagtccatgctacagctgcatacaaatctgtagcccgctgctcttatctctcatcttttatctcctcgaaatatgtttgtagctggtttatagtctgctattgtatctactctttatcattcacattgtttgatactttgagggaagcccgcataagatggtgttgtttctaggctagggaaagccaatatgtacgagagttgttagagctaaaaaatcaatctagatttggtaatacaattggatgttaatggtattaaggatggttagtaggaaaaatcatcggagacgatgaagaaagaaggttgaagcagaacattgtgtgaacttattcatcaacagtgacacggaatgatactactgatgctagcaaaggttagtgggatttgtgtgccgacaagttcatgactaattaggcaaccagtgttttggcttccaaggaacacggatcctctgaggctctgacttctataatctaagtcaaagccatacaatacccgctcactcatcacccgtttcaatccaagtgttgatgctttatttcctttcttcccttaattctctatgggtatgaggtgaagtgagaataaggccgtgacagttgaggcaccaagtaggacgaaatcagtggcaacgagagaagccaaggcacgcacaagatgttctcgggacagaatgggaatggttaggatatggatctagcctaaaacgtttcaaatgagtttattgaaccatggtttaatagggtcaatccatcatgagtctattatataaataggttatccatggatatcaaaatggatcatctacgctcctaatagataaaaaaaaactcttattgcatgcatgtaaaactcgggtccaaaatttttaaactcgcgttcacattataaagccttatcaaatttaattgaattttatagagatgatttattatatggagaagcaactttgttcaaattttaagtcatttagacatgtgaggcccacgatacattactaagattcaaaaattatagttaccatcctcctaacatcaattgaggagatccaacgatgccatacgccgtaggatggtccgaatagaggtgacagaggcgccgacaaagatctaggtggtagtaccgctcgtctatcgcccgccgccggccgctcgtctgctcccgcctccggccgcccgtcggcgccgcatcgtccactcccgccgctcccaccgttcccgagtccgcgcgggaggagaagcgagcggcgcggtcgacggcgaggcgcacggcggcggcgtccccggcgcggtcgccggatccgcctcggccactagagggaggggaaggaggcgcaagggagaagcggagcggtggcacgggaggagaagcgaagcggcgcgggaggagaagaaggcgatggcgatggagtagaggaagagaaagtcgttaggggtaggtggggaataaatttcgtcccgtaccccgtgtccacacgcttgggtaatgctgcactgtgggtccggttttcttcacctgtggctccatccaattaagccacacatagtatgggtgcttgcactgtggggtgggtgtctttaggccaactttttttgctagagctacgggccccataacttgcactgtgagaggcttaatagccttgagcacgaatgtcaaaggaagacgaggccaaccgttgacgaagctggcaacaacgtagagggctatgaaacagtggtctggcagtcgcaaaaatgggtggcccagagttgcacaggtaggggcgagctggaggcagcgacgatggttgcgcttgaccttgacgaggagaccattctcctgagcggtggtagcctgaggaagggatcatagatgggatgaccgaagaagaaagactacgagcgatggagaggagaggaagagggcaatactgaccggtgggccctaccattttttatatttttcgttgatatgattgccatgtcaaccaaaattctgctaaacgtgtgacatgtaggaccaacaccgctccggattgggccaaagggataattcattcgggttgaagagcttagggttcaagatgtttagttttgtagtttgaaaggattatttgaattgctgtaatagttcagggatagttaggatttctttgtagattgaaacgaacagtgtataagatggtattgcacacatctgtcttagcttaagtaggtcagaggatccatatcacatcaaataccatggatagtcttcgatcgttgtcaattgtgcttgttcaacaattggaacgccactcaacaattggaacgccactaagtgagcccacccacttagggccctttgaatcataggaatgaaaaaacggaggaataggaaaacataggattctaatatgaatgcaagtgcaaaacagagtactgcaaaacgtagaaaaaacacagggatgaccgtttgattgaaccgcacgaaaaacacaggaatcggatgagagagagattcaaatgaaagtttccaagatgttagagttcttgctaaatttcctccaaaatctctatagaattgtccattccataggaattttaaaggatagcatatgattcaatcatttgtttcaaagggcttcatagaaaattttcactatagaattggaatccttcaaaaattcatatgtttgtcgtaagtccagggatcatcgagggctatttggagtttgggcagaggaaaatcaagtcgtcgtggtcttcttttaattctacctttactaggaagcatcgatgcacggctacaacttctgtaaggaaaaagtacgaattacccccccccccgaactatcgcggtcgaccgaattaccccctaaccatagaaccggatatttttcacccccaactttgcaaaccgaacgaattacccccctcgacccaatccgcggtggttttggtctatgtggcgtacacatggcaatccagtcagcattctatttatgaaaaaaaaatgtgggacctacctgtcatacactactctctcttctctctctcacacacacactctctctcactcttcctctctctctcaccatctcacgggtcagcggcggcaggggacacggagcactggcggcggcggcggcgggggatgaggaggcggccgctcggctcagtggcatgcgcgcggggaggacgaggacgcggcttccccctcccccctccctctcagcggcgtgcgggcggacggagctcgccgcggcttcccccctccctctcggtggcgtgtgcgcggggaggacgagggcggcgggggcagacggagcttggcgcatctgg

SEQ ID NO: 70761 - DNA, 2484 bp, Oryza sativa
tatagttgggggtgaagaatatccgattttgctgttcggagagtaatagttcggagggtaattcataatttttttccttttgtaatcagttgcaccaccagctgcctgcctcccccaaaacgggccaagattttccgacggtggtcggagccgcacgcgcagcacggcagcagcagcgtcgtacttgacttcagtttcagccagctttaccaccaccgccgcggcgccagtgcgccacctttcccccgtctaccaccactccagtatgagtagtacagtgtatagtagtagtagtatccctcgatctgccgcgcggcgattgggcatcctgcggcccttctgacttgtgggagcggcacggcacagcacaggcacaaaaattgcgcaaaagcggcagcagcgccacgtgaccaggggggggggggggggggggctctgcctgcctgcgcgtgtcgtgtgcggtgcgtctgtgggcatcgccgcgtcggtcccccgcgcgctcctgccgagcggtgccaatgctcgtcgccaagtcacgagttccgattgacggcagcgcggccccgcgtgcggcgtgccatgctcctcggatgccaatgctcgtcgcgggcgggcgcacccgtgcgtgcgatgcaagggaagaccgatggttttcaacgcgcgcgtgcgtgcgagcgtgcatcggtctggcggctctgctccgctgctgccgtccctctgataggccagggccagcccaggggttgggtggtgggtgggcttctcatcgatgataatttccttgttgggctgacgcacctcggctctggtgaattgaagcagcaataagtctatcatgcctcccaattcccgcttctgattgaatcgtctccctcaaccgcaaaaccgggtataacatctcccccatcttcgaaaatcggtataaatcgactcctttagtcgtttgagaacatgtttatgttgatgtagcaatttacaaacctaccagtagaaaccgctttaattccaaaccactgactgagtcgatttacaccagttttcgaagatggggaggcgttttaaccagttttacgattgagagaggtgattcaaccagaagtaagaggtaaatgaggtagaatagacttattccgtttaagcacaacctaatggattgcgtggctgacacatttttagataatggaatggaacatcccaacctttgctcaagagctatagctaattattgacaaaaaagcaaacgcatggtgttgggtttatgttttgtgttgaaaggctggaagcctggaatgttggagattttttttaattttttattaaaatatttgtaaaactaattttgtgtttcaaaattttacaactagtcgcccgtcgccctttggaagggcgataaaaatcgccctcccaaagagcgattttcgtgacgtggcagatggccattggctcatgcctaacggccggctatagggggctgccattttgcaggcgacccccttgccgcacttagggaggacggtttaacactgtgcggggccgctccccttctcctccccctcacccctccctctttcttttttttcggattttgagtgaatataaagcaaaatcatagagcggcaaggaggctgcccttttgcaggccgcccccccgcacagtgttaaaccgccctccttaagggcggcaagagggccgcctgttaaaaaaaagccaggtcgctatcgctgcccttttgcaggcagcaccccgcacagtgttaaaccgccctccctaagggcgggaaggggaccgcttgcaaaaaagctaggccgtcctcaccgtccttttgcagccccccccggcacagtgttaaaccgccctccctaagggcgatatgggggctgcctgcaaaatagcaggccccctttgccggccgttacttgtgaggcgatagccgtctgccacgttattaaaatcgccctctgggagggcggtgggcgactacttttgtaaatttttgaaacacaaaattagtttcataaatattttaataaaaaaattccaatgttggatgggtaataggagacggtccaatagcccatttgtgttcaggagctgaaggcccatgcgaactttagttacatctcgagcttgcatcttttgcctaattacatgaaagaggatcgattacataaaataaaagatagactttttcaagttcttttagcctaaaaaataaaaaaaaatcattttcataggcggctccaaaagaccacctgtgaaaatgtttcttggcggctgattttgagcctatataaatggtcgattttcataggcccttagctacatgcggattgaaaagcgctcgtgtaacgggttatgaaccgctcacacaaacggttttttaacacaacctcaaagagataaaataggtgatataattatgatctcataaaaattccttcaatatgatcttgggcttatatcttatatatgtagtttgagag

SEQ ID NO: 70762 - DNA, 8477 bp, Oryza sativa
aaaaaccaatctaatactgaatgtgacacatcctagtaatacgaatctgaacatacctatatccaaattcattgtactataatatatcacatccagtactagatttgtttttttcgggacggaaggagtatacttaagtttaaaaaaagtttatttttctaagaacaggcacacaacacaaaggacagcaggggtgaactttcaatacggacttctcacccaaccagtgatctttgttaactctactcaaaacagtgaaccattatcagattattctcagcatgacttgcagcacaacgaataataaatcttctactagtgagcatccaattgggcacttggctctatagatcagttcagcgtgttaggtagcaaccatttgattgtttagaacttgcaagacttgcgaatcgtcgagtcgtgtctttatttatgtatatcagtctgctatatacatgcatatgaacttgcacagctaaccgcacagggacctctgcttacgaactgtatgatgctctgcgtcgcgtatgaattttccgtagatacgtatcatgttcactcccagcgtaggaaaaataagaaatgacgatgtcatgtggaagtctttcttaggcagcccggcgaagacgcaagctagctagcaccaactccacttggctgttcttctattgaaatttgcgaaggtttgcgttcagccgccagcaggttgtgacgatcaagcgatccgcaaccatgagcggctgagcgcacattacatacacatcagcttcatataagcaaagcaacagtgttaagagtctggttacaaatcacaaagatcattaatactcccaacgtcatatatacactaaaacacacatgaccggaggggagtacttatttttttaaaattttgatcttaccgagagagtacttgactgtcgcatatatggtcgatatgattgatcgtttcccctttccttttaatgatttgtgagctcacgaagtatgaaaagaaagagtgaaagaccattcagtagtagttactactctttcctctttctgtactaaaatataaggatttttagttataaatttgaacaactgtgtttctaaattcatagccaaaagttactatattttgggatgaaggtagtacctccacctctcgacgatatcaaatgatgacagttcccacaaacacatgtgaaaaccaaataaattttgtcaaaaattatattttctttgaactggatcgatccaccgagtgaatttatttccgtacctggtgatgggcacaattaccatggtaaccgcgcggtaagagaaaccatacttattcattgtctttcgttttcatttcaattggttacaatgaattttttaatatctaagtttttattcattttcttgttttattgtaaacttctaatttacggctccctttgattcaaagaaaaatcatacaaattttggaggattttatttctataaaaaaatatttttcctatataatcatttgaatcaaaggaataaatcctatgaaatgtctcactccatgcaagttttataagaaatttaatatgggttagaacctcatgggacgtttcttttgagtctttatctctcttaaaatttttgtgttttttctgcggtctaatcaaatgactattcttgtgtttttttctatgtttaatcctatgttttataattgcatttatgtcagaatcctatattttttttattcctccttttttatttctaatatttaaaggggtcctacataagattgtgtgacaaaaagaaaaatgagttttccttttttttaaaatcttttcttgaaggtttttatgtctcccaaagggtatttctgttgtagtgtctcgaagcaaatgtttccaatctgtattgttgatactttttgtgataagatgctttagagtctcctcaagtgaaagttgattgacctaagatttcacgagtttgactgcaactgtttgaagttattagaactgttttcgtttgataatgagctactagaactagcaaagggattataatagatcacccgagtaaacatcccctcatttactaggcaactaaattattatgattcttttctaaaagattgatacgacatatcaatatataacatatcattatatattactgtataaatatataagtataaattcgacttctccaagttataaaaaaaataacaaaatggatgccaactcaagtgactaaaaagagtttctcgatcaacataatctatcaattttcaattagaaaattgactctgacttggcagcataattgagactaacacatgcacatccaccataccaaagtacaattactgaaccgtccccgtccactacactgttgtacgatcgattaccagtagtagctcactcctaatctcctacaaatacgtagcgtcactcgcttgcattgcatcgcatctccaacccaaacccaataaatcctctcccattgcccatggagccatcagcattggccaccttgctatccatggcgctcgccgccttcctgctactcgggctgatcaaacgcaagggcagccgccgtggctacaacctgccgccgggtccgacgccgtggcccgtcatcggcaacttcaacctcatcggcgcgctgccgcaccgctccatccatgagctctccaggaagtacggcgagctcatgctcctccgcttcggctccttccccgtcgtcgtcggctcgtcggtcgccatggccaggctcgtcctcaagacccacgacgcggtgttcatcgaccgccccaggacggcgtccaggaagcacaccacctacggctacgccgacatcacgtggtcgccgtacggcgcgtactggcgccaggcgcggcggatctgcgtcaccgagctgttcagcgcccgccgcgtcgcgtcgttcgagcacatccgcgccgacgaggtgcgcgcgctggtgcgcggcctcttcgccgcggcgtcgtcgggacgcagcggcgccgtgcacctcaacagggatcacctgtccacgctgagcatgaacgtgatcacgcggatggtgctcgggaagcggttcttcggcgagggcgcggacgcggcggaggggcccgtgtcgacgctgtcggagttcaagtggatgctggacgagctcctcctgctcaacggcgtcctcaacgtcggcgactggatcccgtgggtggactggatggacctgcaggggtacgtgcggcggatgaagaaggtgggcaagatgttcgacgcgttcatggagcacgtcctcgacgagcacagcgagcggcggcggcgcgagggcgaggcgttcgtggcgagggacatggtggacgtgctcatggacctcgccgacgacccctccctcgagatcaagctcggccgcgtcggcgtcaaggcgttcacgcaggacctcatcgccgggggcacggagagctcgtcggtgactgtggagtgggcgctctcggagctcttcaaaaaccccgccatcttcgccacggccaccgacgagctcgaccgcgtcgtcggccgctgccgctgggtcacggagaaggacatcccgaacctcccctacctagacgccatcatgaaagagaccatgcggatgcaccccatcgtgccgctcctcatcccgcgcgtcgcccgcgacgacgccgccgtcgcgggctacgacatccccaagggcgcgcgcgtgctcatcaacgtgtggaccatcggccgggacccggagctgtgggacgcggcggaggagtttatgccggagaggttcatcgggagcaggatcgacgtgaaggggcaggacttcgagctgctgccgttcgggtccgggcggcgcatgtgccccggctacaacctcgggctcaaggtgatgcagctgagcttggccaacctgctgcacgggttcgcgtggaggttgccggaggggatgaaggaggaggagctgagcatggacgaggtgtttgggctgtcgaccacgcgcaagtacccgctccaggtggtcgtcgagcctaggcttcccgttcaactctactccttatgaatctgtgggtcagtgtgtgttgatgagtgggacgtacgtgattgtgcactgctgtactagcttacttgctttcaagtttcaaggtttcaagttgcgagttgcaaatagccgttggtgcagtccgtttataggtggccaaattggccccctgacccgacctacatgtcgggtcgtgctgtgccaaccaacgggctgcacacacggcccaataagattcgggtcgtgctgggccagcccgaaggaatgacagtatattgtgcttctccatagaataagtctactttttcatccctcaactctttggggtgtcttgtatggctagaaatatgtctattttgtattcctcttctctttgggccttgccttatatggttgattaagtctattttggatcccactactattttctttgatcatgccatgccggccggccgactgtgtcaaggcatcggccccggcacagcccactgttgggccatgtcatgcttgggccgggccaaatggccgttccttgggtcgggccgttgggcctcgggccatatggccaagtccgtcctctcctccatcccggtgcacctctcccttgccatcgggttgccgaatgggtcttgaaaaccgttgacaaatggcaggaatccttcctttggaatggattggactcagtctatggtaggagttgccttgtcgcttaacccaagatgtattagatcaagtagctcggggccctggaaatcatgaacctacggatcataggatgggtcctgcaaatgcaatgcgatggacttggctccagcgcattagagacccctgctaggccaacattaacctaccacaagtgcagtgtgtgtcggagattttccatgcgtcagtcaatctgtcatggtcgtcatcggagatggatgtcgctcgttgttctggttggacaactggatcgacagacagttgattcaactgatcgccccagatctgttccttgtcgtccctgtgcgtcgtcaagactccacttcggttgttgctggcctagccggcaatactaggatatatgacatcaccagcgccctgactgtgtgcatgctctcccaattccttacgctatgaaatagagtatagaacttcctgactctatccaaaatgagttcatctagcgttggatggatgatgggtacaacattgcctcgacctacaacgcgttctttgagggattgatctccttccttcctttggcgcaacgcttgtcccgcaaagtgtagcttttttctcgggcttgcactttagttacagagttggacggctgataaaatgcacaaccgagggatggacagtcataccatgtgtcctatgtgtgcgtaggagctggaaacgctattgtatcttggtagagtgtgtcttcatgtgacaagtttggctcaagttgctacctaagattgagttgacctccctctcaccctgccgacaatatttgcttcatatttggtggagtcttctcgccagcggctactggatcataataggaaggggttcgattccctcatccttttgattacctggcacctgggctggaaaggaacactcgcgtctttgaggggatactttccacagtagagacaatggttgattgtattgtgcaagaaggaaagctttgtgtgggttacggcgatgcatagtcccctaggagtttttctcggtgcttagacacaaactctttctccttttcccttgttgttttcaggaatctagttgtctttcctagttagttttagaggcggatggccccatacggtagggtgggccggctggcccagcttgctaccagcccataccccatcccctcccctcccgggtcccgacgggagcattgagccacgcgctaggtcgttgagttgggctaggcccttgagtgcattgaggctgatcgaagtacaactactcaacgcctcgactccatgaacgcacgtagccacgcaccgccgtatgtagaaccctatccgctagtgctgccacaccagcaccacattgtgaacctgggagccgttcactgccgccttgttctctgccaccttattctgcatcattggcctcggttgtcctcaatttttttctcaatctacatcattagcctatgttgattgcagcagcaaaggaaaaaagaacattttttgggtgcgtatctccatccatacgtgatttgctcttctgggatttgtgttgttaaattttggtgggtgttgtcatgagctcaatcattgcttggtctctgtgtctctgaattattggtagtgttcgtgtgtgagagaatattagtggattgaaaacttttgatgatgctaattgggttggtttatggataaacaggtatggtatttctgcaattttgttgatgttctttgaaaccctcatcattttcagttcaatagacactccctcatcattaatatctcatggtgtgacccacctaattttgtcagtttgatgtatcctccttacccctcatgatcagcaagtcacggtcataaaatctcgttttttttcttgctaatatatttttgatgaaaatttcttgctaatatatagatgcgcaagattttaagcaaataaggacagtgccgattattataagttgatgcctcgcgcgtggcagttttattgattactatcatggccttgctttagttaacctcgctaaagaatactacaacctccatcctacaataagggtatttttgaaattcaaatttgttccataaagtgtatatttctagagttgtagttgtccattcaattcttccatttcaaacaataagatgttttgactttttatcaagttaaactatttttaagtttgactaagtttataaaaaatagtaatatttttaacacaaaataaacaaaataaacatgctaccaaaatttatccgatgttagatttaatgagactaatttggtgttttagatgctatatttttttataaaattgaacaaacttaatagaaatttaaaaaaaatccaaaacatcttgtaatataaaaaattacaaaacgaagatagtacctttcatttagattattactttcatttagattattactagttcctcctcgattataaaacatcttgtaatatactactgcctcctagttccaaccaactcctaatttagtaaggagcatttacattttttttcttccctaataatttttctttcaagtgctaaaaatgcacatataatgagatgaaggtggtaagagagaagattggcattgggaagaagagaaatagaaggaacagagcagctagcaatggaggtcggacaaacgacatgaagaaagggatatggaaattacatttatactgctttgaaaattaggtttaatgcatccgtggcaaagatcttgaattgggacttgagaaattatggaaggaaaaagtacaccgaaggtccctcgacttgtcatcgagttacaaaatcgtcctataaccacaaaaccagatatccaacgtcccttaactaatcgaaaccggtcacgataggtcctttggtgtttttgactccggttttatcctacgtggcagttgagtcagcgtggaacccacgtggaccccacatgtcagcgtggccacatcagcctcctctctcttttcccctcttctctctcttcctcatctctctcccttctctgccaccgtcgactgtcccaccagcatgaaggacagctggagggcgcaccggcgcgtcgcgtacgacggcgaggccaagaacctcaccgtcgcgctctcctacggcgacgcggcggcggcccaacagatcccgtgctctggtacgccgtcgatctgatggagtacctccccaatgccgtcgccgtcggcttcttcgccgttacgggcgaggccgccgagctgcagcaagtgtagtacttggagttcaccaccagcatcgaccccaaggacgtgtgggtggtgttgggactctacagcttgcttctcgtgctcgttgccataggggtgctctggttcgtgtcgcaatggaggaaagccggagagctcgccgatggcgacatctttgacgagatggggtacgacgagcttgccgacgaggagttcttcgtggagagcgggccgtggcggttccggtacagcgacgcgcgtccgcatccaacgcgcgcgccggccgccgccacaccttcctcctcccccgcgcgccggtcaccgccacaccttcctcctcccccgcactccggtcgccgccacaccttcctcgtcccctccgtctcgccgccgcccgaaacggcgtcggctggggcacccggcgcccatggtggaggcggctagatccggattcgccgtagcctctccgccatcgacggtggccggcggcggcgccgtgctcacgctcgtcctcctcgccgcggctgagtggtggcggcggcggcggt

SEQ ID NO: 70763 - DNA, 2887 bp, Oryza sativa
cgcctacctcgtgttccgctgctccccaccactctacgcctccgccgtctccatctccaacctcctcaacatcaccgccaccgccgtcaccgaatccaacgccgtcgaccccggtcacccccgtcgccgccgaccccctcgtcctcgcgcccgttgtcggcgacctcatccccacccgccggctagcctgcccgagaggagagaaccgagagagggagagagaggaggaagggagaggaggggaaagacatggagggtgatgacgtggcattctgacacgtagatcccacgctgactcagctgccacgtgggacaaaaccggcgtcaaaaccaccgagggacctgtaaacggttttataagttaagggacgtcttgcgttttggggacgattttgtaactcgatgacaagttgagggaccttcggtatactttttccaattatggaatcccaagtccctggcctgacccaataatatgccaacatttgggcttgcagataaggggctttagacagggagaaagatatgggctttgtttagattccaaaaaaattttagccaaaaacgtcgcattaaatgtttgaacacatacatgaaacattaaatgtggacaaaaaaaaccaattgcacagtttacatgtaaattgcgagacgaatcttttgagtctaattacgccataatttgacaatgtggtgctacagtaaacatttgctaatgatggattaattaggcttaataaattcatctcgcagtttacaggcggaatatgtaatttgttttgttattagtctacgtttaatacttcaaatgtgtgtccgtatacttcaaaaactttacacctaaaaaactaatcacacccatgatagcctggtacttgtagcatcccaagaaacaataggcctgtttggattgacgccatactaaaactttggcaggtctacggagagttaaaaatgtttatttggattgaagccaaaatatgtctataagagataagttcaccaaaaaccaattttttttagtaaaggtattgttttaataaagatggttggtttttcctaccgtaccaaaattttgatagggtaaaattcgatagggtagcaatccaaaatgtcccgatatcttttctcaattacacacgagagattcacaagcatgcacatctctatgcacacatatcatacgcacatataggtgagtctgctacctaccacacgttcaaatcaacaccatcacatttctaacatcaacaaatttctattaaaaatgtacctacatggtttttaatatttatgggcattagatctaaatcaaaatggtcataaattttgtatgcagaggccggattcaatacgggtgctaggggggacttacccacattagatccccatagagagaaagagagagggaatggggaagaagagtagggggctggagcaagaagaagatatgtcctccctcccattcaatcctagatccgcccccgttagtatgtatatgtacctaataatggaaataccaatacatacttcctagacaccttgtatgagaaattgcacgggcaaactttatgcctacttgattagtacatgaaaacgaatgccaatgacacaattcgtcaaattgcaagtatacacatgatttgaatttacatcaagtatacaacgcacaaacggcacgaagtttaatttgaagaggctacacacactgatacacagattgatagctgcaggaagccaacaccaagagctagaagaagctgatataaaaggggcaagagtcagccgtaccatgtccatgtctagctccatggcacgtacgtagcaccatgaaaaccatccctacgcgcaggcgcaggggctctcgagctcgtcgtcccccacgccgccgtcggcctcgtccgcgccgccgcggaacgccaggtgcccggcggcgagccccgccacgacggccaggaacaccccgccgttgaacgacatgacggccagcatcaggaggtacccgaccgcggcgctcaggccgaacagcgccgccgccgccgcggaagcagcagcccggggctccttcatccaccgcctgccgaggccgaggccgaggccgaggcggccccccgcggcggacagcagggcgcgcgcgtcggacgcggcgggcacgacgggaccggcggcggaggaggcggcgccgccgccgccgccggcgcggtgacgacgacccgccctgaggcggacgcggcgggcctcgaggtgctggtagagcgcggcggcgaggaagagcgcgaggagggaggcgaggtaccccggccaccccgacgtgcgccagccgtcgaagaggatggtgacggacgtgccccagtagaagctcatgtgcatcatcgcggcggcgcggcgaggtcgagcagcaagctctctctctttctctctccgatctgtgggtggtggctaggcttgccggcggcggcgcgacgtggtcggggtttaatacgactacgagcacacacacactgacgatcgagtccaggcccctgatcttacgcgtttattacggcccggatgccattggatcatcaatcaggcagattttctctccaccgtccatcccaaaatataagcattttttaagtatagcgacaagtcaaacatttttaattttaattattaatagaaaaagaaaataaaaataatcagtaaaattaaagttactagatttatcattaaacaaactattataatatataagtctttttatttaaaatatcttactttttatagataacgttggtcaaattagcatctcgaagaccatgtcaggatttaaaaatgcttatattttaggacagtatgagtactaattttaattagtatgtgtgtcgtacggttcttgcaatgt

SEQ ID NO: 70764 - DNA, 3455 bp, Oryza sativa
taattactcatgaaaaacacattatttcagcagggtagaattaccttgattctattgacttctgttaattttggcttcaatgcaaacacccaacaaatagttggtaggacatgatttggcatcaacgtgccttctgccagaattggtcagctatatatgcgccgagaacttgttcaccatgcacctgatgctagtataataaatagtttgctagccaaactacgaaacaaccacctgcattgcgaggtgaatatatatatatactcaggataggaggcatatacgggagtcgatccgcatggcgttagatcgttactctatgcccgttgatgcagaggcgggctttcctcctggaactatgagagccgcaagcaatgcaggccacaatttagtggggaatatgttgcagcgtgcatggatgcataccgagtaatctcctggagattggagatgaatcgcaagcactctcgtatctctaggagtgaaaagtgaaacttgaaaaggttctagaataagccacgtcactcagtcaataatagccattggatatagctggagtctataggatcgaatcacaataactaagccaactagagggggtgaatagttggtatacccaaaaaccgaaaacttttagcggaaataaaaattacactcgaattcaacggaagtcggtctggccatagtgaatgcgccggtctgaccgcctgatgaatgtcggtctgaccgatgtagatcgatcggtcgaaccgccgagatcgcctgctgccgactcctgtcgccgccggtctgaccgccgtgtgcccgctggtcggaccgccgaaacccggtgaaacacaaatcgaagaactcttaaagtagatgacaactttattgattctctctatgtttacaaagtgcaccaacagcactccttacaaagtttcgactaaactcgaaaccctaactcaaaactcaactcaattgctctcaaaagcgataccgggaagcctcacgctccacctctatttatacccgaggtaggcagcctaaagccacgaaccaaactcatactaggagtcctaaacaccttaggaaaccctctagttcaagacacaaactttacataaccaatcataccaaatttggactccttccaaatttgactgcgcatcccatacgcacaatatacctccatcgtatgccacatggaatctccatcaaccacgtgcatcaactctagcctaagtatcccgcatgatctctgaccaccacgaacgtcgtcttatccccaagccgactcccggtccatcaccgcaaatactctcccgaggcatcgagtcacctacacatgaaataaacaaagaaacgatattccgagaccaagctatctccaccttgactcattagtagcaaacaacagtattacatacgtatagtatcgacctagaagccataatcatgaaataatcacggatatccaaacaaacaacccgaaaccgaaacagacacagcgtcggtcggtcagaccgcgggctggccggtctgaccgcgcgtataccgccagtctgaccggcacacagtgcccggtctaaccggtccacataaaataacagaacctgcatattcacctgtaaatccaatcatctccaaaaccacttcgtgaataaattccaaataacaaaaccaataatctccaatgacaattgttcacagaataataatcaaaaacacctttgattttacaatctcccccttgatgaacacattggcaaacccatcaaaaatgtttttgtatttggaaaaataaaaacaaaagtggtaaaaagcacacttcgtacaaatgtacacatcgtgctaaaaaatccaaaagaaaacttctccccctttttaaaagaaagaaattccatcatgaactaaaaaatatgctcttctcaacaactccaaaaatcttcttccaaaactcatctcttctcccccttttgacagggtaccgagctcatcaagcataggacctatgttcattaatgtttaagagcttagcatacatatagcatatcatgtcatgtattgcaataaaaagaaaatgaacccatctccagtataacaagcatgcataaaagtataagcatgacccaaagattttataattaagcttgaatcaacagtcaaaattcatgatttcatacgatttataatgcaacatcttaacaagcacataggttgaagaataaacactaaacacatatacctattgcatttattactctttctacacatatacctattgcatttattactctttctcaaattagcttttgcacaaaacaaccaagagaagtttttaactttttgttttctttagcctttttgctcatatttttctcttttattctgggtacgtccctgtcgtcaacactgtttccagggattcggcacccattattttgctcacatcgaatacgtccttgtcgtcaagactgtttccaaggattcggtattcattttttttcatatttttattctctttttcacaatgagcaattaaagatctttgagcaataacaattcaataaagcatatatataaagcatttatagatcaaaccatatgctagcatcaacattgcatatttgcttaattcaagtatagaatttaagtgtcatgcatcatctcccttaaaagcaacatgtaaatctcatgaaaagactagaatacatgcaagctatgcgagacaaataaaccttcaaagtattgctagcatgcacaagaaaataccacatgtataaagaaagctctctttttctcaatttttctcattgtcatattattgcttgataaaaccatgaggtacaaactcccccttaaaccatgccaaaaggatgaattatgcccaattcaccacgaagaaaagcaaatcgattagaatccaaaggtttagtgaaaatatcagcaagttgcaactttgtgtccaaaaactgcaattcaacatctcccttctcaacatgatctctcaaaaagtgaaagcgaatatcaatgtgccttgtgcgtgagtgttgaacagtattcttagcaatgttaatagcacttgtattatcacgaaagagaggtactttctaaaaagtaagaccataatctttcaaagtaaataaaagtcaaaaaatctgtgaacaacatctagcagcagcaacatattcagattcagcagttgattgagcaacactagattgtttcctagaagaccatgcaattaatgatgtaccaagaaaatgacatgttccactagtacttttcctatcaattctacaaccaccaaaatcagcatcggaatattcacttaagtatatagaaaatgaagtagaataccaaattttaaactcaagtgtttgattcaaatacctcattattcgcttgaccgcttgacgatgtgaaacacgaggagaagcttgaaaacatgcacacaaacacacagcaaa

SEQ ID NO: 70765 - DNA, 11694 bp, Oryza sativa
cgccgaatcgccgccgtcgtcttcgccccgtggagcgccgccgcctccctccgcgggcgctccctccgtcgccgcgcctctcggtgagccgcctccctcctccttttcctcttcgccggccgcccgccgccgttccacgtcgccggctgctgccgccggtggccgcatgccgccgctgcgccttggcttggccgggccggcttcgtgccgcgcctgtgcccctggctgccgctcccctcggccgcccgatcggctcaggccgatctgggccgtccacgtggtggacgcgcacccgaggccacgtgtggaccatgtccaccgtgcgccctccccctttgactcgctgacatgtggggcccgcgtgtcggcgccggccgccccttgctgacgtcagcgaggtccatttcctttgtaaaaataaataataattgcgcaataaatcgagtttaattctagaaattcatttaaatggctcaaaacttctaaaattcatatctaattcatacgaactccaaattgggccattcaacttgcaaaattcatctaaaattgagctctacatgtttgtttactttttatgtactgtttccttggtttttattagagtttttcctcgttttgcgtgccagcgtgtagaatccgtcgtttcggaagtccgcgatcgcgaggaaaagagttcggaagatcaaagtgaagaagcaaggcaagtcacacattccccttgagcatgttgatcccaatttataaatgttttaccatttgcaaataaatatgcatgttttgctaattacatgggatccgagtattacctatctgctcgcttgtgccatgtttacttgatatctgtcctttgtcaaacgggggtaataaatcgactagctcatgttacttatgtgacctagctagaactatatgcttagccatgcttaattaccactagctcagttgatgggataattacagtattagacctttttagtatcagagtgagctgcgtgctcgagacatctggccatgcttcatggtcgtaattacccaactaaaatgcgactacatggtgggctgtgggtgcatggttttgtgagtcgcacccatggcaattaaggaccggttcacgggaaaccctggaagacttacagcgcttgccacaagcgggagtaggtaactgcttgatctgaagtatagctcgaccctttcctaggcaccggtggcgagggtgggcgtgatggagttgggtcggccggggtgtccggttgtccagctgccggattcaccgtggcgcaagaggggaccgcccactgccttttgaggggtgggggtgaaaccttagcgtggtgtggatggttaggggagggttatgtgaagggtctcgtcacaatcactcgacatggtgacgtgtgcatcatgggcacatgatgacgcggtgacatgtcggtgggttgtgtcttgtgggtacagttgtgcacctctggccagagtaaaactatttgaatagccgtgcccgcggttatgggcggtcgaccagattcaccgtgattagtcccaccttaataaatcgactcaatgcactgtagtccaggtgggttggttggttgggcctgttcaacgtggtgtagcgttgatcagtggagattcaatattactttaattactcaaccgttttactgttttcctcaataaaatgttttacaactgcctttatgcaaatagccacaaacccctccttgtatccccttgcacgtctgcatcattggtgtggcttgctgagtacggtggttgtactcagccttgctattattcccccttttcagaagtgtagtgcttctgagctgaagacgaagttagaggaccaaggctcagaccccagttgagttttgcctgtggagtggagctgaagccccgctaggatcgcctttttccgctactgctgcttttgtttcggtgtgaggactaagtgcctcttctgtaagtattttgcgctttatttacgtttggaactgtttattacttgtcgttttgtgtaccctggctggtcctggacagggatttaatacacaaaatagtctggaaatttgggctaaatttctgggcgtgacacaagtcctccgccgttaccacgagaagcgcattcgagcacgcatactttcgatcagcgactacgtcctccgacgggttcaaagccaagcagggcgaaacaagctctcacccaaatgggaaggaccttacacgatcacacaagtcttgtggccaggcgcattcaaaattgcagacggtgatggtcgcgagttggcaaattcttggaacattgaccaactacgtaaattctatgaatgagtcaatatcatccatacttataagacaccttacagcatcaagaaagcctatttttaggcgcatattacaatcaaagtgttcctgcccgatgatcccttacccagatgacacctagcgttgaaacctatcctcatgtccctttacgccgtcttgacaaggcctccgaggaacctaagggatcttcggctggggacgcccagagccgataaggccttgtcagatcctgtagagacgaaagaccaggtaagacctggtcgtgtaagagttatcgccgtgcgtattaaccaagacgcgtaatcggaaattaactttccaacttcacggctgggagctaggattagtgcttattcaaccaaggcaggtcaaaggtccaagagccttgtcctctgagaaaaatcctctgacgataaggctgggggctagggagagtgtacgactcaaacgactgactaaagtcgtgaactgagaacatactcttacacatgatatctagagtaagaaggatttgttaagatagattccttttctattttacaaaatactccttacaatttttacacaagtccaaagctatattacacttttccctaagatttctatcacagggtacaaagactaccaagaaggccaacgccagtccatagactggaagactttctccgccaacggcgccatcgacttcgccaggtggtctatctccgccggagtcctccgagaacgagcgaaaccttcatgaataaactcgaggtctaatccgggcggtgatctcgtaggcaagccaacacgtgccctccggcatatcggctcgatcgacgacattcctgcttcaaggcttcgtcaatgcgtttgccgacgccttcgagctgagtacaggccccattcagccacgaaatgtatccggccgccgactcctcaagatctccacggggtactcggagctctctacaaaccttggccatggacgtgcagcaactctttaagtacgagttgaaccacacctcacgacctcggagcgtttccacagcttgctctttctttacttccaacatagttctctcgagttccgctacttcaaatttcgtcttccaatattggatacgatgatctttgccagcaagagcactctcgagatctgttcaatatgggaacaactaagtcaagctgcacttctcttttgagaacacggctgatcaagtcggaggagcaaaaagggataaagggaccactaacctaaggaagtcgtcgccgtccccgtcctcgtggctaaactctgatctacatcgtccggcgacgcgtgtggctcaaacgcaagggtcgggatgatcgccagcgactcaggctgcccacgctgctggacattctcgtcatcaacatctctacaaggaacaaaaaaaggtactagagatcaaaatgctaaagaaaactaaggtgatggctgcacgtgcaaaggcggttagaacccattggagttttatacaagatgtctaaggagtacaagcgagtcaaaatcctactcttcaaaaagggggaggacagattcccccagatcgccaacttcttccatcacctccttacgcgtgtcgctagctgccccccgatccaagatctcgcgcagatcgagttctgggtgagccagcctcacacacgcaaggacgtggcacgccccggtgtagatcccgttggacgtctcctctccgatcctggccgcatgcttggagggaatctcctccatcgccaccgccagctccgcaagagaagacgtcagcgagaactcatcgggattcaccgggatggtagacttgataccgcattccccggcgagctggtgcagaccagtataggtgacccgcaacgagccatggatttccgacaaattgttcccgagctccaacatgcgatgcccgagtccctgccgttgtcgctcattgccggccaccaactccctcatcttcttgaggtcctcatgagcctccacctagtcgtgcgctagccggtcggcgcgctcgttcgccgacgccgccactgacctcgcctccgcaatttcacgaccaatgccgcggccaccagcctcgaggaggcgccccatttcaacctggagctcttcccaggtgaggacggcagccggcggaccacgaccagccacgggatcgctagccgggccgcttggtgtcacctcacggctcccgggcacgaccacaacactcgtcgaggctacagcgggagacgcgccggaagtccctccagactcgtcctgcgccgccttcgcccgcgccgccctacgagaaggctgtggttcagacaaagtttgacggaatcatgagaactcaaagtcattcacttacttctcgccgagcgtcacaagccgctgccatcgtggaggcgggggagacgcgtccgaggcctggagcacgatcgatatggagtgaggtggaagtattctgactacgtgatcaaatgacaggagagcttaccgagggagtagatgcctttcgacgatgtccggttacagaggagaatttcctcccctttgttggaacgtcgccaccacttgttgtggcagcgacagcggcagcatcggacgcctccttggcgaccttctctttcagtgacactgccacctgatagtccgcaagcggcccgatgatatcagtcagaggaagagcctacgctttatgaagtcaaatggcgatctcggaagaaaaacgcagaaggcccacggagaacacttacattgatggcatcgtcgcgttcggccgcccccttctcacaaaggggaacggggacattgctcgtcgtcgtcggaccactgatcatcacttggccgacacgatgtcccacggcttcactgctcagacctatgaatcgagaaccaaaattcgataagtcaggaggaacgcgcacacaagcatgtcagggtaaatgcaagaaagataccccgaggagaaacccgggttgtgtcctccggtccagaatagtcaaaggctggatggtctcgagcctggagcggctggatccatctaccaatgaagtcagcagcgacttcatatcccgacaaacctcgtactcggagatcgtcgacaacatcgatgaaggactgaagagaaggggtcaagaggggttttgcggtccaagacgaaatcttgtccggttgttcctaaggaacaacgaagacaggatccgaatcttctatctgaagatagaaccacctcgtccgccatttgctgcgagaggaagggcactggaaggggatataacgcgacttcaggccatcccgaagtcggaatccgacacatccaaacacgctatctgactccatccaacgcagctcgtagtagaagcgcaagagatcaagaaagggctctaccccaatgtgggcctcacaaagatgcgaaaaaatactaagaaaggcaatagaattggggttcagatggagcaaagaaagaccatagaagttcaaaatcaagagaagaatttcggaaggtggagggagaaaaccgcaaagaatgtagtcctcaatcgcaaccatgcgacctaggacaggctggggttcagtacatcctgcttccctctccatggtcccacgaccgggaagggcaccgtcctcctgaagcttcttcagcgacgcgctggtggaggaagattttccaagatccatcgccgactgcagatcgctggagaaagggttgagattgacgagctagggttttttgtgggaacggagaagacgaaaaacgcttacaggctggaggttttcttcacaacaggcagacttcaaaatggatccccaaaattcccttaaatagacacacttccgatggtgcgaattccaaggaaaggagggacatagccgccgaaaatttctgggtccgttatgcgcggcagttttttagacttcagtttaaattcactcatgaccgttgggcttcacagggtattctcgactatgtcctgtctctacggttcttacaccgggaacgacaacagcctcgacacctgaagtcactaatggttacacgagttcatttaagcagaagtcgggggccactgtcagggttacgggttaggtataccctttacccttcgatatacgctaaatatcggtatggcataactacgcgtatacggacactttctgcatatactaaggaaatccttcacggagtttgtagatggaaagagtcctactcggacaagactgggtcgtcaatgtatcgtgtaaggtccgatgtctccgagtcctacttagaaaccacctgacctgcgatataaaagggacccactgggaggacctaaggcatcgaatctcagaaccaacacaactcccacagcctacgaagtcggagcctgcaggagccaaatcgctggagatctagtcgaaccaactcaattacgatctcgccggatccatcgagttcaatctttccctttgtaacctgtgttttccatcatataatcccacatcaactggattagggctattacctatcaatgggcctgaaccagtataatcttcgtcttctgtttgcttgatgtcgtattacgtagatccttgtaccaacgtatcccaataccctctatatccggtctacgggtatcactcgtcgacaaccgtagtcgagttggttcgactagatcaccctagcgacttggctactgaagactccgacttcgtaagctgtggtggttgtgttggcggtgagattcgatgccttaggtcctcccggggtcccctttataccgcgggtcagttggtctcccagtagaactcgaagacatcggaccccacacgattcagttacgacccagttttgtccgagtaggactccttccatctatggactccatgatgaatttccttaacgtgtacagaaaacatccatatacgcgcaggtataccatatcatatcagtatacgacgtatatccaagggtagagggtataccttatccgtaaccctgacataatgcgtcttgtttcatatgctacatgtttgatcttttttggtgagttgtcatgtataagattggactccgataccaatgcctgtcgctctagttttttttaaaagtgcagattgacttacttttttgtctctccattttgatttttttttacttgctcaaatattttctatcctgctcaaatattttctatcaacattctatattgtttagattttcattttcgcagttatacatgttcctgatagaagtttcatagtcttgccattgtagcagacaacttttcgcagctttaggaggggattttttatgagctgtagttgcaaattttagctaaaatagaatgtttatattggcaaatttttattgtaagcactagttcatactacttcaatgtatcattcttgaggagatatgtgtattttcatgttgtggtggaaacacgtgtcaacaaattttattcccggtatgattatttatagatgtatcaagaaaagatgtacgacacatgaaaaactcactcgacgtacataatggaagcatctaaatttattgactaggctaaggcacatgctttgaggtaaaattttgggccacttagtggagcatggattttatgaagaattacaaggtttggacctatcacaaggaaattgtcactcttgaaggtgacggtaatgcagaagtgaagaggttttcaaatgtctgaggtagagaattttacaattgagttggtagtgataatttcgaggttgattttgatcaggaggatacgctacggcacgctgaatcagaggtgctagctagtcggtacagcacgaggattagacaattggaaggtgctaaagaagtcagcgaaggatctttttttacgatgaatccaagggatgtaataagaattttatggtgttgcgtttggcatttaaacttctcagattgaagggtaggcacggatggtccgatggtagtttcaatgatttgatggatcttagagtttgcttcctaagcctaatttcttgtaatccaacacatgtcaagctaagaaacacatatgtccattatcactaggtgttgaaaaaattcacgtgtgtgtaaatcactgtgtacagtgtcgtaaggaatatgtagacttggacagttgcccctaatgggacatgcaagttggtacaaaacgggtaacaggtgctttgataatgaggttatcgacctagatttatcggtgcatacaaagaaaaaggatccgactatggtgatattacatcagtaacatgggctatatgaccacttaaaatttgtgttactgaaaaccacaacactacatttttgaggctatagtagcacattgttgttttactaaagccttgacatgatgtagttgtaagagaatgtgaaaataaatatagagtaatgtgtataggcagtccttaaacttgtagaggtgtgtcatctaggtccctaaactttcaaaatgcaaattcaagtcccggaacttgtcatagtgtgtcatctaggtcccaaatcgccacaccccttctggatcctacgtggtgttgatgtggcctgccacatggaatgacgtagcatcattttgactgacaaatgggtcccatttaaaatttttcctttttcctttctattctcttttttccctttcttctcatttctatgtgtctcgagcagcagaagaaaggggcaaaagaagagtgagaagaaaccgaagaaaaagaaaaagaaaagaagaaaaaaaaggaaaagaacacatcacatccatgtggcatgccatatcagcgccacgtaggattctagaggggatgtgtcgatttaggacctagatgatatactttgacaaattctgggatctggatatgcattttgagaatttaggagctatatgacacaactctaaaagttaggaccgttaatgcactttactcataaatatatgtataggtgccacaactcagctagtgcgtgtattttgattagaagatcagtattccacacgatatatactttttaggccatgtaaaaaagcagcaactctgaccatctcgataaggatctatacatgtattgtttttcttggttataataataaaataacctgccgatttgaaactgaaaaatataatgattagcaaaaagtaagcgcatgcaaactaacataatttccagactatttgagtaatcatacatatcattgtctccggtgatgaaaactgtacacaaacaaaatcgaatccaggagccaactatctagttgttaagcttataatacaaataacaaagtaggattaatcaaaaggtgcataacagtgtttttaaccaatatacacacgactgctaggtgatgtcacgcattttagactgcattcagcagctgtggtcgggaacaaaccggccgctactgcacgtagaacggagcagttcattagcatatgattaattaagtattagtttttttaaaaaatggatcaatatgattttctaaagcaactttcatatagaattttttttttaaaaaacacacgtttactaatttgaaaagcatatgtgcagaaaatgaggggagtgagttggaaaactcaagtgccgaactcagcctgtttatgaaatgatttggtactgtctattcattcatggttctacttatttgtcacacggatagtacaagtactaccacgtacttctttctttcacattataagatcttttgggttttgagtagatttataaatggattatgcatgtgtttcatatgtgtgtctaaattcatttaaaatgtaaacataagaacaacgaaagtaataattagcaatatatagacagtaaacgacgattaggcagtgatatcatttcagcagtcagtttgaacaaaaattaaaatcatccaacgaaaaggacctatattcgggagcgtatcctatacacacagaccctcgcgtgtacacatcgtgtacaccaactaaaaattatcacaaaaaaatgtacgaaaattcatacatgtactttcaatagtattacatatacgtgcaaagtcgcatcttcaaattcattctacatagagaataacaaaaaagataaaattctgagaaaattgcaaccttaaaactgtcagattttttggtttttttgttacggctaaaatataatgaatttgaggttaagattttaaccctaggtgtaatacaattgaaagtacgtgtatgaatttttctagattttttggtaatattttttagttggtgtgcatgtgtgtacatttgaggacctgtgtacatagaatatgttgcccctatattctctctaacagcaagacaaggaaaaccaatgcagcagcggagtgtttgcagcccttctcctaccaacatctgcaagagagctgaggctcgattgtttacaggtttggctacatgagaaaatcacctattgtgttggcctgtatacctatctcgataggaatcaccttccatgcaaaactagttgcagagctggacatttcagatgcgtggtgcgtctcaaatcccacatgctttccattccgaccagctgcaaaaaccagcatgcaatggatcgatcatgaaaaaaattaaaggctcaggtaaactggccagcattccggtaaacccctgatgccttcagatttcagttccgattagtccccatcttctgtctagccaggtcaagcaattttctgatgagttgcatgctctgccgtgtagctgctaggccgaacgagctcaaataggtgtctgctacttatataaacagcagtttctctctaaaaaaaagaaagaaagaaaagaagaagaagaagaagaagaagaagaagaagaagatatgttcattaattaaccgaactctctctgagccaatgtctcacacaataccatgaaatgaaaaataggtccaacgtagcgaaaggaagtaatgttcatgagcgtctttatggtccagcaaattgtatcgctcggtactggtatcgctcggtactagtacgtatctaaccgttcattccggcatgggtaggatcggaagaaaaaaacgtgtggactgctaaagtcgtcctgctgtggcgtcgatgtcgtggttcccggcggcggcggcggcggcctcgaactcgttgttcccagcggtggcggagtccttcccgacggcagcgttgaagcaggcgcggcggcgtcaaactcgtcgttcccggcggcggcggcgtcaatgtcgtcgttcccggctgcagcggcgtcgatgtcgtcgttcccggtggcggcgatggcgtcgatgtcgtctttcccggcagcggcggcggcggctgagttcacctccaatagtcggcggagaagatccaggaggcggtggaggcatcgatccagggttcgattcctcccaatccatctattgc

SEQ ID NO: 70766 - DNA, 13268 bp, Oryza sativa
agttcacctccaatagtcgccgaaaagatccagaagccgttgaaggcatcgatccagggttcgatccctcccaatccatctattgcacgcgaagtaacgtttttatccttctaactctgttttccaaaaggtcccgcatcaagaataattttggtaactcgctgtaccaaacaatactagccgttagattgggctagatccaacaaccagcattcggtaccgtacggtaccgtttgaccataaaaaatctcaaagtttatacacagcaattagacacaaatatattgatgtgaaaagaatcagtgcacaacataaagcttgttatttctttgcttccctacccatggcatcagcaacatacatatatgaatatttatttagaaatacataaagtaaactaacattgtgacaaagtaatagtaatgacattccctactacagagagaaacaaagaagatggtattataggtgtcaggatagctaaaaccagcacctatagtgctttttctgcccacacatgcaccctcgataaaaatcggcacctatagtattactatcagtcagaagagccgacacctataatatattataggtcccagtttttacgaacctacacatacactcatattataggtattagtttatttaaaaatgaacacctactaaaaaaaccagaaggtgccgaccgaaccaaccaaccttatctgctcccagtcagcattatccccacagttctcctccacactgatgccgcactcacccccttctcctccgtcctccacatcctagacacactcccacccgccccctaccgcggcctctccccacctgcctccaccgtgcctcctccccaccgtggcggcaacagagatgactactctgctctcctagccgacggatccaggcgatggcgatgaccctctctgatccgccagatctggctggaggggaagtggcaggctccccatatagaggcaacggcggcgcccttccctctgcaatgatgtagcaattatggtttgtcccccatctaactttttctcattgtctgtagaatacctgccattgtctgtagaaaacagagaacaacataatagtattatccctattaactacaaaatatggattgtaatggaggctaacaaatagaaatatcttatcaagctcttacaagtatcttaccagcaatgctaaggacggtacaaccggtggctggctcgtgatccaactattgcaagggtcaaaactatactgataaaactatctcatactcgcagaaaactactagttcagagaacaactgctttttatgctcggtgcctttcttcatgcaaccaaccaaatcgaccatggaaaactcagtcatactccatccattgaccactgagagaaacctgtgagaaaatttcatccatgccacgacgagttcaattctttttggacattcatttttgttcagttctattctccaaaccattcgatgtcaaactggttctctatatatactagttatcgtgcacgtgcaaggcacgttttagtattatgtgtgtgtacagagagaacaatagtgacctagaaaggcagtacactccaacaaaatctcgagataaaaatagagtttcatacaccatagtaacatgtcaatttggatgattcctataaaatcctttcgggtgaatcacactaccttcgatacgcattacaaatttacaatagtgtgaactggcgtatcgaagctgctagttcatttgagacaatgattgaaaaaaaacacaaaagtgcgtacattatcaattataaggcatggtactgcgtcaacctggctcaatgaggcgccagcccattttccacgggcttttctcttttgcccctcccctctatcttctttgtcctgtaaacccaaacagctgcactcaatgctggcattgataagagttcatatccttgacaagctagaatagtagcaaaatatgtgcacaactatgtatgggtagttcatacaaaaattgcttaaaaacaaaaaaaaaaggaaagaataatgaggtagtttgaatctttcccttgatgaaaataaaaatgtgaatagaaggaaatcaacccttttcaggatgccatggagcagtttgttaccatattgtacagaaccaacaattaaactatccatttttttaagaactgacacataatgaagggagggaaaggaatataggttttgtatgtctaaaatgttgattgttccacgaaggctatatctatgctggtacaatcacgaaatatttttggatgtaagaatcctctacccaacacaaacatctatttgtatcaaaagattaggaaatggatacactgccttattacagtaataagatattttcccataagaaattggttggcagaaaaaagaaaccggagttaagaaataaagtgctcacatgggccagaaatcaccagataagagcgatatgacgctgaaacatacaactgggcagcacaaagacctactttggaatacaacctgccctgaaaatgcattccaccatgtaacatgagtactatcaataaagaataagggctccttgatattcaatagagaaagccaaatagaagtcacaaataggtataaatatacatgaactcaaatttgacataggcattcgattacccctaagaaaaaaaagtcagataaaatggagtgagctactctattaatatcaattatttgccaatttgtcaatcacttaatccgatttagtcactccaagcaatactaaacatcacagtaatcttataattttttcatgcctaactccatatcacacatgccatgagcatctgccactgacatgaaggatgcaaatatcagcagagaaaataatgatattcgcaatttacaaatcattagtgtcattaagtgtgttgagagaaaataattaatataaacagcaggtacacttaaatgtatcgccaagggaacaactttgaaaaagcttccaaaagcatataactaaacaatacaacaaacccatgtactgcacattttctacctagagaaaattactctcaatcattcatattgcgtaggtgctaatatgggtgattaggcacctatccttgtcctttgtttcaaggcacctttacatatgtttcatgctacaagctgacttgaattttgctgcacacactaaacgatatggattgaacccaatcctcgaaattacatgcaagtgcagcaaaatcatggaagagaaattagtgacaactaaccttgccaaagctcttgtttacatttttactatgggataagccccaacaacgaatggcatccatggtccttgcagtcttccaaaacacttatatttttttattagaactcagcataggcagcaatagtcaggcctcaggaccagagcagaagcattataccgtgtcatctggagcttgggcaacacattgatcatgtcaaggaacaaatcatgtccaacgaaccatctattagctacaaaacagaaacaaagtaaaagtgtgctaaaaatcgattgaagaaaaaaatagtgcatatagcatacccactttgcaaactgaaatatgcttggggaataatattgactaaccagcatttcatcgaacaccttttggacatgagaatcaatgatccttttgtccctaataatcctgaaaatagactgggaggcactcagacatgtaaaatgatcagcacataactcaatatctagcttttgttgtagatcaagatgaaacgactaaactaaaagggaaaacacagatcaaacatcattttcattgtagattcagaatttgacttcacaaaatataggaagagtaaaatgattttgtaccttcactgatgggggaggggataagatcagctggccacatcgggcttgagggccggatcacgtgggtgacatctgagtggcaggagtgcaggaggcagcgccgtggttgaggtcgaatcgtgtcgtgacagcgcggtgattggacggcgatgcgggcggagtggaggaggcagcggcgggtattaccggtggaagatggacagcgacggcggagaccgcgaggaggaccggtgcccggcgccgtgttggagtgaggaggatatacaaaggggaggggaagaatgggagatgcgatagctccggcgaaacctccggtgccgatggatggatggatgcgcggtggcggggagaggcgcgttcgttttgaggatttgtcgttgctgtgcggatgcacggtggattgaatgcggcagaggcggggtgcgcggcagagatggcgcgggtggaggggaggaatcgcgcgtggacggcggtggagaggataaggtagctaatcggtggagcgaggaggatagcgaaacaaattgatggttgagatgagatgagatgagatggcagatggacggatgagatgaaaggggttgatttcacctgtaggattgtcaggcacaactcctccttttgggaccacctatatatttgtcgacaaattttttcctaaaaatttgacagatgtaattatagtataatcgtagtgtaattacactgtaacttctatgtaactacagtgtaacttgtatgtaagtttcacgtaatttttaatcgttagatctattacaagatttgttttggtaaggaagaaaaaaaatcacagcacacatatatgtgaaaggatttgttcccacgacctctattttaccgaaataacatgttaacgagagattcttgaaagttatatacaagttacactatagttacagtgtaattacatgcaagttacagtgtaattacactatgattgtactgtaattacatctgacaaatttttggaggaaaatttgtcgacaaatatatagcaaattcgtctcctttttatattagtatatatatttttgtcagacccatgaacgaaataatttgatcagtgccaacaaccaatcctcataccatttcaattattacgatattacatactcgatcgtgagtattcaaattcagttggaagaactttaatttaaattaacacactaattaaaattaacacacatagtagttgtttttttgggagaacactctacataaaaaaaggtcaaaattactatttcgaaggaatcaagaacaaattcagatgaagcagtaatattggcaccgcagctccacagagacaggcgcctgctaaatggaaagtttgaagttttttctgaactaatagtggattccttcaaccgagttaaatggacaagcacaaagagatacgaagaagaaaaggaaggaccatgccgtgtgggtatggggtacccataatctccacagtagcccctgagaccttcacagtcgaaaagataatcttgtctcgaaccaaatttctccaaagccgagtgcttcaatcatcttcgatatggtctcccgagtacttttaacaaagataatcttgtctcgaaccaaatttctccaaagccgagtgcttcaatcatcttcgatatggtctcccgagtacttttaacaaatctgaagattgtggaaggctgaaaaataaagtcagctgcatcaactagatgcacctaataggtgtagcccccgactatatgtggttagttgaacaaactaagcatatagtcaaggaataaataatccaactaaccgaatggttttgataattatagtcaaccaagtgacttgatatcaatatatagcatatgtggtgtgaatcccccaaataacatgatctaagtgatataccgactactttgtaaaaattgatgcgaacaacctaaagttgactacatcattaaaaattcacataacaaaacagctataaaaaagcttgtatgctttaaataaagaaatttccaaagtattgggcatacaccatgcgcacactgctttaacaaatgtgcttaagtctctaaaacacacatggtttcaccacacctggaaatatatagcatatatggtgtaaaatccgagtaaataaactcataaaggatttaccaaccgcttggaaaatgaccacaatatataatcagcctaagccataatattagtcaataaaaatgcacacttacgtggcaaaaagcaataatatagtatccgatcaattgcttgataaacccaaatagcgccttgactatataaaaaagccagtgaggcagctatataaagctttactgtgaggcaccttttaaaatgcattgtaccaactccaaaaaagttgagtaactacggtataaaaggattttaaggtattgggcacataatcacgcgcacttttgcctaagcaaaaagatgcctaagtccctaaaagaacgtgacaggccacacctgaaaatatgggatgcagacgtattaggcctagacctaaagtatatctaccgatacccttaaaatatgatgtatagaacacgccaattaatatgctcccgagtgacaaatctcccaagtgatgtagatcaactgctctcatctgagtggcttctgatccgagtaattatccctcatggagaataccaaagtagatatgataattaaaatcccgactggcgcaagtactcagctgatggccctcacggggaataatgagtggtacagtcattgagcatgagaaatcaactcatgaccatgaatccatgttgaatatatccagaacaagtctaaattgaagatataatccccgcgtttgcgttgatgagcccccaagcttgtagattatccctctgtagtagtcacaattgtccattgatgatagctgatgcagtcggcatggagacgaaatgaccaacatgaagatgatatcacccatcaaagctaacgaaaatgttggtggtggtaaagacaatgacaccaatcaaaggtgatgaagtcacacagccgtggaagcgaagaaaccagtcgacagaagacaagtcagccagcaatgaagatgaaggcatccagcaacaacgacacaattatgcagccatggtggtgagataatcagtctgtgaccgacgagccagcaatcggtgacgacgagaacaagccgacaatgaagacgtagacgcacaccaacagcaatggcgaaatccgtcaaacatgaagatgaagaaaatagtcagcgacgacaaacgcaaccgacggtaatgacgattaacagcaacagagatgatcaaatatgatgttgaagttgcccaccaatagcagtagagttggctatgttaaataagcttgacaggatgttgatgatgatgacgatgtcggtgacctagtcaatagaagtgtagcagccaatgataatgacgaagacgctcatcagcatttgcgtagtaggtcaaccatgaaggcgaaataactagtcggcaatgacagaagcagccggaggtgaaaacgtagccatacattagcaatggcggagacgtcagggccgacgaagtagaggtgctggtgatgatgtcagtgacaataatccatcaaactgtcgagaagatatcaaagctcgagtagtttccttgatgcgagcgtgtgtataaagaagactgatgcaacgcttcttgatttatgaagacttaatgttgtagctgttggagatgcttcacttggaggaaagtagatgatgctgtctaactcgttgaatctgtgttaattggttgataactccacaaacgcccagacatgtagataaaatctcaaacttgatacttgaaaaatttggagaagccaaaatttctagtgaaataattggagttactcaagtagaacgccagctctaaagcgaagacaaaactgataactcctggagttgactcgttggctgattaattgattgcttcagcttgtcgaattttgagagtcttgtatttgtgtagcccccgacactttggttagttgggaaacaactgaacatagagtcgagaactgtagttttttgtcgtcaagtagtcattgcttgagtgaagatacgtgttaaagatgtccaagtagaaatattgaatattgaaataccacttgttgtagtaaaataacacggcatcatatttggtgacgcatgccaagatgtcagagctcttgccgacgttgtggttggtgaagtagcaaatcttgcaaagtggaggcaatagagtttgccaatgaagaaaacaataaagatgaagtcgctccaccatggtgacaaagtgcatagccgtgatgaagtgaacacgagtcagcggcaacagaagcaaaccaatagcgaagatgcgtagtcgtgaagataaaaacactagtcggcgatggcgtaaccagacggcgacggaagaagctgaatgatgatggaaacgaagacgtccttgaacggtggcaaaataggccagctgtgaaagtgaagacaccatgggcagcagcgaaggcaaactggcgatgacgatgttgccagtcaatgatgacgaagacgcgcagccatggaggtgaacaaaccagtcggcgtcagacaagacggccagcaatgaagacgatgacgcccatcagtagtgctagcggtatataccagctgtagaggcgaggacaccagtcaacagcagacgagacgaccggcggtgaagacgataaagccaatgaacactggcagaaccatgcagccatggaagtgaagaaaccagtcggcagcagacgtaggcacccaacaatggcggcataataggccagccatgtaggcgaagacaccagtcgacagcggtgaaggcaagccggtcggtgaagacgtagacgcgcaacaacgacagcataataggctagccgtgcaggcagtgacaccagtcggcggcggtgaaggcaagccggcggtgaatatgtagacgcctaacgacggtggtgtgaccaaccaaccgtataggcgaagacaccagtcggtggcgacgacggcaagccggtggtgatgttctgactgatccattcctggagtgtaagagataagcttaaagccatgaatcccttttatgcgtatttggatctggatcctgcagaacaaacatataggatgagtagtatctgatgtacatataatactaaaaaaaattcaagtattttaaaatgtttataaatatgtatttctcctcttgtcaatcttgatttctcctattttacgtttaaatactctgcccgactagtcatagccccaaagcaccgggagtcggcctaggcacttcccaaacatgcatatgggtggcatgagttcgtcattactggaaccaagtttcacggatcccgtttactactcaggtacttttgcaattgttaagagtagaaaataaattatcttatctctatgcttttgatttcttccgagtaatacttagcaccttgcgttactcggtccatccaacgagcccccatgtgctaggaatcggcccaaaagcaactatccattgacaaaccaaatggaaagcataggaagatagaactccataacttgataggcactttattgttactcggattatttcgcaagcaatcaagataaatattatgaaaattgttgaaaaatatgatataacatctgtagcccccgactcactagtctacagcgaacctgttgacatagtgaggcagaggagaaggaaaatatcatataaagaaaaaaaataatgaattagctttgtaatattcctcttgatgacggcagaggtgcctgatgtgggaacaaagtcgtccatcaatgataatgaaaacaccagccggcgcggtgcaagcaagccagtggtgtagatgacgaggcccatcaacggcggcggagtccgccaactgtataggcgaggacaccagtcagcggcgacgaaggcgggccggcggtgaagtcatagatgcccaacaacggtggcataataggccagccgtgtaggcggagacaccagtcggcggcggtgaaggcaagccggtcggtgaagatgtggacgcccatggacggtggtgtgaccgaccaaccgtataggcgacgacaccagtcggcaacgacggagacaggccagcggtgaagtcgtagacgcccaacaacagcggcataataggccagttgtgaaggcgagagcaccagtcggcgtgacggacgaggtagccggtcggtgaagacgtagacgcccaacaacggtgatgtgaccgtcaaaccgtataggcaaaagcaccagttggcggcgatgaggcagccagtcagtgatagagtacaggcgatgatacatgcaaagacaagaaattgcacatcaacctgtggttagatatttgtaaaaagaaaataatttatataataactaatagatccaaacacatggtttgatttgtgcttgacgaagaggcttgcatgaccataaacattaaagcatgtgctcggttgcaatggcttctccatctgttcagcagccgtccctgtataggacttgtagagccatcaactgcatggtcaaaaggactcggccgaaccgacgacagaaaaagtatacgcagataatagattaatctgggaaaaaaataaaatcaaagattaattttaataatctgcagattgaaacagctaacccgatccctaaatagtttgatcggtgtgtaattcgctgatcagcctgttggtctagtcccatataggcaccgctctgcctgtacgcgtgtacagagacaaccgagtgatctaggcaatagcagtccggaggatagaccaaaccatggttgcatgcaaaataaaagctcaatatattagtcagattaatcagtagcggcatttatagcacagcatatatatcgatgcatgcatgcaacatgcacgcgtgctaatttgcatgtccgtgcgtctggcaatactccatgcataaatctgcccgtggaggccgcagggcaagatgggacgcaggagctctcctcaggcgccgagtcatcggtgatacgtccatgtggaggcgatcaatggatctcatcagccgccagtgcatgcacgcaaacaaagcatctcacagaagatcgattcatgattagaaatcaatctgataataatatattgaaacgacaaaccggttgatgtttggagtcatcgaattcgttgagattaatctcaacgcctattttagaattgattccatcgcactcgtcgacggaaaactcgatgcatccccaacctagcacgccaactgtcgaaacatgaattcggcaataataaaaaagggtagcgcactagacctaaaattggatggatgcggagacaaaagatttagacaggttcaggccctctcaatgagaagtaataccctactcctgtttagggatttgaatccgccgagtgtattatggatctgacgatctggttgtgtgtcatatgccctctagagggcctcctgcccaccttatataggacggggggcaagattacaagatagaaaccttaaccaatacggtatcggtttcctaaatctactttacaatattatcaaaccagtactttaggccgttccgtaatatacaagaaaacgtaatacccaagttatgatctgttacatattccatagatataagctatcccctataactagtcggataaccatgccgtgtgggtatggggtacccataatctccacaattattataatggaaataattaaggaggtaactctggctcggacgtccgatgtttggggaaaaatcgggcgctgacgtcagcgtccgatttacgtgtaaaaactactttaaactgatttttctcttaaattacttatccaaatcatgattcgattgcaccattaaattcgttgcaattaaatctttaaaacaagaccacacatggatatattccgacgaaattttttttagcttattattgaattatttttaaatgttgcacgatgttccaccaggtatatcagaattgtttcactaaatagatcgaaaatgtttcactcatttaaatcgggtgttgtttcaccttatataaaaataatgttttagcaaatagagaaagaatatttcagttcactgcaacatttgatccatacatagtgaaacattataagtacactaggtgaaacatttttcggtggaacaaaaaatgaaacgaattcccttgatagggggtttctaaaatatatgggttttttttgttgcaatggaatatttcagttcactgcaacattagatctatacatagtgaaacattgtgagtacactaggtgaaacattttctgtggaataaaaaataaaccaaattcccttaatagggggtttccaaaatatgtgggtgatttgttgcaacgacgcgttccataatatcaaaatccactgcaacatttgattcgtacatattgaaaaatcgcaagtacactagctgaaacatcataaacctactggttgaaacatcaaacgagatcatatgcaacattcaaaaaaatatcaatatagaagctaaaatatttttttatcaaaatataatcatgtgtagtcttgtcgtaaagatttaattgcaatgaatacaacaatatgattggatcgtagattggataattagtttaagagaaaaattgttttaaaactagagcaacaggaggcgcgggcgccaaggcgtccgatttttttttctgacgtcggacgcgcggcacggggtattctccaataattaaccatgattacgtcaaacttgtaaaatgtatcacaaagcttatatatatatacttatgtcaaagcaaatttatttagagaatttactacgtgcatgtcattatatcaaatttactatgcatgtattgtattaagtacaagtttactgtatatttattcattcagtaaatagtcccactgcttcacggatatcgattccacgagctggcaactggtaactcttcctattgacttgcatcagtagttacttttgaaatctgaaaatacaaaattttaatggttttctaagtaaatactactatgtatcttatgtatctttatcgtaaaatgaccagaacttaggtagaaatattatttatttagaggaccctaaaataaaaaatttttgtaggggtgcttgtgtaaaactagcaggagaatttaaaaaacacaattggattttcaatgtgaagaagtcacgtgaacactctccataatcccttttttacaggaaccttttttacttctgcttgtgtgtaggctttggtggcaaggaaggagaacgtgtggatcgtggattccggttgttcacggcacatgaccggtgataaaaattagttctcctctcttaaaagggcatccaaaactgaatcgattatctttggtgatgcttctaca

SEQ ID NO: 70767 - DNA, 2399 bp, Oryza sativa
  unsure (1)..(2399): unsure at all n locations
ggatagcccaggtcgccgagagtgtccgccatggccttcatcttgcagcaatagtctgtgatgnagaggtcgccttgatgtagcatgcganactcggtctcgagggtgagagcacggcgttcgctgttgcccaggaattggagctcgagagcgcgcgacaccgaccgggcagtggcgacgtgggtcatcacctcttgaaggagatcagcggagatggagctgtagagccacccaagtacgacacaatccatctggagccagtcggcgcgatcgggaaagtagttgtcggagataacgtgatccgtcaaggcgtatttgccaagggccacgaggaagaggccgcgccatcttgtgaagttggtggcgccgacgtcaagggtgatggggacgagcgccttgacgttcagtacaccaacagcctgcgcgtgcagggcgttgcgggcctcgttgttgagaggtggtgcggcgggacgagttggcgcgatagggatgaagtcaccggggaagccgggaagatgggcgccgtgtcgtcgtagttgccgcaggcgcctagtccagtagcgagacgtgccgcggtgaagagttgttccagcgccggtggtatagatggagcgccggggggaacagagaaaggagcggtggacgccggggcggtagtggccggcgcggtggaggcagggatgcgcggggcaccatccgaggttgacatggccgacgaagacgtggtggagaggaaggacgcgagggcagtggagagcgcgtcgtgggcggccttggatgcgcgccgagcagcggcggcgacgaccgcttattcagtggtggggtcgacgtcagagccggaggagggggtgaaggagttactcacggcgtcggcgacggctttgacagcctcgtcgatcgcagcggaggttgcatcgggaatgggcaccgtcgatgtgttttcgggcgccatagggaagcagtgatagggtttaggtgtggagcggaagcgataccgtatctgataccatatgaaacgaaggaactcaacgtagattggattaatcacggagtgcgtacatatatatgcctgtccataaccactctaccgagttatagcaacagaatcgggaggataaggatctaggtttagagagataaaactcaaccatgcatatctaaaccatattgtctaacattctttgggagcatgaacacaagcgccacggaggaggtcattggttcactcaaggcttacgaagataagaaaagatagcgaagaaaaatgttcttgttcttgtacaccgtgtttctttgtgcgttgagatgtttaagagaaacaccaaaacagtgagctaagagatttggctccatcggtctctttaacatgaacaaggccgacaaatctctctttaacaaattcttgtttgtctacatatcgcataaccattgccattttttctttgcaagatacatcctccaactcatcaactagcaagcaaaatacatcatgcccaattttatcaagaatagaacatttcagctccaaaacagtgaactatattgtttgagtctctaaagacaccatcagattattaccaggagcattatgtgttgtcagttgtcaccatactagtgctagattgcgttgagctgtatagtcgtgaaattccttgaaattccctttattcatggatgatacagattcgtcgtgacctgaaaaggcaacccttgcttcaataacaatcgagcaacattgaatcttgtcagtatcacattgtcttttcagtgcaacataaatgtgctggtcttgtgacaacaaggcatcacaatctctcgtttgattggttatgagcactattgacatcccccacatgattatttgatccaaactttttgttccaactagaccatccagtagtaacaaatgcatcataccccggtgccttcttgttaggatcctaaacaagaaacaacaaaagcaatatgctttattttggactcactgcactcaagccaaatcccaaattcttcaaagagtaaattgcacacacggtgcatcaacttggcaagtgggtgtaatttgatacaagaacttaagaaatgagcgttctggtgtaacaacttgataggtaagtgcaatttagtacaagaactttataagtgatcgcataaatgcaataacttacaagatatatacgattttaatacaataagttaagaagttatgtgacaacttaattatttggagcactttttttatacatattcaattttaagtacttattttgacaatatactagcgtggatttgcatataagtatatttatatttttaccaccgaaagtcaattaaactggatgtagaaattattatattttggttgagattttgggaaggtgaagaaaacaaaaattctt

SEQ ID NO: 70768 - DNA, 752 bp, Oryza sativa
tcctctcatccagatcccaattccgaaatctaagtcaaattccaagttcaaattctcttcgaattaatctcctccgaaaaagtctattttgcctccctcgaatttttgtgggccgttttctcctcggcccatctcctctcagccgctcctcctcctccccctcgcacgtgcgttgcgcgtgtgcgctcgctctctccttcttcctcgctctctctcaccctctatctctctctctctctctcattgactcccgccgacgccgcccaaaatcccaaccgcgctgccgtttctcgcgcgcatggccgactggcaaggacgccgctcccacgcgcctcgcctgcccgcggcccaaaacggaagggagaggcttccctttccaccgtcctccctcactttttcccttctaaacccggcctctctcctctcgcccttgtcttcttgcgcgcggaagcagaggacgccgacaacgtcctgccacgcctgtgcccccaccttgaccgcgccacgccgatgctcccgcgcccgtgattcaattcccgccgcacgatccaccgcctccaccgcccctttgcatcctcgccgtcgccacgtttcgcgcagcccacgaaaacgccgctcccgctcgtgaccgcccgccgagcgccagccgagcgctcaaccgccaaggtcggtttccctcctctaaaccgacctctcctcctcacctataaaacccaagcccgagctccccctcttttcttcccgttttactt

SEQ ID NO: 70769 - DNA, 8495 bp, Oryza sativa
catatctcccgatccgtaattctgattaaccccgttccacttccagtattcccgtaaaatcgagatctatttaatggcactattatttagtctaaataggatccttttcttggtcttttgtttaggttttgattgtttgcgtatagttgcggttaccggatttttgtcgatcgtgggatttctcgaagattcgtgaagcttcgtgaagaccttgagcaaggcaagtcaccgtttgatcatttgctcctataattggaaactcattattgttttgttttcaacttgcattagtagaatcacacacttaacttgcttggcctcggtttgcgtgccaatccgatggacctacccagtagtcgcacaaattcctgtaggctgtactaccctaattctttgtcgctccactcttgtggtacctcggtatccgtgctctctgagcgcgtatacctaatacctcatatacaccgttgattgtcgaaaaattgggaaatgggtttgagaagccttgaaaacccgacatatggtgtcggtgtgtttaaaaataaaatgaattgtgaaaactcgcgatgcgggggtggtgcctgcgtggcgctgtcccgtattcgcatataaggaccgattcctgtgtgaaactcatcaagcataacaaagtgcaaccacaaggtggtatgggacaccctagctaagtaactagtcggttcagggaaacctcgcatgccaatagttgggaacgccggggcggggtcagttggagccaacccgggttcctggtaaggcaagaacgcgaagcttgccagattaccgatcaaggtggttggagtttgatttgtgaaaactaaaatggcctatatttatgtgaggatttgattcttctatgtggcatgaggtaaccctgggtcggcttgggaaaggctttgttgcgaacctccgataccgatgggtgtttggaataagttcgtatcttatgggtaaagtgtacccctctgcagaggttaacttactgttcgaacagccgtgcccacggtaatgggcggatgtaaggtggttcccgttgcgtagatttgtttgcttgtgcttggtgaaaagttgttgtggtgtgggaatcgtaaccagaatcagcctatgtggcagatggatgacctgagtggtcagaaacgaatctatgtgattcgggatgtctgcgggcatcatagactaggcttcccgagtggaagcggattgttgtgctgctgggcagctggactctgggagtccaagaaaatgaaaaaggctctgggagccgatttaatcaagtgaaatggctctgggagccgagaagtaatgatctgacccgggaggttggtacattatcaattgagttgttgaaatttgatacgcaagtctcttttcgacccgaacttaaaaagaaataaatcacttagtgatttcaaaatgatttcaaacaaaagatttaccaaaacaaccttgcctctcttccaagcttgcatcaaacacctaaattcccgtgacttgctgagtacgaaagtactcacccttgctctatataaatatatatagttcctccgccctgaagagaagataaagtgaagtgaagattagggtttcgtcctggttcccagccgtcgcctgtggtgttgggtgttagtccgttggttccgctgctgctgctgttgttggtgttttcctcgtccgcgtcgtcggttgcattctcgggctgttctgagctgcaacctaagttaaggtaaataagtcctttatttattttaaggattgcaatgattcatatttttcatcgtgggtaccagcactatgtcctgggactggtactgtaatcgcggattcgtaagaagcggttcacgccgttttttctacgacacgctcctgtcaggtgccgttgtatggcagtgccgaattggggtgtgacaataatctactgaacagtctatcaaatggacatgatctttgcaccaccaaacctactatgtggcatccacaattcgacatgccacctcccctccaagcggccgtactcgattcatttttgcttaatatcatatcacacattaaatattctctctatcaaaaaaaagtcgaactctagggatgaatttaaacatggtaatgcatccctagagttggactcatttcgagatatagggagtagtttggaagtaagttggaataatatacttaatttaaagtgcgatgtgcaggcttagtccatggcgtgcactaattgaggcccaatcatttatcctcttcagattgcatcatgtactgtgacgagttctttaacttcatccgcgttacgttgagagtcaactgtcgaggtcaacgctcgattcaccatttagcaaatcgcattcaagtcaatttgctgtttcagtcgtatatagtgtgacaaatcagatgcaacgcaacattaattaattagcaattactgataattaatcacagtaactttttcagcagcaaaaaaagtttcaaagcatagtctacactgtacaccatattatatgacaccaaccaaaccggcgagcttgctgcgaggctgcatgccacagatgaaagctccatcgcggcgacgacgacgacgaccgtgtccaagtccactcatgcctcgccatctcttctaccctacgcgattgcatcttgcatcaagaactcgatcgatctgatatatattactatgagctaagctgctaattaagttctagatttaattagcaacaatcaatggacgtgccgttcttcctcgccttcgcaatcatcgcgctcctgtccaggtacgtccccttcgcgctgccgccgatggcgcgggacctcctcgccgacaactccgccgagccggcgcgcgccgccaagtgcgcggtgtcggtggccgtcgccgggctgatgctgctggtgtcgctgcagtgcggcgccggcggcgagcagtactgccccgacgtcagggtggaggggagggcgctgtggctcaactgcgcggcgctcttcctcggcatggtcgtcggcggcgtcgcggtggtggtgatgccgccgctcgccgccgtgtcgccgcttgtccaggtgatggtcgaacacctgaccaggttcacggagaccatcgcggtgaccgcgttcgcgcatgacttctgcatctttatcaagctcgtgaggctgaaacaatgaggcgaggaaccgaaggccatttctcctttgtttttcttgaggcttttttattcacgttgtaaaaagattgatgaacttcaatgcgagaatggcattcaatgttcatttgcgtatattaattaaaatttaatttattatttttatataacttgaagaaatcgatttctataatcgaatttaataactatgttaacatgtaatacatccattttgatgattagaatccctcttcggaaccaggaaaccgtgcgcacggcgtccatgtctcgggaatgctaatgtgggagcgaacgcttgtggcgcgttcctgtcagcgaacactttcgcctttcggacaatataagtttcgctgttagctttccactttttctcagggcaaattatcggtttttctattcgatgattgaagtatatgctccatgatatgacaggtagaatatgacatgtaggttagaagggaatggcaaacaaaaagcaatatttgcacagcaatgtaaaactatgaatttaaaaacaatatgtaaatccacatattttaaaggttaaatcatgccatagttatcctagtaaaacttctaaaatatacgttgtttggcaaataaaattagtgctaaatttgccgctttgttatattatggctaaatatgtagttctatgctaactccgttataaattatgggagtgtctagattttaagcacatggaaaattttcaaaaactttaatcacaattctcacctcttagatataatccactggttgttatcaatacctacttatgcaaacaaaatctgtttctactaaaagattgacaaaattacataaaccaccccataacctattttgtcgcaaaagcccacccatcaaatattgtgaggccaaaattacccaaatgcttaagtcggactcaccacaaaccacactacctagcttggcttagttgatatggtccgccgggattcaagtaaaaaatggaccgaatcagttactcatgtgtcagggagagggcgagggtagagtggtttttccaacacaatgggttatgcgatggaatctcaaaacagggtgacaattataatgatttatgcaatttctcctaaaagattaaacaataaactattctaacctataaaaagaattacaaaactgcatgagataaacttataactaataaaaacttactaaattacatgaaaaaaaatgtttgaacttagataaaaataaaactctaccaaataccttacatgacagtttcatagtattgtagcctaaggctgctttcatttgaagcaccgtgagaaaaaatagtgcatcgtttttcgcgtgcgcagatattgaacggttaaaaggtatttttttaaaaaaatatataggaaagtggatttaaatatggtattatccatttttcacttttgaaataattaatactcaattaattatactctaatgactcatattgttttacgtattttcttaatcttctacttttcccttcctttagtgtttttagaaggagtaattctacggttcttgagaaggtaccaagatgtaccaaaaatttagtgcaaaatttaccaaatttacaattgaaaaagtggtacctcatggtacattctcaaggaccgtaaaattgctctttagaagtagctaggcttattccttttcatggttttgaacggttgattttgtgcttaaaatttcctctctcttaaaaagaagagtaaaattcacaaaactacatgttttattgtccaacttgtataacaatgtacatattttaacacttatcacttaactacatatattttagtattgaagtttcacaaaactatactatcaacgaacgaatccacctgcaagacgacgtgattgtttatctacatatatttacaatgcggacgtggcatcgtgaatgttcgacctcggatgaagcactcaagttcgcatcctaggtgaaacaaccgcacatcatctcgcgggtggatccattctctaatagtgtagttttatgaaactttaatatcaaaatatatgtagttaagtgttaagtgttaaaatatatgtaattttctacaacttgaacaactgaaaatgtagtcatgtgaaatttacttagaaaaggttctgcatgaaaaaaaaagaggttctacacgatttttgtgtggttaacgtgcgattaccgcggtaatcgtcctacggcaggggtgcagtaaccccggtcaaaacgaatgggaaaccctgcccttaagaacccggggtcttcagtacaacccagcaccggcgattgaacaggtccagaatccagaatggtgcgattgattgctcccggtgcgtgggacgcgccaacacacaaactggaaaaaaacccaaataagtggctacgagcgagcgtctccaaaacgaaccaagtactagcgactaaacgaaactttttgctcccgcgactcccgactcggctctcccgggcaccgcgggacggaaacttagccgcgttccgacgaccccagtgaaccagaacgaccggttccagctgctacacgcgagcaacaagttgaagcagagagtacggttcagagtgcccgaatgtccgattacactgtggacctggtcacctggacttcatcttggccggggccgctgaccaagatgggcgacccacccaccggtggcgcggctggagcaactggcgaggatcacaagattcagggcccgtctagttccccaaaaatttttcccaaaaatatcacatcaaatctttagatatatgcatgaagtattaaatatagataaaaagaaaaactaattgcacagttatgggggaaatcgcgagacgaaccttttaagcctaattagtctatgattagctataagtgtaacccacatgtgctaatgacggcttaattagtatcaaaagattcgtcaaacggtttccaggcgagttctgaaattagttttttcatccgtatccgaaaaccccttccgacatccggtcaaacgttcgatgtgacacccaaaaatttctttttccccaactaaacacacgcacaatggatctcctgagaaattaacacactgacagataacatggcaaaatctgcaagacaatttcccagccatgctcagttgttctaatatttccccatgtatatcaaaagtttggctgtcctgttaaaaaaggacttgttattattcccgagggagatgtaatcatagctcatcatgcattgtgtttcttgactttttattctataaataaattttcatgagtctaatggtgtgtttggttaggtaaatgggactagatgggagatggctatccattttattggggtgtttagttagagggcaggtagtagcggattaggaagatatagcgggagagtctaaacaaactagataaagttatagcctttctttccatctacatatagctaaaaaatttagtgggggttcccatagtattcgagccagtagtgggggctcgagacccgttaaccccatgctagatccaccctaagaacagtgtggatggggcggtctagaaaaggaaatatttactcaacatactggatgaagggatccggttttttgggcggatgaagccatccaccttctttaggatgttgattagtacatgattagtgagttgattagaatatgattaatgatattagcatgttttgctattaattagtaattaaaatggtaagattagttgttgacaagtgctattaattagtaactagaatgctattattatgtttaggtatgtatgttatatggagcatcataattatatgtattttttaactactttaaaagcataaccatactcttccttcttaaaaaaacgctcactctcattttaaatgaaccgcttaaagaaaatctcccaaaatccaacccatggtgcaacgcacgggtaacctccctccaattttttttatgaactaagggtgtccttcatatggtaataggagatattatattttctagtgtaaaatttggtatcttcagttattagttatctcgaagtaccaaaatttttagtctaaaatcttagtacctttagctaatttctcaagaattataaaatttttcatgaactaaatagtgttatatattaaataaacctaatattaaattttacactcattcgtaaatttgtagtactagaatagaatgcggaagtttgtttaactcactcgccggtgcgatgacacacagccacagagatggaaacctgtagcgcataacgagggcctctccaaacatttacatacgcgacgacctgacacgaaccaccgcgcaacggatcggcacccgttccacgcgtctacgcgggcaggaaaactcgccgattcccaactcccaagcgaaccaaaaccctacatatgtgatgcatataaacgagcgcctccgctgccacttcacaagcaacttaactcgacagccaacaatttgaagctttgaacagatagcagatcgtacactccgttggtgtagaagccgggttttacaacttttcattattaaaagaagtagagcagagtagtctccgttcctggccgatccaccatggcctccttcttctggcctgggccgccgggagcgcagccggtgggcgacctgcaggtggcgaagttggcgctgctcgtcgccggcaacgggttcatctcgccgtcgtcctacctccgccgctgctgcgacgacgacggcccgtgcttcgtcgacggcgctggggagaggtgcttgcacctggccaacctcgtcaccgccatgctcgggctggccctcgtgctcggccagatggcattcttctcggcggcggcgttccggccgcaggtggcctcggtcactgttgctgcgcggtggattgtcagcctcgccaagctcgccacggttgggaccctccagctttgggtctatgttttctgcttgtgcctgaaaatgttgtgcatcagatactaattagcttctcgtccttgcaactctcttctgtcgtgctgatatgatgtgattctttcattctttgcgtccaaaaaccaaaaccactatgtatttcagtgactggatcagatggatattaacatgaggtggtgtactgtgtacacctgtacaatgaatattgcatattacagtctctgtacaaacaattatttagttgctggtgggctaatcggctcataatgttaacgaaagcacttgtactgcttgtaacgactacgctatattatggaaacggaggttagagggagcaacttataagccgttggatgaaataacgacgccagtcatagctatgtcttatggtggcggtattct

SEQ ID NO: 70770 - DNA, 868 bp, Oryza sativa
cagcatggcatggcgcatgccggtgcgggaaaggcactgtagggcggtgcgacagacggtgggcgcgggcgatcggcgcggaacggcacgtacaggcagaagacggcggagaggcggggacaaatggggatggccggtagactcgtcgccggagtagacgagtggctgacgagtccgtcggcggcggactcgtcagcaccttcagcaggatgttgcggtcgagcaggatgttggccggcttgaggtctcggcgcacgagcgactccggcttggtctgatggaggaacagcagcgccgtggttatctccgccgagatcctgaaccgctggctcctcgggatcgacgggcgacggcgtgccggaatcttttttctttttatttttgtctctgcccgcttctgaattttctgatctgatttggcgccgcgttttggactttgggaatgtggttatgtgctgcatatgtagtatattggtttctctttggaatgttgggtaaagaattttgtcgagagctaacttgcacacttgtatatatgcatggccttaatttgcagtcgatggcttgcatcatcagtgattttgcagccgtccaccgaggcgcggcggtaccagcagccgccgccggcgtagctagacacgtacgtggtgcagatgcccaaggtcaaggtgttccgcgtcccgccgccggagaacgcgcacctcttccagcactacacccgccgcgcgcgccaggcgccacgcccgctgctcctgcgtccgcgtctgctcctggctcctcctcatgctcgtcttgctcatcgtcgcgctcacggccttcgcccccgtcgtctacctagtgtttaagcccaggcagttggactacacgc

SEQ ID NO: 70771 - DNA, 614 bp, Oryza sativa
ttacgatattcatgttttaccgcacatctcatcaggaacctaactttagaaaatatatatatatatatatatatatatatatgcacaccatacattacatgcggccaaaacgaagccatccatccatctatccatgatccatcctattgttagtttttgccatgaaatcatgaacgcgtgcagtaatacacacccctagaacgcacactctacccagccatattaatcctctcatatctttgacacacgctacactataaaatcagttatccatagccaacaattcatcacagattcaccaaccagaagactactcccgtcgtcatctgtgtgaggctagctagctctagctcgatcgatcgacatggcgaaagctagggtgaacctgaccgtcctcggcctgtcgtccctggtggctctcctcgtcctcatcatcgccgtcgaggatgtcgccgtcgtcgcgcaggtcatcgactactcgtccatgaatcgcgaccatattcctggaacaccgcagctcaaccaccccggcgacatcgctaacaaatacacgcgtggatgtgagaaagagcaggcgtgcagggatagcaagatgacatgatcgatcgatcgat

SEQ ID NO: 70772 - DNA, 697 bp, Oryza sativa
cccaaaatcaatctagaaagattgaacgaagaattaggtgaattgtactcttttctcttagataagttttcccagcagtttcttatcaaggtttttaacgaggcgattcgtgtgacattgcaagcgtatgctatgtactctttctctaaatttttcccactggatttttctgaagttttgatgaggcatagacatcacgcggtgagtgccaagggggagtgttaggaaacctatggggttgggtccatgaaggcccaacccatatacactaattgggcccacacctaaacattccatatatgcaatatggctatataaagaggaggctgctcactttgtacacttgtgcttaatcaatgaaaagagtgcctcaccctatatcttgtgtctccacttttgtagaactatgcaatcccttttggactacctcagtagcaggaggggttgcataatactttcttttttaaaaggaaaaagtacgaattaccccccgaactatcgcggtcgaccgaattaccccctttgacccgaaaaccagagattactcaccctgaactttcaatactggacgaattacccccctcttctaatctagagcggttttgtcctatgtggcatacgcatggcaatcctgtcagcatttcttttaaaaaaaattggtgggacacacctatatttctctctctaccatccaaga
